(12) United States Patent
Johnson et al.

(10) Patent No.: US 11,718,660 B2
(45) Date of Patent: Aug. 8, 2023

(54) RECOMBINANT POLYCLONAL PROTEINS TARGETING ZIKA AND METHODS OF USE THEREOF

(71) Applicant: GigaGen, Inc., South San Francisco, CA (US)

(72) Inventors: David Scott Johnson, San Francisco, CA (US); Sheila Keating, South San Francisco, CA (US); Adam Shultz Adler, Belmont, CA (US); Michael Asensio, South San Francisco, CA (US); Kacy Stadtmiller, San Francisco, CA (US); Emily Benzie, San Francisco, CA (US); Ariel Niedecken, Sunnyvale, CA (US); Angelica V. Medina-Cucurella, Mountain View, CA (US); Rena Aviva Mizrahi, Pacifica, CA (US); Yoong Wearn Lim, South San Francisco, CA (US)

(73) Assignee: GigaGen, Inc., San Carlos, CA (US)

( * ) Notice: Subject to any disclaimer, the term of this patent is extended or adjusted under 35 U.S.C. 154(b) by 0 days.

(21) Appl. No.: 17/469,493

(22) Filed: Sep. 8, 2021

(65) Prior Publication Data

US 2022/0064268 A1  Mar. 3, 2022

Related U.S. Application Data

(63) Continuation of application No. PCT/US2021/044523, filed on Aug. 4, 2021.

(60) Provisional application No. 63/061,730, filed on Aug. 5, 2020.

(51) Int. Cl.
  *C07K 14/00* (2006.01)
  *C07K 16/10* (2006.01)
  *A61P 31/14* (2006.01)

(52) U.S. Cl.
  CPC .......... *C07K 16/1081* (2013.01); *A61P 31/14* (2018.01); *C07K 2317/52* (2013.01); *C07K 2317/565* (2013.01); *C07K 2317/622* (2013.01)

(58) Field of Classification Search
  None
  See application file for complete search history.

(56) References Cited

U.S. PATENT DOCUMENTS

| | | |
|---|---|---|
| 2004/0009168 A1 | 1/2004 | Kaisheva et al. |
| 2010/0310558 A1 | 12/2010 | Oleksiewicz et al. |
| 2018/0258422 A1 | 9/2018 | Johnson et al. |

FOREIGN PATENT DOCUMENTS

| | | |
|---|---|---|
| WO | WO 2004/061104 A2 | 7/2004 |
| WO | WO 2009/030237 A2 | 3/2009 |
| WO | WO 2016/200577 A1 | 12/2016 |
| WO | WO 2018/170013 A1 | 9/2018 |
| WO | WO 2020/223573 A2 | 11/2020 |
| WO | WO 2021/253002 A1 | 12/2021 |
| WO | WO 2022/031834 A1 | 2/2022 |

OTHER PUBLICATIONS

Wang et al. (Science Translational Medicine, Dec. 14, 2016, vol. 8, issue 369) (Year: 2016).*
Adler, A.S. et al. "Rare, high-affinity anti-pathogen antibodies from human repertoires, discovered using microfluidics and molecular genomics," mAbs, Sep. 22, 2017, vol. 9, Iss. 8, pp. 1282-1296, XP55784902.
Bendig, M.M., "Humanization of Rodent Monoclonal Antibodies by CDR Grafting," Methods: A Companion to Methods in Enzymology, 1995; 8:83-93.
Bloch et al., "Deployment of convalescent plasma for the prevention and treatment of COVID-19," The Journal of Clinical Investigation, vol. 130, No. 6, Jun. 1, 2020 (Jun. 1, 2020), pp. 2757-2765, XP055815868, GB Issn: 0021-9738, DOI: 10.1172/JCI138745.
Branche, E. et al., "Human Polyclonal Antibodies Prevent Lethal Zika Virus Infection in Mice", Scientific Reports, vol. 9, Article No. 9857, Jul. 8, 2019 (Jul. 8, 2019), pp. 1-12, XP055664845.
Colman. P.M., "Effects of amino acid sequence changes on antibody-antigen interactions," Research in Immunology, 1994, 145:33-36.
Cross, "Searching for a coronavirus cure in the blood," Chemical & Engineering New, Apr. 7, 2020 (Apr. 7, 2020), XP055850922, 7 pages, Retrieved from the Internet: URL:https://cen.acs.org/pharmaceuticals/biologics/Searching-coronavirus-cure-blood/98/i14 [retrieved on Oct. 31, 2021].
Ferrara, F. et al., "Recombinant renewable polyclonal antibodies," mAbs, Jan. 14, 2015, vol. 7, Iss. 1, pp. 32-41, XP55784903.
Frandsen, T.P. et al., "Consistent manufacturing and quality control of a highly complex recombinant polyclonal antibody product for human therapeutic use", Biotechnology and Bioengineering, vol. 108, Issue 9, Sep. 2011, pp. 2171-2181, XP071108999.
GIGAGEN Press Release, "COVID-19 Antibody Therapy: GigaGen Initiates Development of rCIG," Outbreak News Today, Mar. 30, 2020 (Mar. 30, 2020), 4 pages, XP055850665, Retrieved from the Internet: URL:http://outbreaknewstoday.com/covid-19-antibody-therapy-gigagen-initiates-development-of-rcig-21518/ [retrieved on Oct. 12, 2021].
Goldstein et al., "Massively parallel single-cell B-cell receptor sequencing enables rapid discovery of diverse antigen-reactive antibodies," Communications Biology, vol. 2, Article No. 304, Aug. 9, 2019 (Aug. 9, 2019), pp. 1-10, XP055758874, DOI: 10.1038/s42003-019-0551-y.
Hammarström et al., "Development of passive immunity against SARS-CoV-2 for management of immunodeficient patients—a perspective," Journal of Allergy and Clinical Immunology, Elsevier, Amsterdam, NL, vol. 146, No. 1, May 12, 2020 (May 12, 2020), pp. 58-60, P086207336, ISSN: 0091-6749, DOI: 10.1016/J.JACI.2020.04.043 [retrieved on May 12, 2020].

(Continued)

*Primary Examiner* — Meera Natarajan
(74) *Attorney, Agent, or Firm* — Fenwick & West LLP

(57) ABSTRACT

Provided herein are compositions comprising recombinant polyclonal protein (RPP) derived from mammalian plasma cells and plasmablasts. Specifically, RPPs specific to Zika virus are provided. Also provided are the methods of using the RPP for treatment of viral infection and the methods of making the RPPs.

6 Claims, 117 Drawing Sheets

Specification includes a Sequence Listing.

(56) References Cited

OTHER PUBLICATIONS

International Preliminary Report on Patentability, Patent Cooperation Treaty Application No. PCT/US2020/030878, dated Nov. 2, 2021, 8 pages.
International Search Report and Written Opinion, Patent Cooperation Treaty Application No. PCT/US2020/030878, dated Dec. 21, 2020, 13 pages.
International Search Report and Written Opinion, Patent Cooperation Treaty Application No. PCT/US2021/037232, dated Nov. 8, 2021, 16 pages.
International Search Report and Written Opinion, Patent Cooperation Treaty Application No. PCT/US2021/044523, dated Nov. 18, 2021, 19 pages.
Keating, S.M. et al., "Capturing and Recreating Diverse Antibody Repertoires as Multivalent Recombinant Polyclonal Antibody Drugs," bioRxiv, preprint, Aug. 6, 2020, 78 pages.
Keating, S.M. et al., "Generation of recombinant hyperimmune globulins from diverse B-cell repertoires," nature biotechnology, vol. 39, No. 8, Aug. 2021, pp. 989-999, XP037534475.
Khantasup, K. et al., "Design and Generation of Humanized Single-chain Fv Derived from Mouse Hybridoma for Potential Targeting Application," *Monoclonal Antibodies in Immunodiagnosis and Immunotherapy*, 2015, 34(6): 404-417.
Lou, Y. et al., "Cross-neutralization antibodies against SARS-CoV-2 and RBD mutations from convalescent patient antibody libraries," bioRxiv, posted on Jun. 6, 2020, 32 pages.
Murphy, C et al., "Enhancing recombinant antibody performance by optimally engineering its format," *Journal of Immunological Methods*, vol. 463, Dec. 2018, pp. 127-133.
Non-final Office Action, U.S. Appl. No. 17/386,504, filed Mar. 2, 2022, 27 pages.
Paul, W.E. (ed), Fundamental Immunology, 3rd Edition, Chapter 9, Structure and Function of Immunoglobulins, 1993, pp. 292-295.
Ravichandran, S. et al., Antibody repertoire induced by SARS-CoV-2 spike protein immunogens, bioRxiv, posted on May 13, 2020, 34 pages.
Reason, D.C et al. "Human Fab Fragments Specific for the Haemophilus influenzae b Polysaccharide Isolated from a Bacteriophage Combinatorial Library Use Variable Region Gene Combinations and Express an Idiotype That Mirrors In Vivo Expression," *Infection and Immunity*, Jan. 1997, vol. 65, No. 1, pp. 261-266.
Rudikoff, S. et al., "Single amino acid substitution altering antigen-binding specificity," Proc. Natl. Acad. Sci. USA, 1982, 79(6):1979-1983.
Shen et al., "Treatment of 5 Critically Ill Patients With COVID-19 With Convalescent Plasma," JAMA the Journal of the American Medical Association, vol. 323, No. 16, Mar. 27, 2020 (Mar. 27, 2020), pp. 1582-1589, XP055725009, US ISSN: 0098-7484, DOI: 10.1001/jama.2020.4783.
Sheridan, "Convalescent serum lines up as first-choice treatment for coronavirus," Nature Biotechnology, Gale Group Inc, New York, vol. 38, No. 6, May 1, 2020 (May 1, 2020), pp. 655-658, XP037167671, ISSN: 1087-0156, DOI: 10.1038/D41587-020-00011-1 [retrieved on May 1, 2020].
Tanno et al. "A facile technology for the high-throughput sequencing of the paired VH:VL and TCR:TCRα repertoires," *Science Advances*, Apr. 22, 2020, vol. 6, Issue 17, 8 pages, XP55851688, Retrieved from the Internet: URL:https://www.science.org/doi/pdf/10.1126/sciadv.aay9093 [retrieved on Oct. 15, 2021].
Tiberghien et al., "Collecting and evaluating convalescent plasma for COVID-19 treatment why and how?", Vox Sanguinis, vol. 115, No. 6, May 3, 2020 (May 3, 2020), pp. 488-494, XP055815870, CH ISSN: 0042-9007, DOI: 10.1111/vox.12926.
World Health Organization, "Landscape analysis of therapeutics as Feb. 17, 2020," Feb. 25, 2020 (Feb. 25, 2020), XP055809736, Retrieved from the Internet: URL:https://web.archive.org/web/20200225223659/https://www.who.int/blueprint/priority-diseases/key-action/Table_of_therapeutics_Appendix_17022020.pdf?ua=1, pp. 26,28.
Yuan, A.Q. et al., Isolation of and Characterization of Neutralizing Antibodies to COVID-19 from a Large Human Naïve scFv Phage Display Library, bioRxiv, posted on May 19, 2020, 15 pages.
Chi, X., et al., "A neutralizing human antibody binds to the N-terminal domain of the Spike protein of SARS-CoV-2," *Science*, Jun. 22, 2020, vol. 369, Issue 6504, pp. 650-655.
Partial Supplementary European Search Report, European Patent Application No. 20799387.7, dated Jan. 4, 2023, 33 pages.
United States Office Action, U.S. Appl. No. 17/386,504, filed Dec. 7, 2022, 22 pages.
Wang, B., et al., "Functional Interrogation and Mining of Natively-Paired Human VH:VL Antibody Repertoires," *Nature Biotechnology*, author manuscript, Feb. 2018; 36(2): 152-155, 14 pages.

\* cited by examiner

| GigaGen donor ID | Race | Sex | Age | Symptoms | Date of symptoms onset | Days between symptoms onset and blood draw | Presumed/ Confirmed | Spike antigen EC50 (mg/ml) | Spike antigen peak OD signal | RBD antigen EC50 (mg/ml) | RBD antigen peak OD signal | Library ID | PBMC CoV-2 RNA qPCR |
|---|---|---|---|---|---|---|---|---|---|---|---|---|---|
| CSS-1902 | AA | Male | 67 | Fever, SOB | 2/28/20 | 32 | Confirmed | 0.0056 | 3.15 | 0.039 | 2.46 | Library 1 | Negative |
| CSS-1905 | White | Male | 71 | Fever, Cough, SOB | 3/16/20 | 15 | Presumed | 0.019 | 3.22 | 0.12 | 2.34 | Library 1 | Negative |
| CSS-1907 | AA | Female | 66 | Fever, Cough | 3/14/20 | 17 | Presumed | 0.063 | 2.98 | 0.091 | 1.41 | Library 2 | Negative |
| CSS-1911 | White | Female | 61 | Fever, ST, SOB | 3/9/20 | 22 | Presumed | 0.10 | 2.80 | 0.13 | 0.75 | Library 2 | Negative |
| CSS-1921 | White | Female | 30 | Fever, ST, Cough, SOB | 3/17/20 | 15 | Confirmed | 0.021 | 2.95 | 0.11 | 1.81 | Library 3 | Negative |
| CSS-1920 | White | Female | 57 | Fever, Cough, SOB | 3/16/20 | 16 | Confirmed | 0.022 | 2.81 | 0.066 | 1.52 | Library 3 | Negative |
| CSS-1928 | White | Female | 63 | Fever, Cough | 3/14/20 | 19 | Presumed | 0.025 | 2.95 | 0.076 | 1.96 | Library 4 | Negative |
| CSS-1924 | White | Female | 31 | Fever, ST, Cough, Pneumonia | 3/21/20 | 12 | Confirmed | 0.16 | 2.63 | 0.23 | 2.30 | Library 4 | Negative |
| CSS-1944 | White | Female | 49 | ST, Cough, SOB | 3/15/20 | 24 | Confirmed | 0.014 | 3.21 | 0.053 | 2.17 | Library 5 | Negative |
| CSS-1943 | White | Female | 52 | Fever, ST, Cough, SOB | 3/16/20 | 23 | Confirmed | 0.014 | 3.15 | 0.067 | 1.85 | Library 5 | Negative |
| CSS-1937 | White | Female | 35 | Fever, ST, Cough, SOB | 3/17/20 | 21 | Confirmed | 0.009 | 3.17 | 0.027 | 1.71 | Library 6 | Negative |
| CSS-1936 | White | Female | 23 | Fever, Cough, SOB | 3/7/20 | 31 | Confirmed | 0.011 | 3.16 | 0.088 | 2.01 | Library 6 | Negative |
| CSS-1901 | White | Male | 67 | Fever, Cough | 3/15/20 | 16 | Confirmed | 0.010 | 3.09 | 0.085 | 2.37 | Library 7 | Negative |
| CSS-1940 | White | Female | 40 | Fever, Cough | 3/18/20 | 21 | Confirmed | 0.012 | 3.07 | 0.057 | 1.99 | Library 7 | Negative |

FIG. 3A

| GigaGen donor ID | Race | Sex | Age | Symptoms | Date of symptoms onset | Days between symptoms onset and blood draw | Presumed/ Confirmed | Spike antigen EC50 (mg/ml) | Spike antigen peak OD signal | RBD antigen EC50 (mg/ml) | RBD antigen peak OD signal | Library ID | PBMC CoV-2 RNA qPCR |
|---|---|---|---|---|---|---|---|---|---|---|---|---|---|
| CSS-1939 | White | Female | 24 | Fever, ST, Cough, SOB | 3/8/20 | 30 | Confirmed | 0.037 | 3.10 | 0.073 | 1.37 | Library 8 | Negative |
| CSS-1949 | White | Male | 47 | Fever, Cough | 3/21/20 | 19 | Confirmed | 0.13 | 2.79 | 0.32 | 2.32 | Library 8 | Negative |
| CSS-1945 | White | Female | 31 | Fever, ST, Cough, SOB | 3/20/20 | 19 | Confirmed | 0.051 | 3.09 | 0.15 | 1.03 | | |
| CSS-1931 | White | Female | 35 | Fever, ST, Cough, SOB | 3/24/20 | 13 | Confirmed | 0.11 | 2.45 | 0.27 | 1.22 | | |
| CSS-1933 | White | Female | 43 | Fever, Cough | 2/25/20 | 42 | Confirmed | 0.13 | 3.23 | 0.27 | 1.16 | | |
| CSS-1932 | White | Female | 33 | Fever, SOB | 3/18/20 | 20 | Confirmed | 0.13 | 3.09 | 0.11 | 1.05 | | |
| CSS-1935 | White | Female | 45 | ST, Cough, SOB | 3/22/20 | 16 | Confirmed | 0.16 | 3.07 | 0.14 | 1.22 | | |
| CSS-1948 | White | Female | 45 | Fever, Cough, SOB | 3/25/20 | 15 | Confirmed | 0.17 | 2.64 | 0.091 | 0.97 | | |
| CSS-1938 | White | Female | 37 | Fever, ST, Cough, SOB | 3/22/20 | 16 | Confirmed | 0.20 | 3.20 | 0.25 | 0.82 | | |
| CSS-1929 | AA | Male | 49 | Fever, Cough, SOB | 2/28/20 | 34 | Presumed | 0.23 | 0.92 | 0.041 | 1.31 | | |
| CSS-1922 | White | Male | 54 | Fever, Cough, SOB | 2/28/20 | 34 | Presumed | 0.24 | 0.34 | 0.14 | 0.45 | | |
| CSS-1914 | White | Female | 65 | Fever, Cough, SOB | 2/26/20 | 35 | Presumed | 0.37 | 1.54 | 0.39 | 2.76 | | |
| CSS-1925 | White | Male | 63 | Fever, Cough, SOB, ST | 3/10/20 | 23 | Presumed | 0.65 | 0.68 | 0.17 | 0.75 | | |
| CSS-1946 | White | Female | 50 | ST, Cough | 3/19/20 | 21 | Confirmed | 0.67 | 2.50 | 0.69 | 1.66 | | |
| CSS-1930 | White | Female | 47 | Fever, Cough | 3/10/20 | 23 | Presumed | 0.69 | 0.45 | 1.29 | 0.94 | | |

FIG. 3B

| GigaGen donor ID | Race | Sex | Age | Symptoms | Date of symptoms onset | Days between symptoms onset and blood draw | Presumed/ Confirmed | Spike antigen EC50 (mg/ml) | Spike antigen peak OD signal | RBD antigen EC50 (mg/ml) | RBD antigen peak OD signal | Library ID | PBMC CoV-2 RNA qPCR |
|---|---|---|---|---|---|---|---|---|---|---|---|---|---|
| CSS-1934 | White | Female | 42 | Fever, ST, Cough | 3/21/20 | 17 | Confirmed | 0.75 | 3.17 | 0.74 | 1.11 | | |
| CSS-1926 | White | Female | 59 | Fever, Cough, SOB, ST | 3/8/20 | 25 | Presumed | 0.77 | 0.55 | 0.70 | 0.80 | | |
| CSS-1915 | White | Male | 59 | Fever, ST, SOB | 3/11/20 | 21 | Presumed | 0.83 | 0.81 | 0.61 | 0.85 | | |
| CSS-1941 | White | Female | 69 | ST, Cough | 3/11/20 | 28 | Confirmed | 0.91 | 2.93 | 0.55 | 0.94 | | |
| CSS-1917 | White | Male | 67 | Fever, Cough | 3/10/20 | 22 | Presumed | 0.91 | 0.64 | 0.69 | 0.77 | | |
| CSS-1904 | White | Female | 20 | Fever, ST, Cough | 3/11/20 | 20 | Confirmed | 0.96 | 0.64 | 0.63 | 0.86 | | |
| CSS-1916 | White | Male | 70 | Fever, SOB | 2/27/20 | 34 | Presumed | 1.00 | 0.69 | 0.15 | 1.00 | | |
| CSS-1947 | AA | Female | 52 | Fever, Cough | 3/21/20 | 19 | Confirmed | 1.25 | 2.68 | 0.81 | 0.99 | | |
| CSS-1918 | White | Female | 59 | Fever, Cough, SOB | 3/2/20 | 30 | Presumed | 1.32 | 1.55 | 0.38 | 0.91 | | |
| CSS-1923 | White | Female | 57 | Fever, Cough | 2/25/20 | 37 | Presumed | 1.33 | 0.62 | 0.92 | 1.35 | | |
| CSS-1919 | White | Female | 53 | Fever, ST, SOB | 3/13/20 | 19 | Confirmed | 1.34 | 0.80 | 0.30 | 0.76 | | |
| CSS-1913 | White | Female | 57 | Fever, Cough | 3/5/20 | 26 | Presumed | 1.47 | 1.69 | 0.23 | 0.88 | | |
| CSS-1927 | AA | Female | 55 | Cough, ST | 3/2/20 | 31 | Presumed | 1.60 | 0.92 | 0.72 | 1.18 | | |
| CSS-1909 | White | Female | 70 | Fever, Cough, SOB | 2/25/20 | 35 | Presumed | 1.88 | 0.92 | 0.13 | 0.75 | | |
| CSS-1912 | White | Female | 46 | Fever, Cough, SOB | 3/8/20 | 23 | Confirmed | 2.20 | 0.76 | 0.10 | 0.67 | | |
| CSS-1906 | White | Male | 58 | Fever, ST, SOB, Cough | 2/25/20 | 35 | Presumed | 2.59 | 1.28 | 1.46 | 1.31 | | |
| CSS-1908 | White | Female | 57 | Fever, Cough, SOB | 2/24/20 | 36 | Presumed | 2.60 | 0.82 | 0.46 | 0.72 | | |

FIG. 3C

| GigaGen donor ID | Race | Sex | Age | Symptoms | Date of symptoms onset | Days between symptoms onset and blood draw | Presumed/Confirmed | Spike antigen EC50 (mg/ml) | Spike antigen peak OD signal | RBD antigen EC50 (mg/ml) | RBD antigen peak OD signal | Library ID | PBMC CoV-2 RNA qPCR |
|---|---|---|---|---|---|---|---|---|---|---|---|---|---|
| CSS-1910 | White | Female | 25 | Fever, ST, Cough, SOB | 3/4/20 | 27 | Presumed | 2.84 | 1.27 | 1.12 | 1.23 | | |
| CSS-1942 | White | Female | 39 | Fever, Cough | 3/24/20 | 15 | Confirmed | 2.89 | 2.03 | 1.88 | 2.31 | | |
| CSS-1903 | White | Female | 52 | Fever, Cough, SOB, Fatigue | 3/1/20 | 30 | Presumed | 3.47 | 0.84 | 1.25 | 0.99 | | |
| CSS-1900 | White | Female | 69 | Fever, Cough | 3/6/20 | 25 | Presumed | 9.94 | 0.73 | 3.11 | 1.00 | | |
| GAMUNEX C IVIG | n/a | n/a | n/a | n/a | n/a | n/a | n/a | 1.41 | 1.99 | 1.27 | 2.26 | | |

FIG. 3D

| Assay | Category | Requirement |
| --- | --- | --- |
| Anti-HLA | Safety | Comparable to or better than plasma-derived IVIG |
| Agglutination | Safety | Comparable to or better than plasma-derived IVIG |
| Human tissue microarrays | Safety | No detectable binding at physiologically relevant concentration |
| Anti-complement | Safety | Comparable to or better than plasma-derived IVIG |
| Spike:ACE2-inhibition ELISA | Potency | >5,000-fold better than plasma-derived IVIG |
| Live virus neutralization | Potency | >5,000-fold better than plasma-derived IVIG |
| Pseudotype virus neutralization | Potency | >5,000-fold better than plasma-derived IVIG |
| Antibody RNA-seq | Diversity | >1,000 antibodies |

FIG. 5

| Sample / Library | S1 binding $EC_{50}$ (mg/ml) | S1 binding fold over serum | RBD binding $EC_{50}$ (mg/ml) | RBD binding fold over serum | Plate-based neutralization $IC_{50}$ (mg/ml) | Plate-based neutralization over serum | Pseudotype neutralization $IC_{50}$ (mg/ml) | Pseudotype neutralization over serum | Anti-RBC (agglutination) | Anti-HLA | % RBD-specific scFv (1st yeast sort) | # antibodies (2nd yeast sort) |
|---|---|---|---|---|---|---|---|---|---|---|---|---|
| GAMUNEX-C IVIG | 1.41 | --- | 1.27 | --- | 114 | --- | No neutralization | --- | --- | --- | --- | --- |
| SARS-CoV-2 mAb | 0.00012 | --- | 0.0001 | --- | 0.75 | --- | Not tested | --- | --- | --- | --- | --- |
| Library 1 | 0.00017 | 147.1 | 0.00013 | 192.3 | 0.0026 | 269.2 | 0.00044 | 36.4 | Negative | Negative | 1.02% | 149 |
| Library 1 serum pool | 0.025 | 1.0 | 0.025 | 1.0 | 0.7 | 1.0 | 0.016 | 1.0 | --- | --- | --- | --- |
| Library 2 | 0.00037 | 297.3 | 0.00018 | 722.2 | 0.0053 | 241.5 | 0.0044 | 206.8 | Negative | Negative | 0.57% | 167 |
| Library 2 serum pool | 0.11 | 1.0 | 0.13 | 1.0 | 1.28 | 1.0 | 0.91 | 1.0 | --- | --- | --- | --- |
| Library 3 | 0.00016 | 337.5 | 0.000047 | 723.4 | 0.0021 | 128.6 | 0.0018 | 31.1 | Negative | In progress | 1.60% | 123 |
| Library 3 serum pool | 0.054 | 1.0 | 0.034 | 1.0 | 0.27 | 1.0 | 0.056 | 1.0 | --- | --- | --- | --- |
| Library 4 | 0.00014 | 392.9 | 0.00015 | 366.7 | 0.0016 | 1500.0 | 0.0011 | 32.7 | Negative | negative | 0.42% | 209 |
| Library 4 serum pool | 0.055 | 1.0 | 0.055 | 1.0 | 2.4 | 1.0 | 0.036 | 1.0 | --- | --- | --- | --- |
| Library 5 | 0.00019 | 263.2 | 0.000061 | 344.3 | 0.0017 | 164.7 | 0.00082 | 60.0 | Negative | In progress | 2.29% | 140 |
| Library 5 serum pool | 0.05 | 1.0 | 0.021 | 1.0 | 0.28 | 1.0 | 0.049 | 1.0 | --- | --- | --- | --- |
| Library 6 | 0.00013 | 307.7 | 0.000054 | 314.8 | 0.0018 | 194.4 | 0.00034 | 115.3 | Negative | In progress | 0.95% | 108 |
| Library 6 serum pool | 0.04 | 1.0 | 0.017 | 1.0 | 0.35 | 1.0 | 0.039 | 1.0 | --- | --- | --- | --- |
| Library 7 | 0.00011 | 290.9 | 0.000044 | 218.2 | 0.0023 | 139.1 | 0.00032 | 74.4 | Negative | In progress | 1.37% | 83 |
| Library 7 serum pool | 0.032 | 1.0 | 0.0096 | 1.0 | 0.32 | 1.0 | 0.024 | 1.0 | --- | --- | --- | --- |
| Library 8 | 0.000038 | 1394.7 | 0.000027 | 592.6 | 0.00014 | 2500.0 | 0.00017 | 361.4 | Negative | In progress | 0.88% | 122 |
| Library 8 serum pool | 0.053 | 1.0 | 0.016 | 1.0 | 0.35 | 1.0 | 0.061 | 1.0 | --- | --- | --- | --- |

FIG. 6

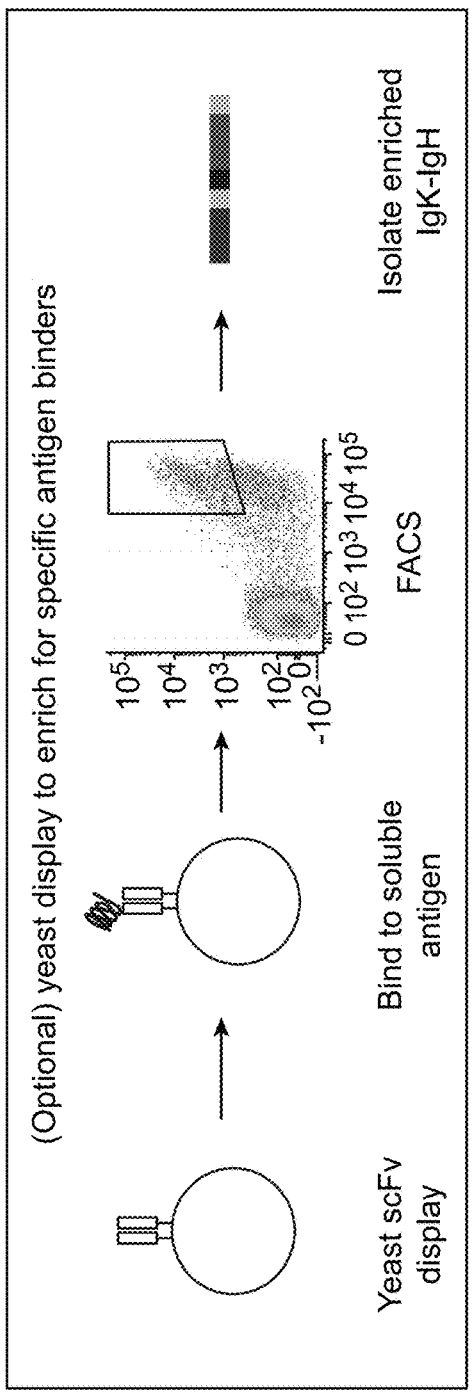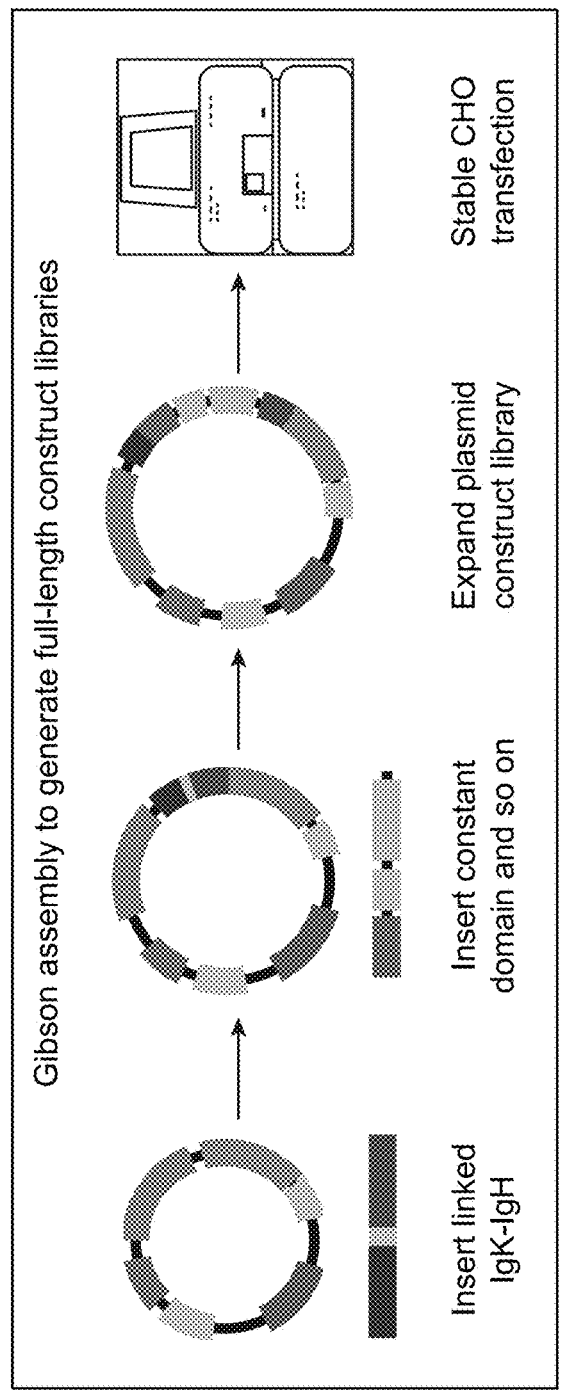

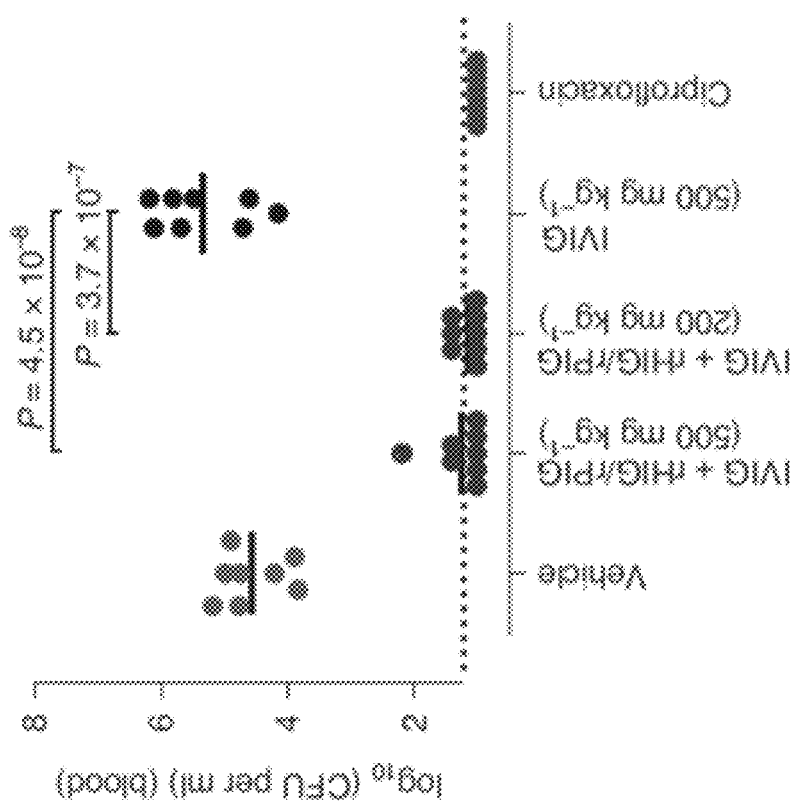
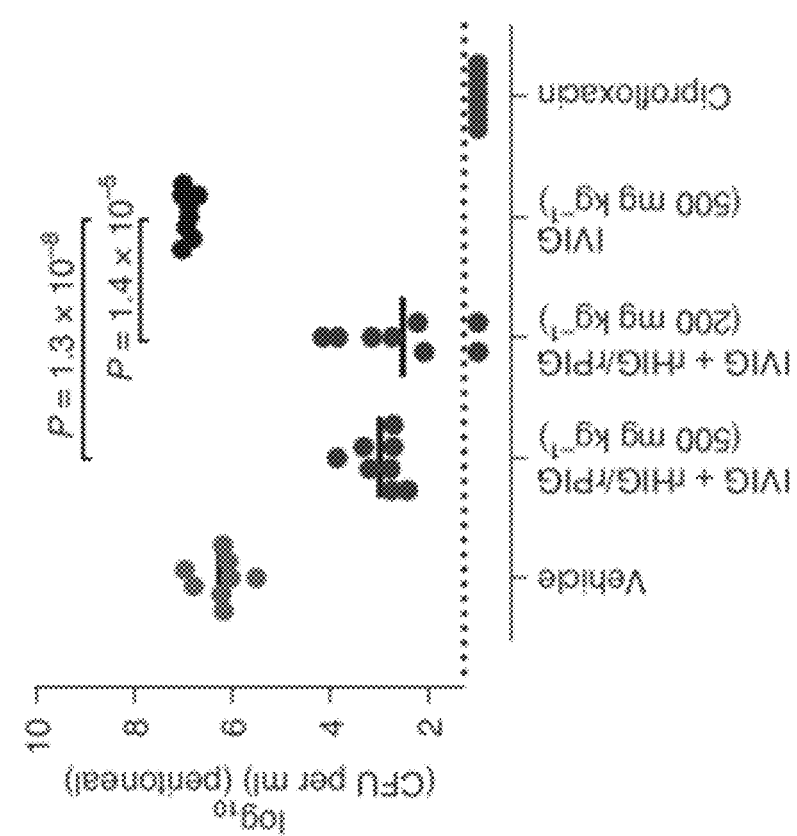
FIG. 10E

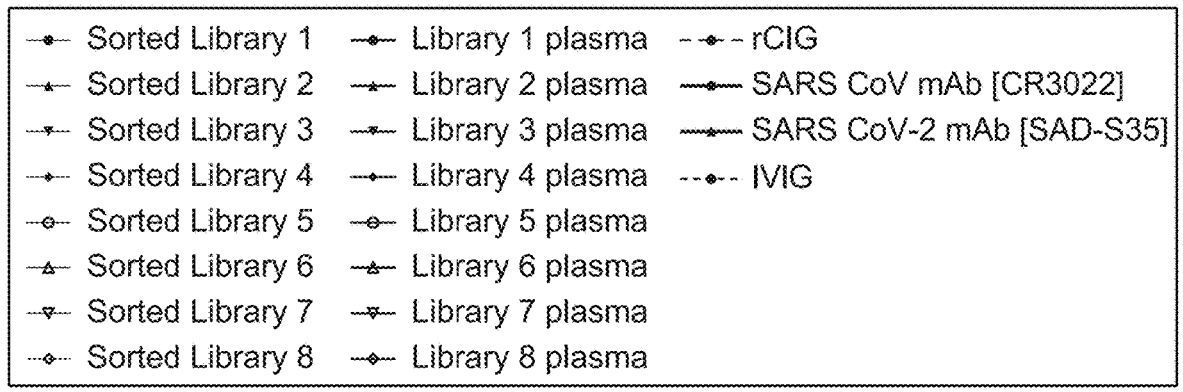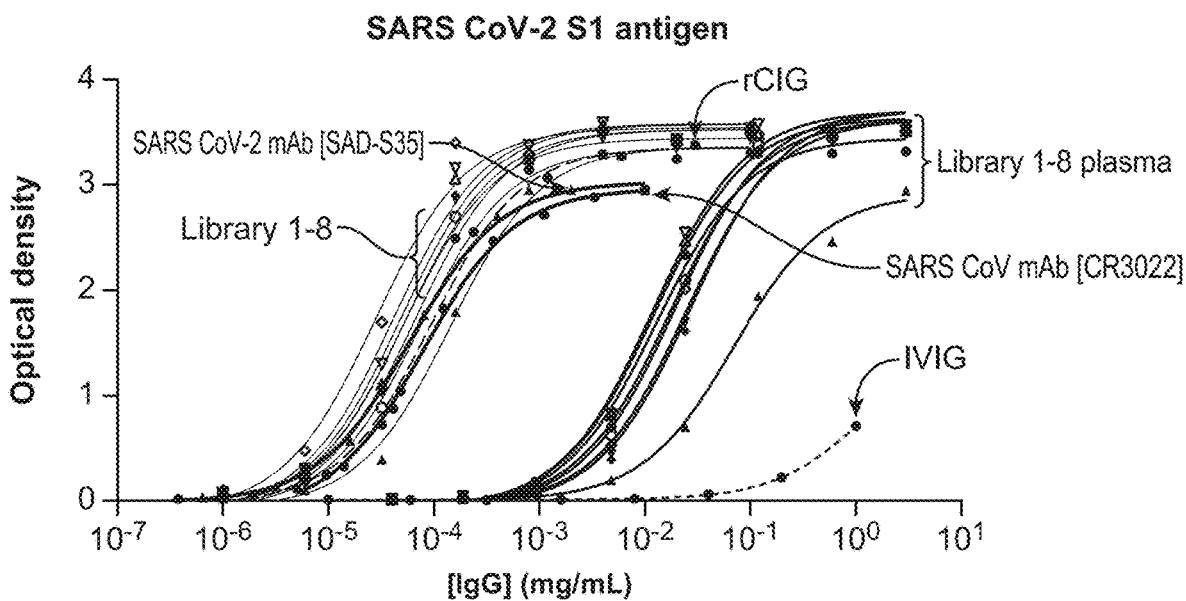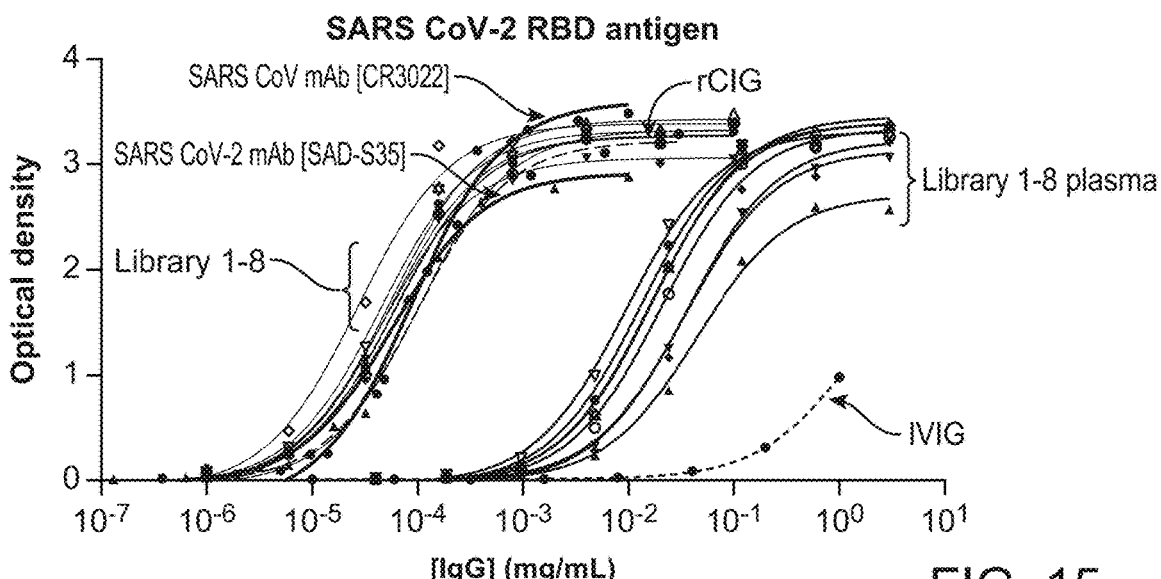
FIG. 15

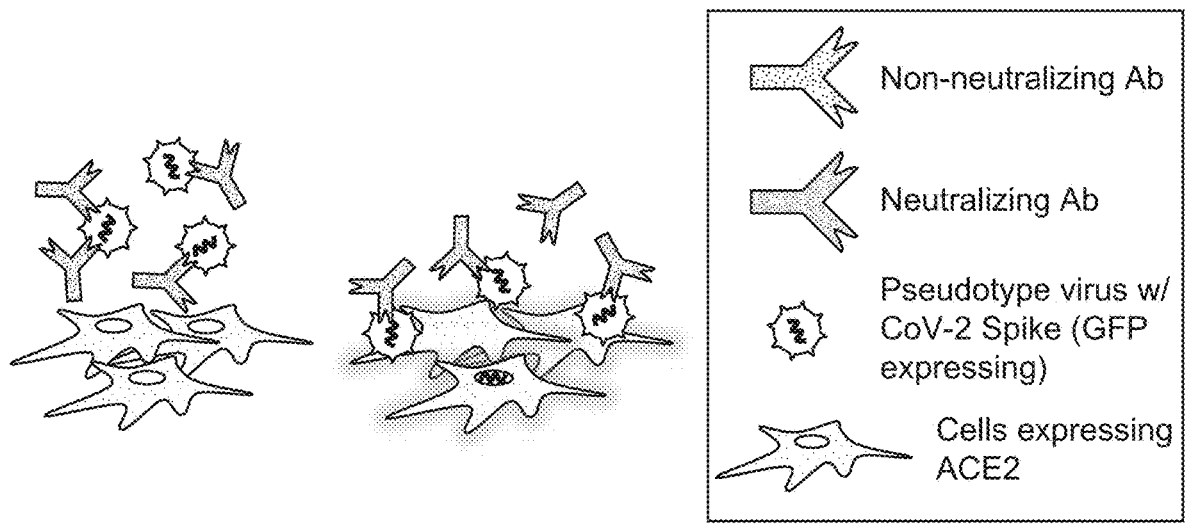
FIG. 17A
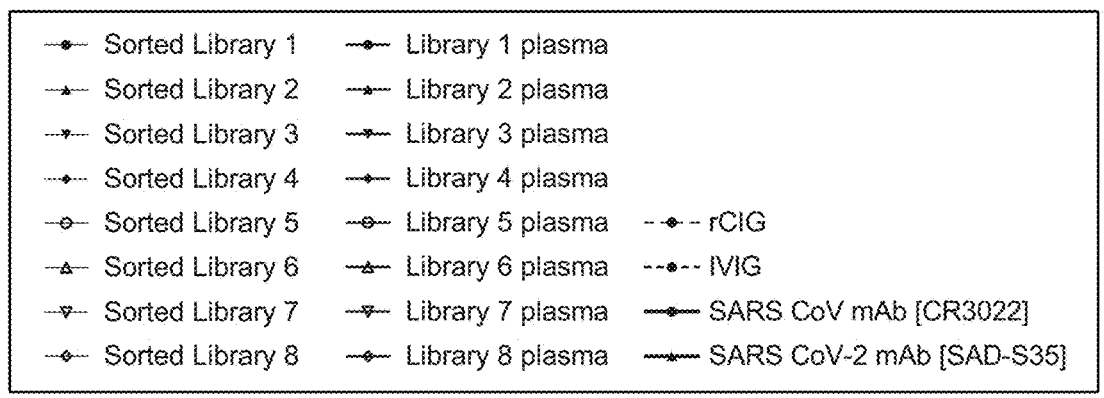
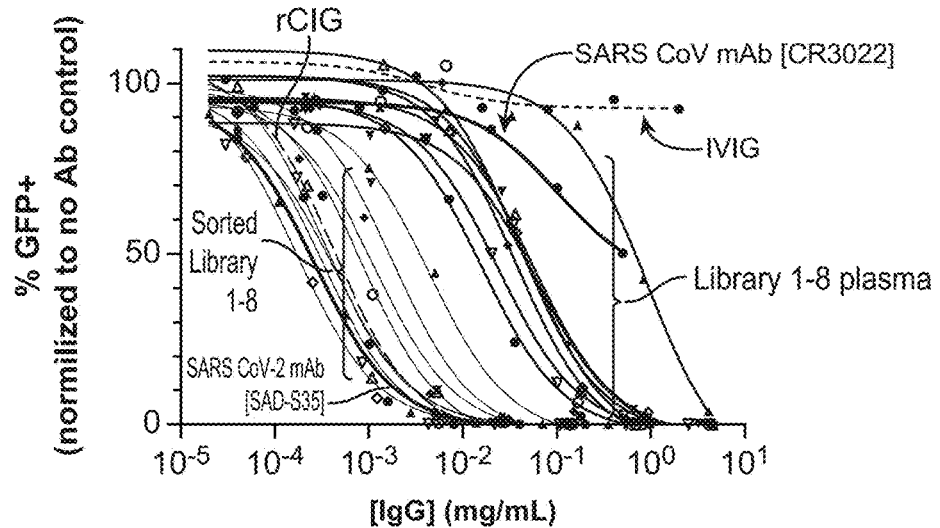
FIG. 17B

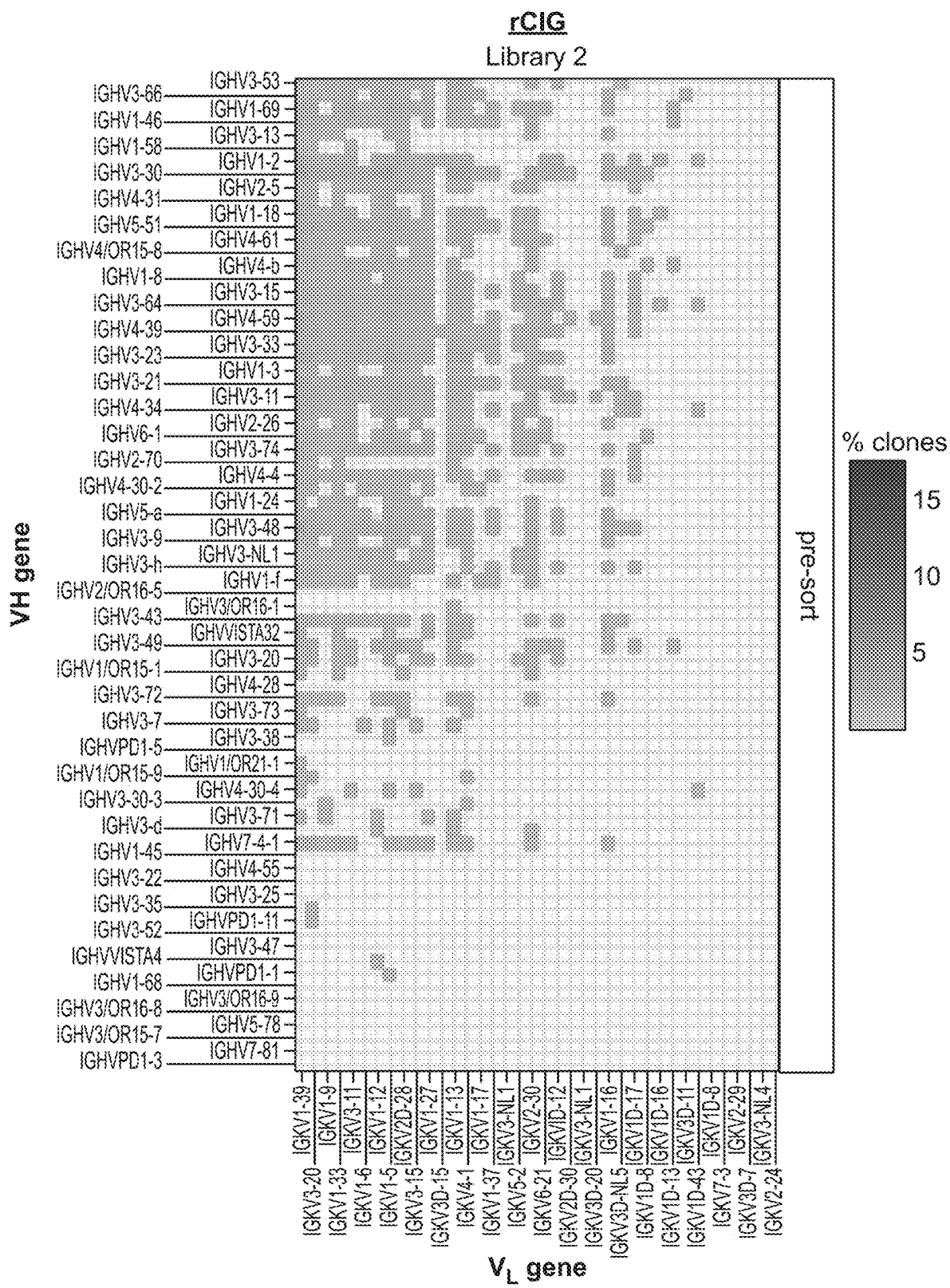
FIG. 21A (Cont. 1)

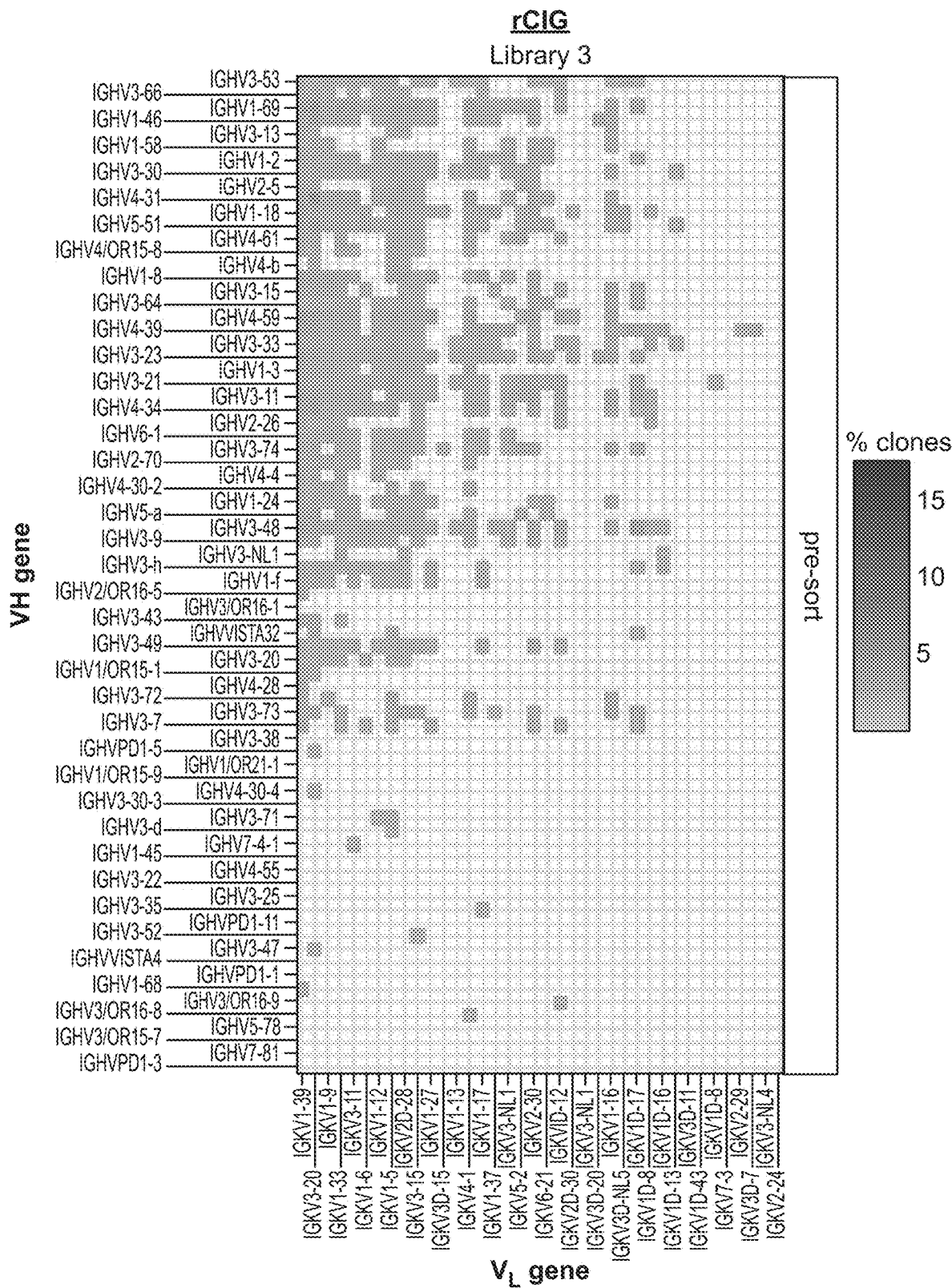
FIG. 21A (Cont. 2)

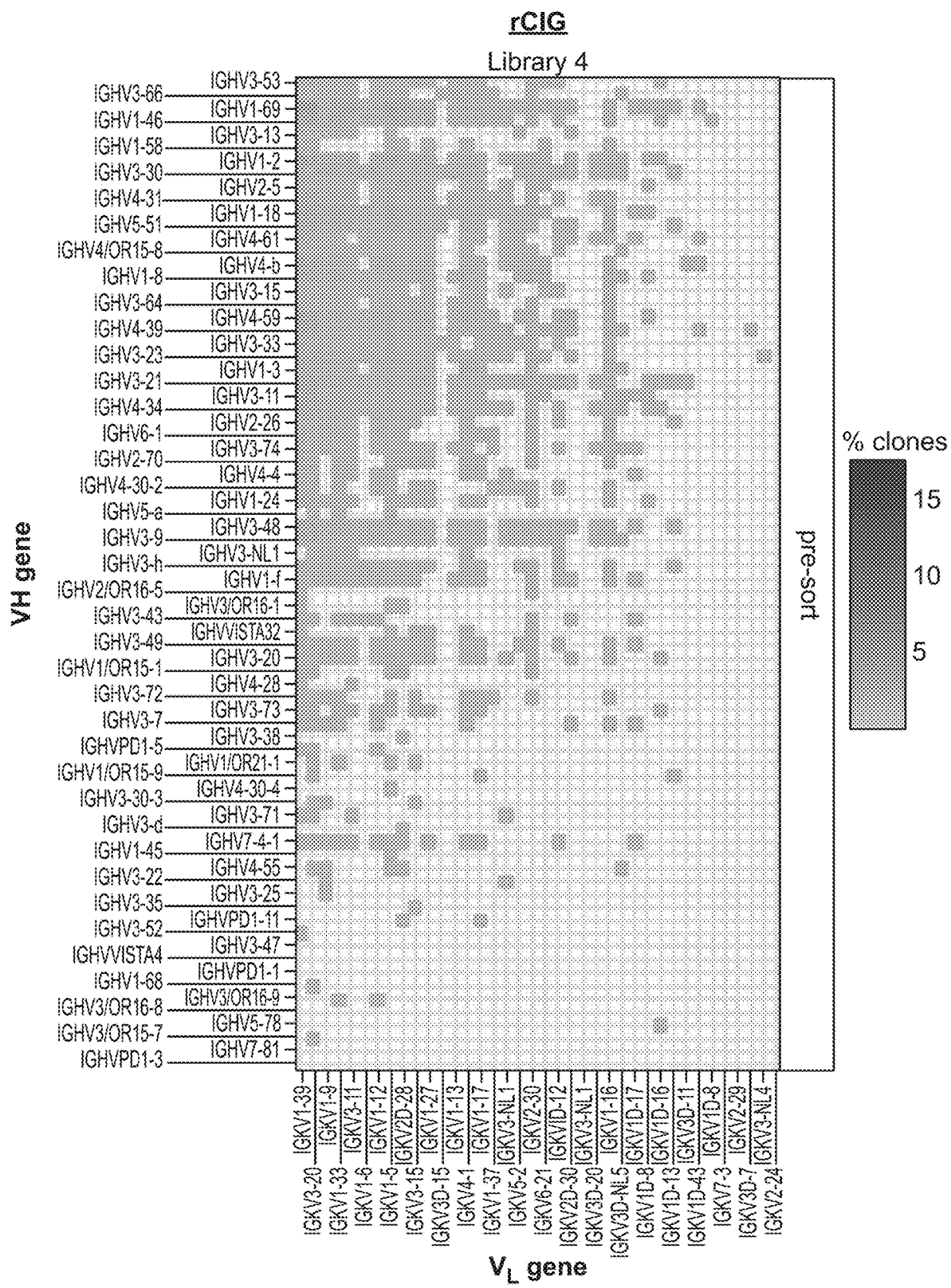
FIG. 21A (Cont. 3)

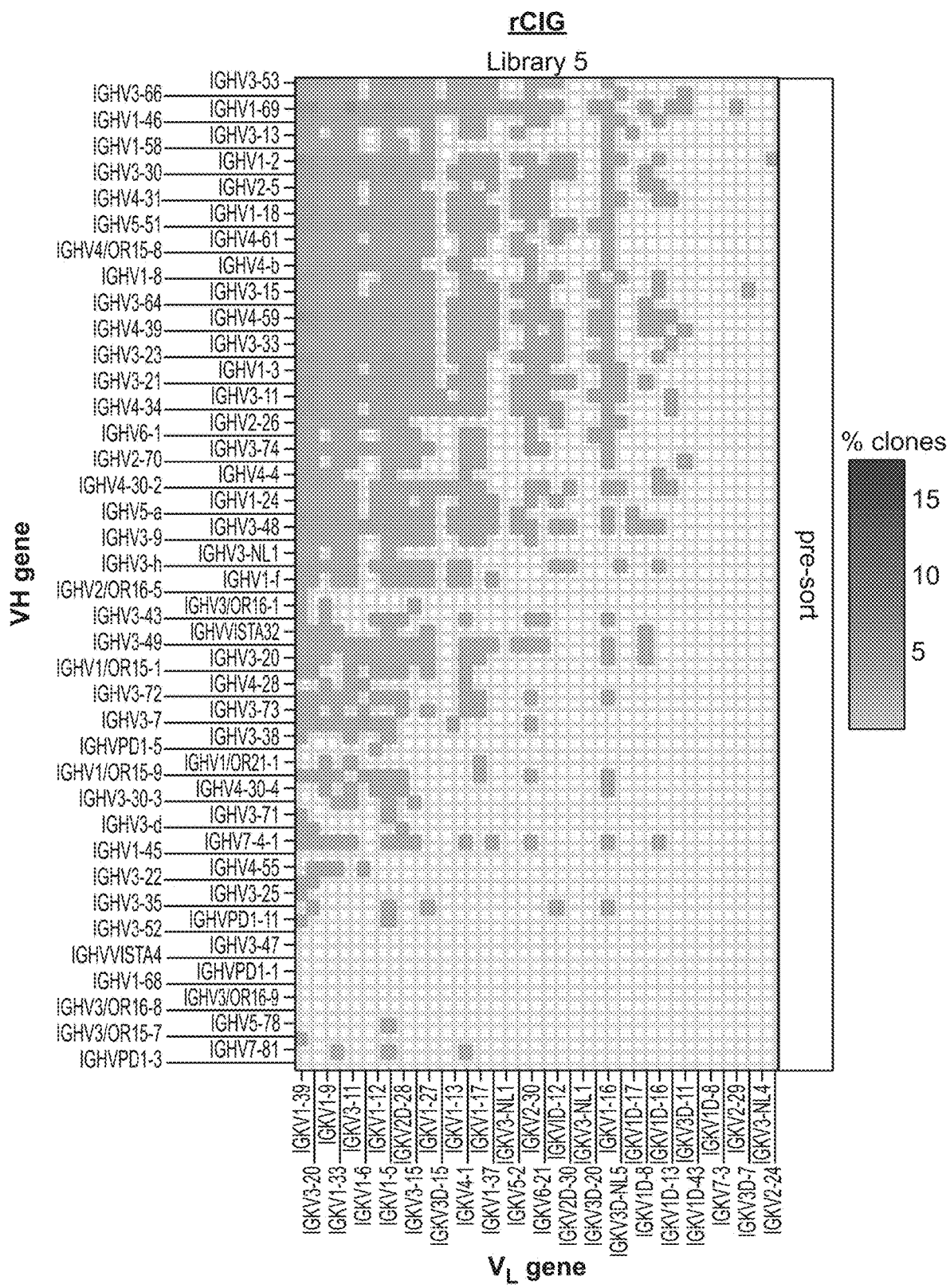
FIG. 21A (Cont. 4)

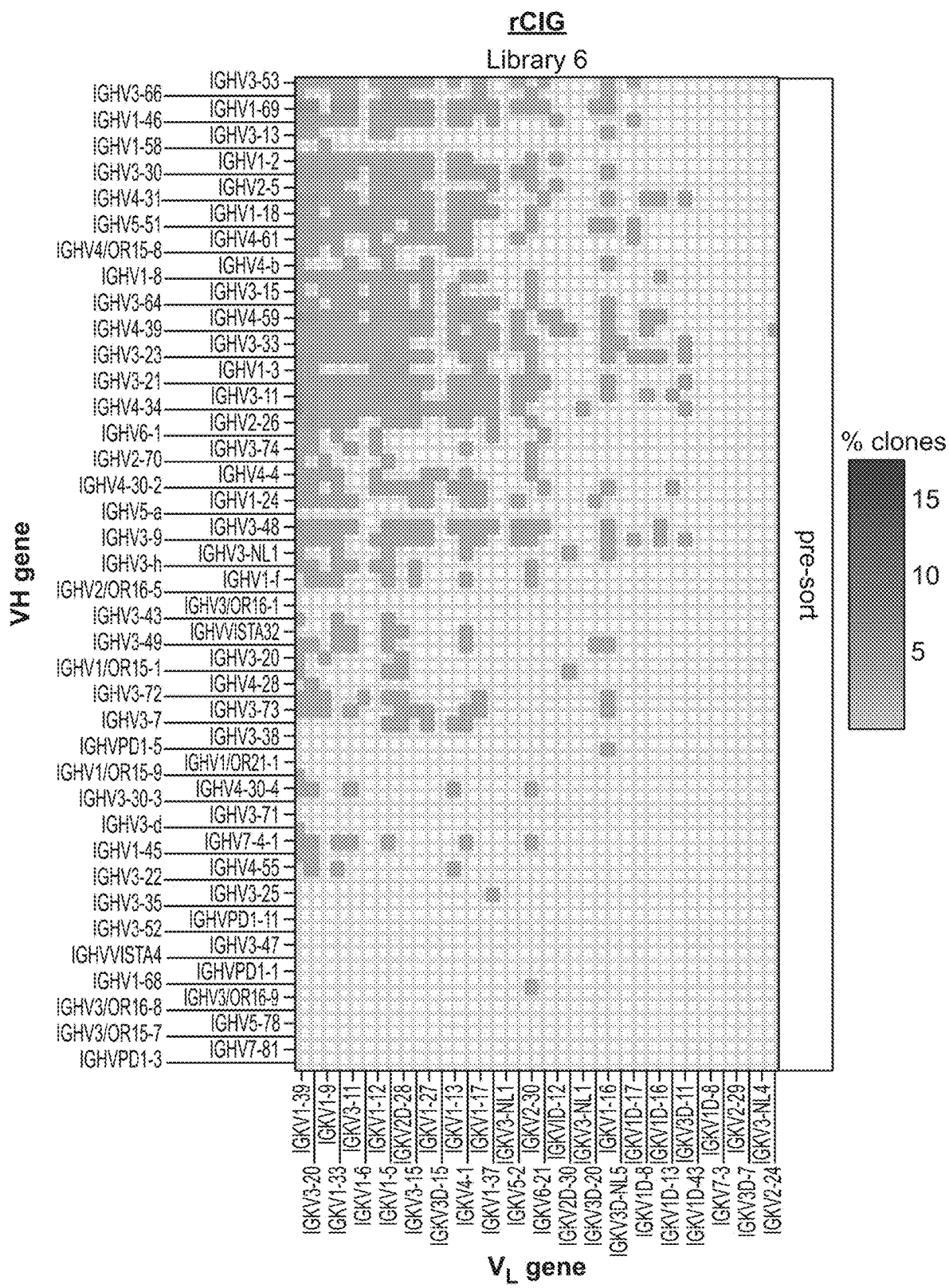
FIG. 21A (Cont. 5)

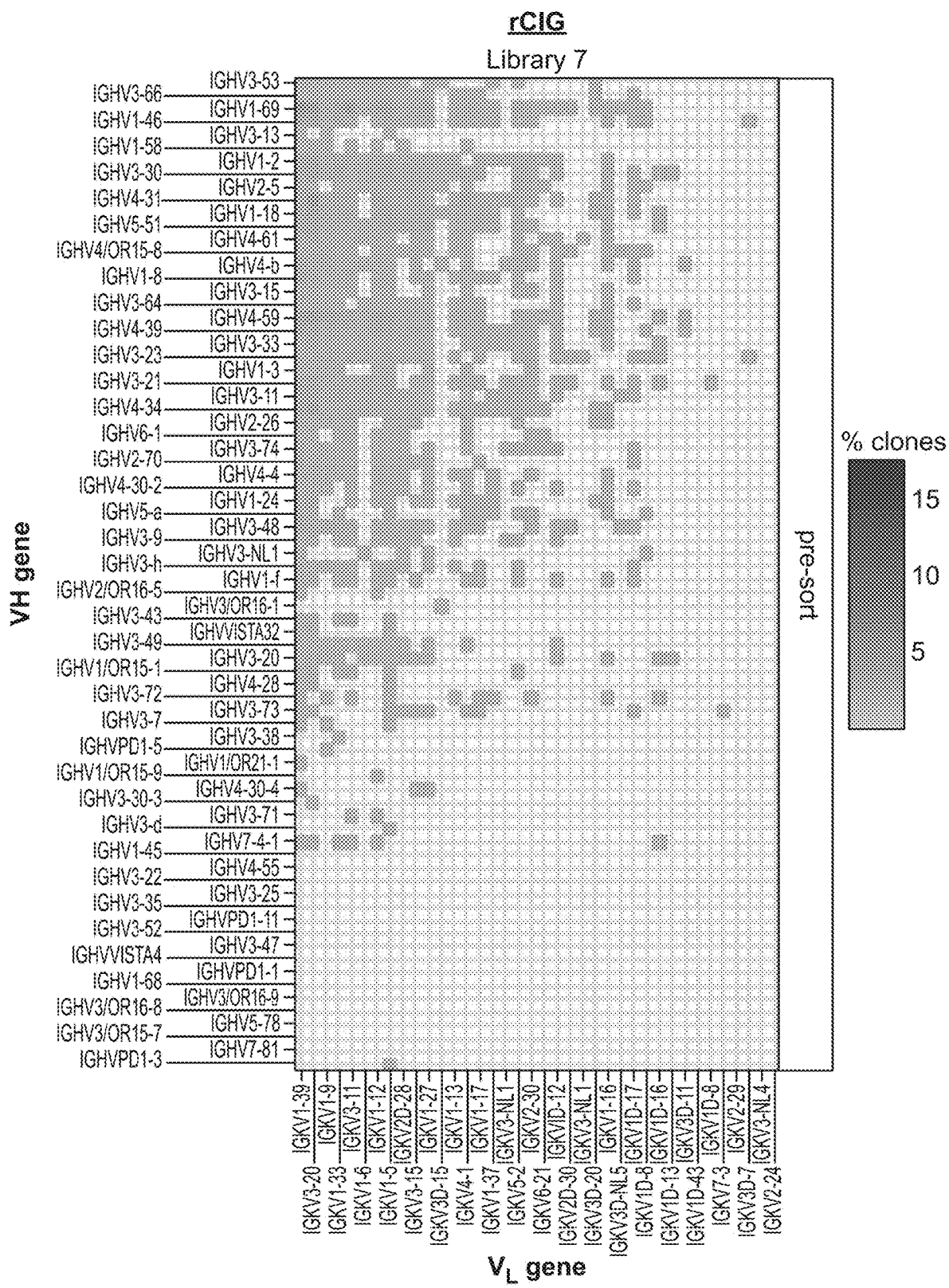
FIG. 21A (Cont. 6)

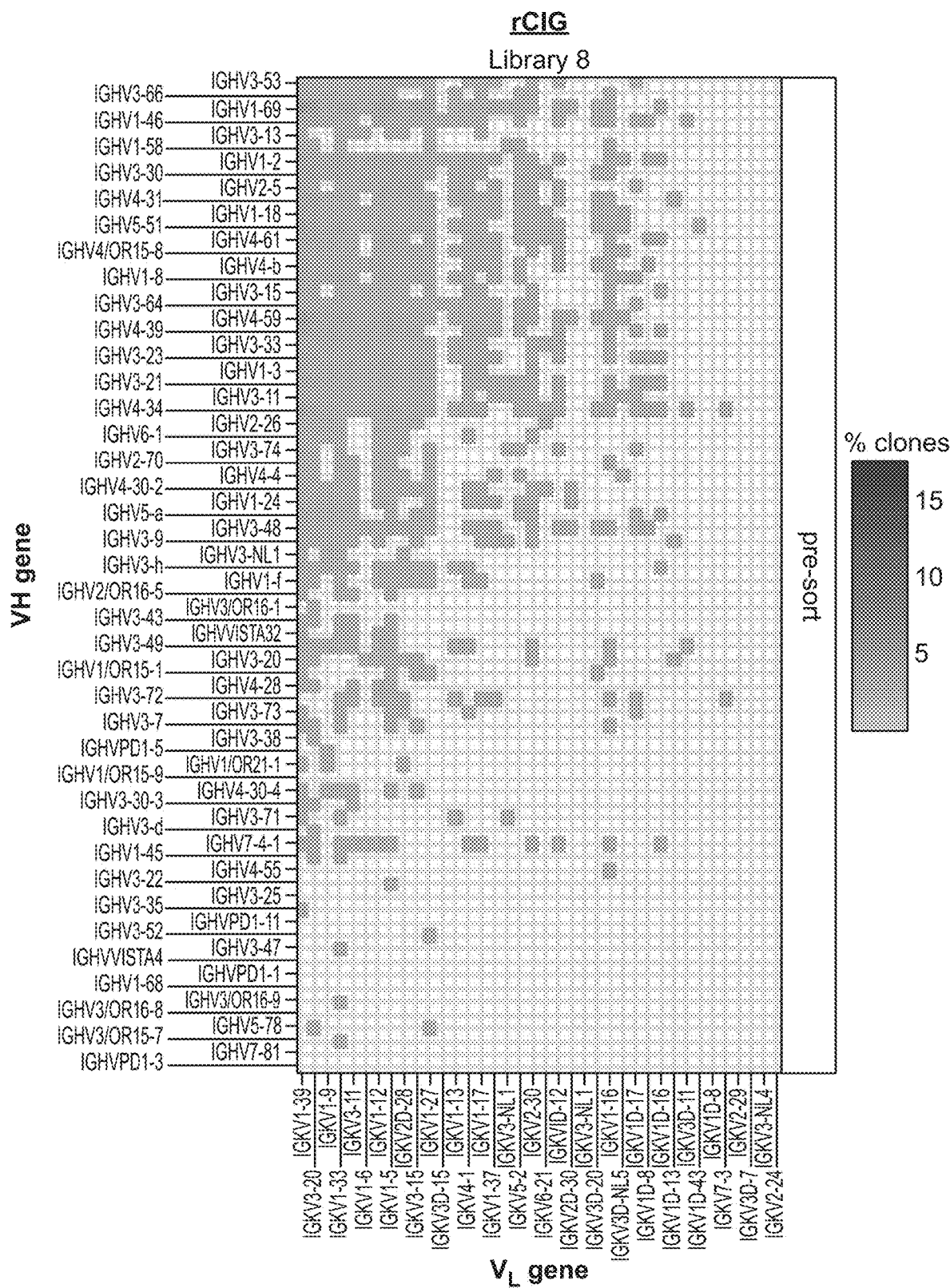
FIG. 21A (Cont. 7)

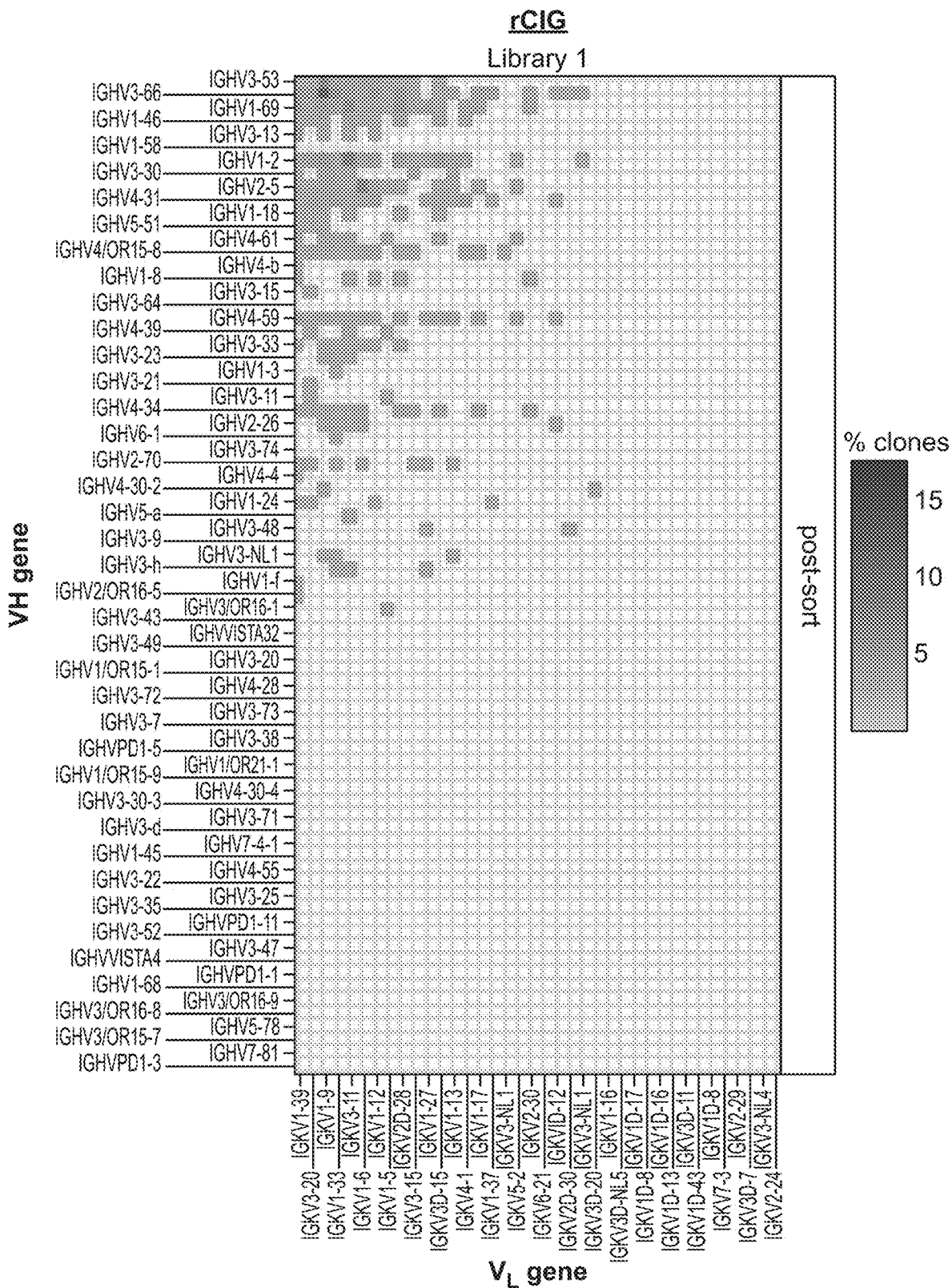
FIG. 21A (Cont. 8)

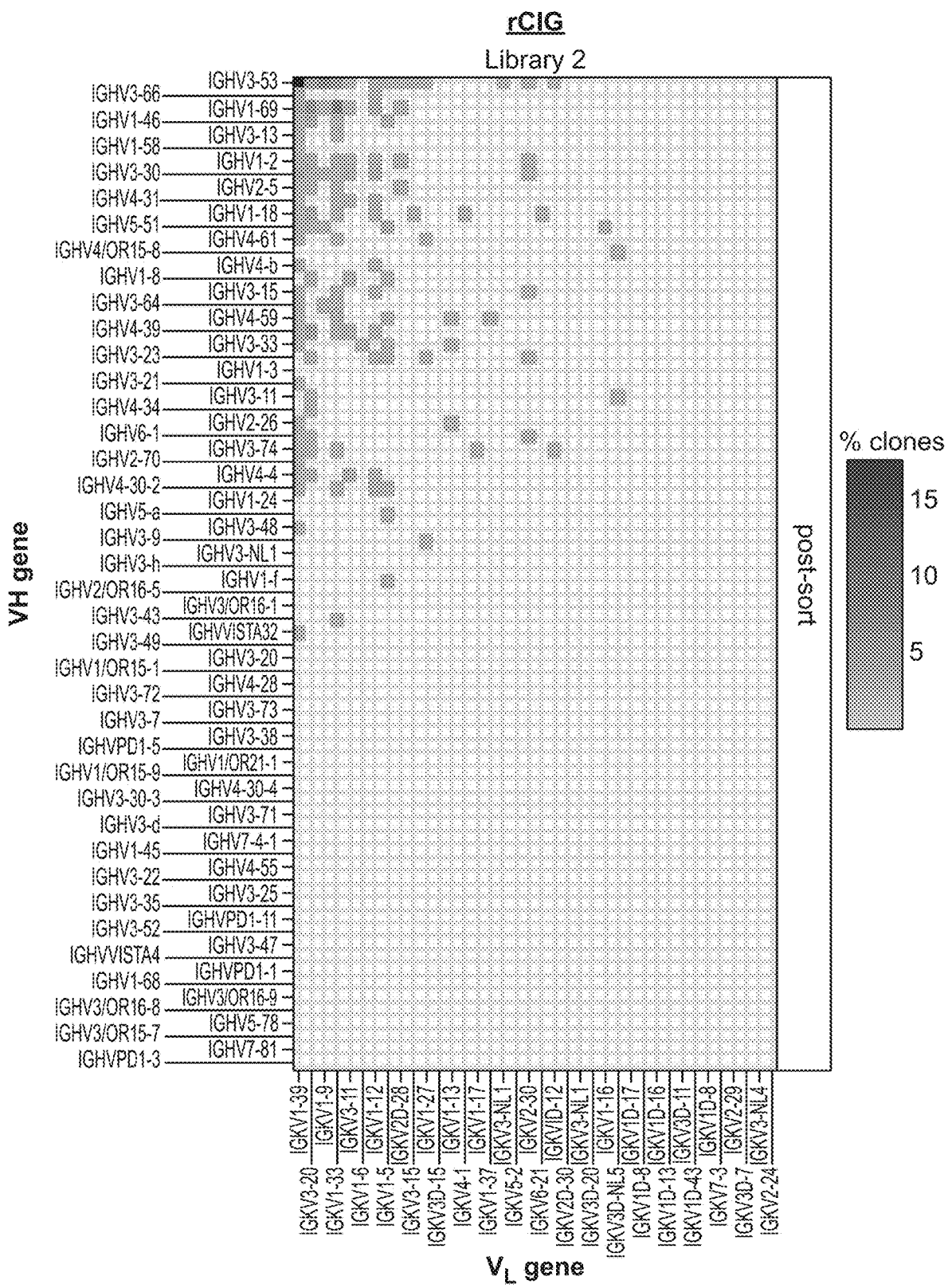
FIG. 21A (Cont. 9)

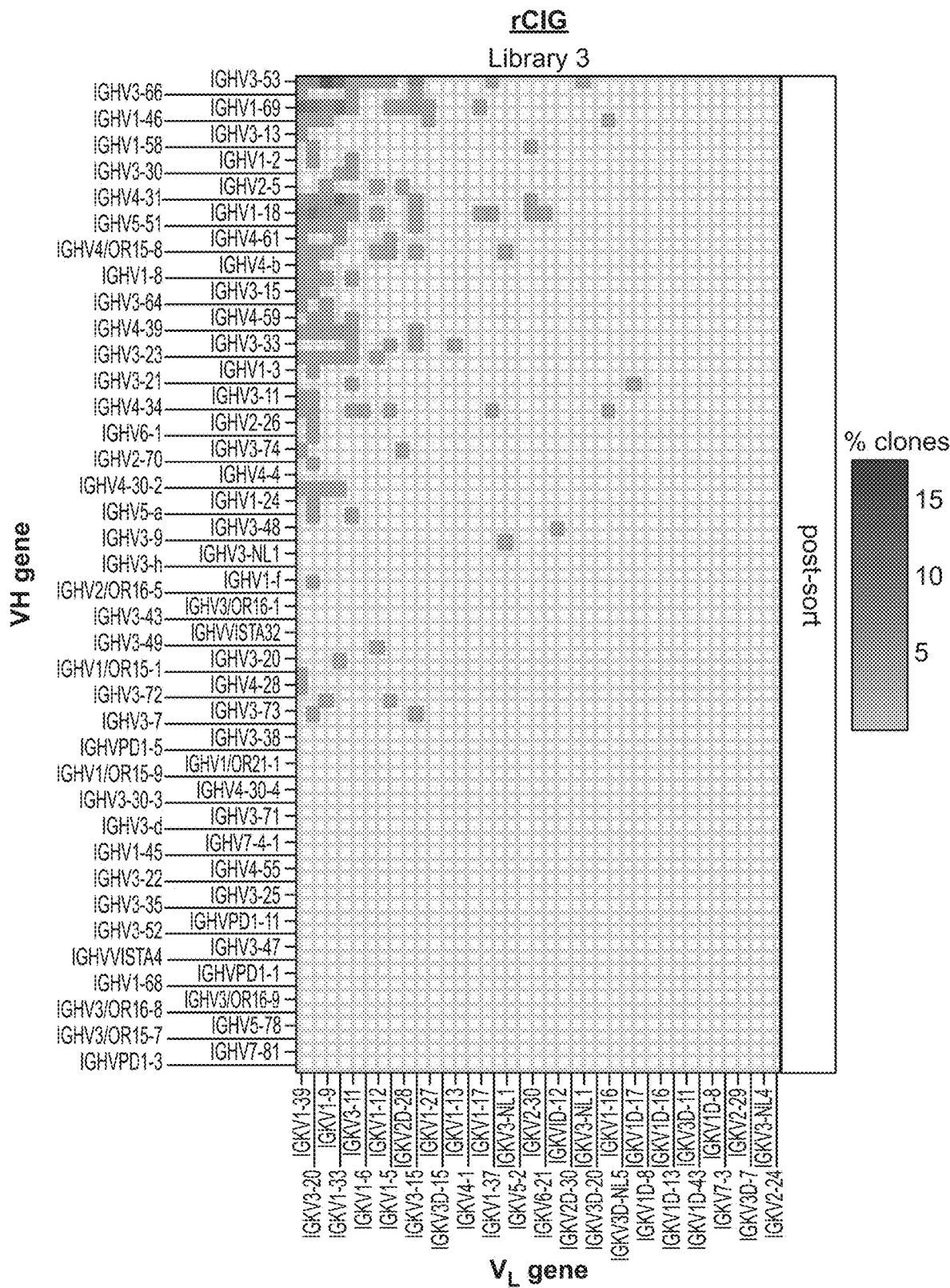
FIG. 21A (Cont. 10)

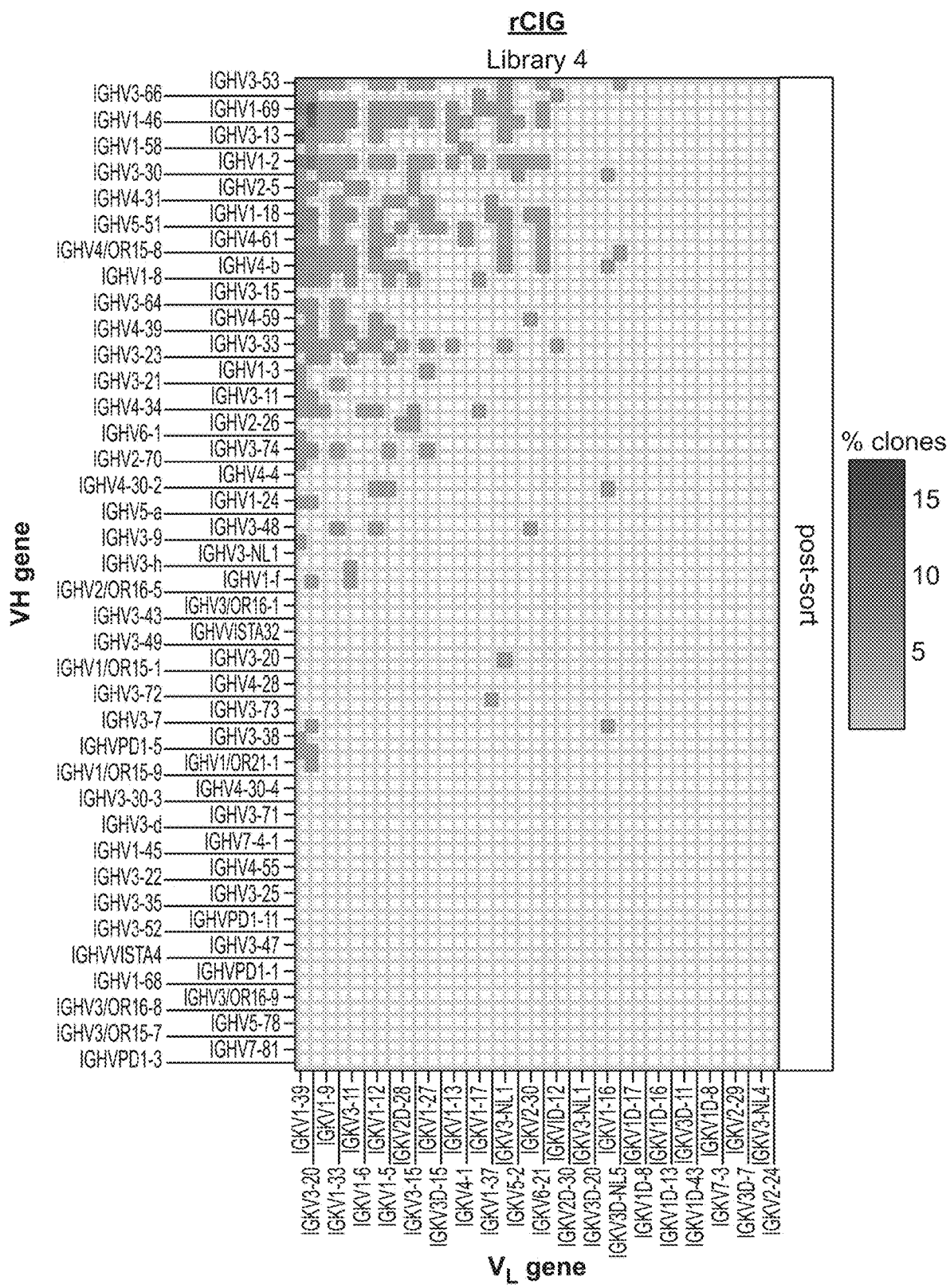
FIG. 21A (Cont. 11)

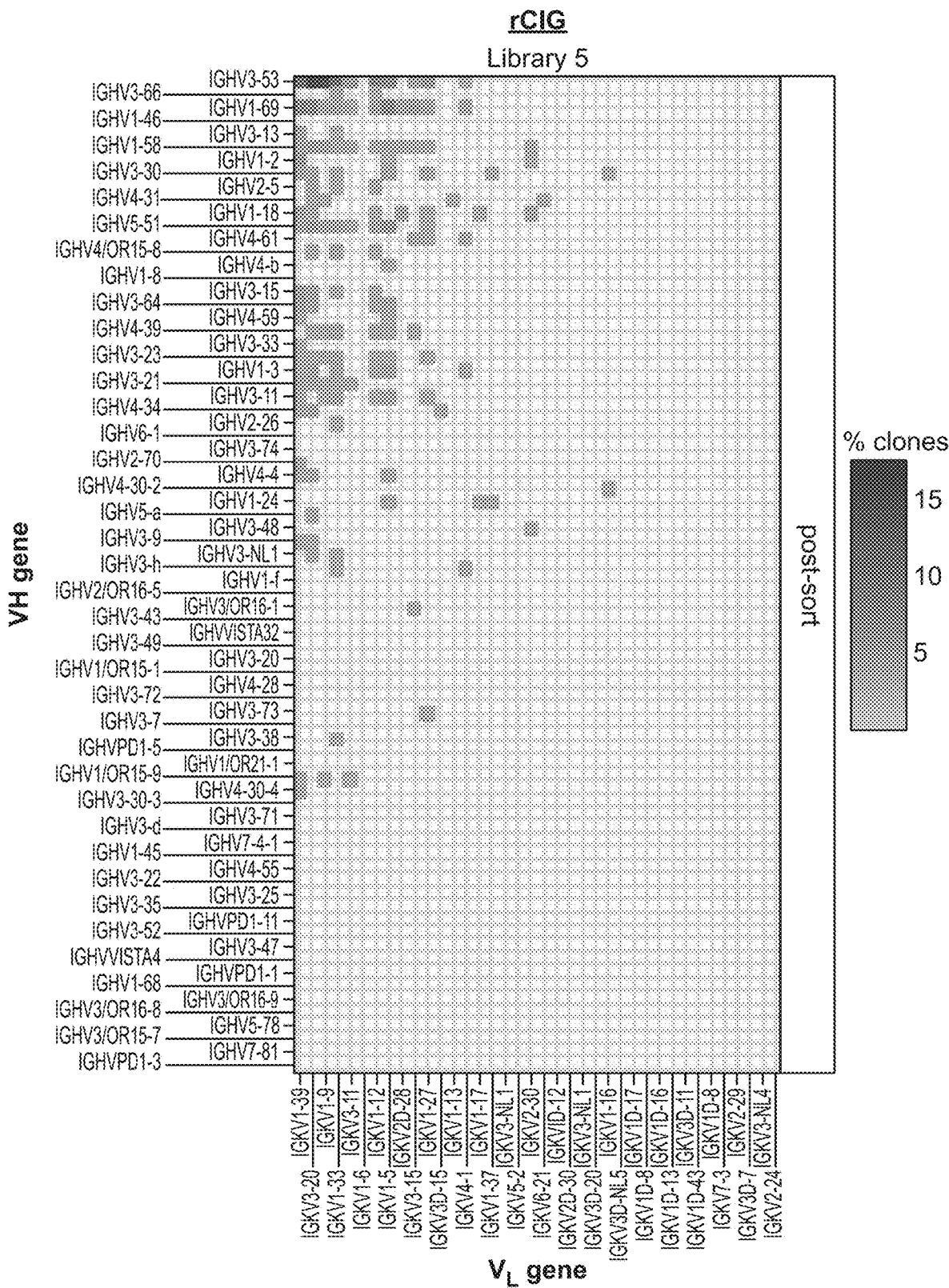
FIG. 21A (Cont. 12)

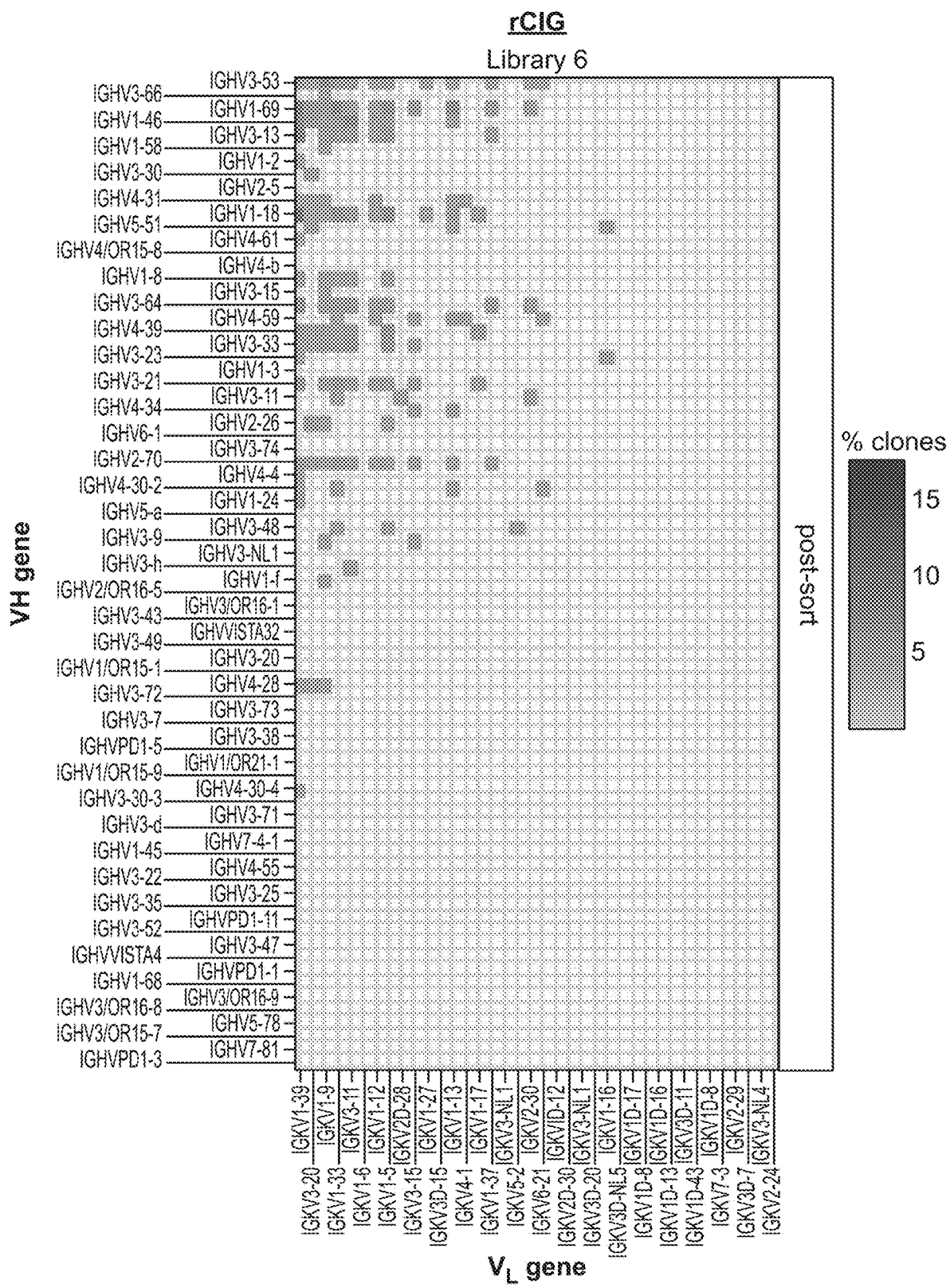
FIG. 21A (Cont. 13)

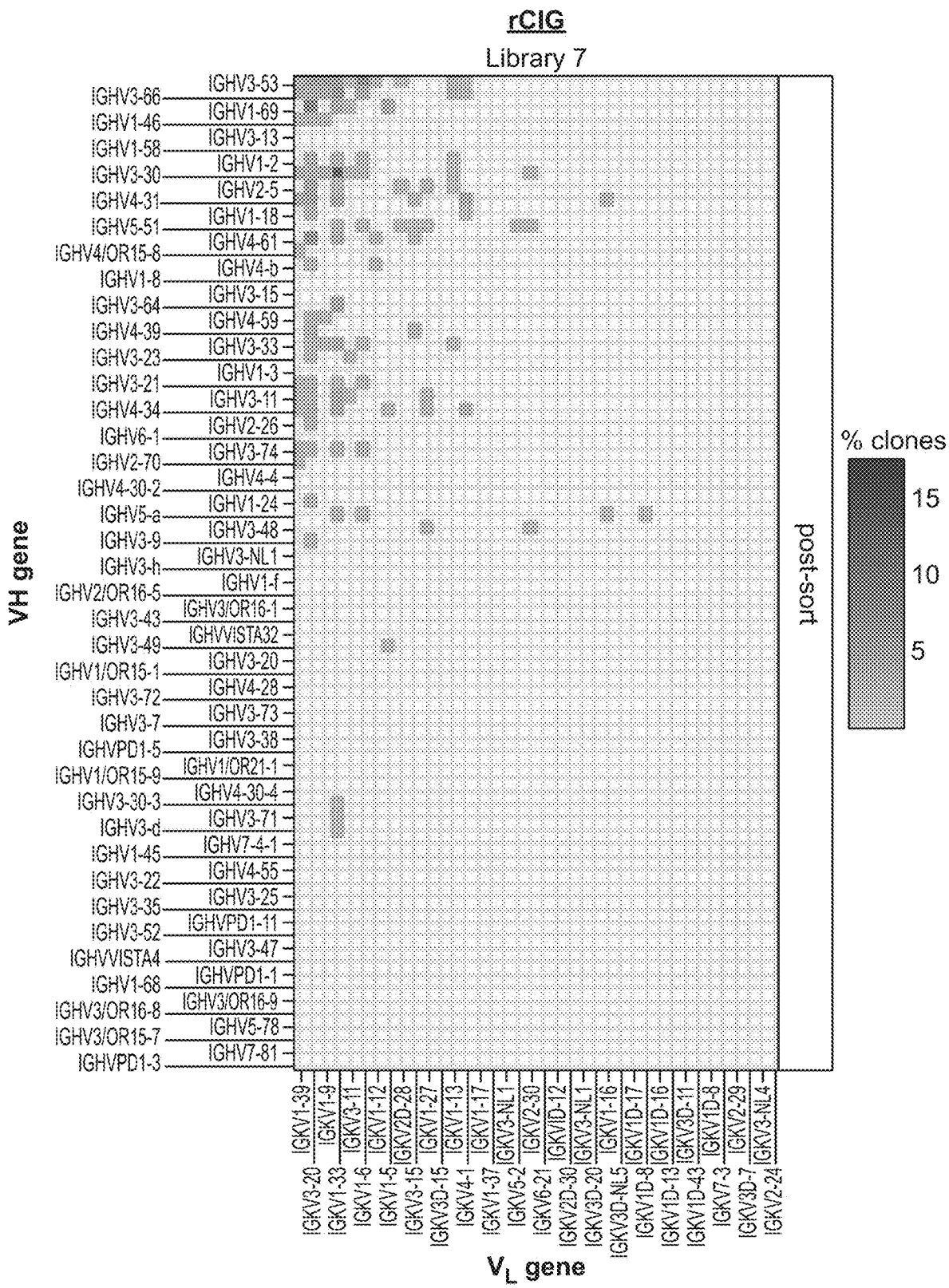
FIG. 21A (Cont. 14)

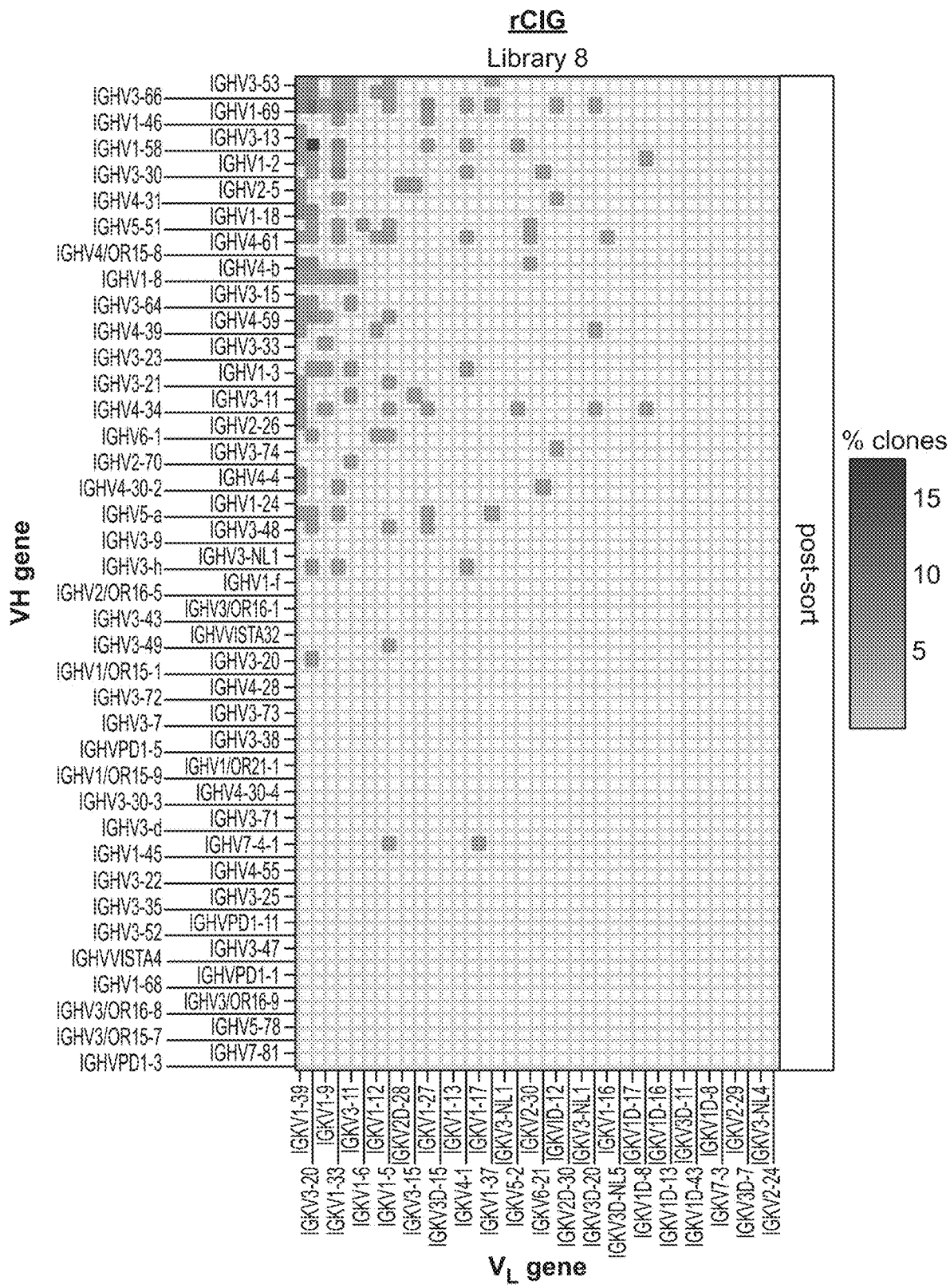
FIG. 21A (Cont. 15)

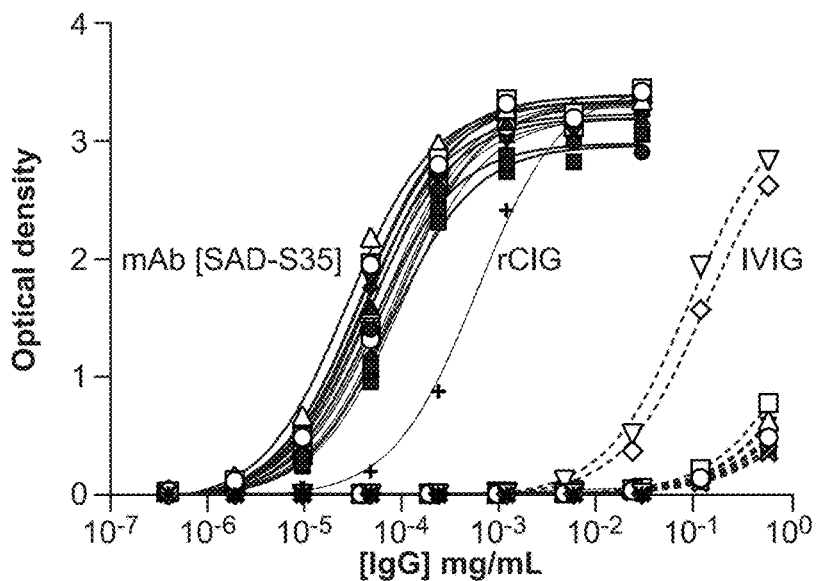
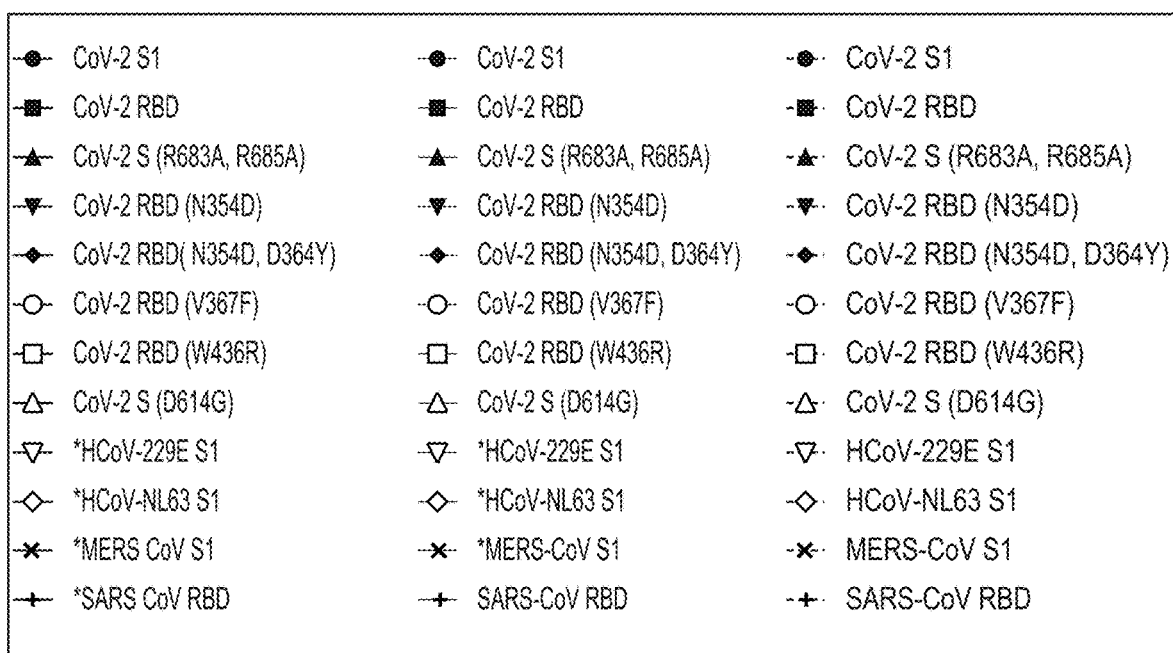
FIG. 22

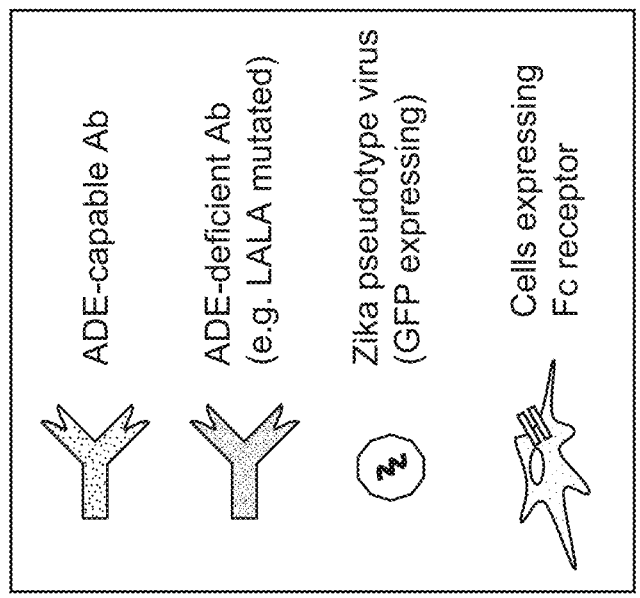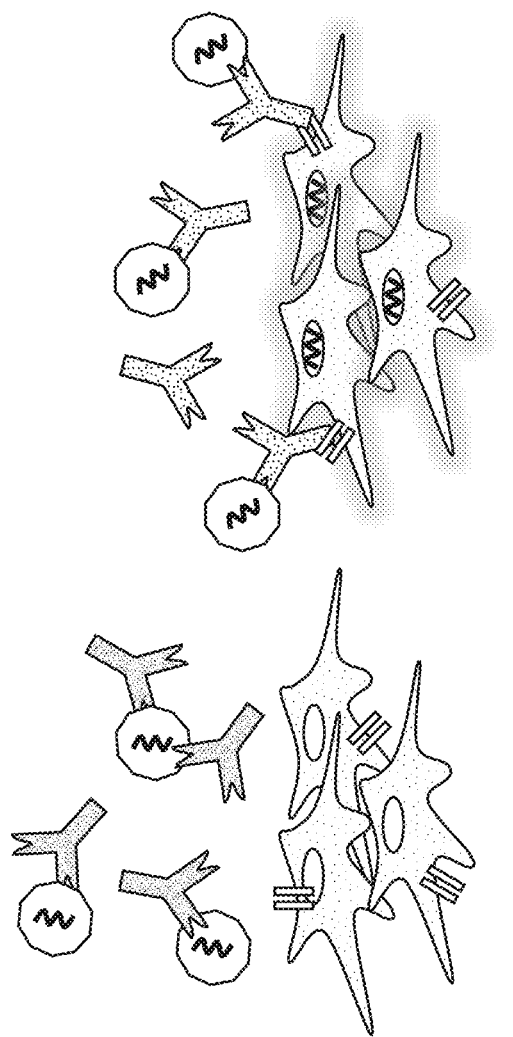
FIG. 32

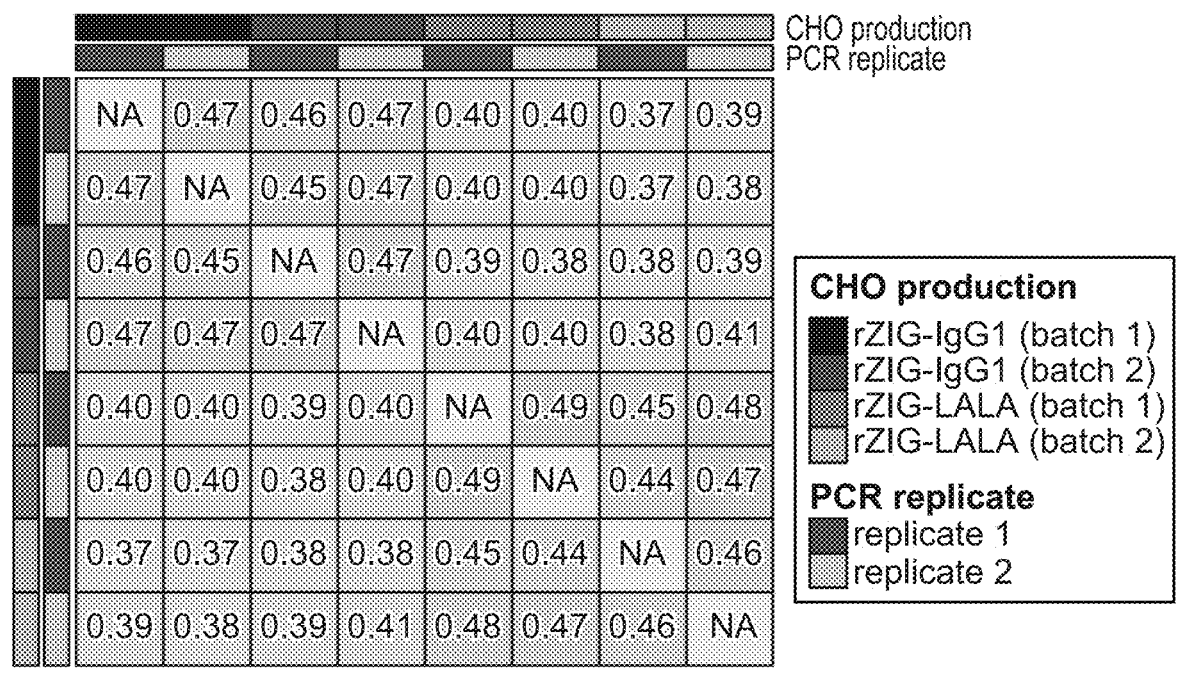
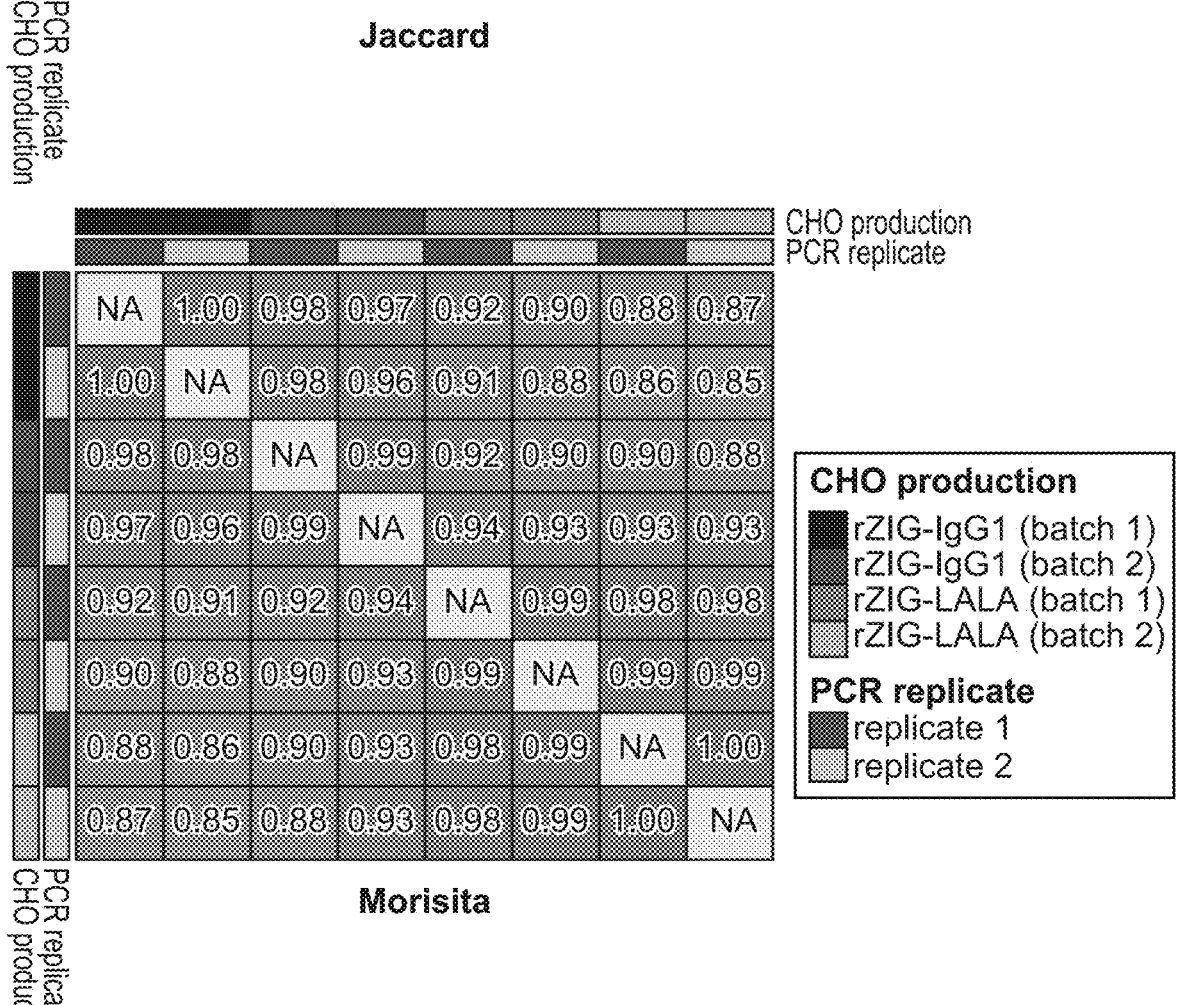
FIG. 33A

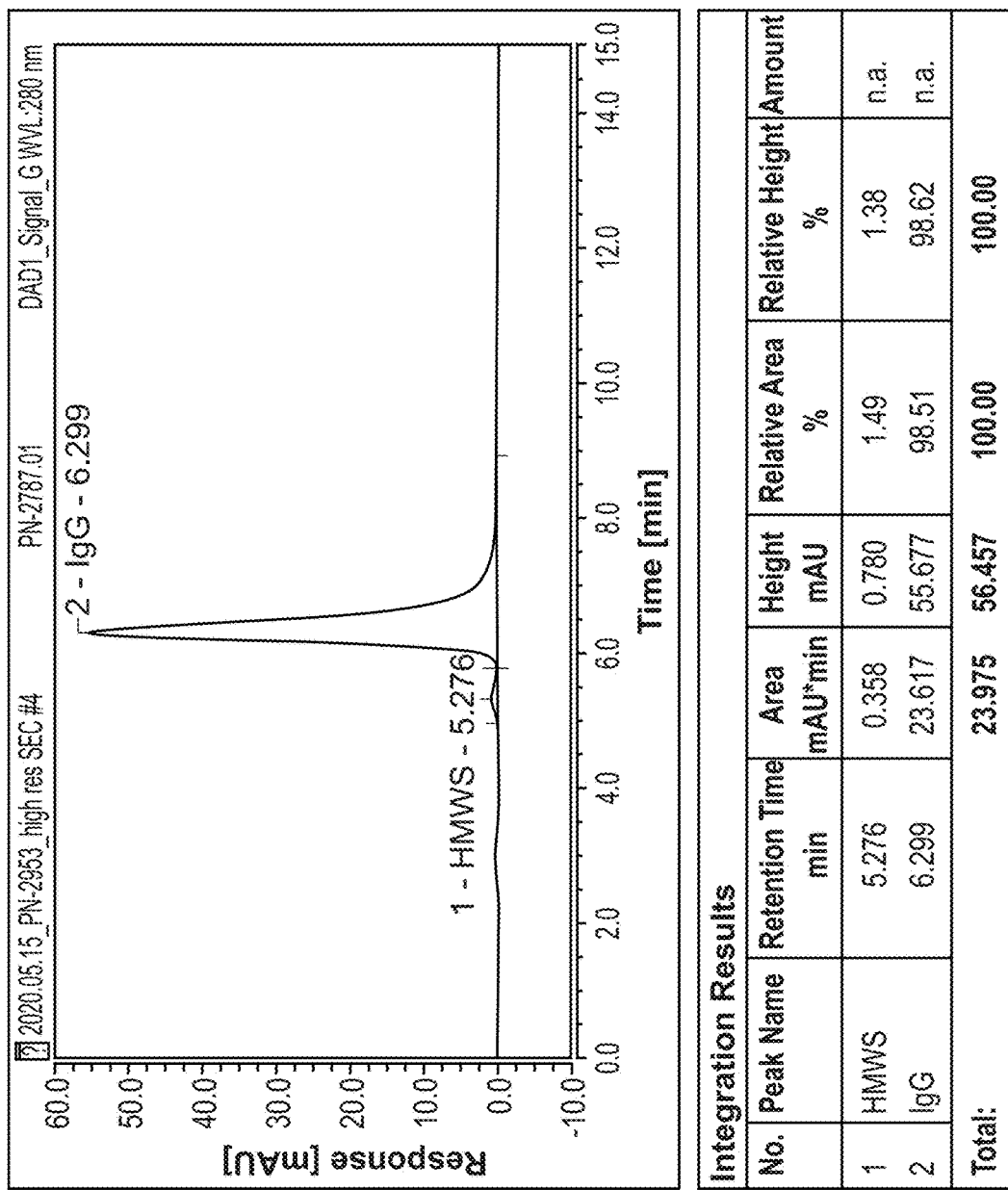
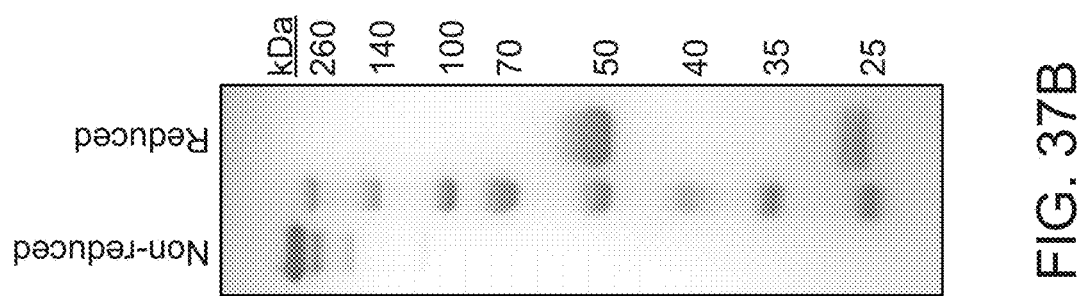
FIG. 37A
FIG. 37B

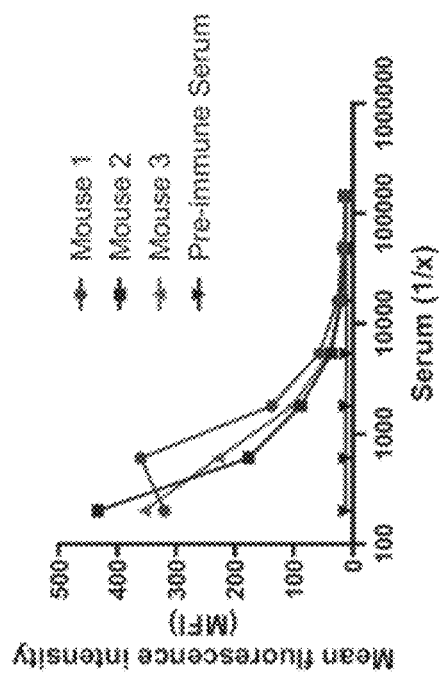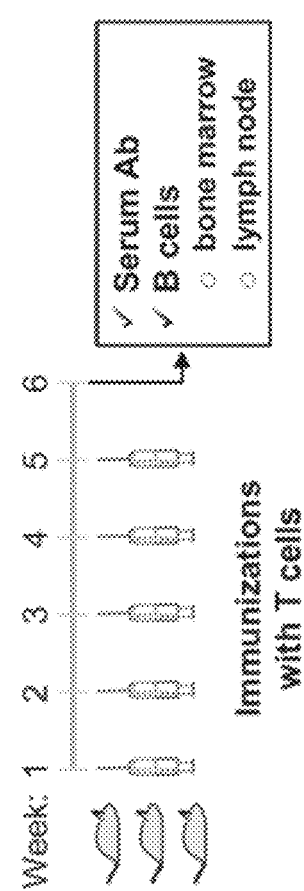
FIG. 43A

RECOMBINANT POLYCLONAL PROTEINS TARGETING ZIKA AND METHODS OF USE THEREOF

1. CROSS REFERENCE TO RELATED APPLICATIONS

The present application is a continuation of PCT/US2021/044523, which claims the benefit of U.S. Provisional Patent Application No. 63/061,730 filed on Aug. 5, 2020 which is hereby incorporated by reference in its entirety.

2. SEQUENCE LISTING

The instant application contains a Sequence Listing with 25975 sequences which has been submitted via EFS-Web and is hereby incorporated by reference in its entirety. Said ASCII copy, created on Mar. 7, 2022, is named 49570US CRF sequencelisting.txt, and is 6,030,864 bytes in size.

3. FIELD

Provided herein are recombinant polyclonal protein composition (RPP), also called Recombinant Zika Immune Globulin (rZIG), recombinant polyclonal antibody proteins, recombinant hyperimmune globulins, or simply recombinant hyperimmunes, with binding specificity for Zika virus. Included are, e.g., therapeutics, vaccines, and libraries, and compositions comprising such RPPs, including pharmaceutical compositions. Also provided are methods of making RPPs, and methods of using RPPs, for example, for therapeutic purposes.

4. BACKGROUND

A major outbreak of the mosquito-borne flavivirus, Zika, spread across Latin America in 2015-2016. Though Zika virus has been less widespread and less deadly than SARS CoV-2, Zika can spread from mother to a fetus in utero, resulting in birth defects such as microcephaly. As of July 2020, there was no FDA-approved vaccine or therapy for Zika virus. Zika virus disease is complicated by antibody-dependent enhancement (ADE) (Katzelnick et al., 2017; Priyamvada et al., 2017), a phenomenon in which poorly neutralizing antibodies enhance viral infection by bringing virus particles to cells that express Fc receptor (FcR). This problem is particularly troublesome for those previously infected with a related flavivirus, Dengue, since many anti-Dengue antibodies are poor neutralizers against Zika virus, and vice versa (Stettler et al., 2016). ADE is a safety concern in the development of plasma-derived hyperimmune compositions and vaccines (Langerak et al., 2019).

Many diseases, such as those caused by infectious viruses or bacteria with many variants or serotypes, are best treated by drugs that target multiple epitopes. An established therapeutic modality is multispecific (multivalent) antibodies derived from human or animal plasma, such as intravenous immunoglobulin (IVIG). Polyclonal antibody drugs with higher potency, known as hyperimmune globulins, are often derived from the plasma of recently vaccinated human donors, for example, HepaGam B against hepatitis B virus (HBV) and BabyBIG against infant botulism. In diseases for which human vaccination is not possible, hyperimmune globulins can be generated by immunizing animals, for example, rabbit-derived thymoglobulin ('rabbit-ATG') against human thymocytes for transplant tolerance. For rapid response to emerging pathogens with poorly characterized neutralizing epitopes, many groups have developed hyperimmune globulins derived from immunized animal plasma or convalescent human serum, for example, Zika virus hyperimmune globulin or severe acute respiratory syndrome coronavirus-2 (SARS-CoV-2).

Plasma-derived antibody therapeutics have substantial drawbacks. First, demand for normal and convalescent donor plasma often outstrips supply. Plasma-derived drugs have suffered from impurities, including infectious viruses and dotting factors, that have resulted in serious adverse events. Antibody drugs derived from animal plasma occasionally cause allergic reactions, lead to antidrug antibodies and have suboptimal effector properties. Because they are derived from naturally occurring proteins, plasma-derived drugs are not easily engineered; for example, it is not possible to modify Fc sequences to improve mechanism of action or drug half-life. Finally, each batch of plasma-derived drug is usually derived from a different cohort of human donors or animals, resulting in batch-to-batch variation.

Many of these problems could be solved by generating multivalent hyperimmune globulins using recombinant DNA technology. However, this strategy presents substantial technical hurdles. Most important, a recombinant hyperimmune globulin technology would have to isolate significant numbers of B cells from donors or animals, natively pair heavy and light chain immunoglobulin at a single-cell level, and then clone the sequences into recombinant expression libraries for manufacturing. Conventionally, most production cell lines for recombinant antibody drugs are generated by random integration of expression constructs into mammalian cell genomes. Pioneering work used 96-well plates to capture antibody sequences from B cells isolated from human donors immunized with Rho(D)$^+$ erythrocytes and then engineer multivalent recombinant antibodies, but this approach produced drug candidates with <30 antibodies, complicating broad application and reducing potential for polyvalence.

There is a need in the art for multivalent hyperimmune globulins with specificity for Zika virus, and methods of using such RPPs, e.g., as human therapeutics.

5. SUMMARY

Provided herein are rZIG (recombinant anti-Zika hyperimmune gammaglobulin), i.e., novel RPPs (novel recombinant polyclonal proteins, also called recombinant polyclonal antibody proteins, recombinant hyperimmune globulins, or recombinant hyperimmunes) with binding specificity to Zika antigens, and methods of using such RPPs, e.g., as human therapeutics. The RPPs are recombinant, and their sequences are derived from peripheral blood plasma cells or plasmablasts. The peripheral blood plasma cells or plasmablasts are mobilized by, e.g., infection of a donor with Zika virus, and the peripheral blood B cells, plasma cells or plasmablasts are specifically separated from other peripheral blood cells. The peripheral blood cells can come from any mammal, for example a mouse, a rat, a human, a monkey, a horse, or a cow.

Accordingly, the present disclosure provides a recombinant polyclonal protein composition (RPP) (also called a Recombinant Zika Immune Globulin (rZIG)), comprising at least 100 antigen binding proteins (ABPs), each of the ABPs comprising a cognate pair of heavy chain CDR3 and light chain CDR3, wherein each of the ABPs specifically binds an antigen of Zika virus.

In some embodiments, each of the ABPs comprises a heavy chain CDR3 having a sequence selected from SEQ ID Nos: 2, 4, 6, through 25838 (even numbers) and SEQ ID NO: 25851-25860, and a light chain CDR3 has a sequence selected from SEQ ID Nos: 1, 3, 5, through 25837 (odd numbers).

In some embodiments, the RPP comprises an ABP comprising a heavy chain CDR1 having the sequence of GFTFX1X2X3X4 (SEQ ID NO: 25839). In some embodiments, the RPP comprises an ABP comprising a heavy chain CDR1 having the sequence of GFTF[S/D][S/D][Y/H/D][A/G/Y/F] (SEQ ID NO: 25840). In some embodiments, the RPP comprises an ABP comprising a heavy chain CDR1 having a sequence selected from the group consisting of: a. GFTFSSYA (SEQ ID NO: 25841); b. GFTFSSYG (SEQ ID NO: 25842); c. GFTFDD[Y/H]G (SEQ ID NO: 25843); and d. GFTFSD[Y/D][Y/F] (SEQ ID NO: 25844).

In some embodiments, the RPP comprises an ABP comprising a heavy chain CDR2 having the sequence of IX1X2X3G X3X4X5 (SEQ ID NO: 25845). In some embodiments, each of the RPP comprises an ABP comprising a heavy chain CDR2 having the sequence of I[W/S/N][G/Y/W] [S/D/N] G[G/S/D/Y] [S/N/T] [T/K/I] (SEQ ID NO: 25846).

In some embodiments, the RPP comprises an ABP comprising a heavy chain CDR2 having a sequence selected from the group consisting of: a. ISGSGGST (SEQ ID NO: 25847); b.I[W/S]YDGSNK (SEQ ID NO: 25848); c.INWNG[G/D]ST (SEQ ID NO: 25849) and d.ISGSG[S/Y]TI (SEQ ID NO: 25850).

In some embodiments, the RPP comprises an ABP comprising a heavy chain CDR3 having a sequence selected from a. AKEGMVLRYFDWLWDY (SEQ ID NO: 25851); b. RX1X2X3SGX4SX5FDY (SEQ ID NO: 25852); c. AX1X2X3X4X5X6VX7X8X9Y (SEQ ID NO: 25853); d. ARX1X2GSX3X4X5X6DX7FDX8 (SEQ ID NO: 25854); and e. ARDEGYX1GYX2LDX3 (SEQ ID NO: 25855).

In some embodiments, the RPP comprises an ABP comprising a heavy chain CDR3 having a sequence selected from a. AKEGMVLRYFDWLWDY (SEQ ID NO: 25856); b. R[D/E][R/L][SN/L]SG[P/W]S[G/H]FDY (SEQ ID NO: 25857); c. A[K/E/R][E/T][Q/L/T][L/W/I][LN/W/N][G/L]V[V/P/L][F/L/N][D/N]Y (SEQ ID NO: 25858); d. AR[D/N][R/G]GS[S/T][G/S/W/F][W/F/Y][R/F/Y]D[W/A]FD[P/I] (SEQ ID NO: 25859); and e. ARDEGY[R/S]GY[V/N]LD[T/N/S] (SEQ ID NO: 25860).

In some embodiments, the RPP comprises at least 20, 40, 50, 100 or 200 ABPs comprising: a. a heavy chain CDR1 having the sequence of GFTFSSYA (SEQ ID NO: 25841), a heavy chain CDR2 having the sequence of ISGSGGST (SEQ ID NO: 25847), and a heavy chain CDR3 having the sequence of AKEGMVLRYFDWLWDY (SEQ ID NO: 25856); b. a heavy chain CDR1 having the sequence of GFTFSSYG (SEQ ID NO: 25842), a heavy chain CDR2 having the sequence of I[W/S]YDGSNK (SEQ ID NO: 25848), and a heavy chain CDR3 having the sequence of R[D/E][R/L][SN/L]SG[P/W]S[G/H]FDY (SEQ ID NO: 25857); c. a heavy chain CDR1 having the sequence of GFTFSSYA (SEQ ID NO: 25841), a heavy chain CDR2 having the sequence of ISGSGGST (SEQ ID NO: 25847), and a heavy chain CDR3 having the sequence of A[K/E/R][E/T][Q/L/T][L/W/I][LN/W/N][G/L]V[V/P/L][F/L/N][D/N]Y (SEQ ID NO: 25858); d. a heavy chain CDR1 having the sequence of GFTFDD[Y/H]G (SEQ ID NO: 25843), a heavy chain CDR2 having the sequence of INWNG[G/D]ST (SEQ ID NO: 25849), and a heavy chain CDR3 having the sequence of AR[D/N][R/G]GS[S/T][G/S/W/F][W/F/Y][R/F/Y]D[W/A]FD[P/I] (SEQ ID NO: 25859); or e. a heavy chain CDR1 having the sequence of GFTFSD[Y/D][Y/F] (SEQ ID NO: 25844), a heavy chain CDR2 having the sequence of ISGSG[S/Y]TI (SEQ ID NO: 25850), and a heavy chain CDR3 having the sequence of ARDEGY[R/S]GY[V/N]LD[T/N/S] (SEQ ID NO: 25860).

In some embodiments, each of at least 5%, 10%, 25%, or 50% of the total ABPs in the RPP comprises: a. a heavy chain CDR1 having the sequence of GFTFSSYA (SEQ ID NO: 25841), a heavy chain CDR2 having the sequence of ISGSGGST (SEQ ID NO: 25847), and a heavy chain CDR3 having the sequence of AKEGMVLRYFDWLWDY (SEQ ID NO: 25856); b. a heavy chain CDR1 having the sequence of GFTFSSYG (SEQ ID NO: 25842), a heavy chain CDR2 having the sequence of I[W/S]YDGSNK (SEQ ID NO: 25848), and a heavy chain CDR3 having the sequence of R[D/E][R/L][SN/L]SG[P/W]S[G/H]FDY (SEQ ID NO: 25857); c. a heavy chain CDR1 having the sequence of GFTFSSYA (SEQ ID NO: 25841), a heavy chain CDR2 having the sequence of ISGSGGST (SEQ ID NO: 25847), and a heavy chain CDR3 having the sequence of A[K/E/R][E/T][Q/L/T][L/W/I][LN/W/N][G/L]V[V/P/L][F/L/N][D/N]Y (SEQ ID NO: 25858); d. a heavy chain CDR1 having the sequence of GFTFDD[Y/H]G (SEQ ID NO: 25843), a heavy chain CDR2 having the sequence of INWNG[G/D]ST (SEQ ID NO: 25849), and a heavy chain CDR3 having the sequence of AR[D/N][R/G]GS[S/T][G/S/W/F][W/F/Y][R/F/Y]D[W/A]FD[P/I] (SEQ ID NO: 25859); or e. a heavy chain CDR1 having the sequence of GFTFSD[Y/D][Y/F] (SEQ ID NO: 25844), a heavy chain CDR2 having the sequence of ISGSG[S/Y]TI (SEQ ID NO: 25850), and a heavy chain CDR3 having the sequence of ARDEGY[R/S]GY[V/N]LD[T/N/S] (SEQ ID NO: 25860).

In some embodiments, each of the ABPs comprises a unique heavy chain CDR3 and a unique light chain CDR3 sequence.

In some embodiments, the RPP comprises 100 to 500 ABPs. In some embodiments, the RPP comprises 500 to 1000 ABPs. In some embodiments, the RPP comprises 1000 to 2500 ABPs. In some embodiments, the RPP comprises more than 2500 ABPs.

In some embodiments, each of the ABPs is an scFv. In some embodiments, each of the ABPs is a full-length antibody. In some embodiments, each of the ABPs is an IgG1 subtype.

In some embodiments, each of the ABPs is produced in eukaryotic cell culture. In some embodiments, each of the ABPs is produced in a CHO cell. In some embodiments, each of the ABPs is produced in yeast cells. In some embodiments, each of the ABPs is recombinantly produced using sequences derived from B cells, plasma cells, or plasmablasts in a sample from a donor injected with one or more Zika antigens or Dengue antigens, or infected with Zika virus or Dengue virus. In some embodiments, the donor is a human. In some embodiments, each of the ABPs is recombinantly produced using sequences derived from B cells, plasma cells, or plasmablasts in a sample from more than one donor injected with one or more Zika antigens or Dengue antigens, or infected with Zika virus or Dengue virus, optionally wherein the donors are humans.

In some embodiments, an average binding titer of the RPP is at least 50 times higher than an average binding titer of antibodies in a serum sample from the same donor or donors, wherein the binding titer is measured by ELISA against Zika. In some embodiments, an average binding titer of the RPP is at least 100, 200, 300, 400, 500, 600, 700, 800, 900, or 1000 times higher than an average binding titer of antibodies in a serum sample from the same donor or donors, wherein the binding titer is measured by ELISA against Zika.

In some embodiments, an average neutralization titer of the RPP is at least 50 times higher than an average neutralization titer of antibodies in a serum sample from the same donor or donors, wherein the neutralization titer is measured by an in vitro assay. In some embodiments, an average neutralization titer of the RPP is at least 100, 200, 300, 400, 500, 600, 700, 800, 900, or 1000 times higher than an average neutralization titer of antibodies in a serum sample from the same donor or donors, wherein the neutralization titer is measured by an in vitro assay.

In some embodiments, an average activity of the RPP is at least 50 times higher than an average activity of antibodies in a serum sample from the same donor or donors, wherein the activity is measured by an in vitro pathogen neutralization assay or an in vitro binding to antigen assay or an in vivo efficacy assay. In some embodiments, an average activity of the RPP is at least 100, 200, 300, 400, 500, 600, 700, 800, 900, or 1000 times higher than an average activity of antibodies in a serum sample from the same donor or donors, wherein the activity is measured by an in vitro pathogen neutralization assay or an in vitro binding to antigen assay or an in vivo efficacy assay.

In one aspect, the present disclosure provides a pharmaceutical composition comprising the RPP provided herein and a pharmaceutically acceptable excipient.

In yet another aspect, the present disclosure provides a method of treating a subject in need thereof, the method comprising administering to the subject an effective amount of the RPPs or the pharmaceutical composition of the present disclosure. In some embodiments, the subject has a viral infection, optionally a Zika virus infection.

In some embodiments, the method further comprises administration of one or more agents.

In one aspect, the present disclosure provides a plurality of isolated polynucleotides, each polynucleotide encoding an ABP of the RPP described herein. In another aspect, the present disclosure provides a plurality of isolated vectors, each vector comprising a polynucleotide encoding an ABP of the RPP described herein. In some embodiments, the vector is an expression vector.

In yet another aspect, the present disclosure provides a plurality of host cells comprising the plurality of isolated polynucleotides or the plurality of the isolated vectors. In some embodiments, the method comprises culturing the host cells under conditions for expression of the RPP and isolating the RPP. In some embodiments, the RPP comprises full-length antibodies and the host cells are CHO cells. In some embodiments, the RPPs comprises scFv and the host cells are CHO cells. In some embodiments, host cells are production host cells.

The present disclosure also provides an isolated polypeptide comprising a cognate pair of heavy chain CDR3 and light chain CDR3, wherein the heavy chain CDR3 has a sequence selected from SEQ ID Nos: 2, 4, 6, through 25838 (even numbers) and the light chain CDR3 has a sequence selected from SEQ ID Nos: 1, 3, 5, through 25837 (odd numbers).

In some embodiments, the isolated polypeptide comprises a heavy chain CDR3 having the sequence of SEQ ID NO: [n+1] and a light chain CDR3 having the sequence of SEQ ID NO: [n], wherein n is an odd number from 1 to 25837.

In one aspect, the present disclosure provides an isolated polypeptide comprising a cognate pair of heavy chain and light chain, wherein a. a heavy chain CDR1 having the sequence of GFTFSSYA (SEQ ID NO: 25841), a heavy chain CDR2 having the sequence of ISGSGGST (SEQ ID NO: 25847), and a heavy chain CDR3 having the sequence of AKEGMVLRYFDWLWDY (SEQ ID NO: 25856); b. a heavy chain CDR1 having the sequence of GFTFSSYG (SEQ ID NO: 25842), a heavy chain CDR2 having the sequence of I[W/S]YDGSNK (SEQ ID NO: 25848), and a heavy chain CDR3 having the sequence of R[D/E][R/L][SN/L]SG[P/W]S[G/H]FDY (SEQ ID NO: 25857); c. a heavy chain CDR1 having the sequence of GFTFSSYA (SEQ ID NO: 25841), a heavy chain CDR2 having the sequence of ISGSGGST (SEQ ID NO: 25847), and a heavy chain CDR3 having the sequence of A[K/E/R][E/T][Q/L/T][L/W/I][LN/W/N][G/L]V[V/P/L][F/L/N][D/N]Y (SEQ ID NO: 25858); d. a heavy chain CDR1 having the sequence of GFTFDD[Y/H]G (SEQ ID NO: 25843), a heavy chain CDR2 having the sequence of INWNG[G/D]ST (SEQ ID NO: 25849), and a heavy chain CDR3 having the sequence of AR[D/N][R/G]GS[S/T][G/S/W/F][W/F/Y][R/F/Y]D[W/A]FD [P/I] (SEQ ID NO: 25859); or e.a heavy chain CDR1 having the sequence of GFTFSD[Y/D][Y/F] (SEQ ID NO: 25844), a heavy chain CDR2 having the sequence of ISGSG[S/Y]TI (SEQ ID NO: 25850), and a heavy chain CDR3 having the sequence of ARDEGY[R/S]GY[V/N]LD[T/N/S] (SEQ ID NO: 25860).

In one aspect, the present disclosure provides an isolated polynucleotide encoding the isolated polypeptide of described herein.

In one aspect, the present disclosure provides a cell comprising the isolated polypeptide.

In one aspect, the present disclosure provides a method of generating a recombinant polyclonal proteins (RPP) (also called a Recombinant Zika Immune Globulin (rZIG)), comprising a. providing B cells, plasma cells, or plasmablasts of a donor exposed to an antigen of Zika or Dengue virus; b. amplifying a cognate pair of polynucleotides encoding a light chain variable region and a heavy chain variable region from a single cell out of the plasma cells or plasmablasts by overlap extension reverse transcriptase polymerase chain reaction (OE-RT-PCR); c. cloning polynucleotides obtained from the amplification into expression vectors, thereby obtaining constructs encoding the RPP; d. expressing the RPP from the constructs; e. enriching a subset of the constructs based on activity of the RPP or a member of the RPP against Zika; and f obtaining the RPP (also called a Recombinant Zika Immune Globulin (rZIG)).

In another aspect, the present disclosure provides an RPP (also called a Recombinant Zika Immune Globulin (rZIG)) obtained by the method described herein. The present disclosure also provides a Recombinant Zika Immune Globulin (rZIG) produced using the methods described in Example 2. The present disclosure further provides a method for producing an rZIG as described in Example 2. In one aspect, the present disclosure provides an rZIG produced using the methods described in Example 3. It also provides a method for producing an rZIG as described in Example 3.

6. DESCRIPTION OF THE DRAWINGS AND TABLES

FIG. 1 illustrates construct PMD-4681 used for random integration into CHOZN cells.

FIGS. 2A and 2B summarize the steps used to generate libraries of scFv constructs. (FIG. 2A) First, IgH and IgK mRNA transcripts are reverse transcribed into cDNA and then amplified with a pool of VH, VK, CH1, and CK1 primers. (FIG. 2B) The CK1 and VH primers have linkers, which drive fusion of the individual IgH and IgK amplicons into a linked scFv construct. This construct is used for cloning into antibody expression construct libraries.

FIG. 3A to 3D are tables with characteristics of the donors used to create candidate RPP libraries. SOB=shortness of breath; ST=sore throat.

FIG. 5 is a table with a list of assays used to characterize the rCIG RPP candidate.

FIG. 6 is a table with results of assays used to characterize rCIG RPPs.

FIG. 7C illustrates the process of enriching binders to a soluble antigen using a yeast scFv display system.

FIG. 7D illustrates the two-step process comprising (i) Gibson assembly of converting the scFv fragment to full-length antibody expression constructs and (ii) stably integrating the constructs into CHO cells following electroporation and selection.

Figure 8A:
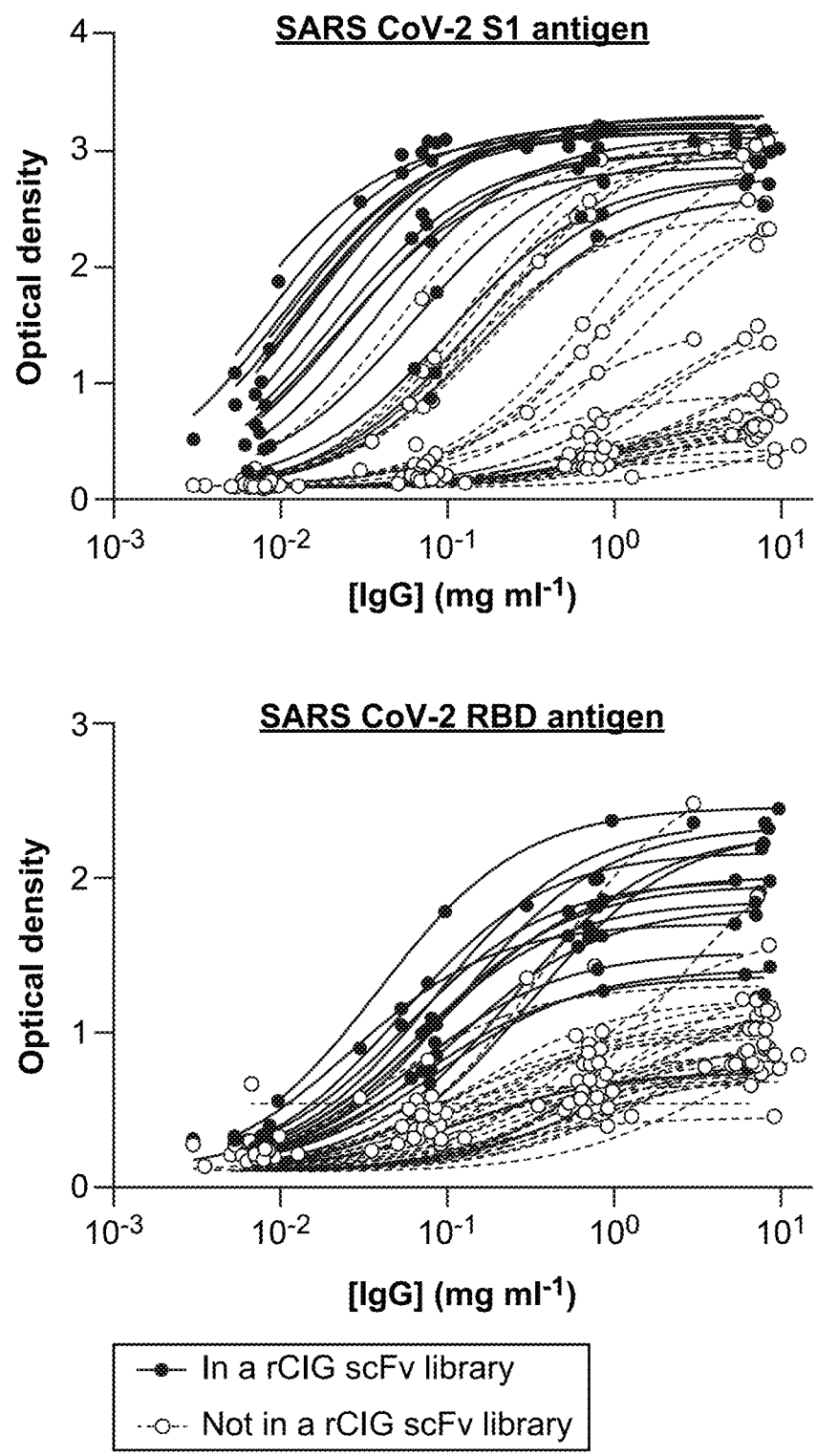

FIG. 8A provides optical density measured by ELISA of individual human plasma donors against SARS-CoV-2 S1 antigen (top) or RBD antigen (bottom). Each data point represents a single measurement at a single test article dilution in a single experiment.

Figure 8B:
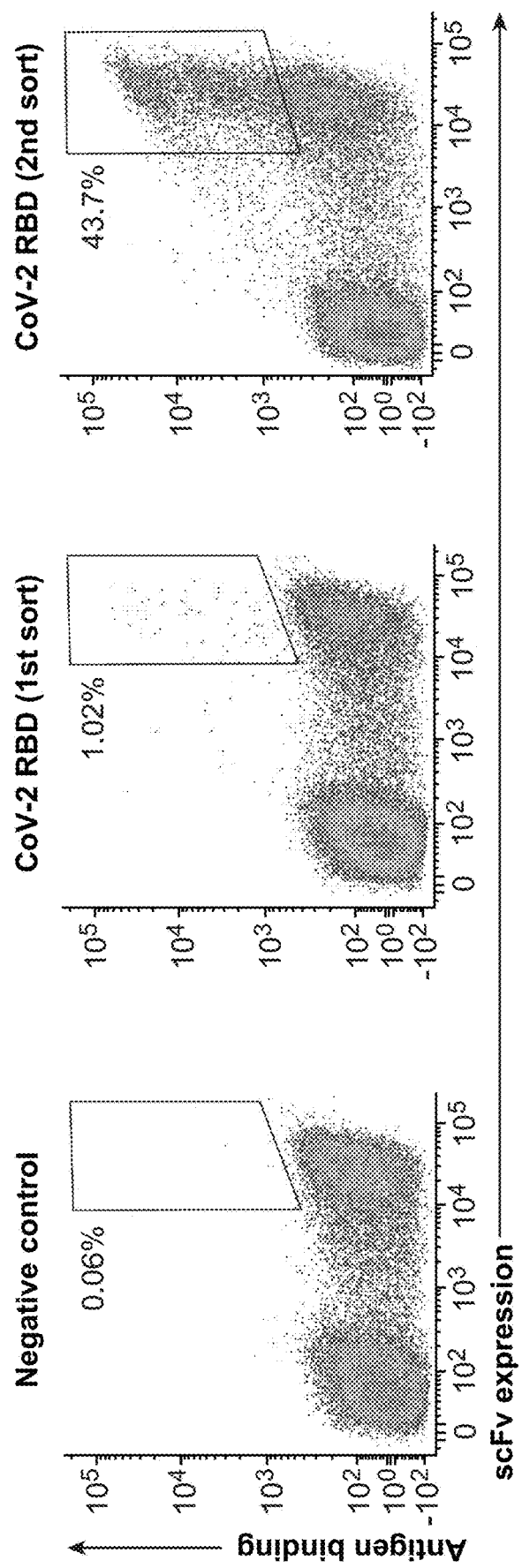

FIG. 8B shows FACS enrichment of scFv against CoV-2 RBD from library 1 using yeast display. The x axis measures presence of a C-terminal c-Myc tag, indicating expression of an scFv on the surface of the cell. They axis measures binding of antigen to the scFv-expressing cells. The gates used for yeast selection (double positive) are indicated, with the percentage of scFv-expressed antigen binders in grey-scale. Each plot summarizes a single FACS experiment with one yeast scFv library.

Figure 8C:
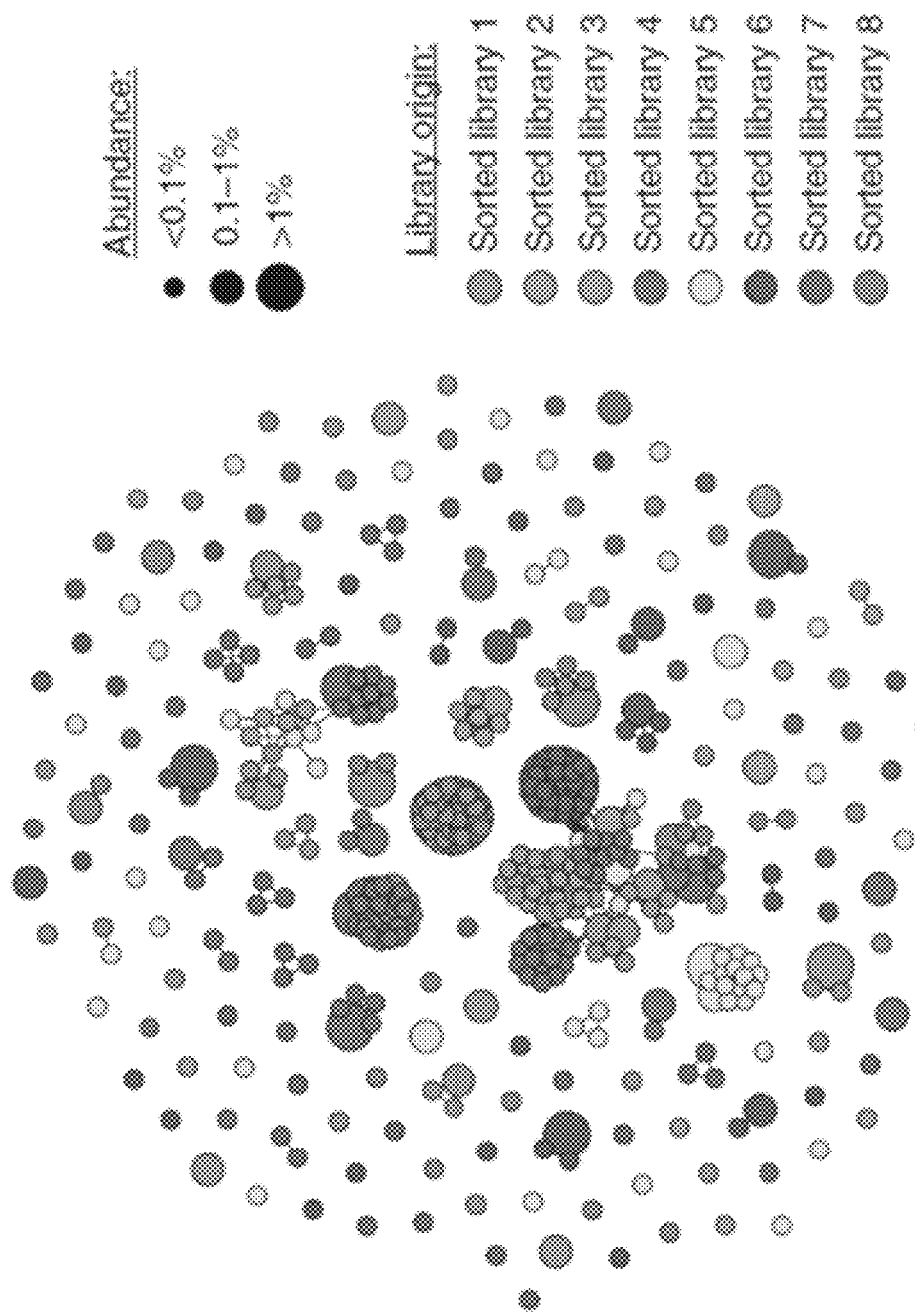

FIG. 8C provides clonal cluster analysis of rCIG antibodies. Each node represents an antibody clone (full-length heavy chain). The greyscale shades of the nodes indicate the sorted scFv library from which the CHO antibody clones were derived. The size of the nodes reflects the frequency of the clones in the final CHO cell bank (only clones ≥0.01% are plotted). The total number of amino acid differences between each pairwise alignment, and edges indicate ≤5 amino acid differences were computed.

Figure 8D:
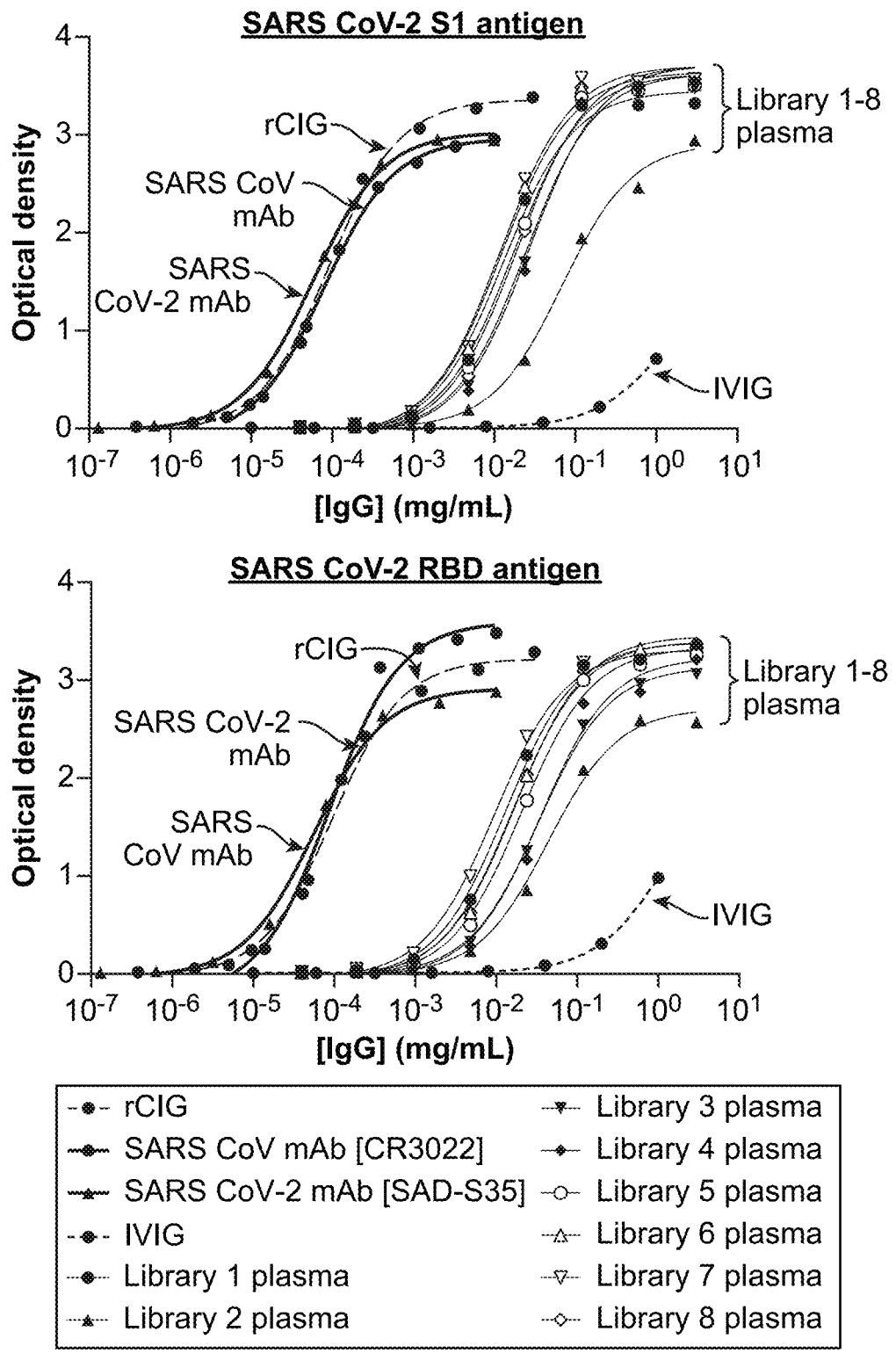

FIG. 8D provides optical density measured by ELISA of the indicated samples against SARS-CoV-2 S1 antigen (top) or RBD antigen (bottom). Each data point represents a single measurement at a single test article dilution, in a single experiment.

Figure 8E:
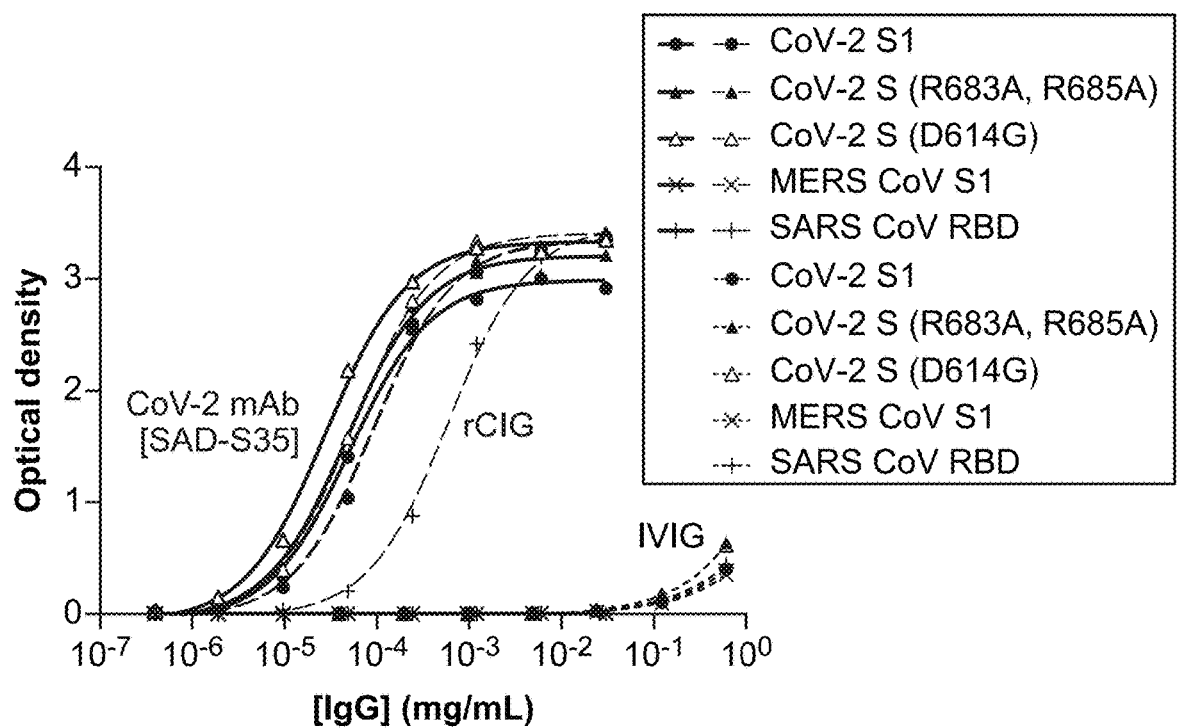

FIG. 8E provides optical density measured by ELISA of the indicated samples against the indicated antigens (different shapes). For rCIG, no binding was observed against MERS CoV S1. For the CoV-2 mAb (SAD-S35), no binding was observed against MERS CoV S1 and SARS-CoV RBD. Each data point represents a single measurement at a single test article dilution, in a single experiment.

Figure 8F:
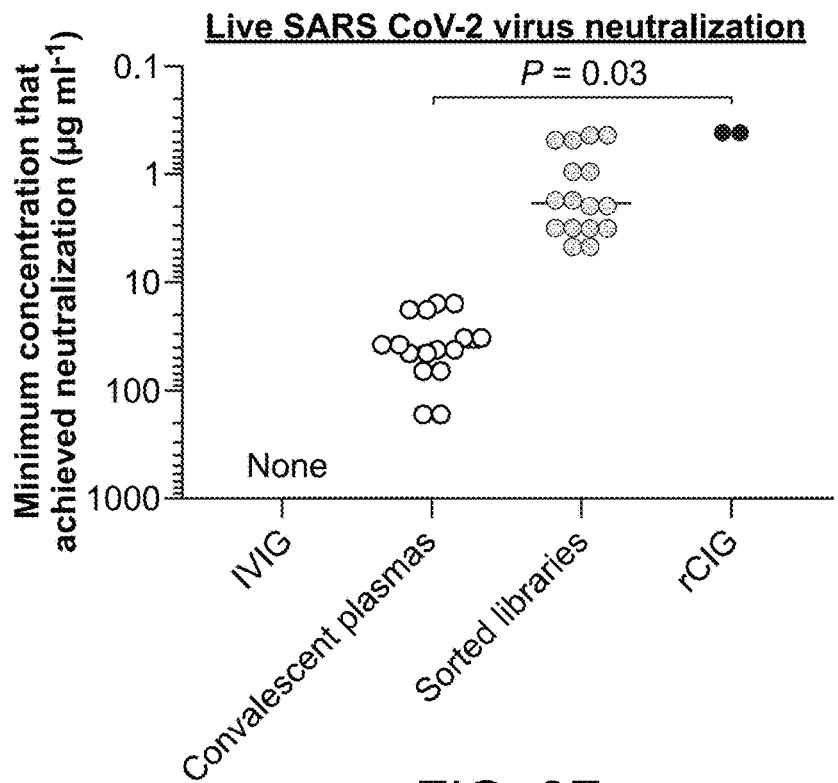

FIG. 8F shows live virus neutralization. Individual dots are separate test articles that represent the minimum antibody concentration that achieved neutralization. Bars represent median measurements for each test article category. Each test article was run in duplicate using different aliquots of cells and virus, in a single experiment, with the same result observed for each replicate. No neutralization was seen for IVIG. A Wilcoxon rank sum test was used to compare the minimum concentration to achieve SARS-CoV-2 live virus neutralization between convalescent plasma measurements (n=16) and rCIG measurements (n=2).

Figure 9A:
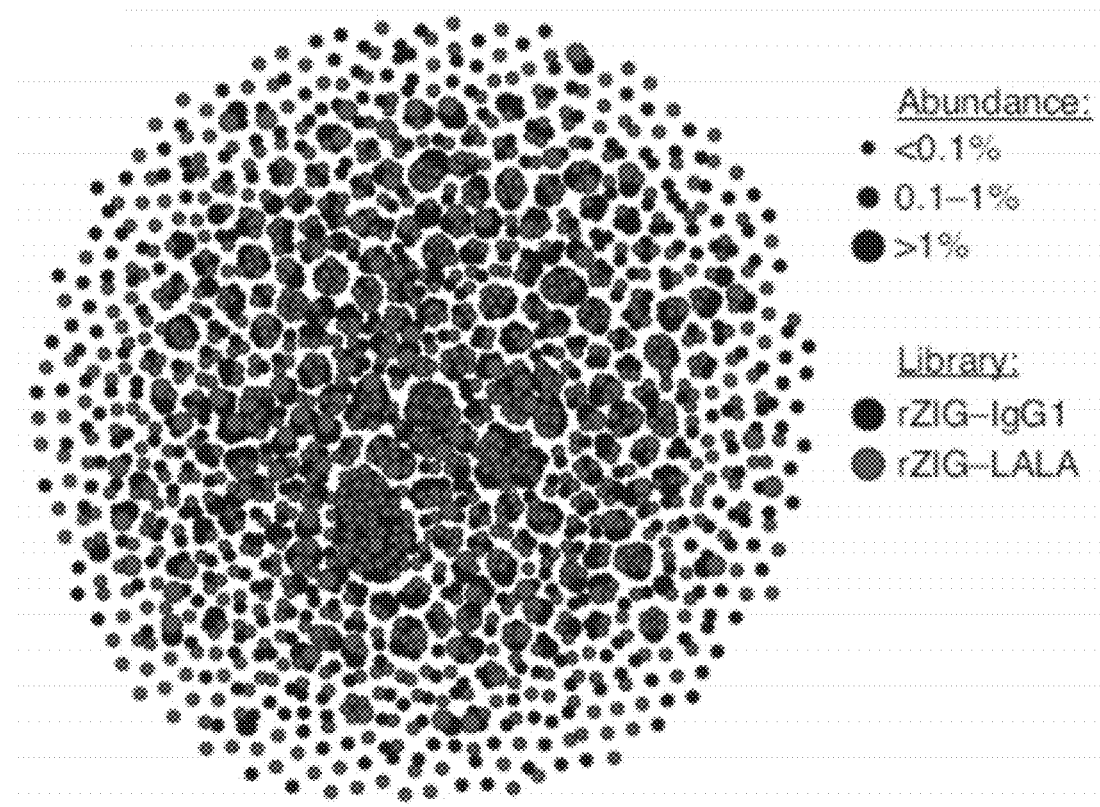

FIG. 9A shows clonal cluster analysis of rZIG-IgG1 and rZIG-LALA antibodies. Each node represents an antibody clone (full-length heavy chain). The size of the nodes reflects the frequency of the clones in the final CHO cell bank (only clones ≥0.01% are plotted). The total number of amino acid differences between each pairwise alignment was computed after combining both libraries together, and edges indicate ≤5 amino acid differences.

Figures 9B, 9C:
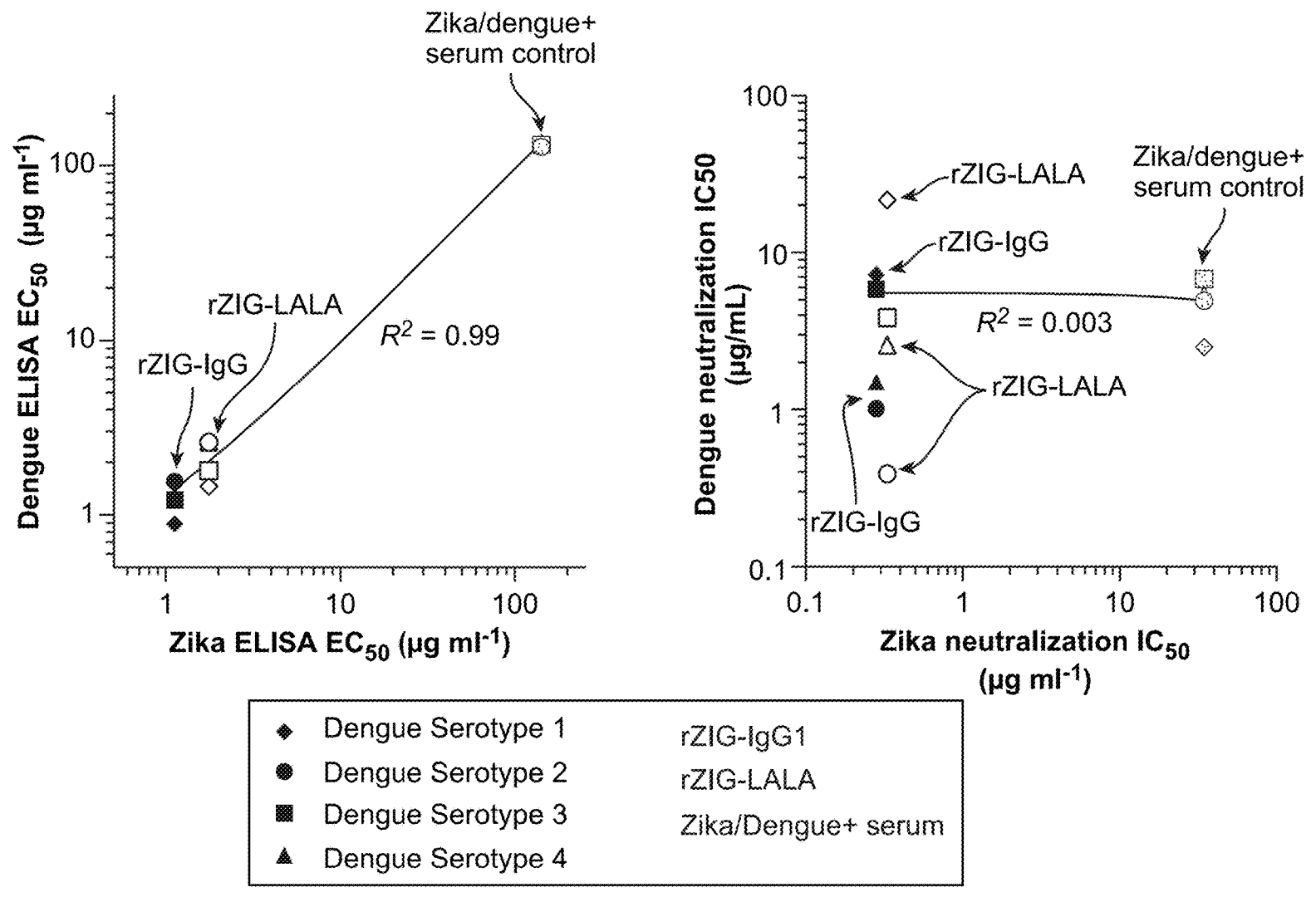

FIG. 9B provides ELISA results of rZIG-IgG1, rZIG-LALA, and Zika/dengue+ serum control for dengue serotypes 1-4 (y axis, indicated by shape) and Zika virus antigen (x axis). Each data point represents a single test article measured against a single dengue serotype. Linear regression trendline is indicated in black. Simple linear regression was used to calculate the coefficient of determination (R2) between Zika and dengue ELISA $EC_{50}$ values (n=7, in a single experiment). EC50 values for all dengue serotypes were pooled for the analysis. Significance of the regression model was determined using an F-statistic with 1 and 10 d.f.

FIG. 9C shows pseudotype neutralization by rZIG-IgG1, rZIG-LALA, and Zika/dengue+ serum control for dengue serotypes 1-4 (y axis, indicated by shape) and Zika virus antigen (x axis). Each data point represents a single test article measured against a single dengue serotype, in a single experiment. Linear regression trendline is indicated in black. Simple linear regression was used to calculate the coefficient of determination (R2) between Zika and dengue pseudotype neutralization $IC_{50}$ values (n=11). $IC_{50}$ values for all dengue serotypes were pooled for the analysis. Significance of the regression model was determined using an F-statistic with 1 and 10 d.f.

Figure 9D:
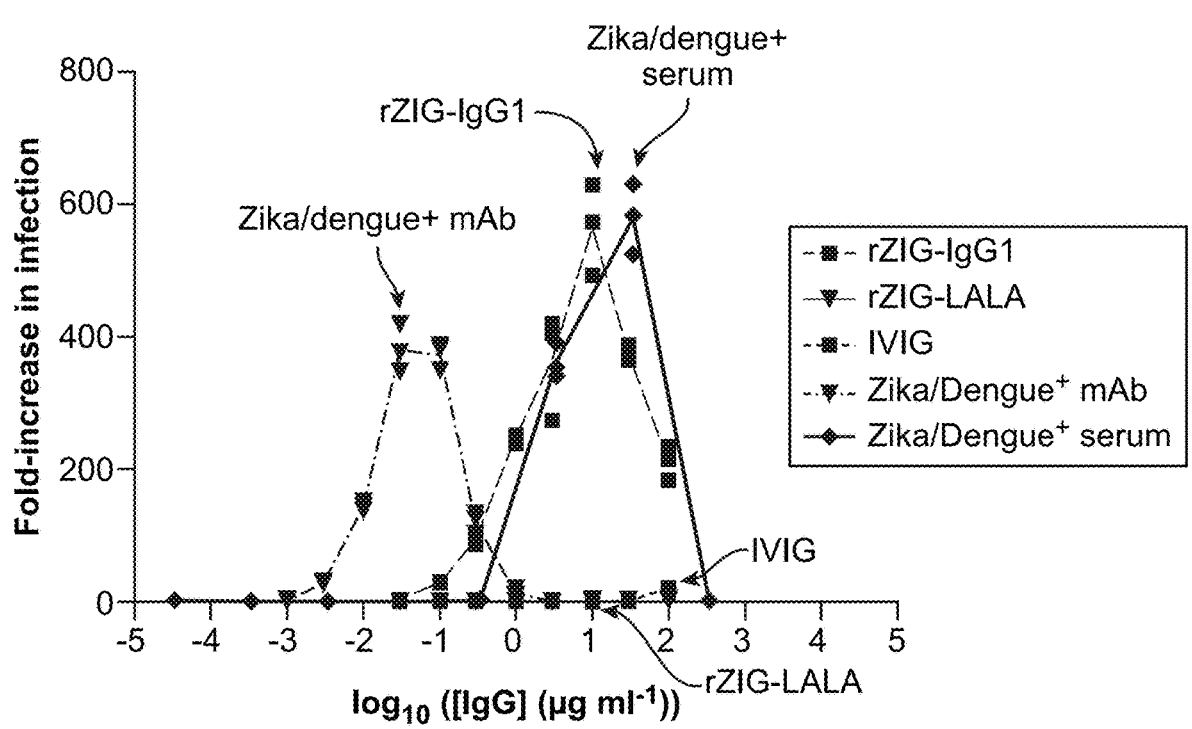

FIG. 9D shows Zika pseudotype virus ADE assay results for rZIG-IgG1, rZIG-LALA, and positive and negative controls. Test article concentration is on the x axis. Fold-increase infection is on they axis, which was the infection-induced luciferase signal observed in the presence of antibody divided by the luciferase signal observed with a no-antibody control. Each data point represents a single measurement at a single test article dilution, in a single experiment.

Figure 10A:
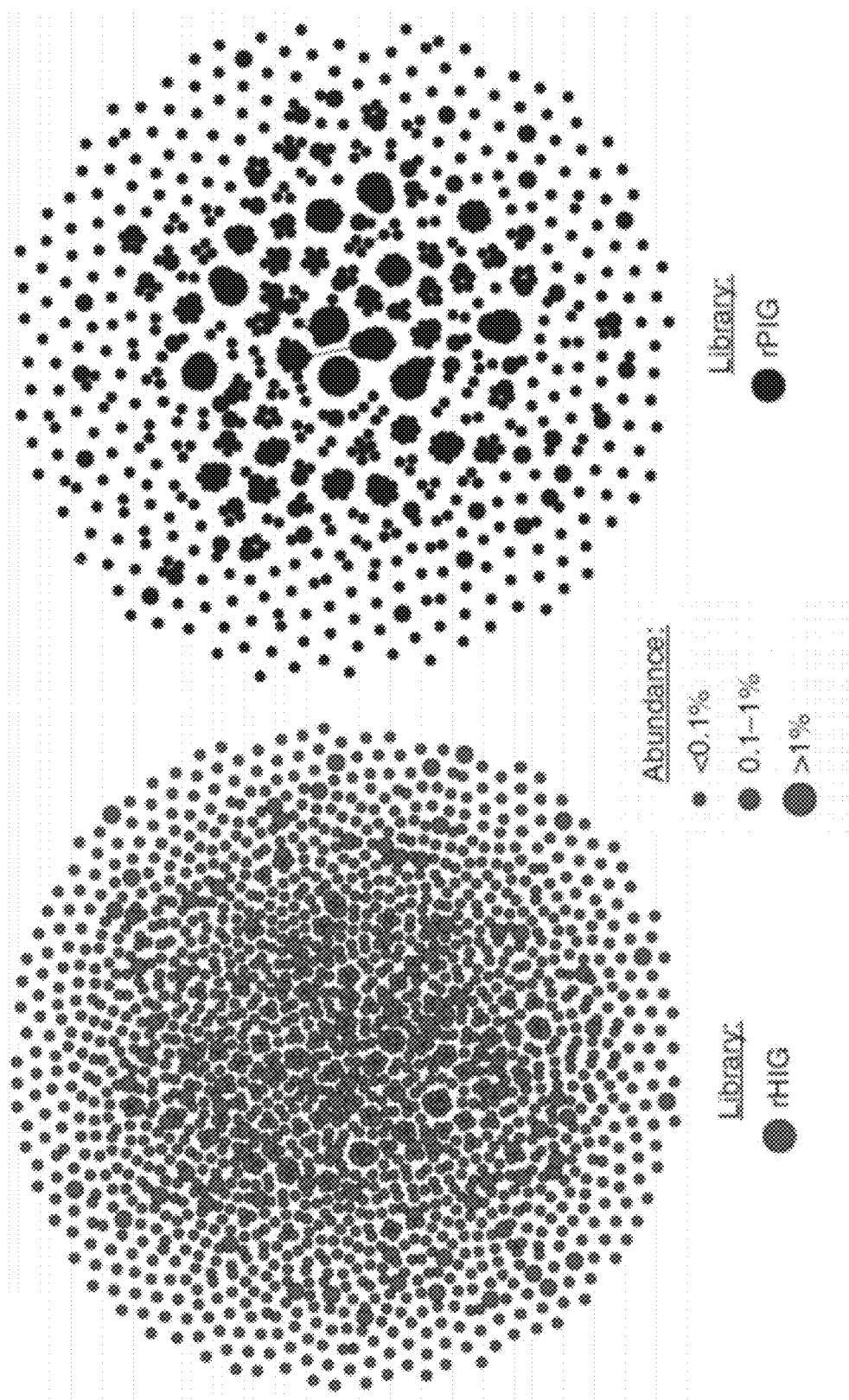

FIG. 10A shows clonal cluster analysis of rHIG and rPIG antibodies. Each node represents an antibody clone (full-length heavy chain). The size of the nodes reflects the frequency of the clones in the final CHO cell bank (only clones ≥0.01% are plotted). The total number of amino acid differences between each pairwise alignment, and edges indicate ≤5 amino acid differences were computed.

Figure 10B:
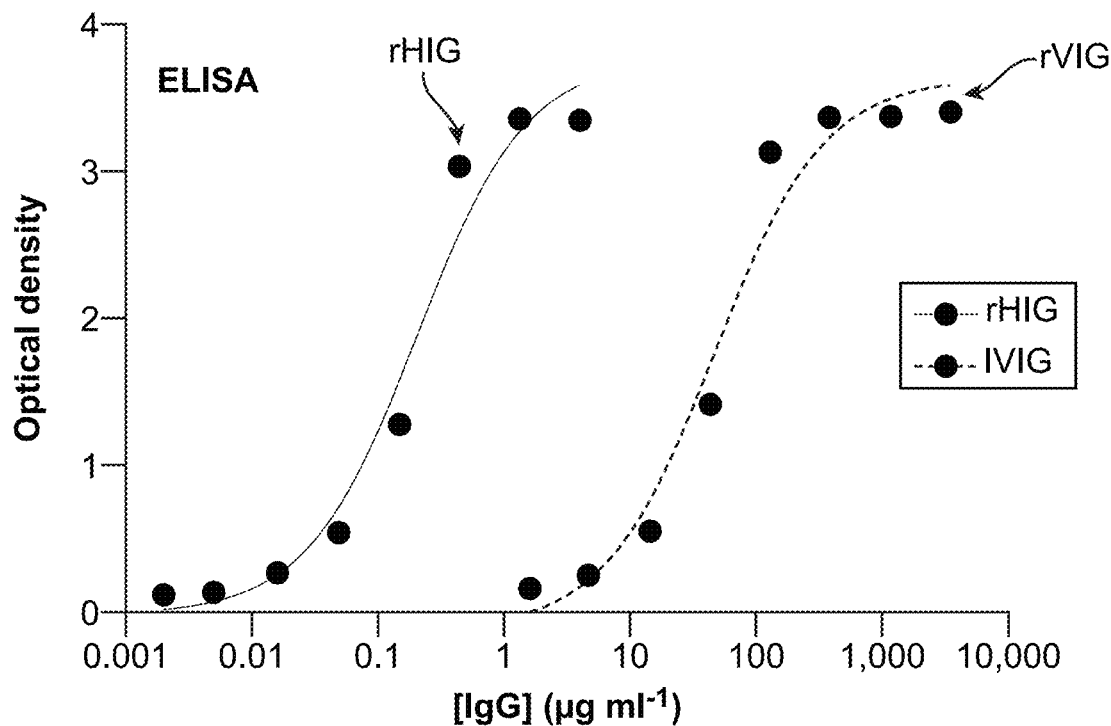

FIG. 10B shows optical density (y-axis) measure by Anti-Hib ELISA for rHIG and IVIG. Each data point represents a single measurement at a single test article dilution, in a single experiment.

Figure 10C:
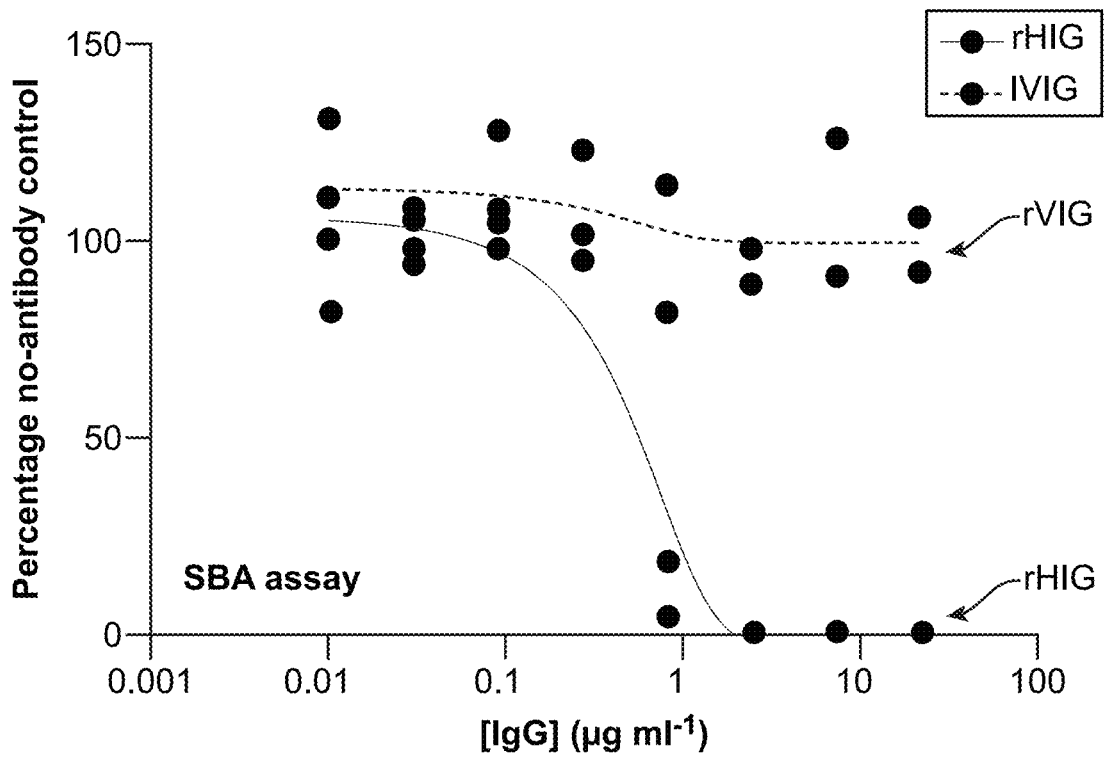

FIG. 10C shows results from serum bactericidal assay (SBA) for rHIG and IVIG with the ATCC 10211 Hib strain. Percentage of no-antibody control (y axis) was computed as the number of bacterial colonies in the test sample divided by the number of bacterial colonies in a no-antibody control sample. Each data point represents a single measurement at a single test article dilution, in a single experiment.

Figure 10D:
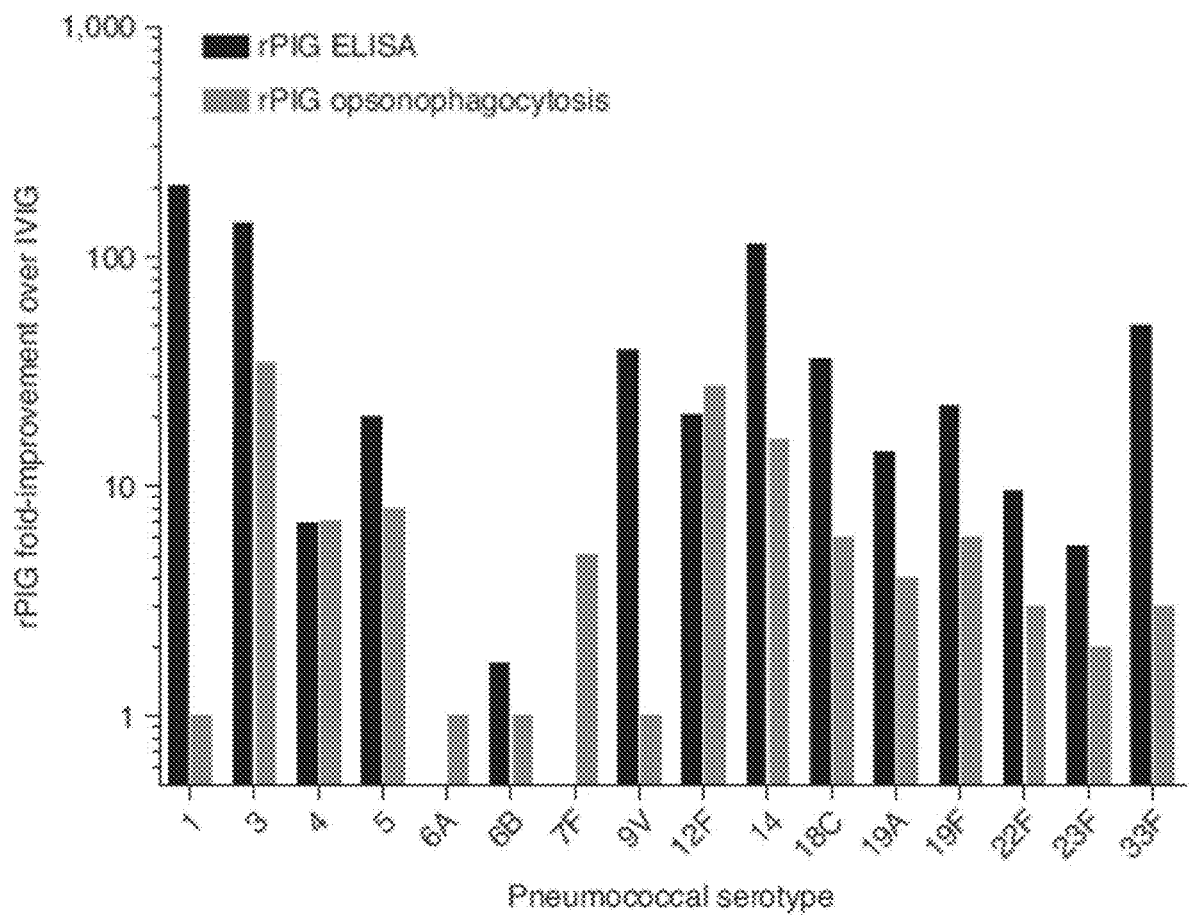

FIG. 10D shows rPIG fold-improvement over IVIG (y-axis) with respect to ELISA binding to (dark shade) or opsonophagocytosis of (light shade) the indicated pneumococcal serotype (x-axis). Fold improvement in binding/activity over IVIG was computed as a mean of duplicate measurements for rPIG divided by a mean of duplicate measurements for IVIG (based on the binding concentration for ELISA and the number of bacterial colonies for opsonophagocytosis). Fold improvement over IVIG, by assay (ELISA or opsonophagocytosis) was tested using a one-sample Wilcoxon signed rank test, with the null hypothesis that the median equals 1, that is, $H_0=1$. For each assay, all individual serotypes were pooled a single Wilcoxon signed rank test. Values for each individual serotype were generated by dividing the mean of duplicate rPIG measurements by the mean of duplicate IVIG measurements.

FIG. 10E provides in vivo assay data with ATCC 10211 Hib strain. Each circle represents CFU Hib per ml (y axis) from either peritoneal fluid or blood from a single mouse in a given test group. Black bars represent mean of the CFU Hib per ml. Dotted lines represent the lower limit of detection for CFU quantification. Welch's t-tests were used to compare CFU Hib per ml between test groups (n=8 mice per group, in a single experiment). d.f. were 7.87 for IVIG+rHIG/rPIG (500 mg kg$^{-1}$) and 7.13 for IVIG+rHIG/rPIG (200 mg kg$^{-1}$) in peritoneal fluid. d.f. were 10.87 for IVIG+rHIG/Rpig (500 mg kg$^{-1}$) and 8.03 for IVIG+rHIG/rPIG (200 mg kg$^{-1}$) in blood.

Figure 11A:
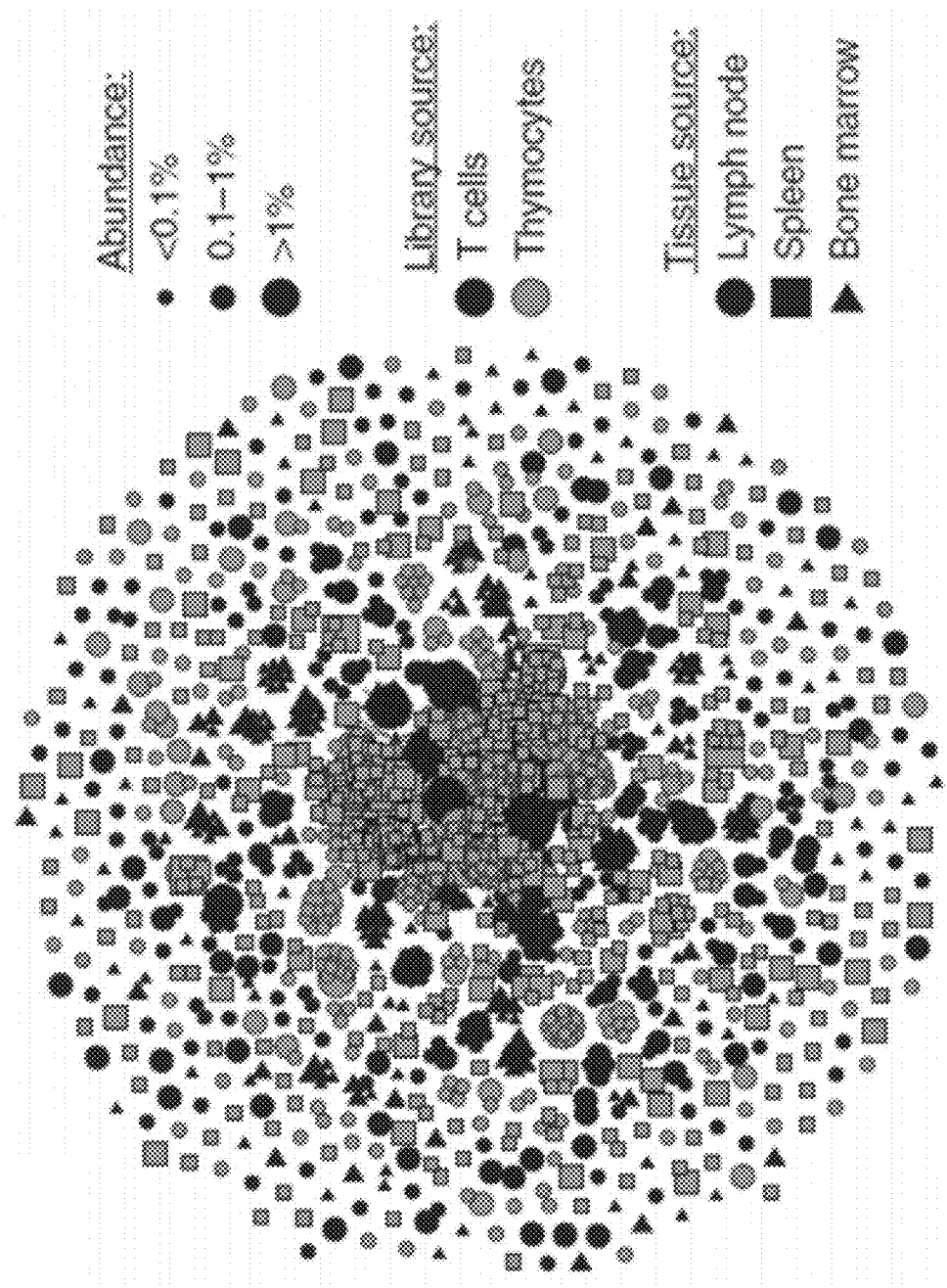

FIG. 11A provides clonal cluster analysis of rhATG antibodies. Each node represents an antibody clone (full-length heavy chain). The color of the nodes indicates the immunized library source. The shape of the nodes indicates the mouse tissue origin. The size of the nodes reflects the frequency of the clones in the final CHO cell bank (only clones ≥0.01% are plotted). The total number of amino acid differences between each pairwise alignment, and edges indicate ≤5 amino acid differences were computed.

Figure 11B:
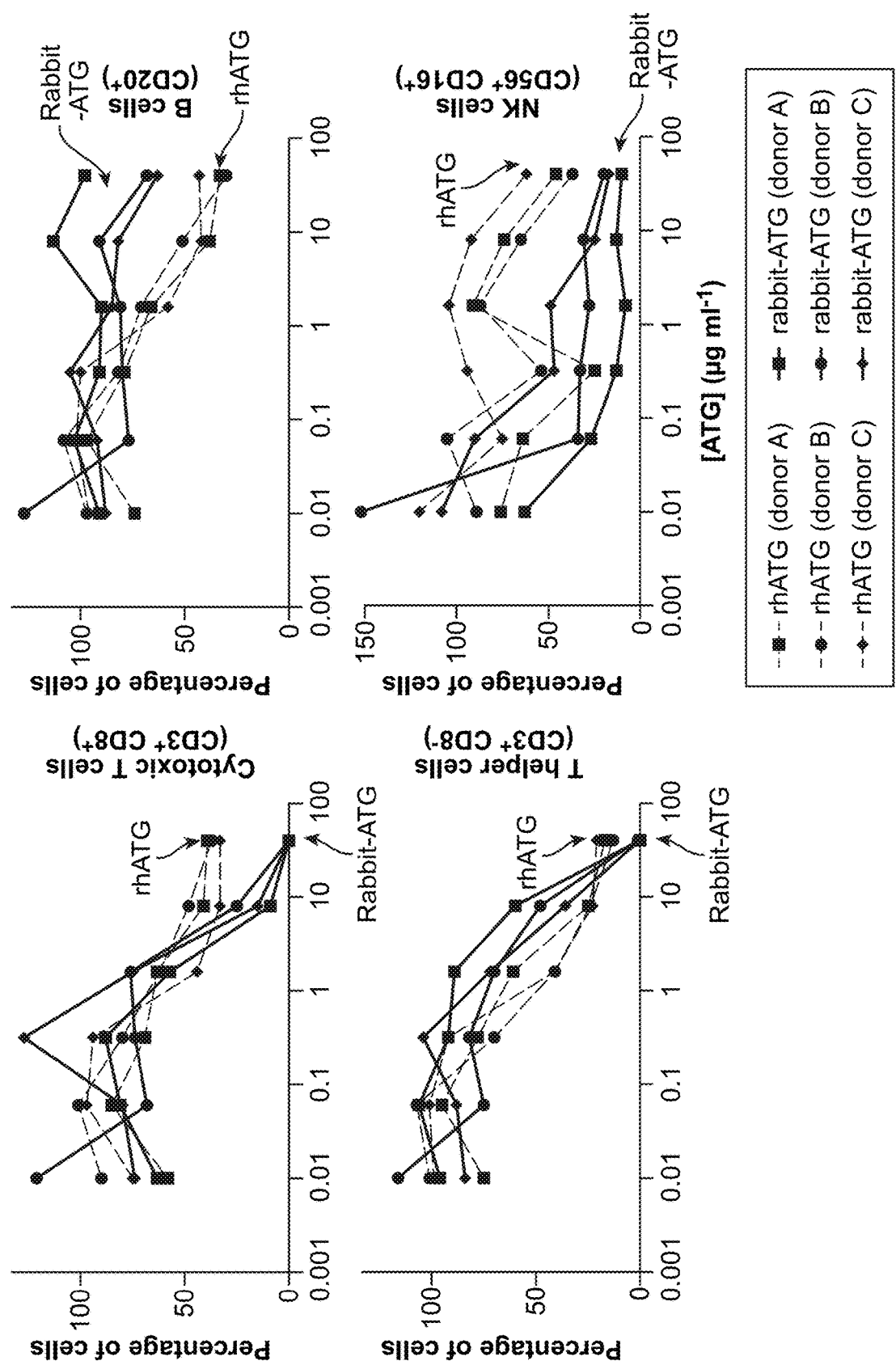

FIG. 11B shows results from cell killing assays of a dilution series of rabbit-ATG and rhATG with three PBMC donors. They axis (% cells) was determined by dividing the number of cells of the indicated cell type present after overnight incubation with the indicated amount of antibody by the number of cells of that cell type present in a no-antibody control. Each data point represents a single measurement at a single test article dilution, in a single experiment. Linear mixed effects models were used to compute P values for each of the four cell types, with group and concentration as fixed effects and PBMC donor as a random effect to account for the dependence of repeated measures. d.f. were 31 for each of the four models. NK, natural killer.

Figures 11C, 11D:
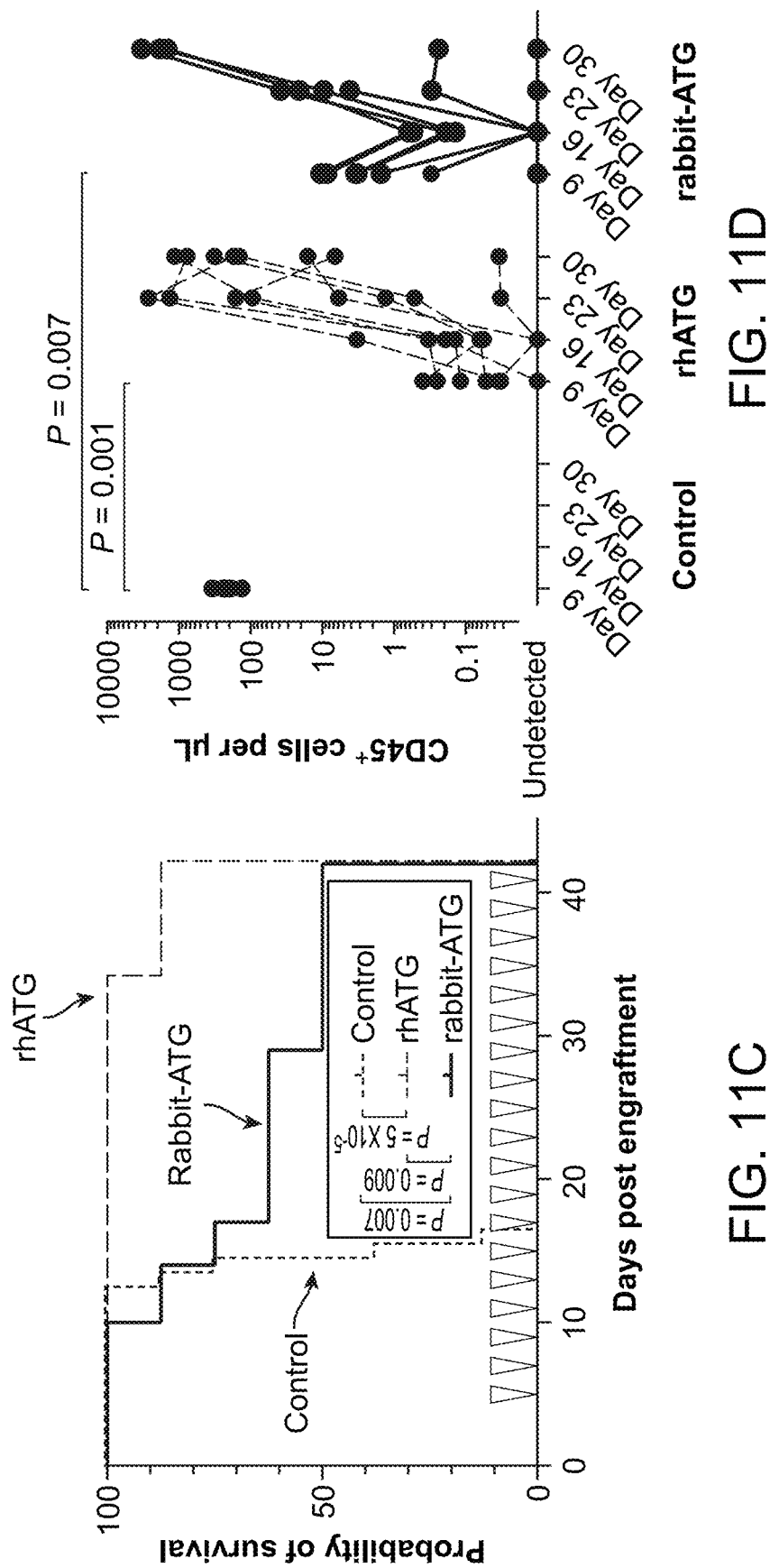

FIG. 11C shows survival of mice (n=8 per treatment group, in a single experiment) in the GVH study using PBMC donor 1 treated every other day with a negative vehicle control, rabbit-ATG or rhATG. Treatment days are indicated by green triangles. Kaplan-Meier survival models were fit on time to mortality and pairwise log-rank tests were performed to compare median survival between treatment groups.

FIG. 11D shows the concentration of CD45+ cells determined by flow cytometry in each alive mouse on days 9, 16, 23 and 30 of the GVH study from FIG. 11C for negative vehicle control, rhATG or rabbit-ATG. Lines connect measurements from each mouse. No CD45+ cells were observed where circles intercept the x axis. Linear mixed effects models were used to compute P values for trends in CD45+ cell counts in each of the four GVH experiments (2 PBMC donors×2 drug dosing regimens=4 experiments) with day as a fixed effect and PBMC donor as a random effect to account for the dependence of repeated measures. A Wilcoxon rank sum test was used to compare CD45+ cell counts on day 9 for saline negative control versus rhATG and saline negative control versus rabbit-ATG, in each of the four GVH experiments (2 PBMC donors×2 drug dosing regimens=4 experiments).

Figure 12A:
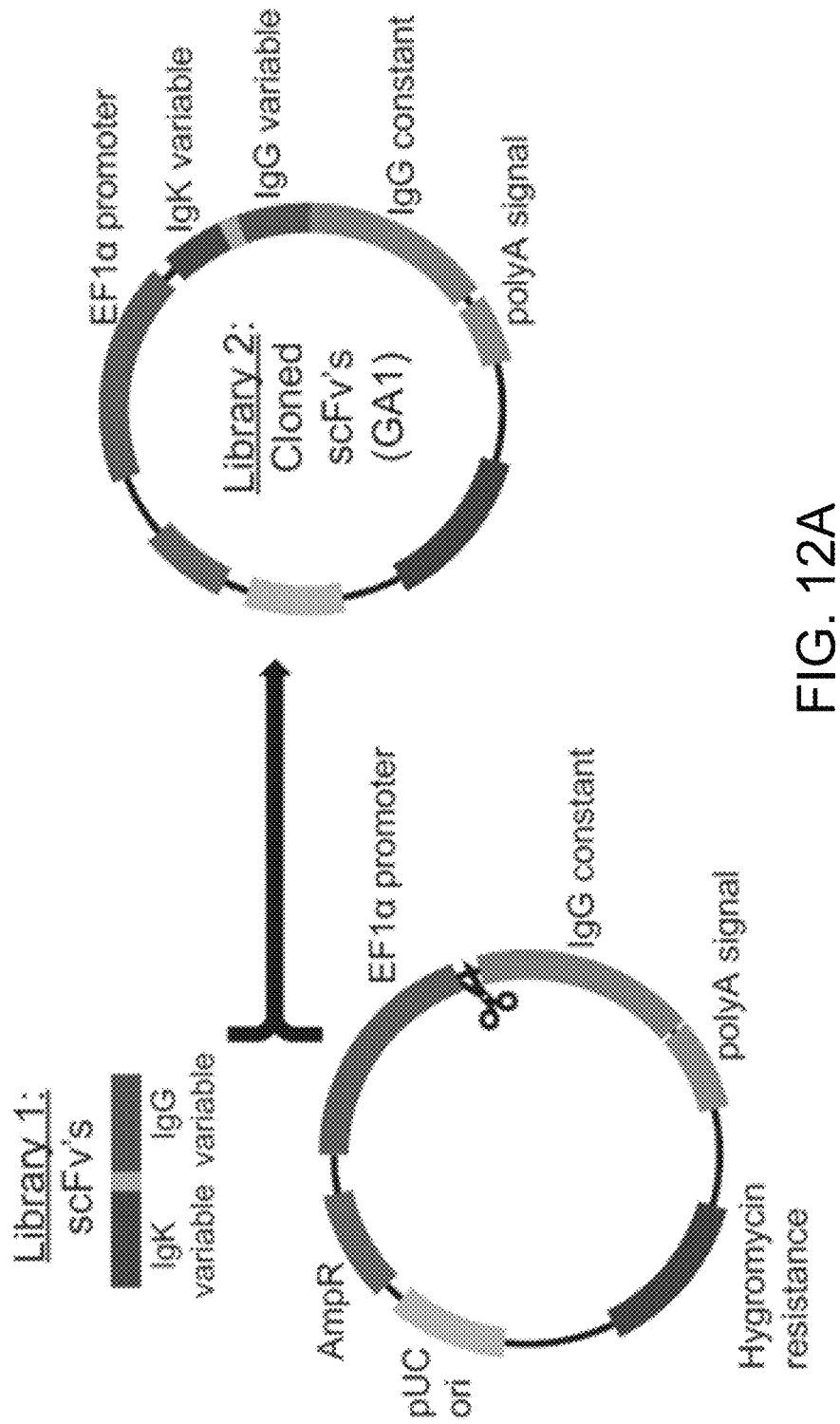
Figure 12B:
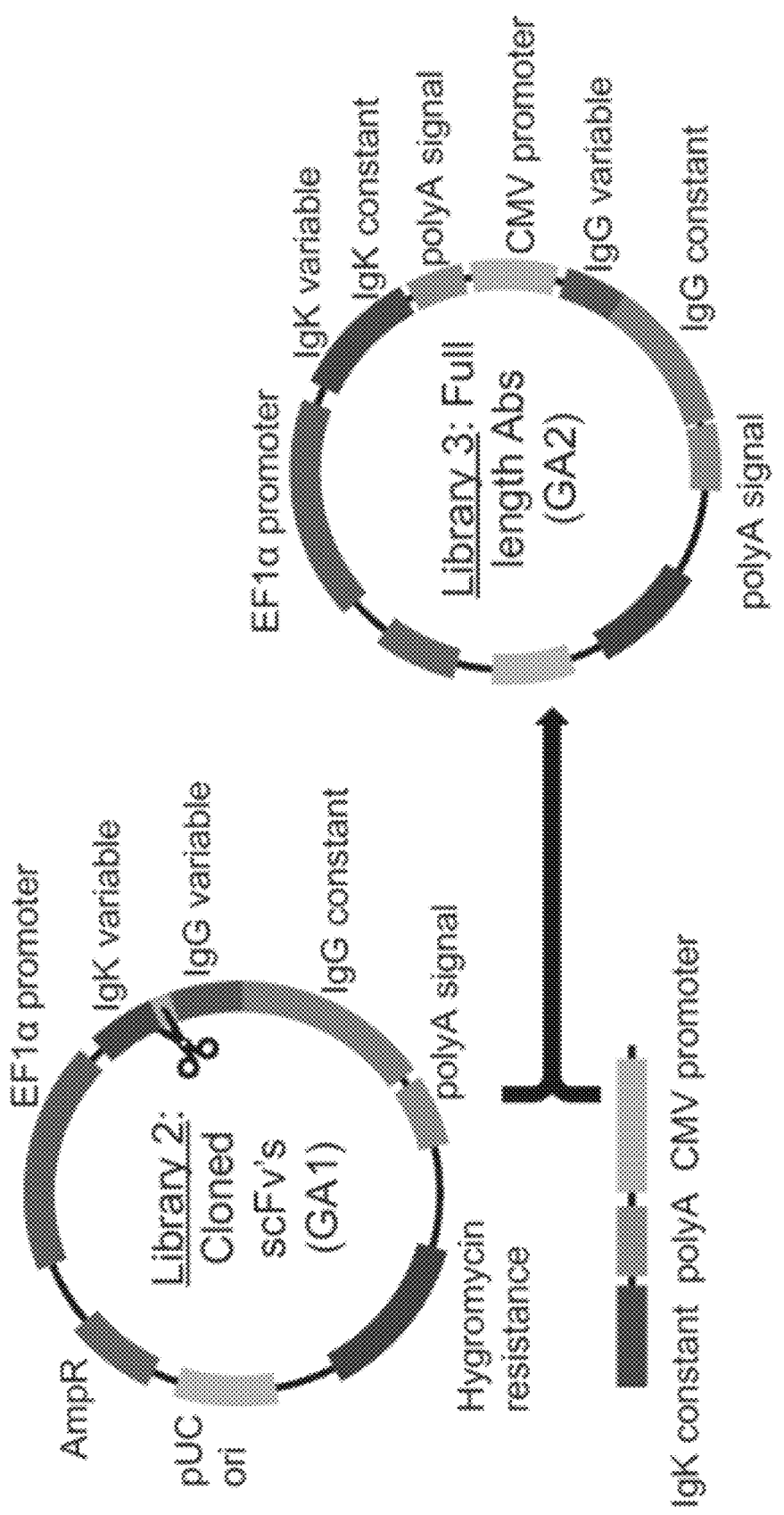

FIGS. 12A and 12B provide schematic of Gibson assembly processes. (FIG. 12A) Product of Gibson Assembly 1 (GA1), comprising the based plasmid vector with an scFv (from Library 1) cloned between the EF1α promoter and the IgG constant domain sequence. (FIG. 12B) Product of Gibson Assembly 2 (GA2), with the scFv linker excised and replaced with a sequence that comprises an IgK constant domain sequence, a poly(A) signal sequence, and a CMV promoter.

Figure 13A:
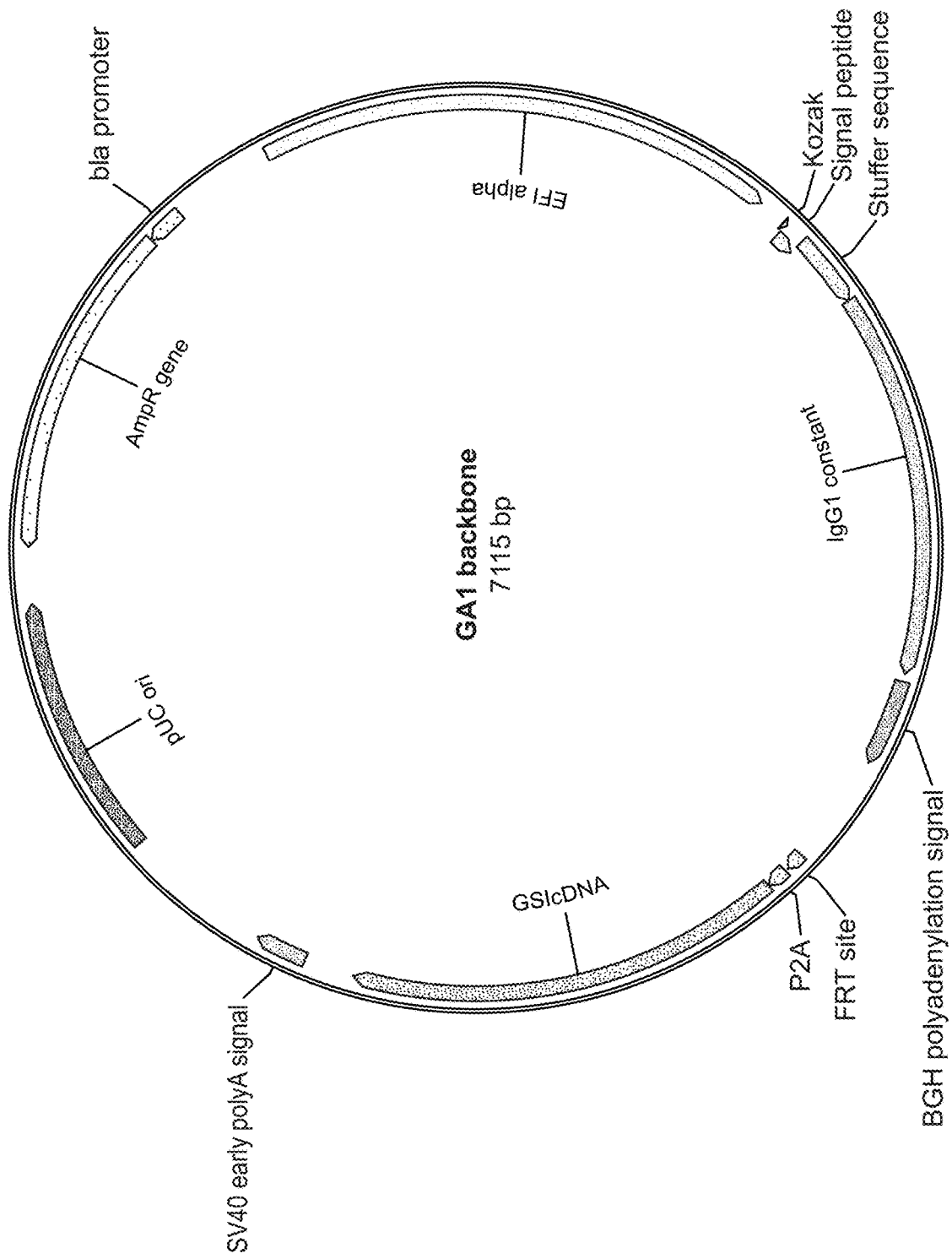

FIG. 13A Gibson Assembly 1 (GA1) backbone (GenBank accession MW079271).

Figure 13B:
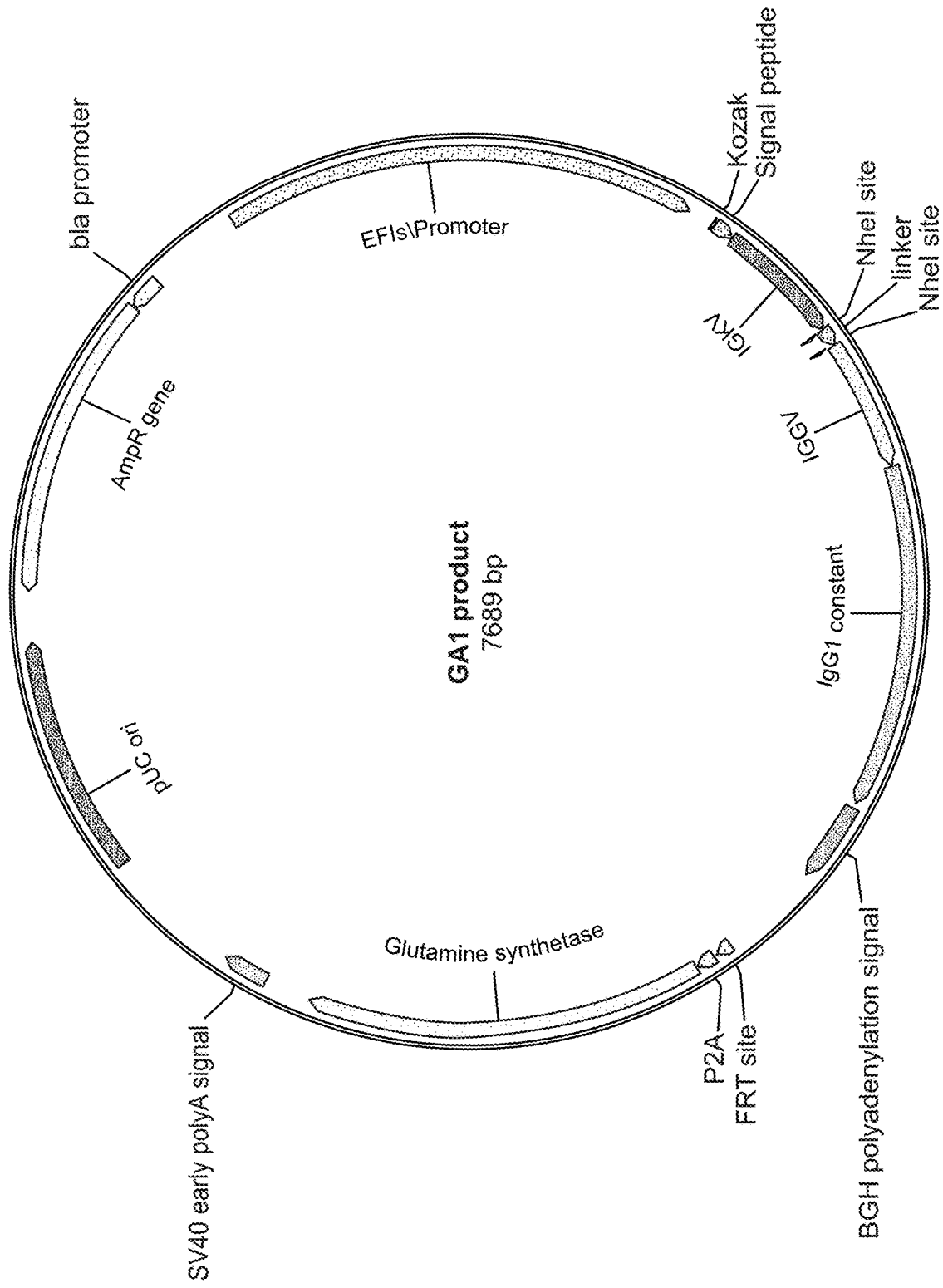

FIG. 13B Product of Gibson Assembly 1 (GA1) after insertion of an scFv sequence (GenBank accession MW079272).

Figure 13C:
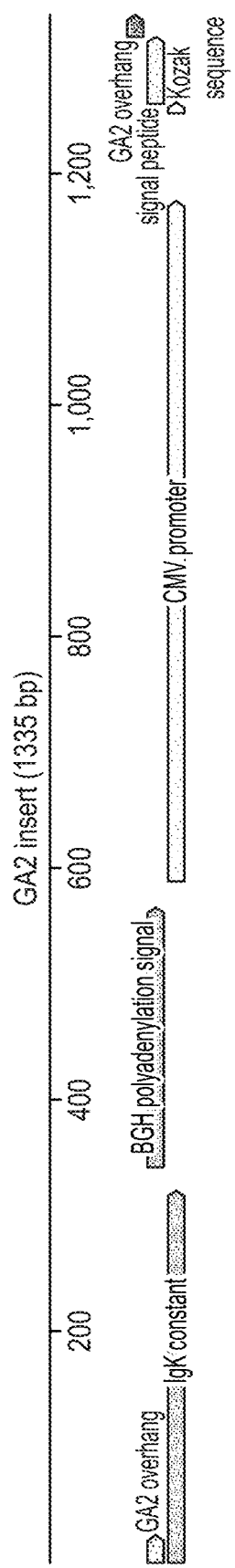

FIG. 13C The linear Gibson Assembly 2 (GA2) insert sequence (GenBank accession MW079275).

Figure 13D:
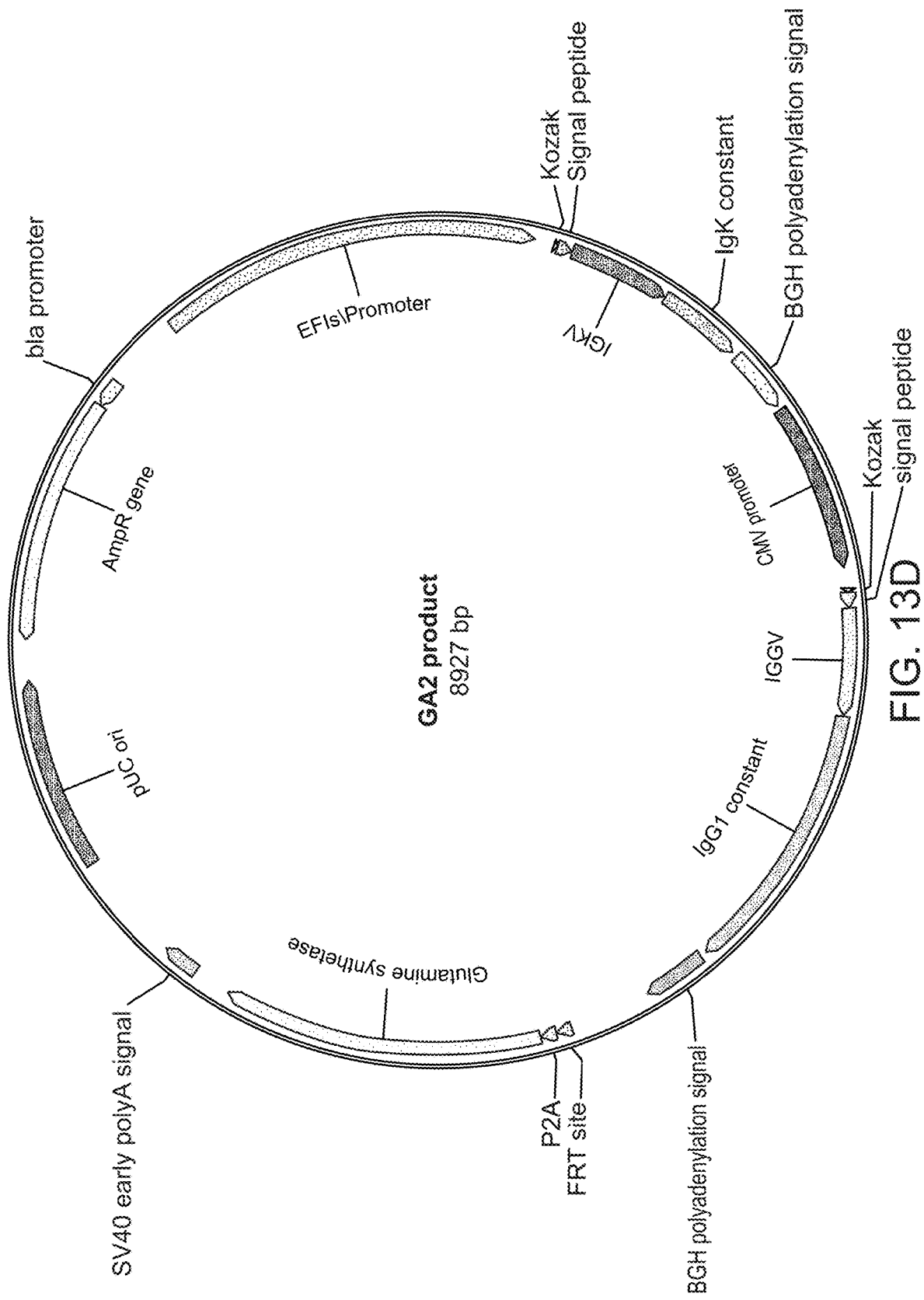

FIG. 13D Product of Gibson Assembly 2 (GA2) after insertion of the GA2 insert (GenBank accession MW079273).

Figure 13E:
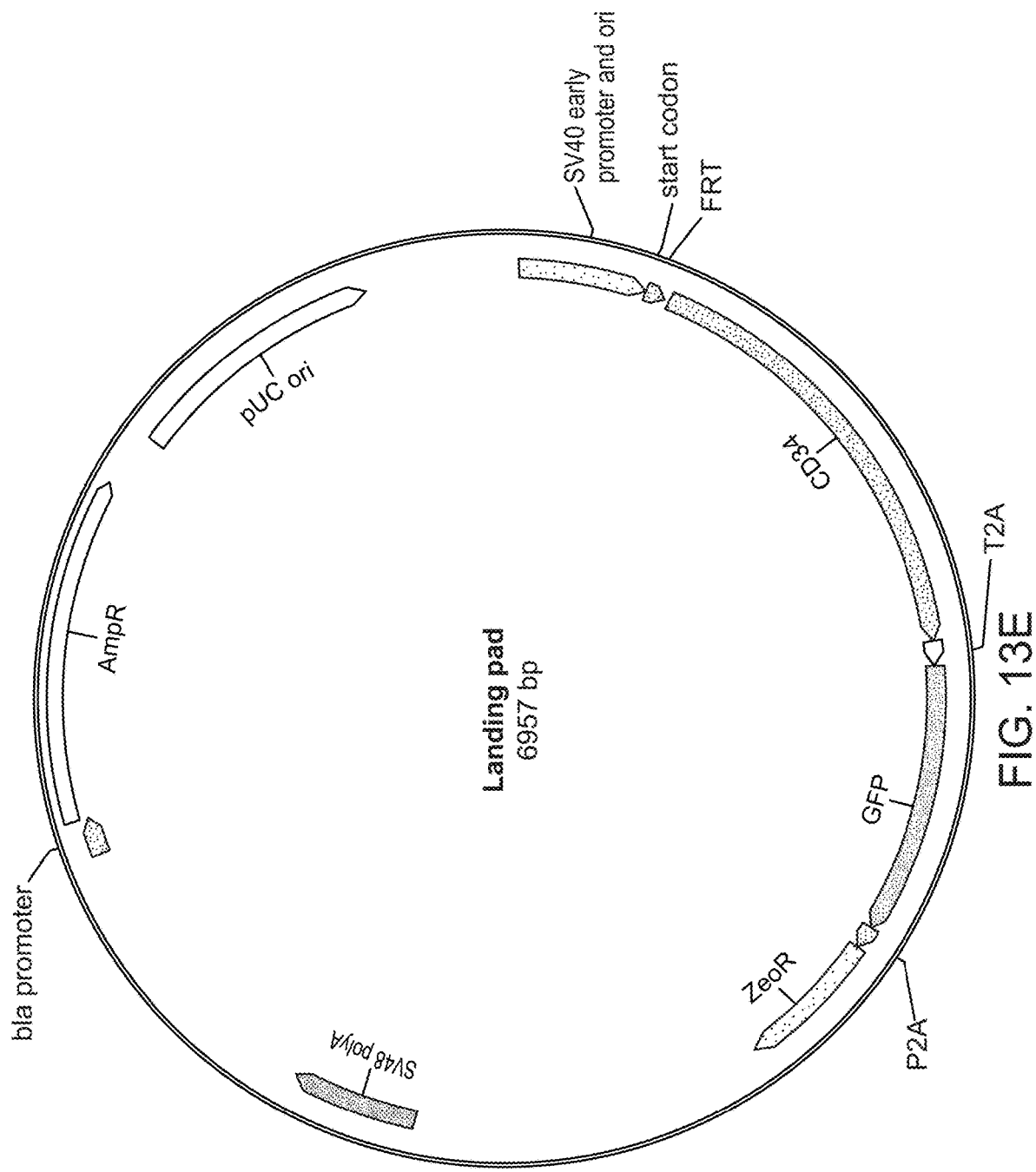

FIG. 13E Landing pad plasmid used to generate a custom CHO landing pad cell line (GenBank accession MW079274).

Figure 14A:
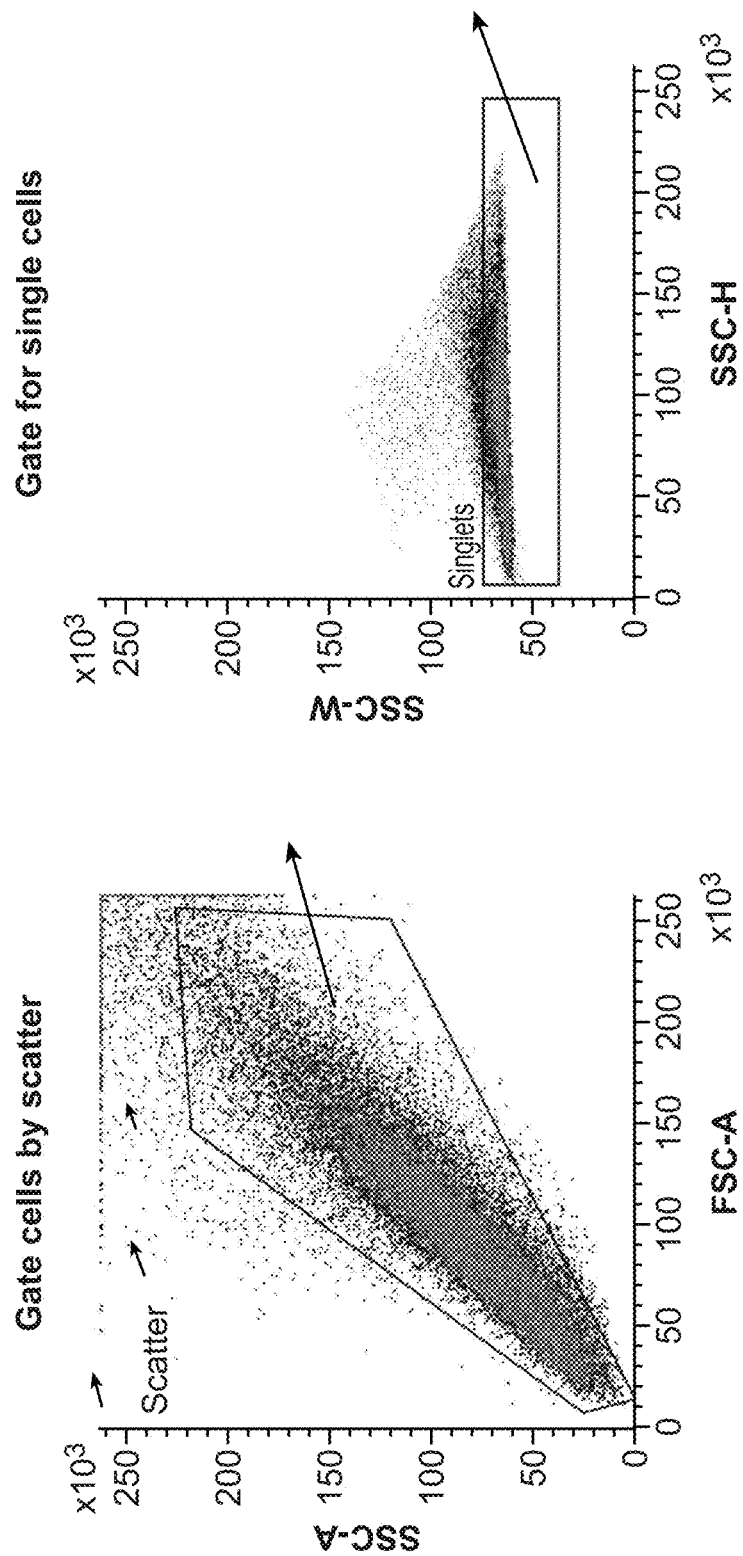
Figure 14A:
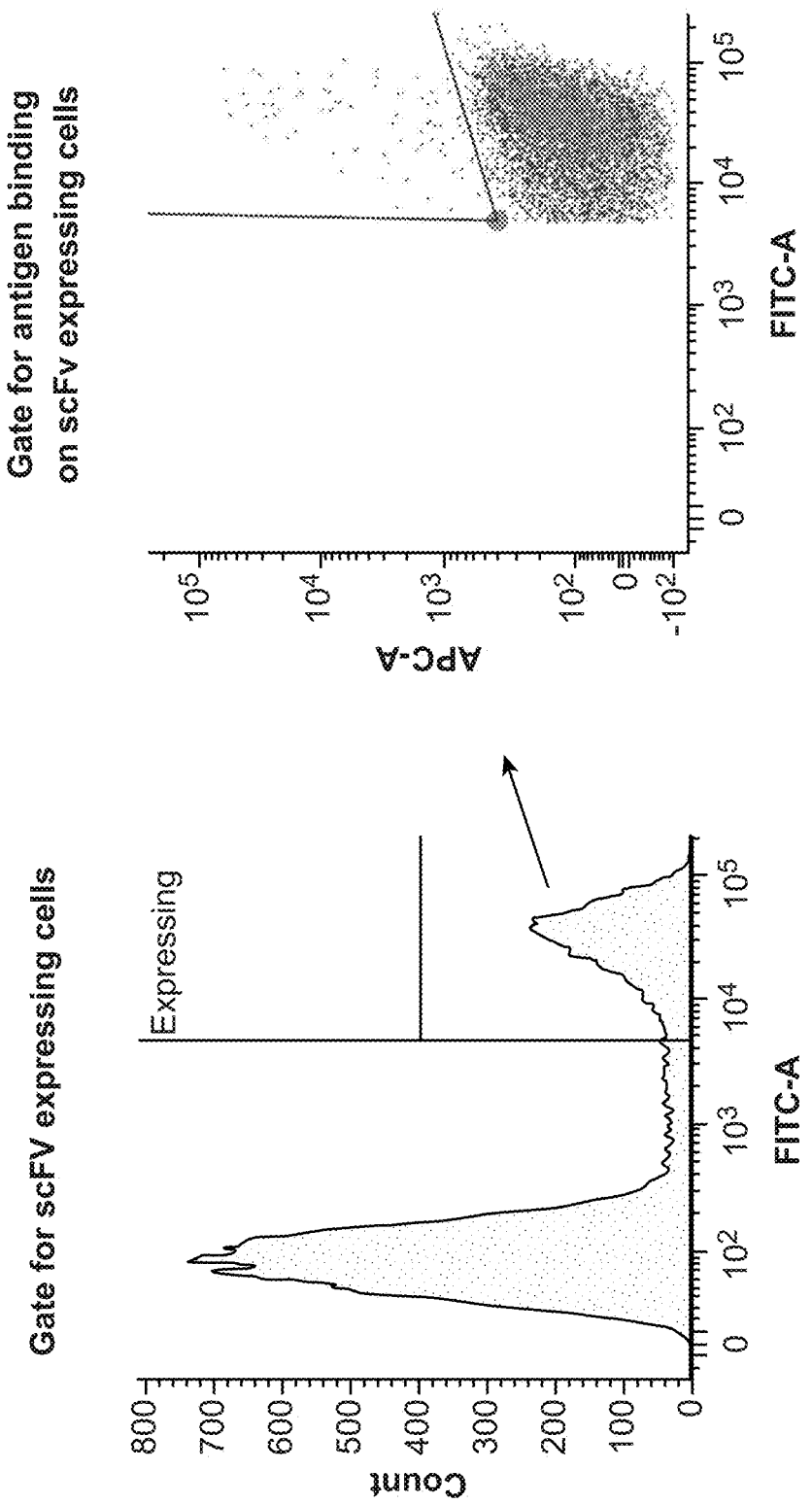

FIG. 14A shows flow sorting for SARS-CoV-2 specific antibodies using yeast scFv display. Gating strategy was used for each yeast sort.

Figure 14B:
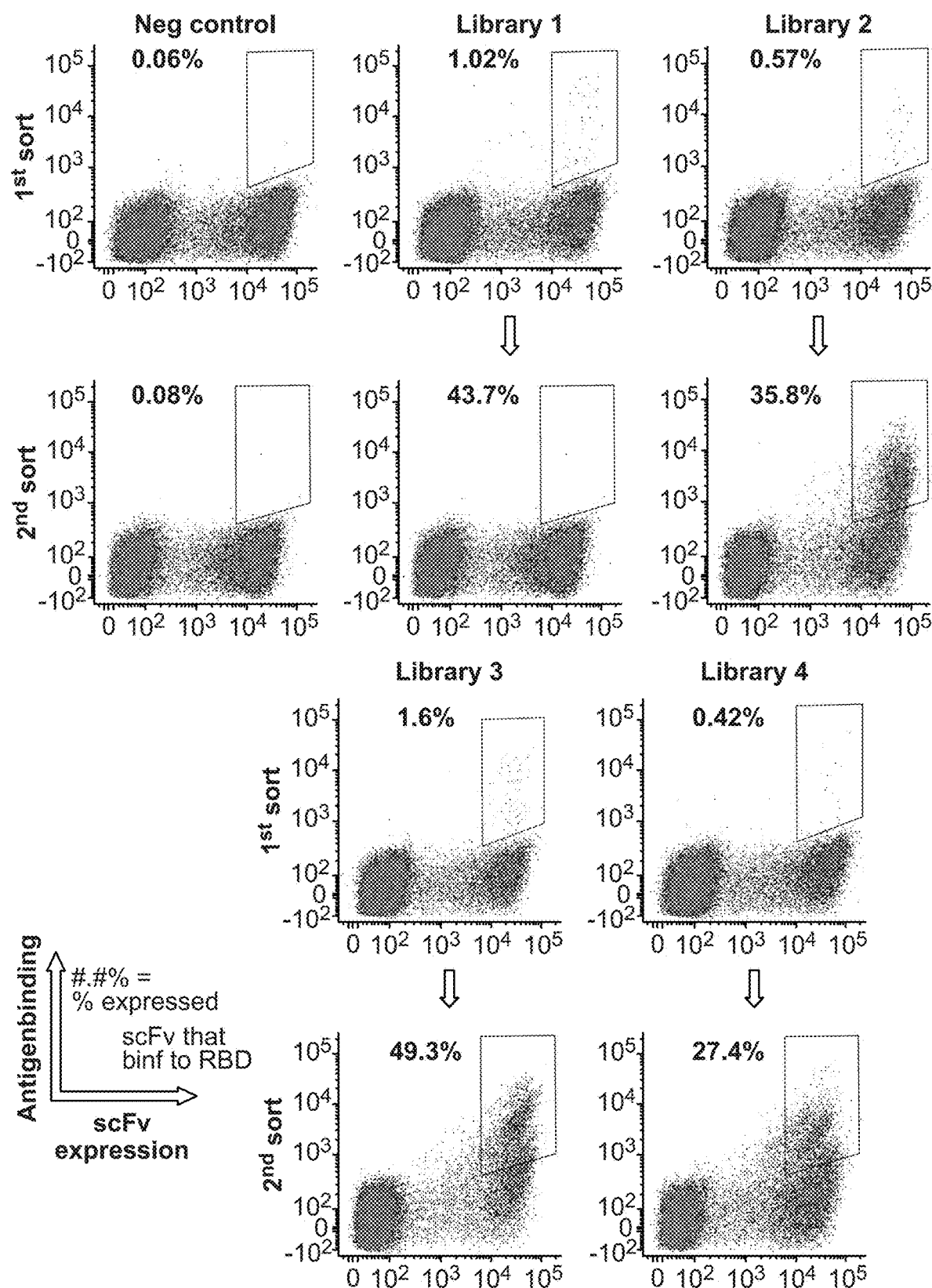
Figure 14B:
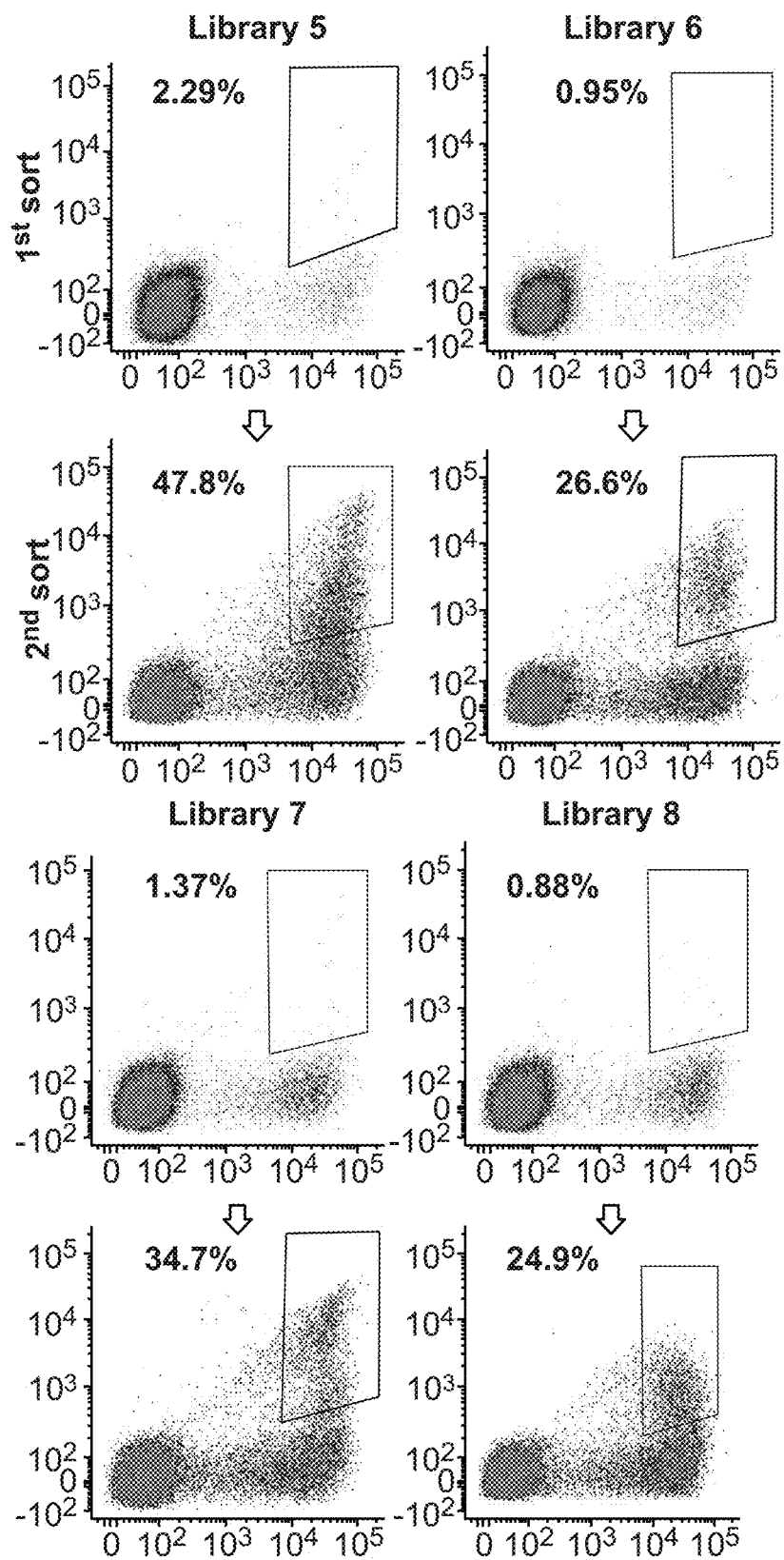

FIG. 14B shows detection of a C-terminal c-Myc tag (x-axis), indicating expression of an scFv on the surface of the cell. The y-axis measures binding of antigen to the scFv-expressing cells. The gates used for yeast selection (double positive) are indicated, with the percentage of scFv-expressed RBD binders. A negative control and the eight rCIG convalescent donor libraries were stained with 1200 nM biotinylated CoV-2 RBDHis. An average of 1.1% of the expressed antibodies were RBD-specific on the first sort. After the second sort, the RBD-specific scFv were amplified and then cloned into full-length antibody expression plasmids.

FIG. 15 shows CoV-2 S1- and RBD-specific antibody binding measured by ELISA. rCIG, the 8 recombinant libraries, the 8 plasma pools from donors that made up rCIG, neutralizing SARS-CoV-2 mAb, nonneutralizing SARS-CoV mAb, and IVIG were titrated relative to total IgG concentration.

Figure 16A:
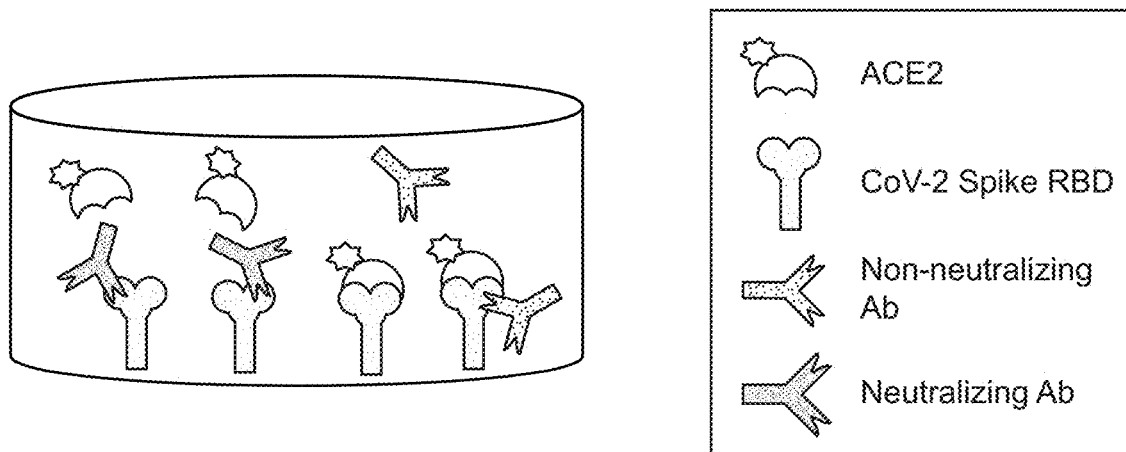

FIG. 16A illustrates ACE2 inhibition assay. The blocking ability of SARS-CoV-2 specific antibodies were measured using a plate-based ELISA method. Spike RBD was used to coat the plate and after the antibody samples are coincubated, ACE2 was added and measured for binding to RBD; antibodies that block the interaction demonstrate low or no binding of ACE2 and are considered neutralizing.

Figure 16B:
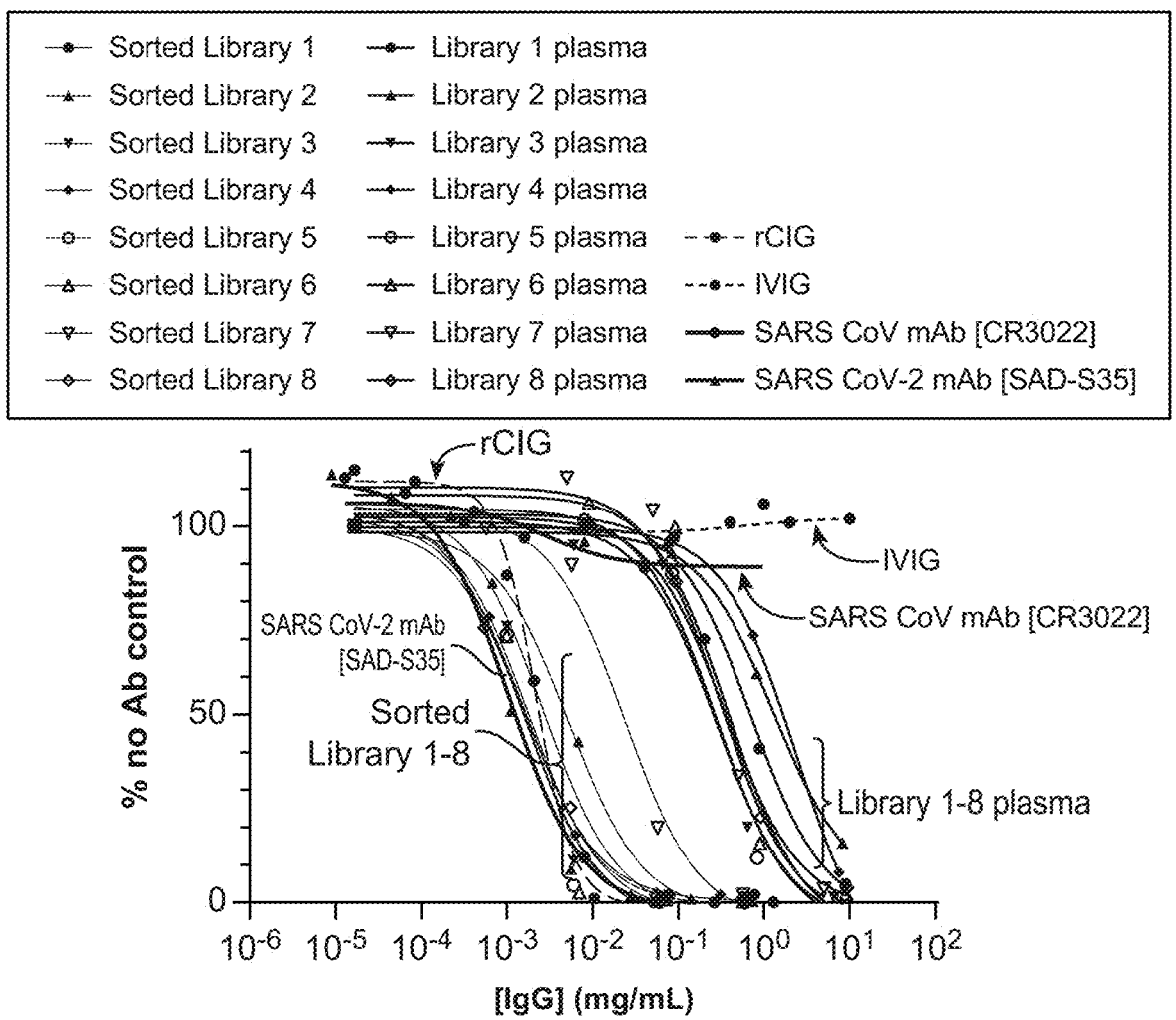

FIG. 16B shows results from the ACE2 inhibition assay. The recombinant polyclonal rCIG, the 8 recombinant antibody libraries, the 8 plasma pools from donors that make up rCIG, neutralizing SARS-CoV-2 mAb, non-neutralizing SARS-CoV mAb, and IVIG were titrated and added to the RBD coated plate. The data are reported as "% no Ab control", i.e., dividing the signal of the test article by the signal of a no Ab control.

FIG. 17A illustrates CoV-2 pseudotype virus neutralization assay. A pseudotype virus expressing the SARS-CoV-2 spike proteins can infect ACE2-expressing target cells (which then turn due to GFP expression from the pseudotype virus), which is used to demonstrate whether antibodies specific to SARS-CoV-2 can neutralize infection.

FIG. 17B shows results from the CoV-2 pseudotype virus neutralization assay. The recombinant polyclonal rCIG, the 8 recombinant antibody libraries, the eight plasma pools from donors that make up rCIG, neutralizing SARS-CoV-2 mAb, non-neutralizing SARS-CoV mAb, and IVIG were titrated and added to ACE2-expressing cells in the presence of CoV-2 pseudotype virus. The percent of infected cells (GFP+) was quantified by flow cytometry and was normalized by dividing by the GFP+ signal in the negative control wells, which lacked test article.

Figure 17C:
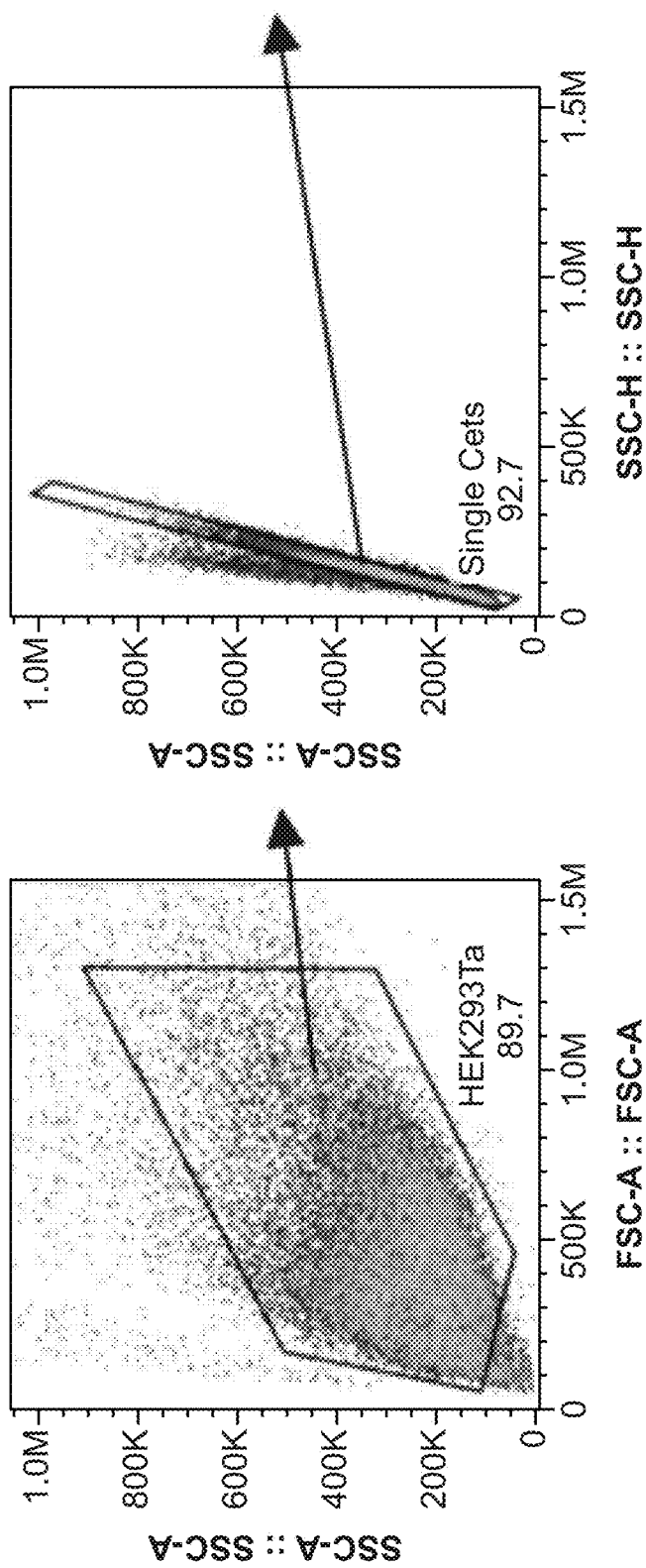
Figure 17C:
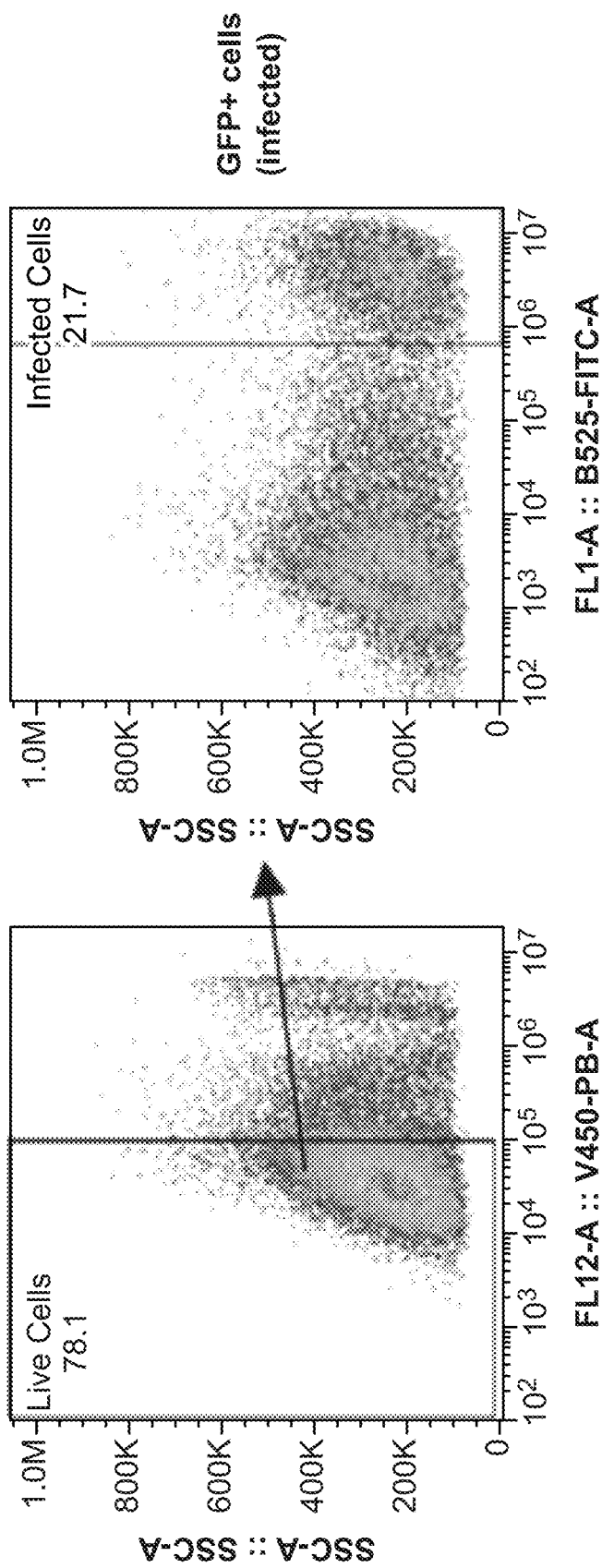

FIG. 17C provides flow gating strategy of the pseudotype virus neutralization assay to identify live, GFP+ cells (those infected with pseudotype virus).

Figure 18A:
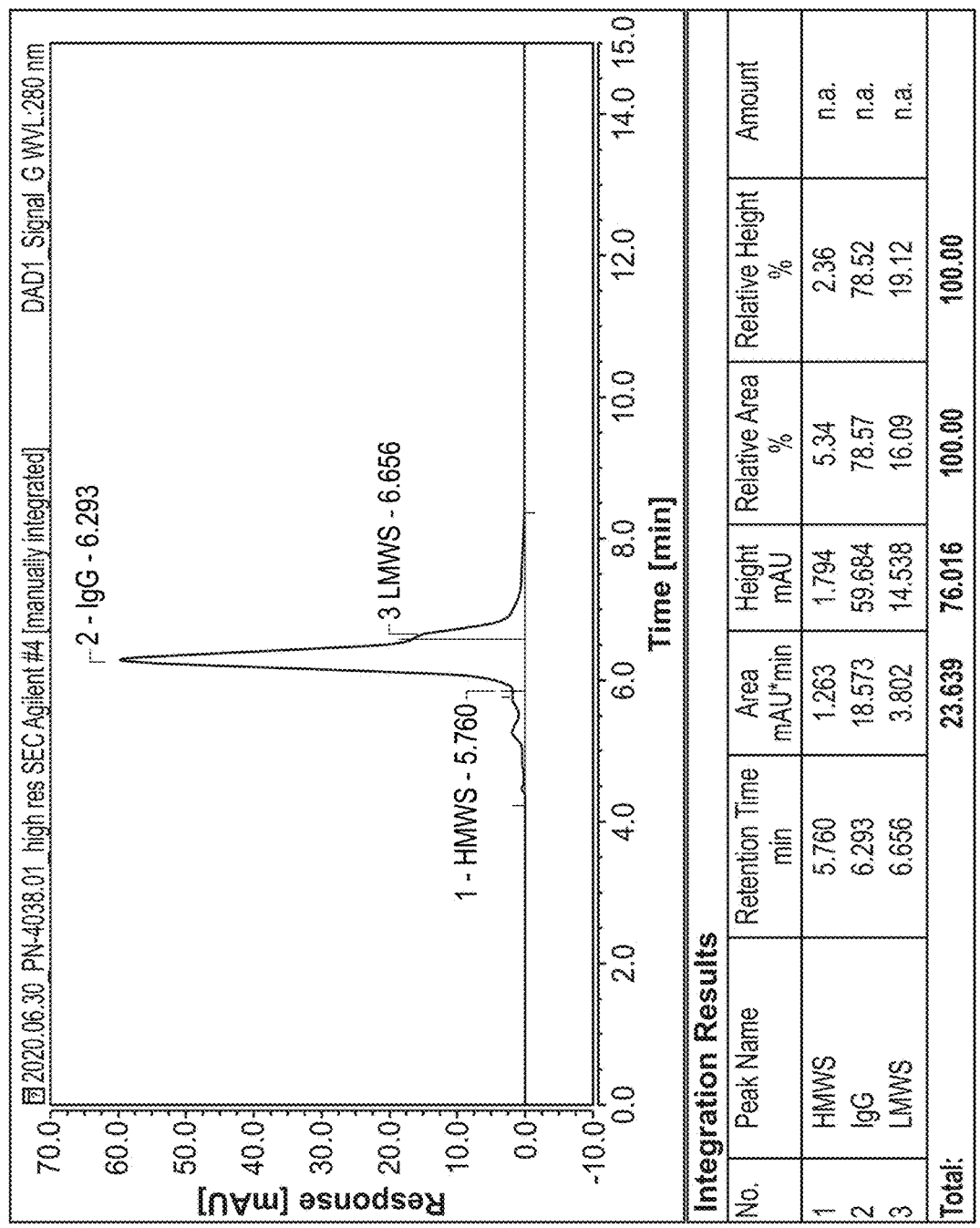
Figure 18B:
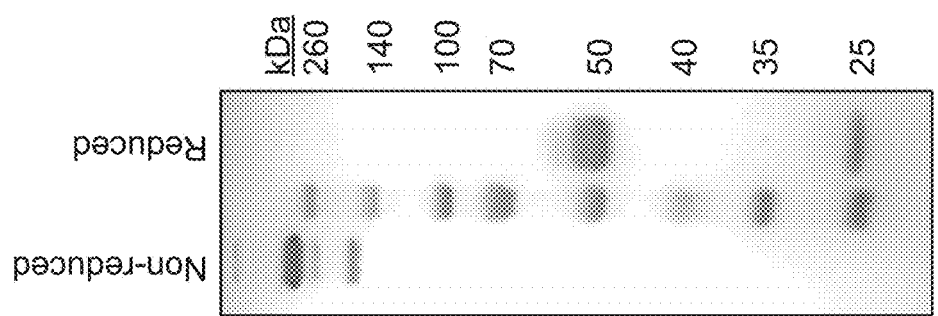
Figure 19B:
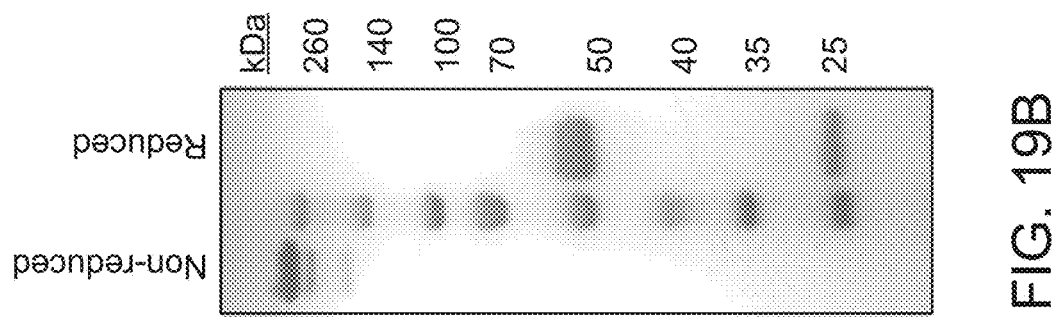
Figure 19A:
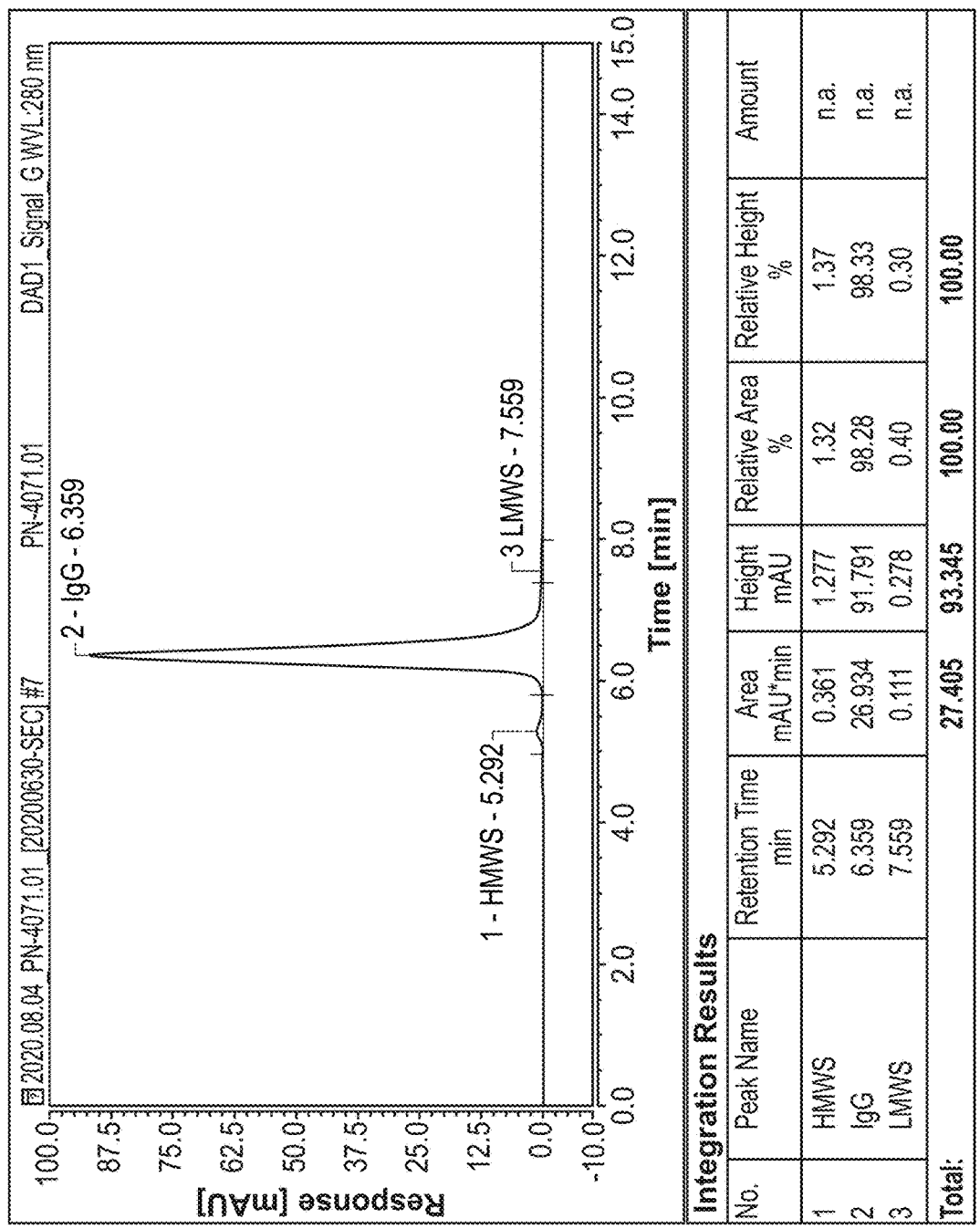
Figure 19C:
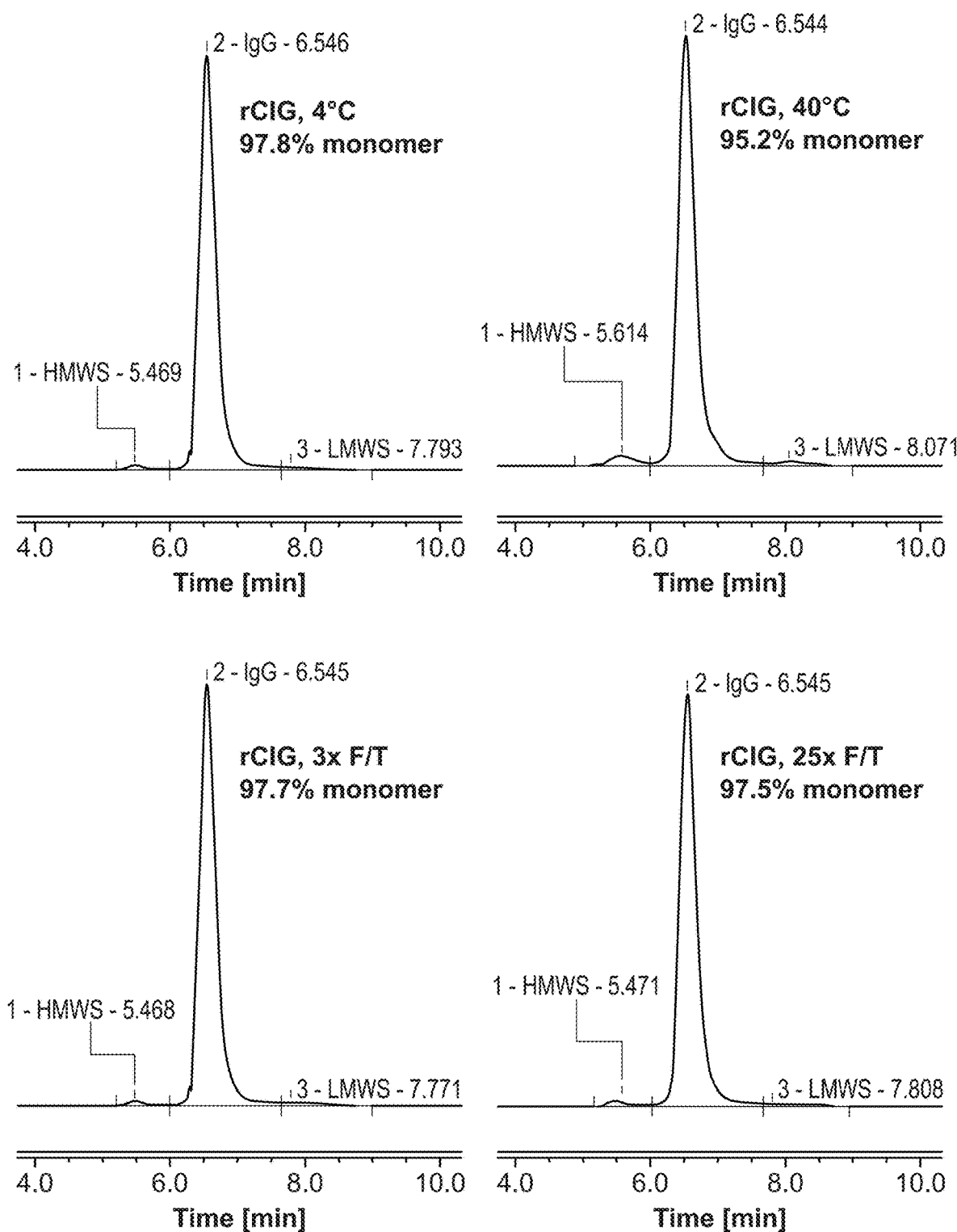
Figure 19D:
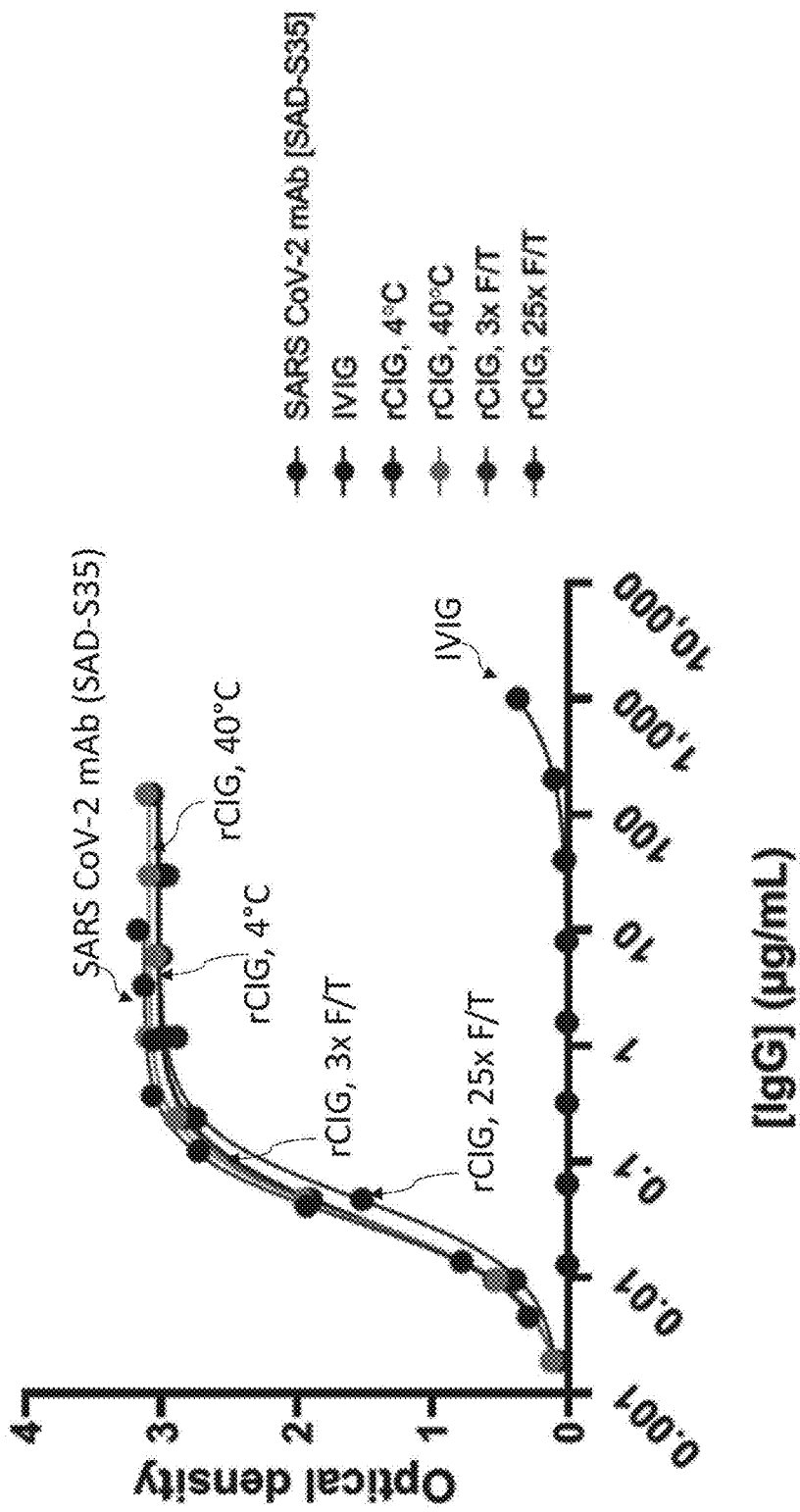

FIGS. 18A and 18B show quality control analysis of purified rCIG protein. (FIG. 18A) SEC-HPLC analysis used to assess the purity of the Protein A-purified protein. (FIG. 18B) SDS-PAGE analysis used to assess the purity of the Protein A-purified protein.

FIG. 19A to 19D show stability, purity and functional assay of polished rCIG protein. (FIG. 19A) SEC-HPLC analysis used to assess the purity of the polished rCIG protein. (FIG. 19B) SDS-PAGE analysis used to assess the purity of the polished rCIG protein. (FIG. 19C) SEC-HPLC ELISA used to assess the purity and function of the rCIG protein after incubation at 4° C. or at 40° C. for 14 days, or after undergoing 3 or 25 freeze-thaw cycles (F/T). 40° C. incubation weakly increased the high molecular weight species with no change in SARS CoV-2 ELISA binding, while 25× F/T had no change in purity but had ~50% reduced binding to SARS CoV-2. (FIG. 19D) SARS-CoV-2 S1 ELISA used to assess the purity and function of the rCIG protein after incubation at 4° C. or at 40° C. for 14 days, or after undergoing 3 or 25 freeze-thaw cycles (F/T). 40° C. incubation weakly increased the high molecular weight species with no change in SARS CoV-2 ELISA binding, while 25× F/T had no change in purity but had ~50% reduced binding to SARS CoV-2.

Figure 20A:
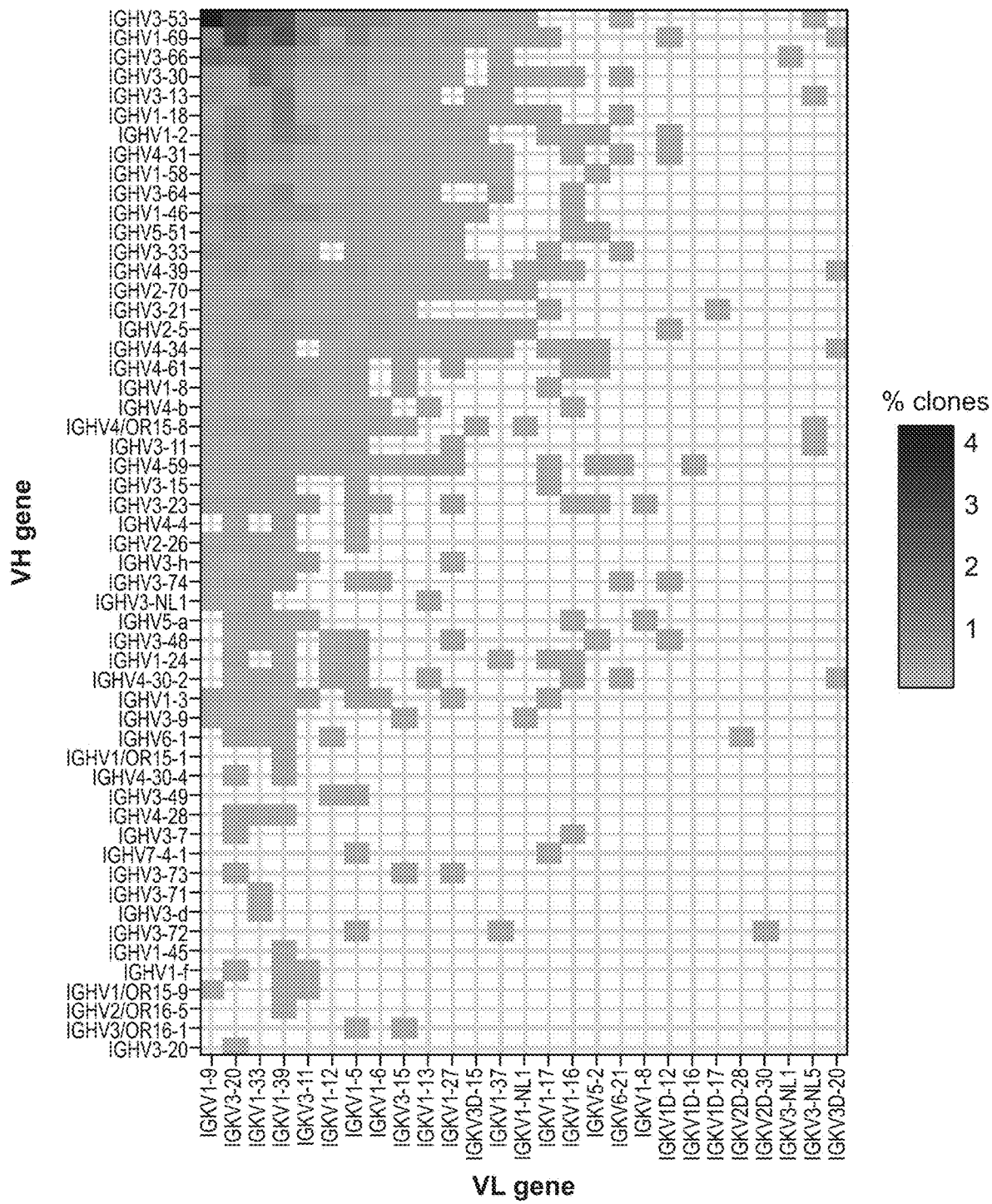

FIG. 20A to 20D show repertoire sequencing analysis of rCIG. FIG. 20A is a heatmap showing antibody variable (V) gene usage from the linked scFv library (the 8 sorted libraries combined). The x-axis and y-axis show light and heavy chain V genes, respectively. The greyscale represents unique clone abundance in the library.

Figure 20B:
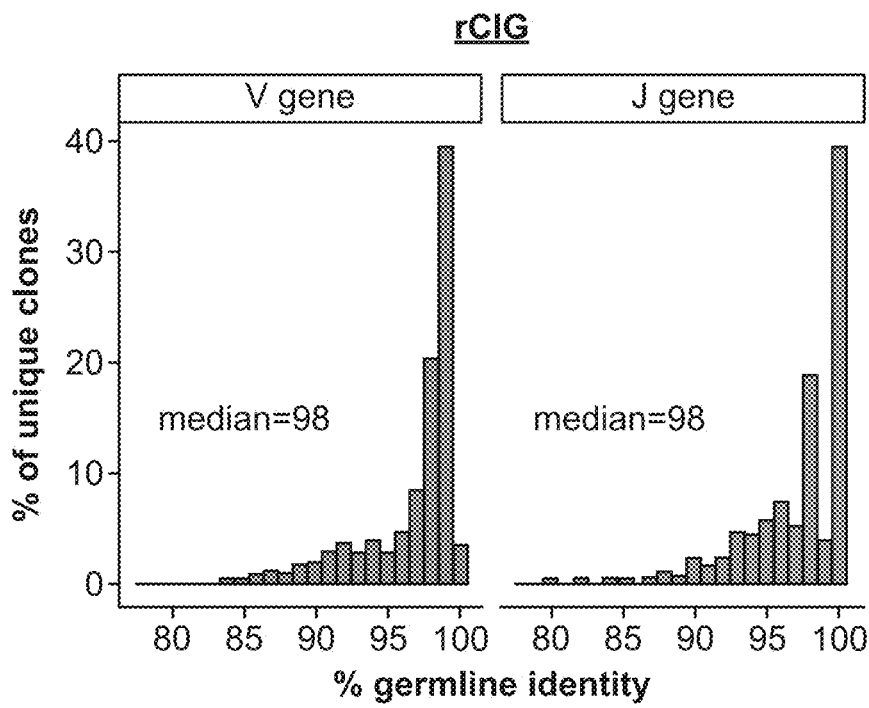

FIG. 20B is a histogram showing distribution of percent germline identity for variable gene (V; left panel) and joining gene (J; right panel), from the final CHO library.

Figure 20C:
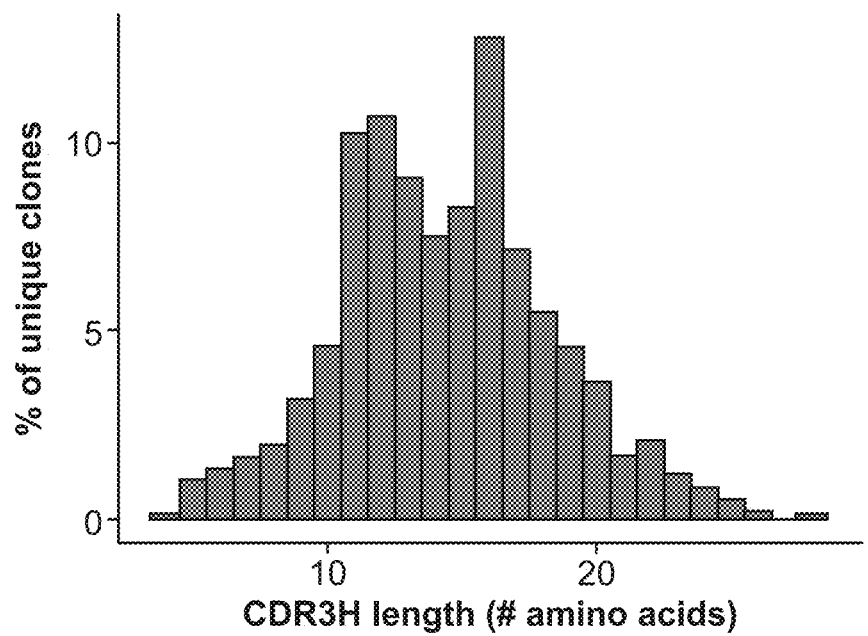

FIG. 20C is a histogram showing the distribution of heavy chain CDR3 amino acid length, from the final CHO library.

Figure 20D:
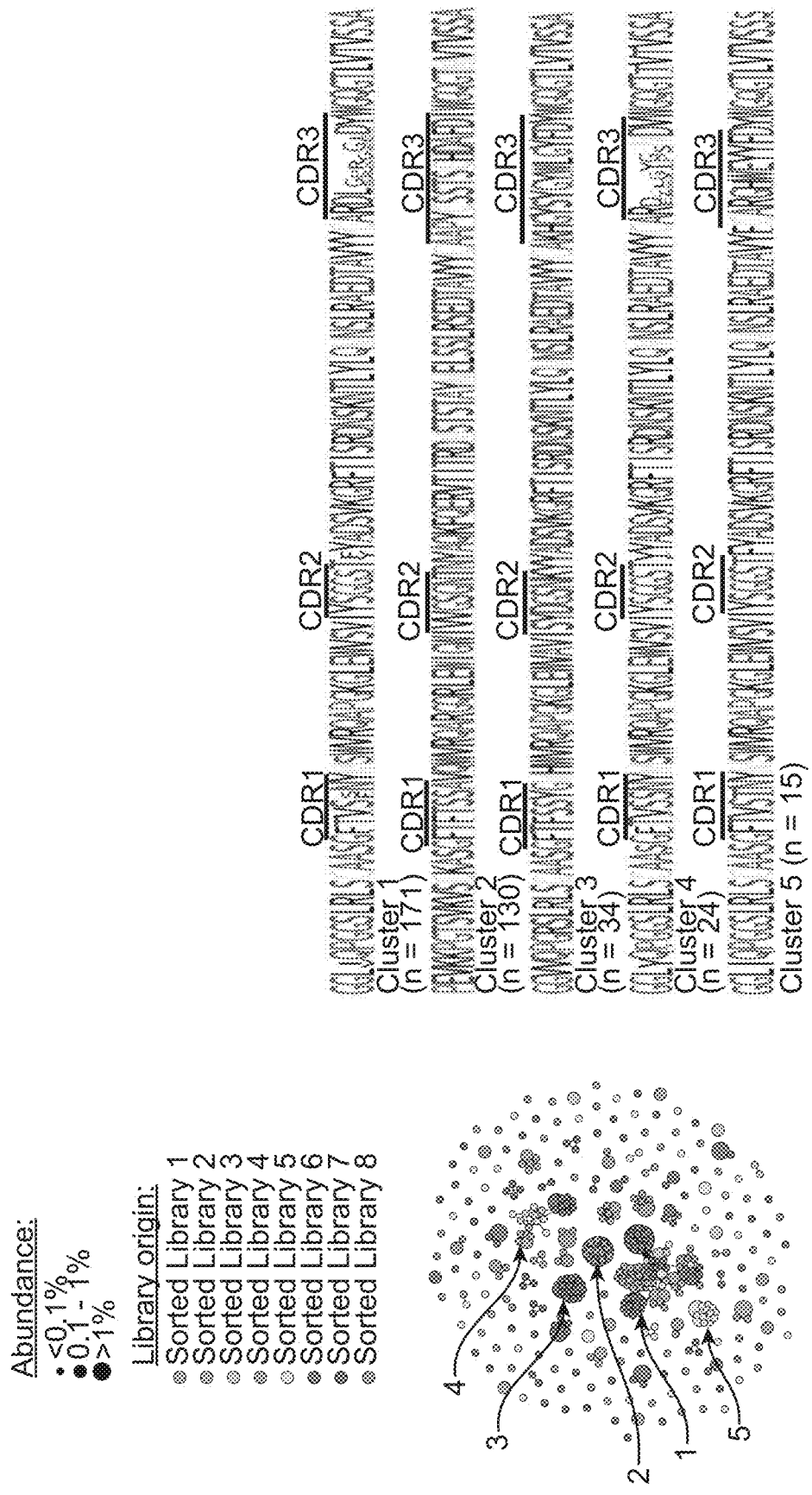

FIG. 20D shows the clonal cluster analysis of rCIG antibodies from FIG. 8C (from the final CHO library) (left). FIG. 20D also shows sequence logos of all heavy chain sequences from the top five clusters (based on clone count). The first 8 amino acids (variable region primer binding sites) are not shown. Figure discloses SEQ ID NOS 25951-25955, respectively, in order of appearance.

Figure 21A:
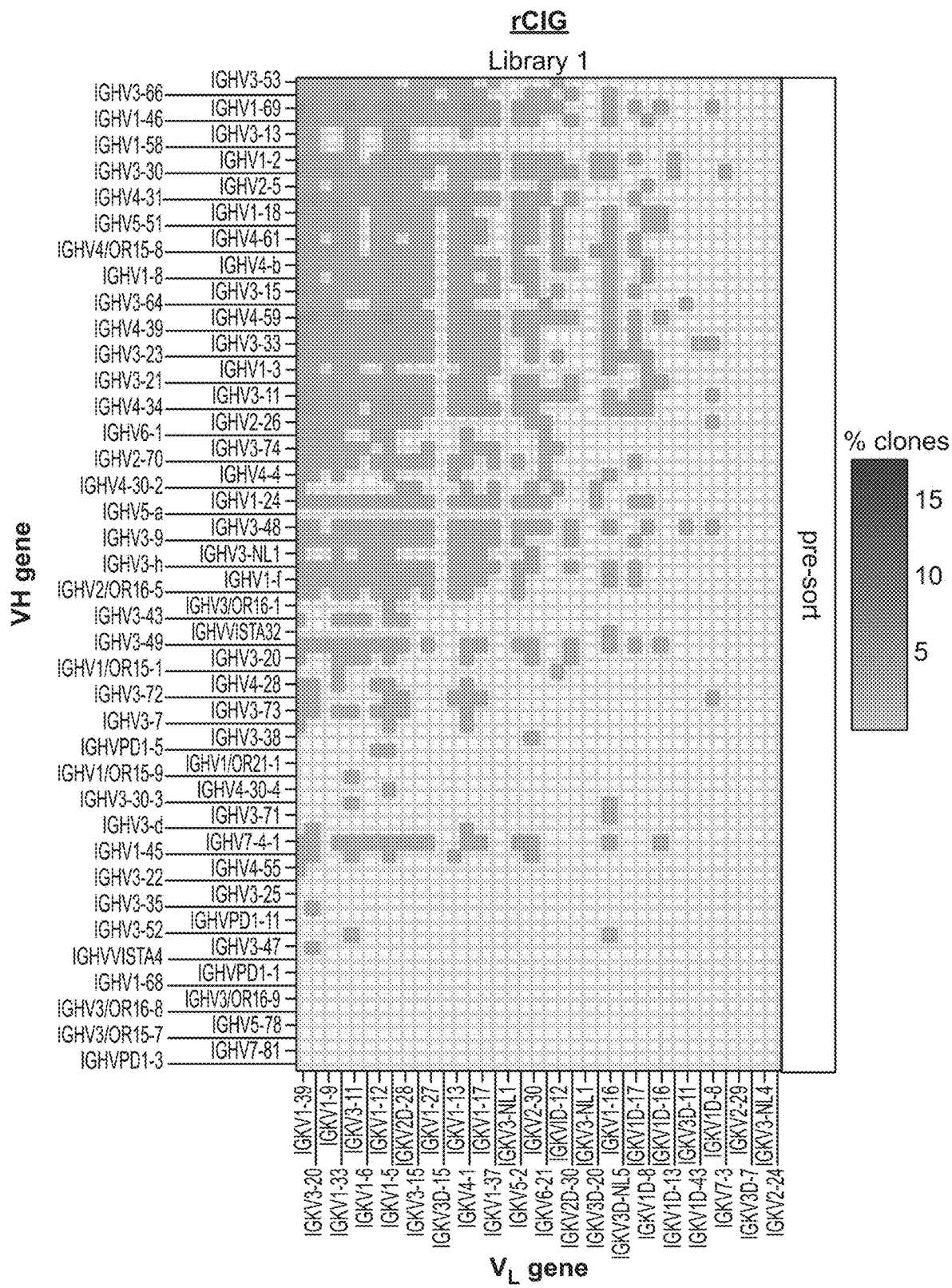
Figure 21B:
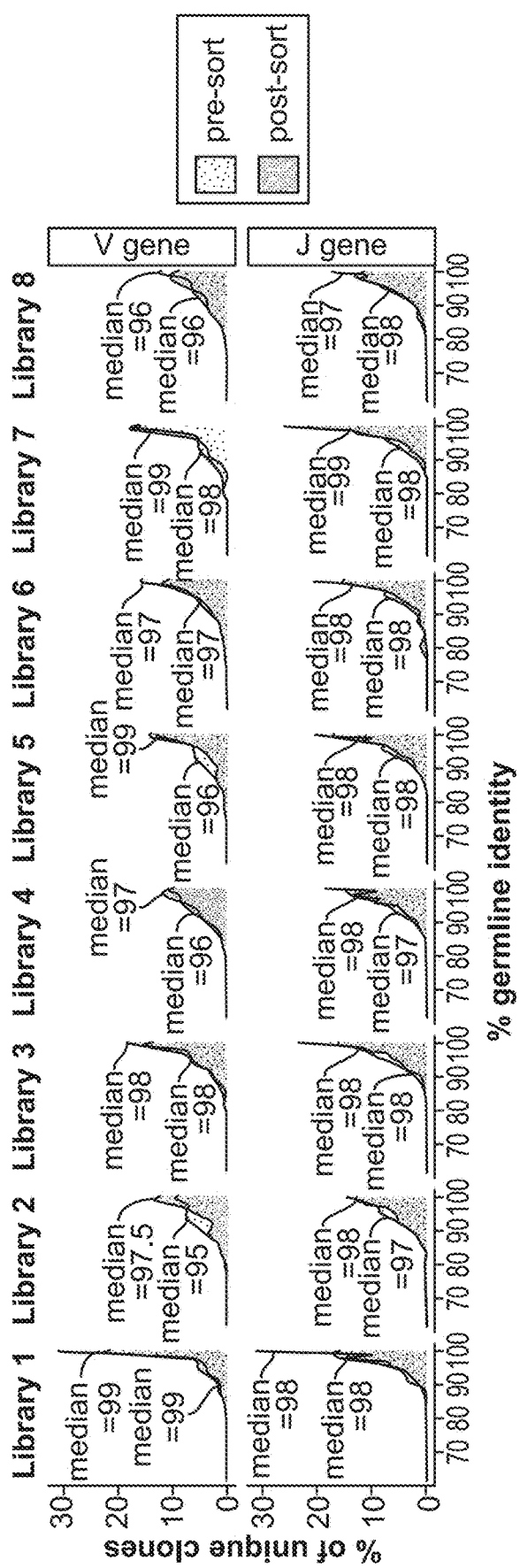
Figure 21C:
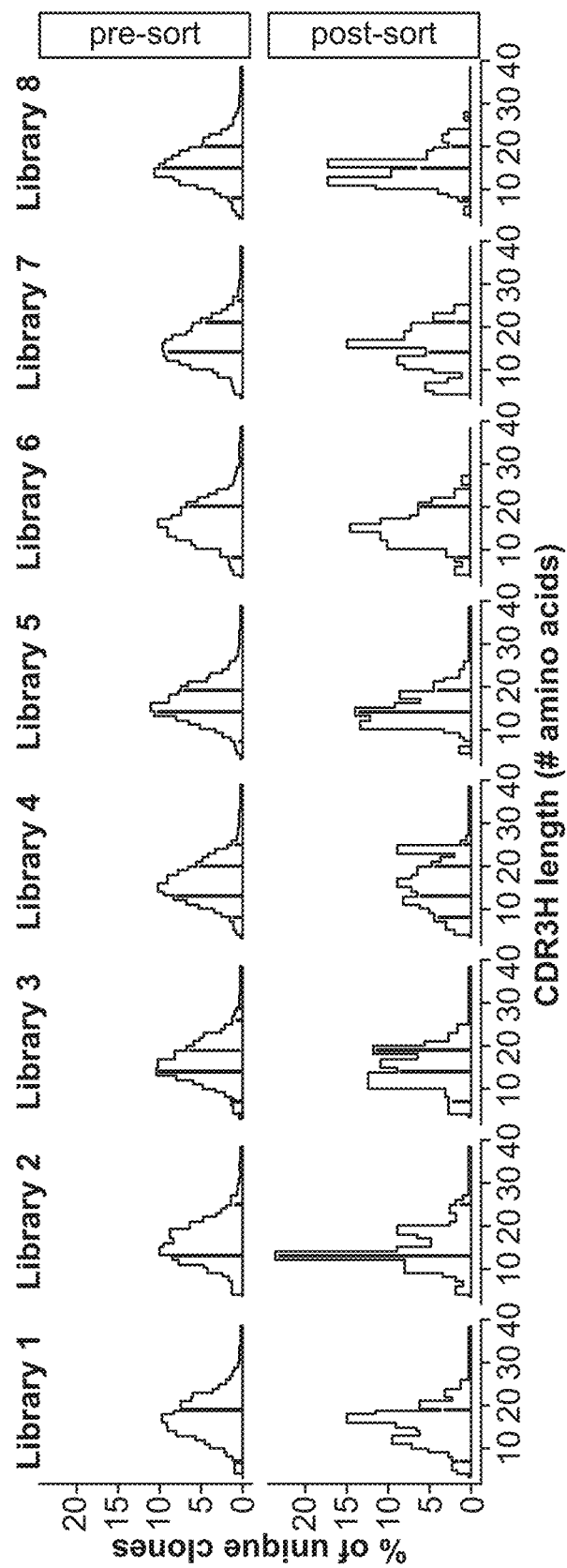

FIG. 21A to 21C shows repertoire sequencing analysis of pre- and post-sort rCIG.

FIG. 21A is a heatmap showing antibody variable (V) gene usage from each pre-sort and post-sort linked scFv library. FIG. 21B is a histogram showing distribution of percent germline identity for variable gene (V; left panel) and joining gene (J; right panel) from each pre-sort and post-sort scFv library. FIG. 21C is a histogram showing the distribution of heavy chain CDR3 amino acid length from each pre-sort and post-sort scFv library.

FIG. 22 shows antibody reactivity to SARS-CoV-2 variants and other coronaviruses. ELISA plates were coated with 2 μg/mL of spike or RBD proteins from known circulating variants of SARS-CoV-2, SARS-CoV, MERS, and other human coronaviruses (HCoV). The binding ability of rCIG, SARS-CoV-2 neutralizing mAb (SAD-S35), and IVIG was determined for each antigen. *, No binding was observed against the indicated antigen. While rCIG and the mAb had poly-variant specific responses to all SARS-CoV-2 variants, only rCIG bound SARS-CoV RBD while the mAb did not. IVIG had no specific responses to SARS-CoV-2, SARS-CoV or MERS but did have a weak response to HCoV-229E and HCoV-NL63.

Figure 23A:
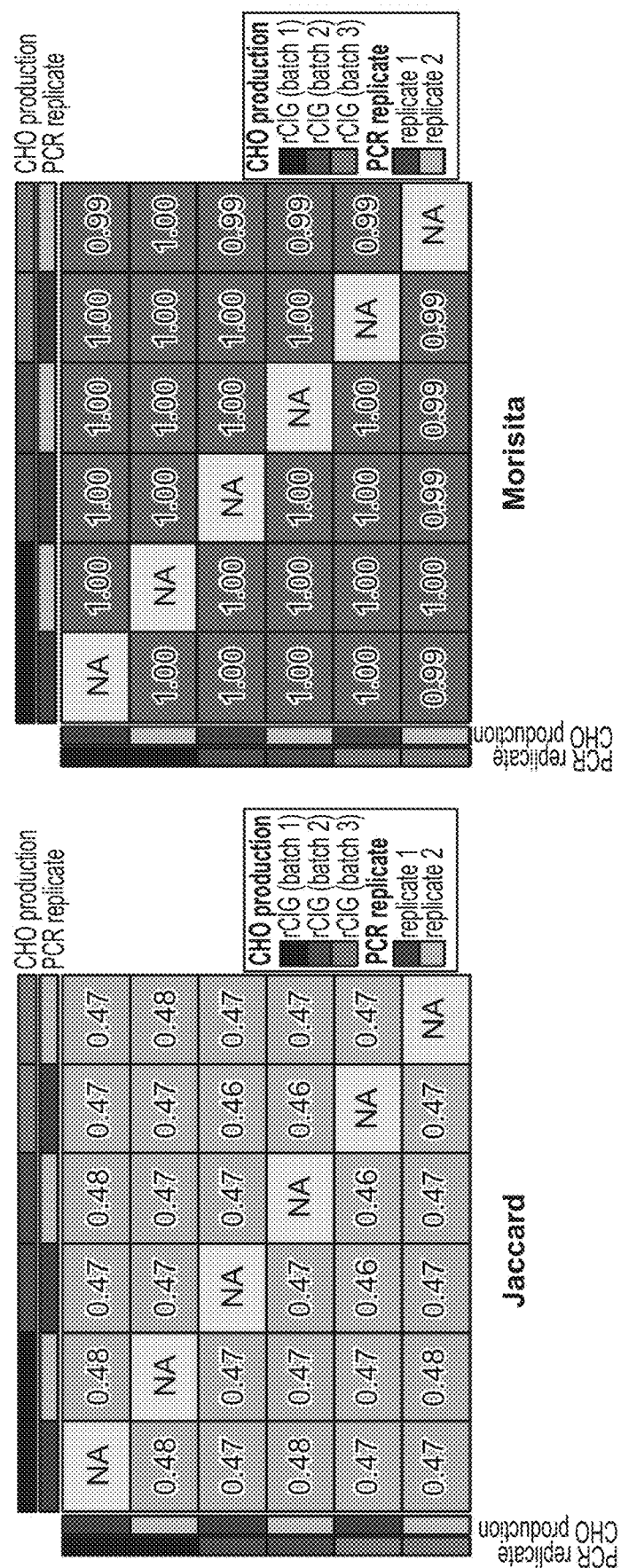
Figure 23C:
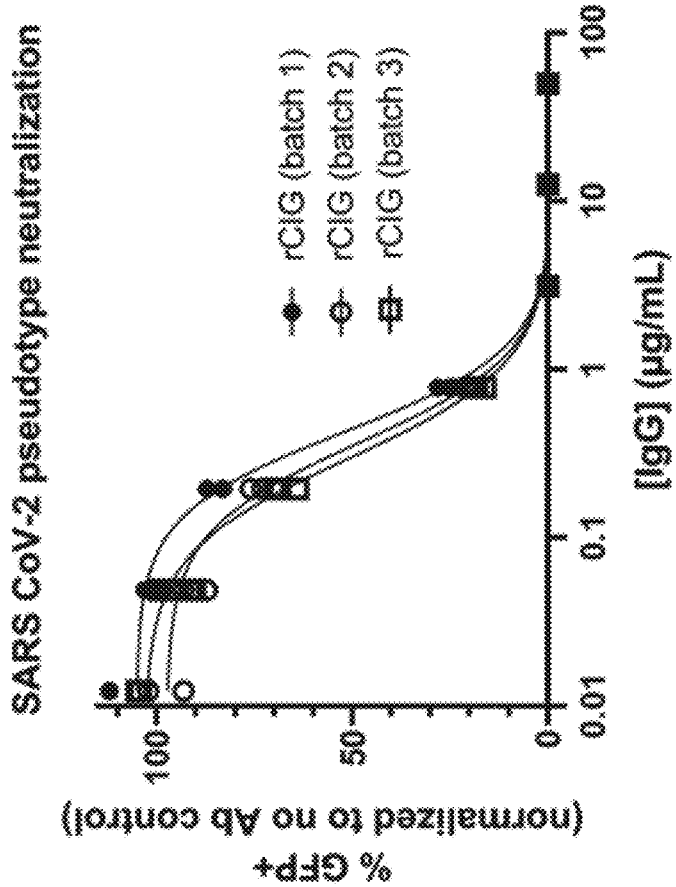
Figure 23B:
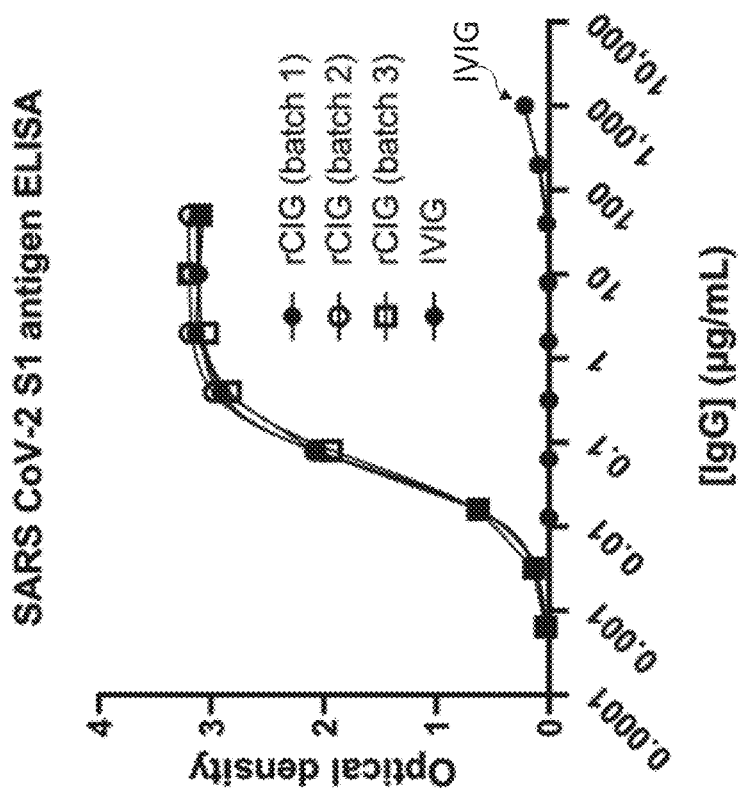

FIGS. 23A and 23B provide data showing batch-to-batch variation of rCIG. RNA antibody sequencing was performed (in duplicate) on RNA isolated from the end of replicate CHO bioreactor production runs. In FIG. 23A, Jaccard (left) and Morisita (right) analyses data are provided to show the amount of antibody clone variation between production batches and between PCR replicates performed on each batch. Wilcoxon rank sum tests showed that the indices from the PCR replicates came from the same population as the indices from the batch replicates (p>0.05), suggesting that the variability inherent to the batches was no worse than the variability between PCR replicates.

FIG. 23B shows binding of the indicated batch of serially diluted rCIG and IVIG to SARS CoV-2 S1 antigen was measured by ELISA.

FIG. 23C. The indicated batch of rCIG was titrated and added to ACE2-expressing cells in the presence of CoV-2 pseudotype virus. The percent of infected cells (GFP+) was quantified by flow cytometry and was normalized by dividing by the GFP+ signal in the negative control wells, which lacked test article. Feltz & Miller's asymptotic test was used to test whether the three bioproduction batch IC50 measurements had a different coefficient of variation from eight IC50 measurements on a fourth bioproduction batch (18% vs. 17%, respectively). A p-value >0.05 suggested that the variation inherent to the batches was no worse than the variation inherent to the pseudotype neutralization assay.

Figure 24A:
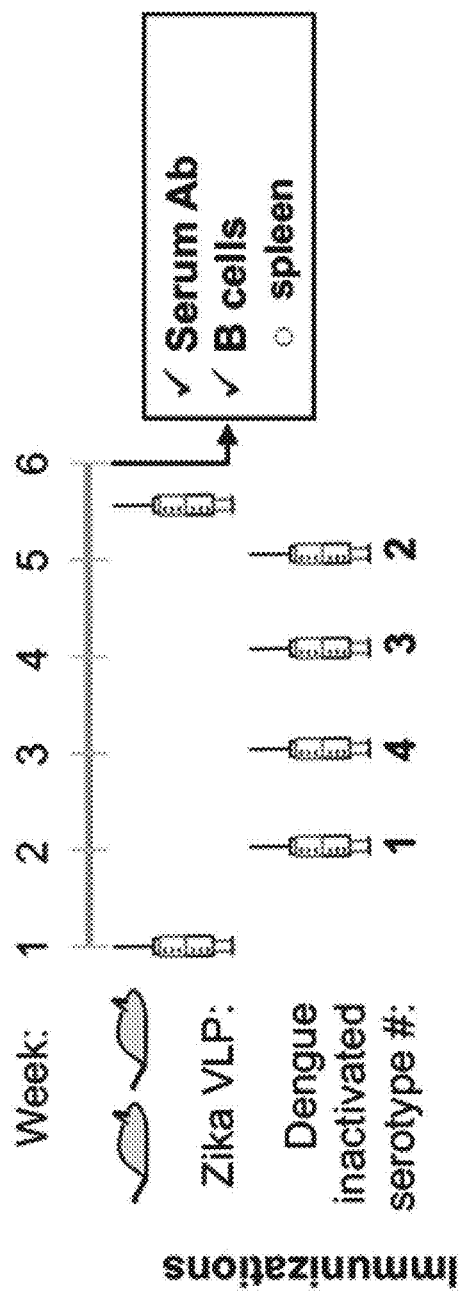
Figure 24B:
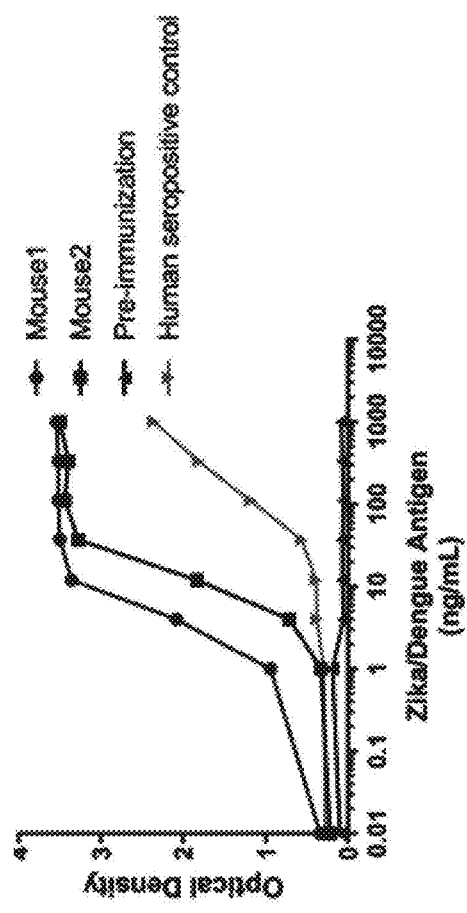

FIGS. 24A and 24B show immunization induced antibody responses to Zika and Dengue in humanized mice. (FIG. 24A) Two Trianni mice were immunized weekly with Zika virus like particles (VLP), inactivated Dengue 1, Dengue 4, Dengue 3, or Dengue 2 as indicated in the figure. (FIG. 24B) After week 5, serum from the mice was tested for antibody response against a mixture of Zika and Dengue antigens and compared to pre-immunization or human seropositive controls to confirm antigen-specific antibody responses.

Figure 25A:
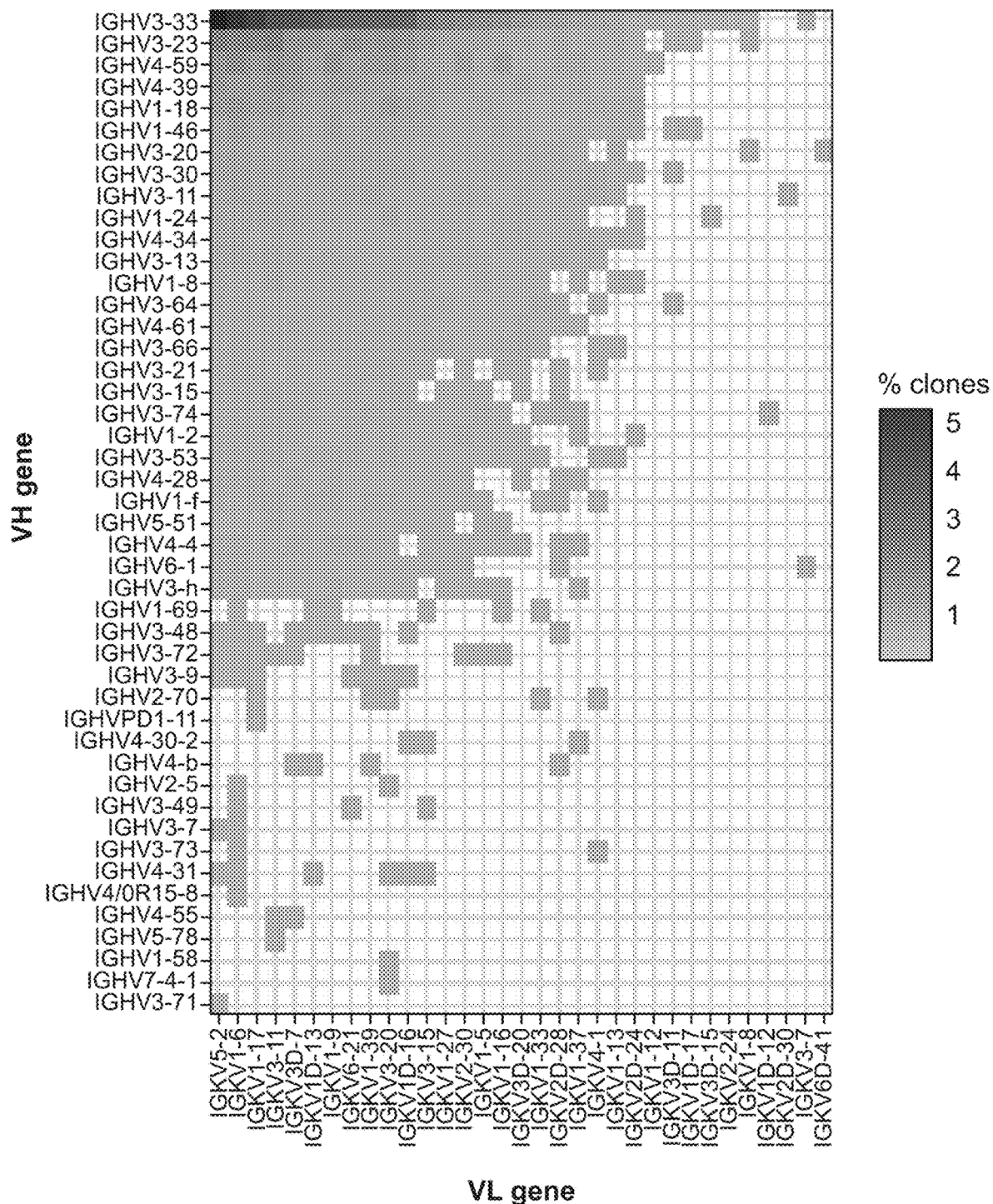

FIG. 25A to 25D show repertoire sequencing analysis results of rZIG. FIG. 25A is a heatmap showing antibody variable (V) gene usage from the linked scFv library. The x-axis and y-axis show light and heavy chain V genes, respectively. The greyscale gradient represents percent unique clone abundance in the library.

Figure 25B:
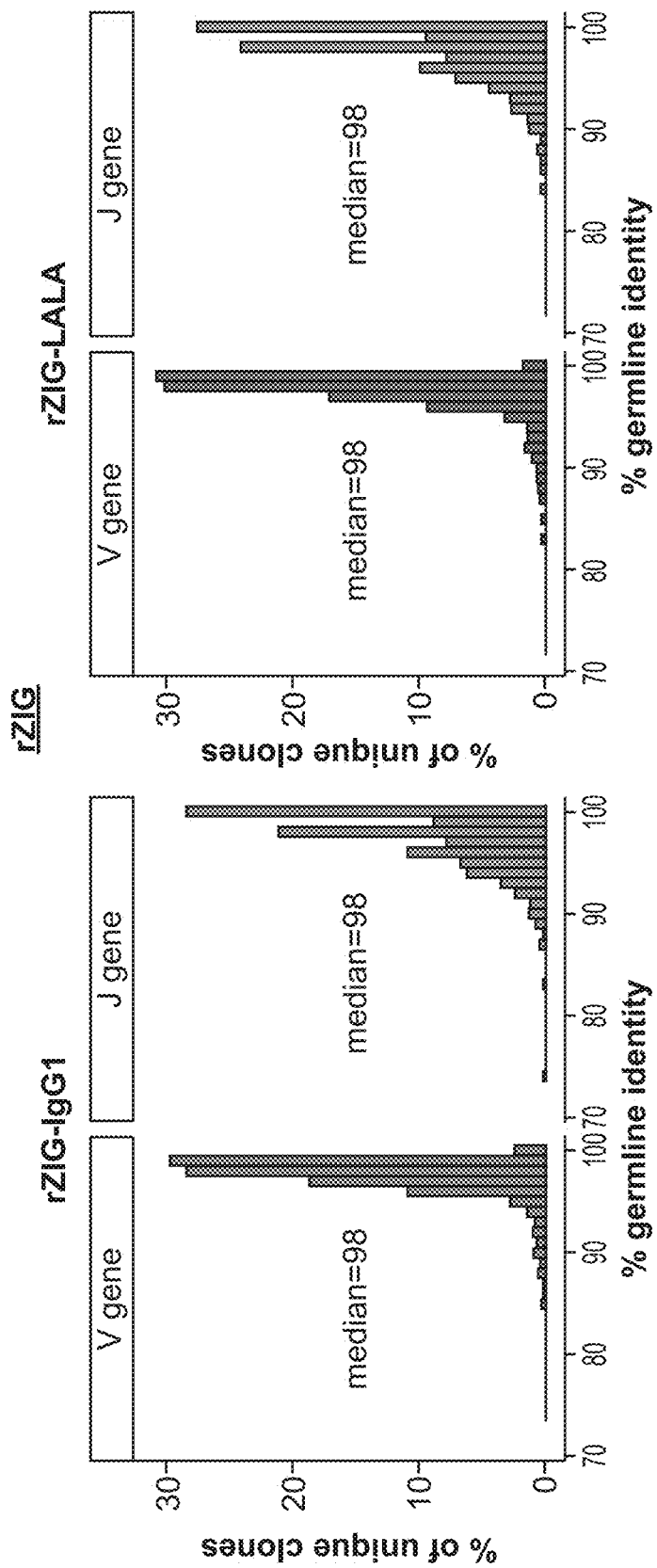

FIG. 25B. For each indicated rZIG library, histogram showing distribution of percent germline identity for variable gene (V; left panel) and joining gene (J; right panel), from the final CHO library.

Figure 25C:
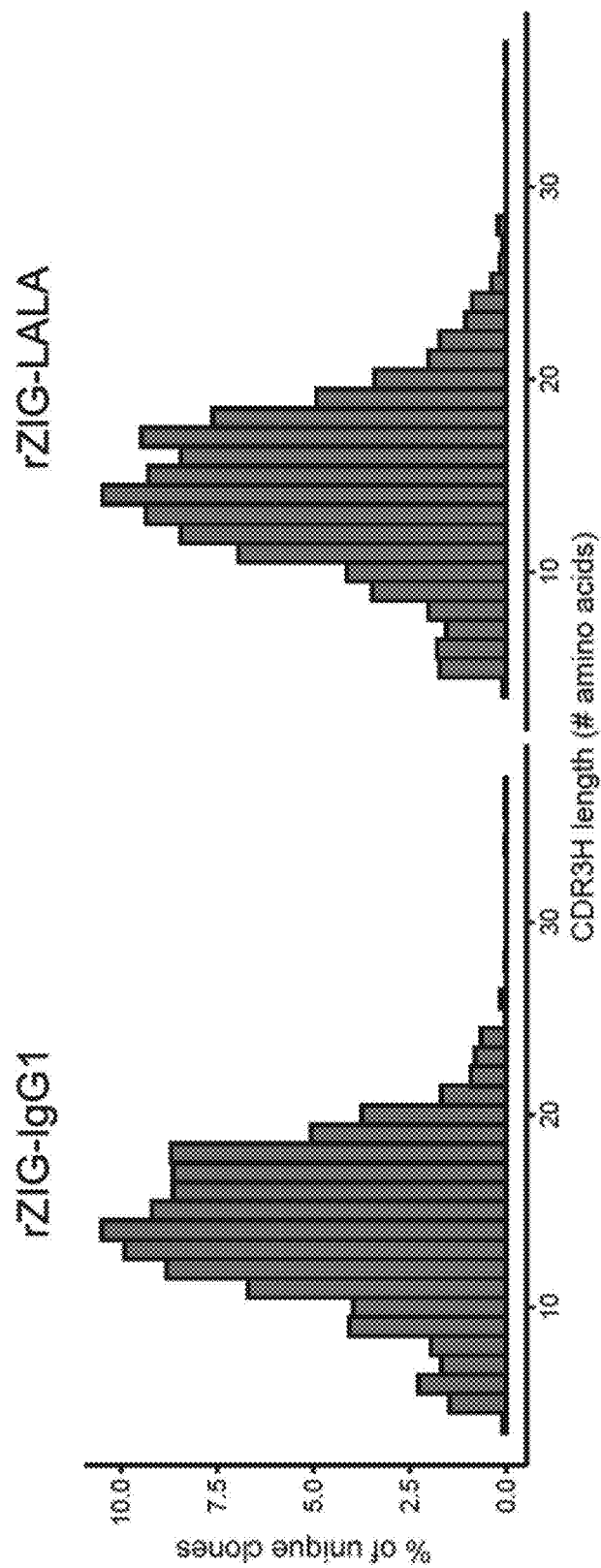

FIG. 25C. For each indicated rZIG library, histogram showing the distribution of heavy chain CDR3 amino acid length, from the final CHO library.

Figure 25D:
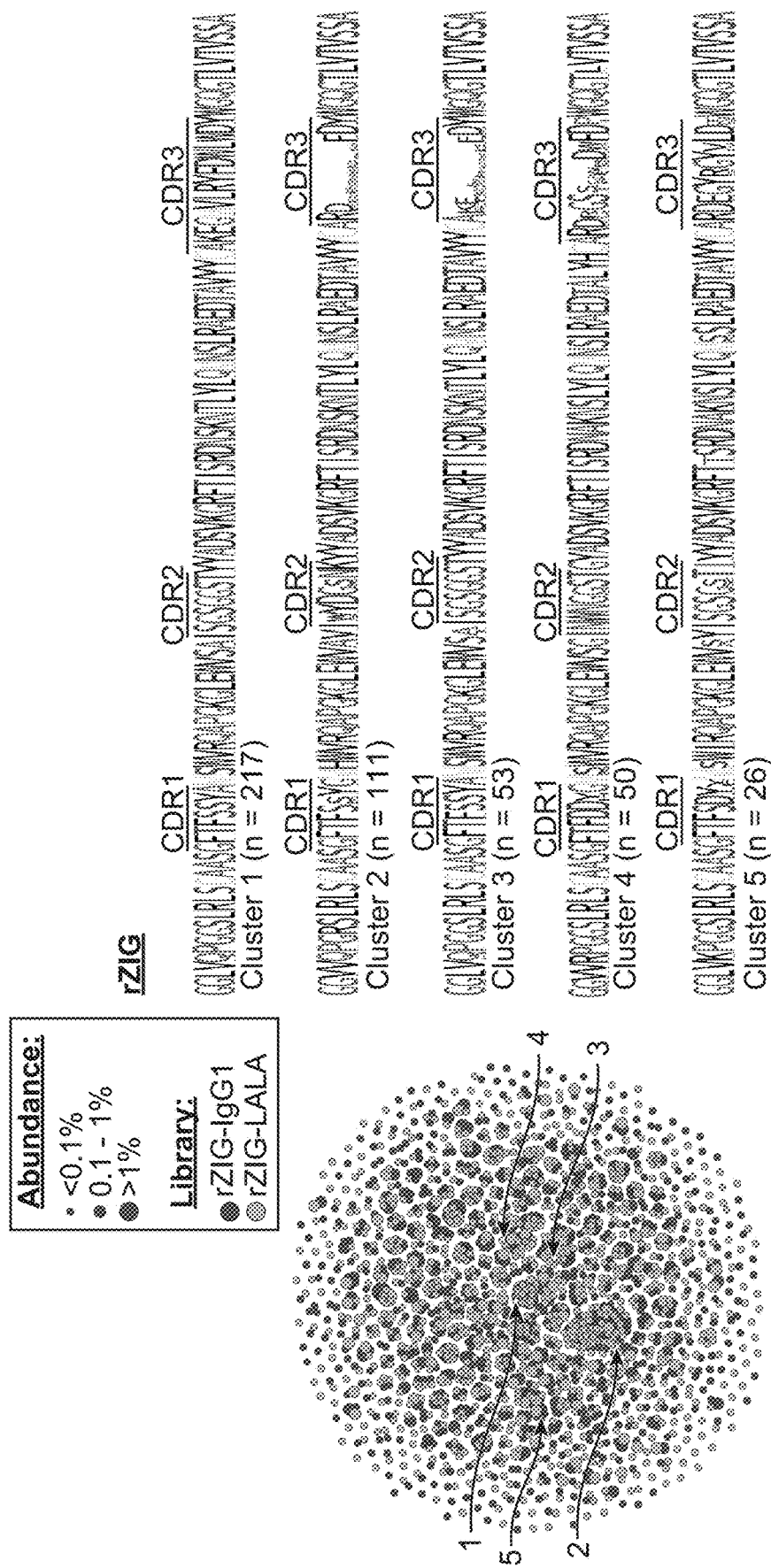

FIG. 25D. Left: The clonal cluster analysis of rZIG antibodies from FIG. 9A (from the final CHO library). Right: Sequence logos of all heavy chain sequences from the top five clusters (based on clone count). The first 8 amino acids (variable region primer binding sites) are not shown. Figure discloses SEQ ID NOS 25956-25960, respectively, in order of appearance.

Figures 26A, 26B:
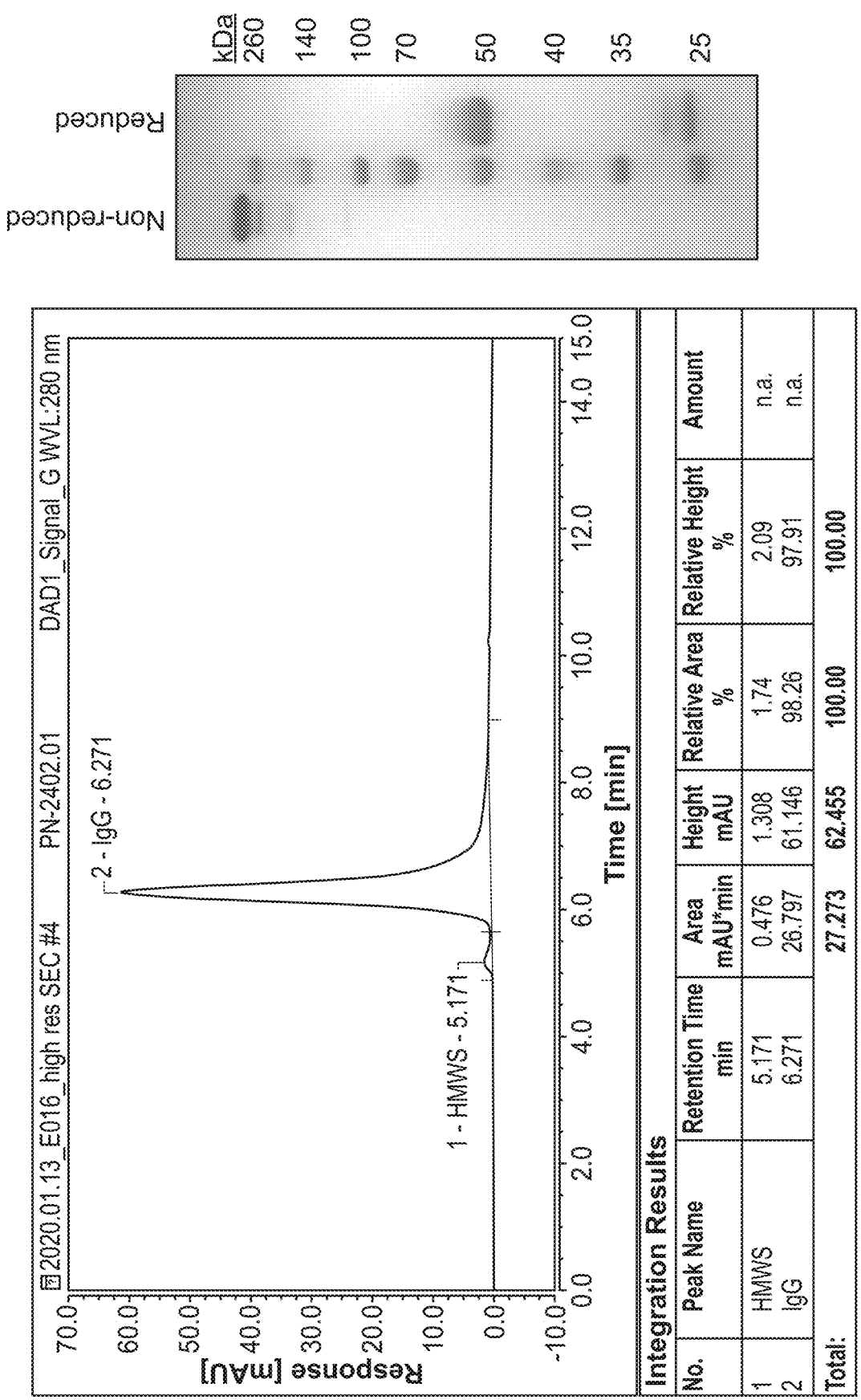

FIG. 26A to 26B show quality control analysis of purified rZIG-IgG1 protein. FIG. 26A is SEC-HPLC analysis used to assess the purity of the Protein A-purified protein. FIG. 26B is SDS-PAGE analysis used to assess the purity of the Protein A-purified protein.

Figure 27A:
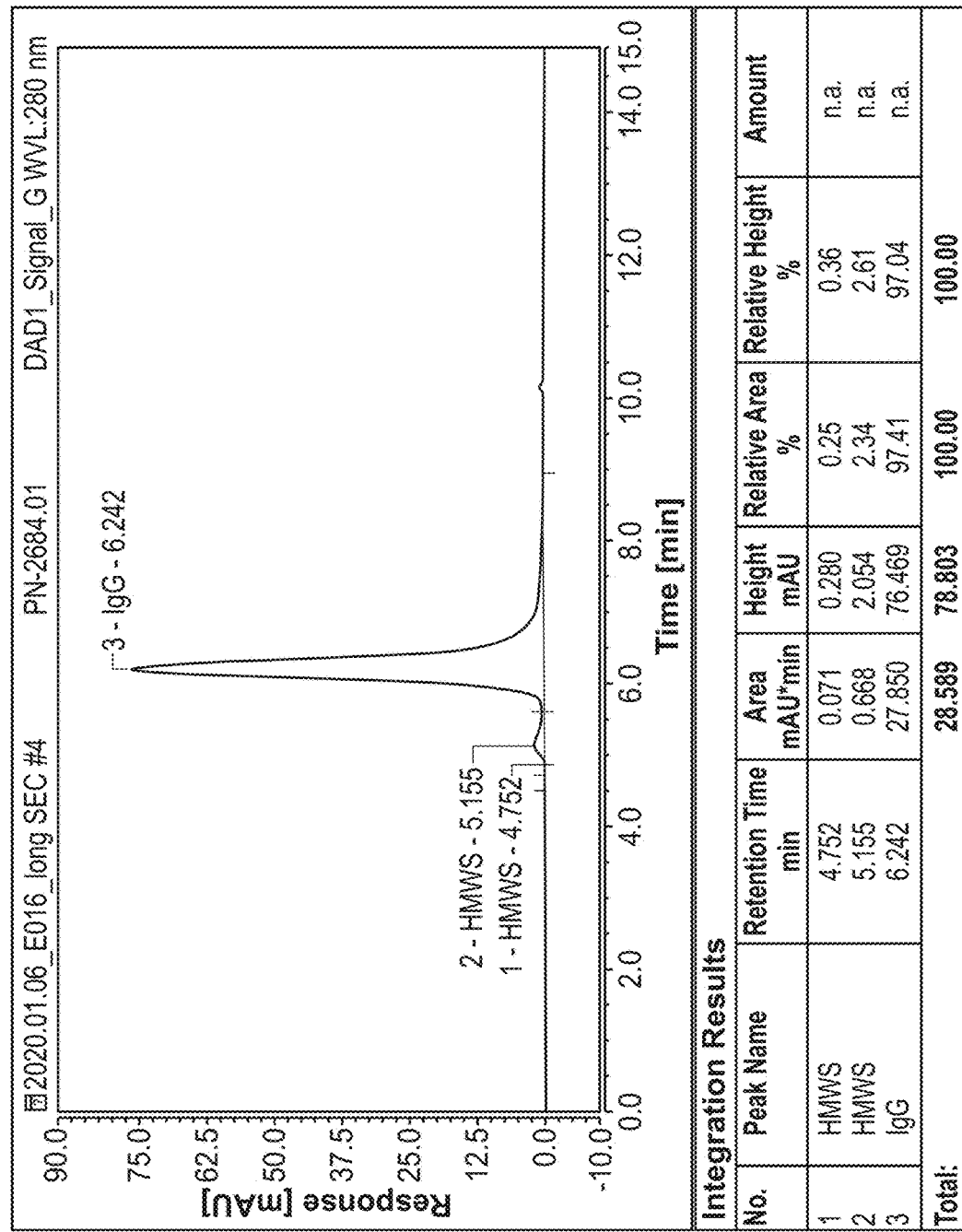
Figure 27B:
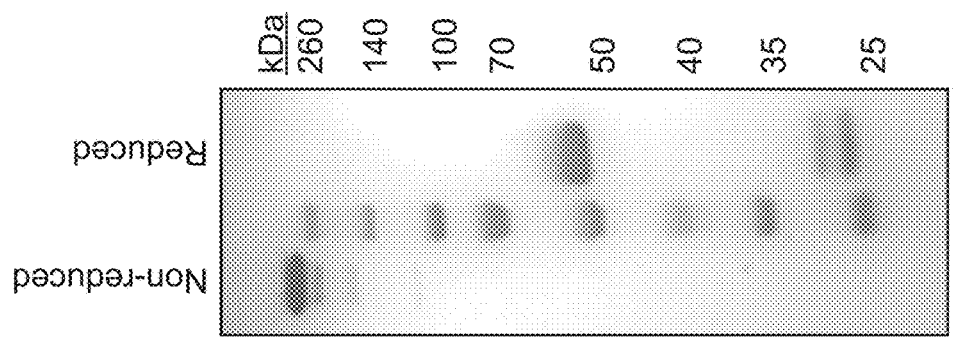

FIG. 27A to 27B show quality control analysis of purified rZIG-LALA protein. FIG. 27A is SEC-HPLC analysis used to assess the purity of the Protein A-purified protein. FIG. 27B is SDS-PAGE analysis used to assess the purity of the Protein A-purified protein.

Figure 28:
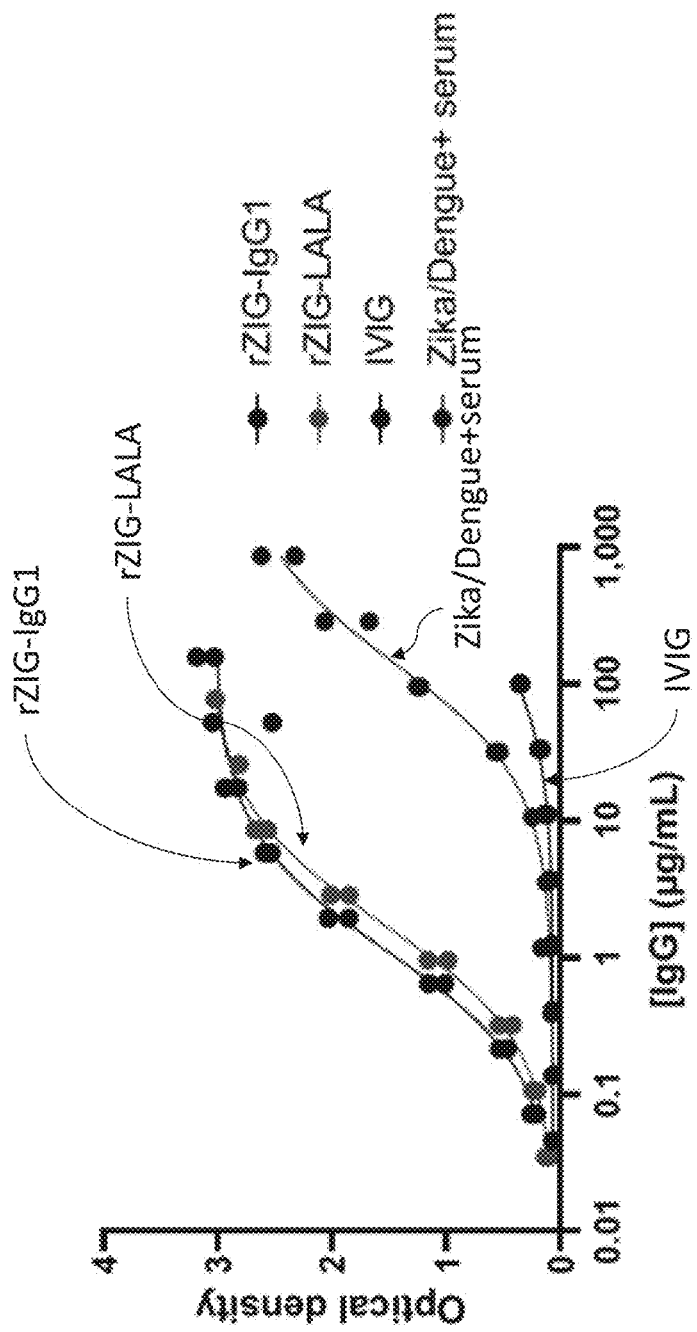

FIG. 28 shows rZIG binding to Zika measured by ELISA. rZIG-IgG1, rZIG-LALA, negative control IVIG, and positive control Zika/Dengue positive serum were serially diluted and added to a Zika envelope-coated plate. Antigen-specific responses were quantified by an anti-human-HRP secondary antibody.

Figure 29:
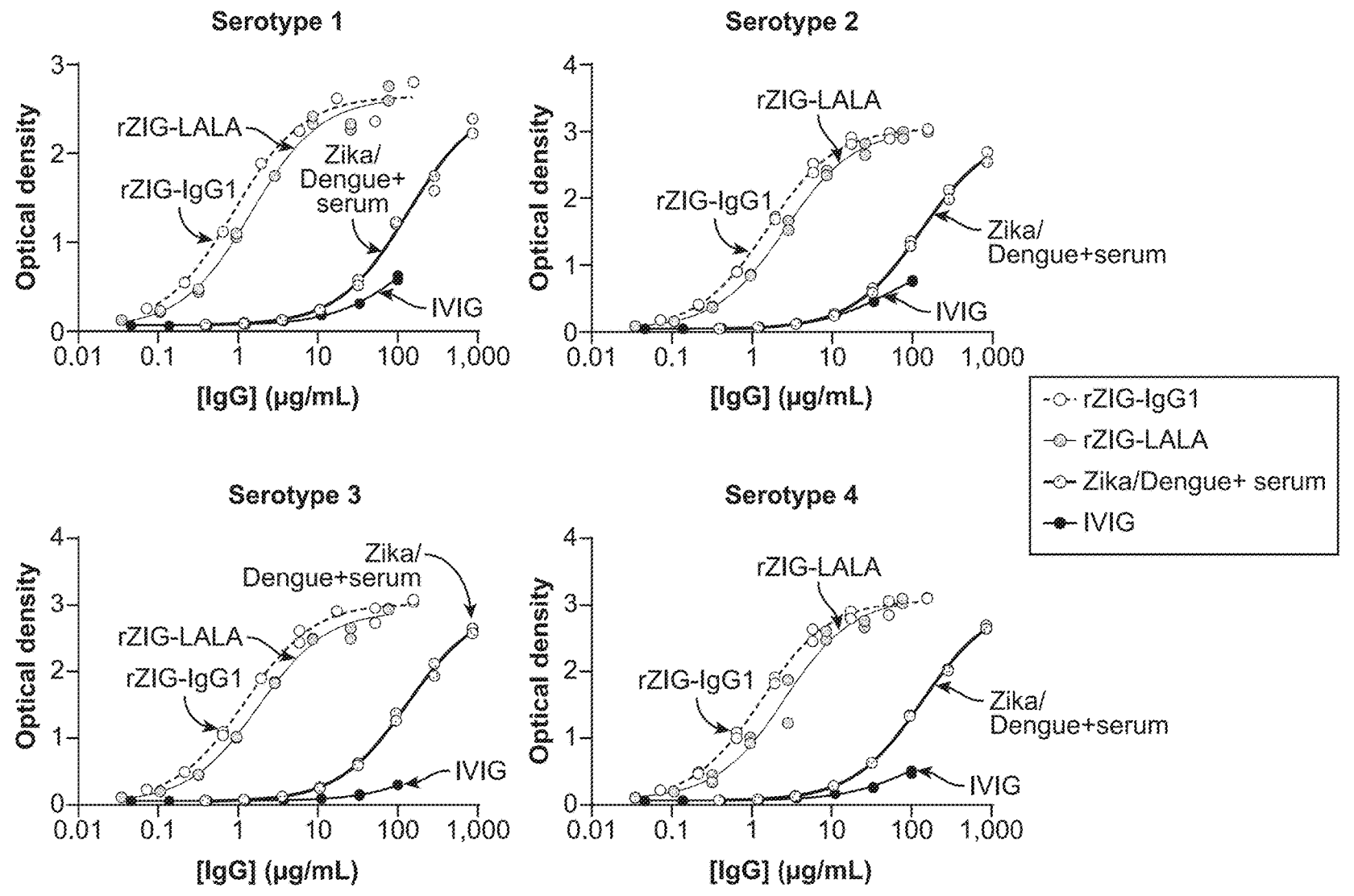

FIG. 29 shows rZIG binding to Dengue serotypes measured by ELISA. rZIG-IgG1, rZIG-LALA, negative control IVIG, and positive control Zika/Dengue positive serum were serially diluted and added to a Dengue serotypes 1, 2, 3, or 4 envelope-coated plates. Antigen-specific responses were quantified by an anti-human-HRP secondary antibody.

Figure 30:
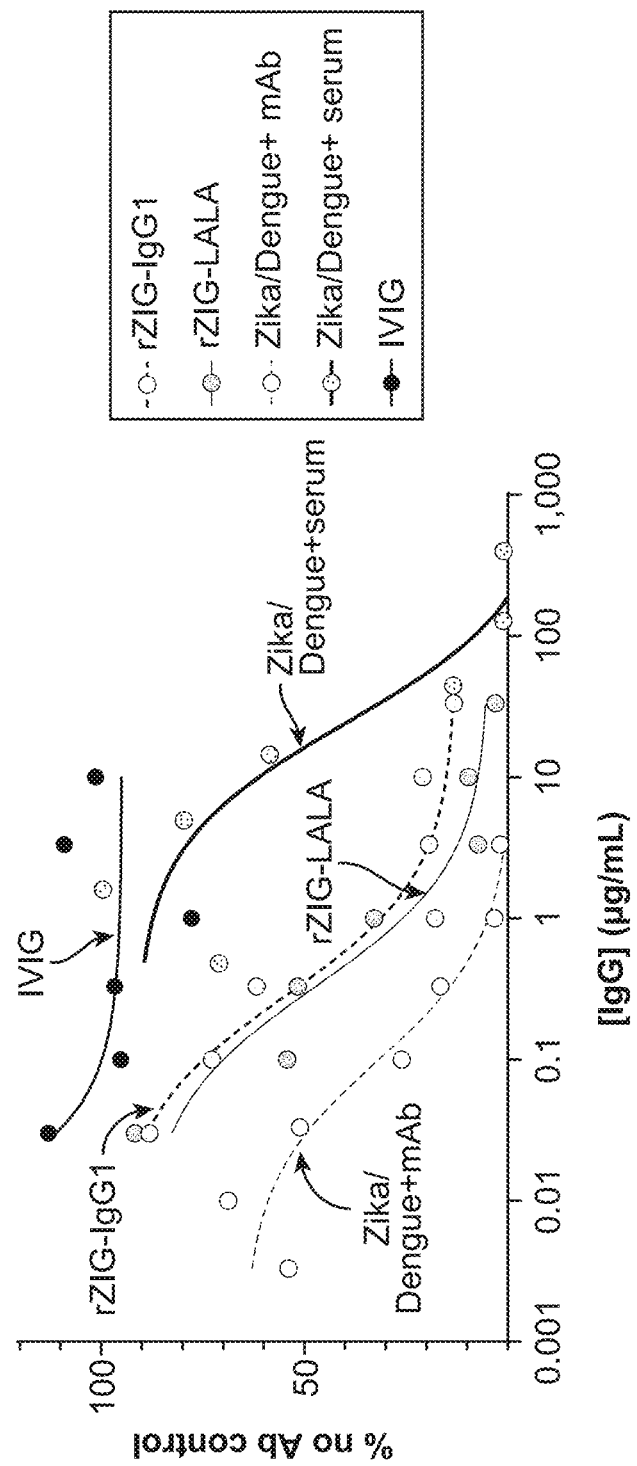

FIG. 30 provides results from Zika pseudotype virus neutralization assay. rZIG-IgG1, rZIG-LALA, negative control IVIG, positive control Zika/Dengue mAb, and positive control Zika/Dengue positive serum were serially diluted, co-incubated with Zika pseudotype virus, and added to BHK/DC-SIGN target cells. Antibody induced neutralization was quantified by the infection-induced luciferase expression divided by luciferase expression in the no Ab control.

Figure 31:
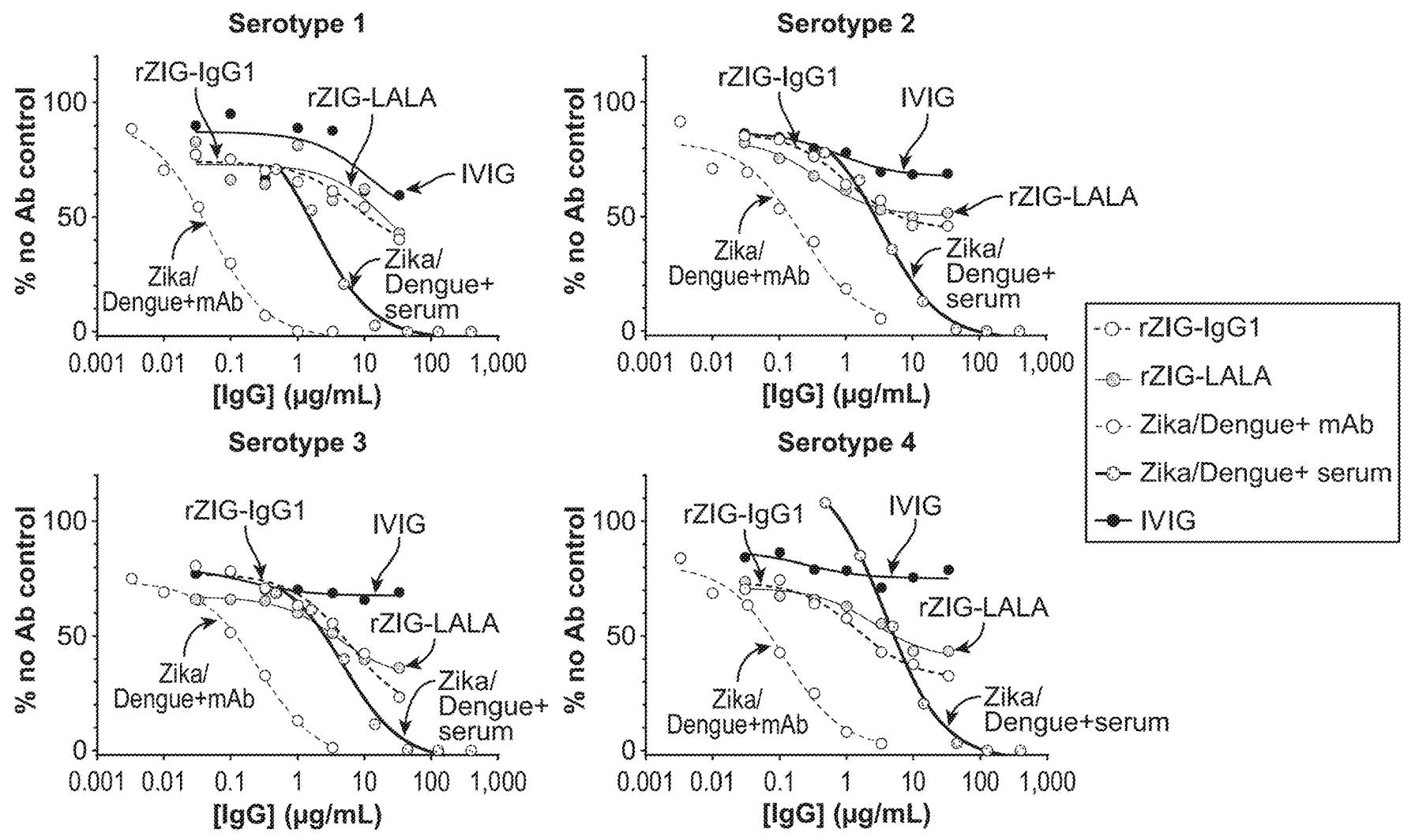

FIG. 31 provides results from Dengue serotype pseudotype virus neutralization assay. rZIG-IgG1, rZIG-LALA, negative control IVIG, positive control Zika/Dengue mAb, and positive control Zika/Dengue positive serum were serially diluted, co-incubated with pseudotype virus expressing the indicated Dengue serotype envelope antigens, and added to BHK/DC-SIGN target cells. Antibody induced neutralization was quantified as "% no Ab control", or infection-induced luciferase expression divided by the luciferase expression in the no Ab control.

FIG. 32 is a schematic of antibody dependent enhancement (ADE) assay. Antibody bound to pseudotype virus can infect cells through the Fc receptor expressed on target cells. By introducing an Fc mutation that prevents FcR binding (e.g. LALA), antibody-induced viral infection is abrogated.

Figure 33B:
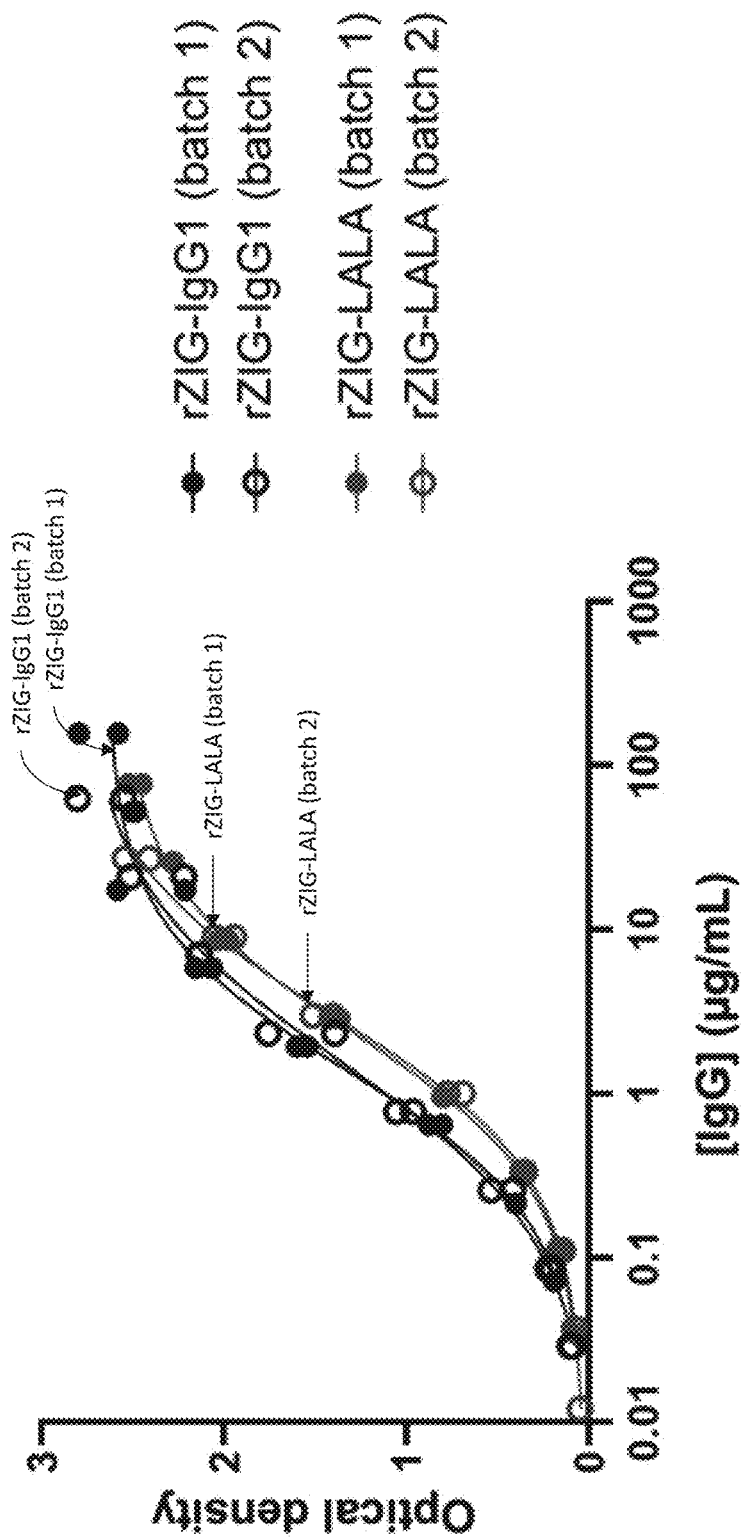

FIGS. 33A and 33B show batch-to-batch variation of rZIG.

FIG. 33A is based on RNA antibody sequencing performed (in duplicate) on RNA isolated from the end of replicate CHO bioreactor production runs. Jaccard (left) and Morisita (right) analyses showed that the amount of antibody clone variation between production batches and between PCR replicates performed on each batch. Wilcoxon rank sum tests showed that the indices from the PCR replicates came from the same population as the indices from the batch replicates, suggesting that the variability inherent to the batches was no worse than the variability between PCR replicates.

FIG. 33B shows binding of the indicated batch of serially diluted rZIG-IgG1 and rZIGLALA to a Zika envelope-coated plate was measured by ELISA.

FIG. 34A to 34D shows results from repertoire sequencing analysis of rHIG.

Figure 34A:
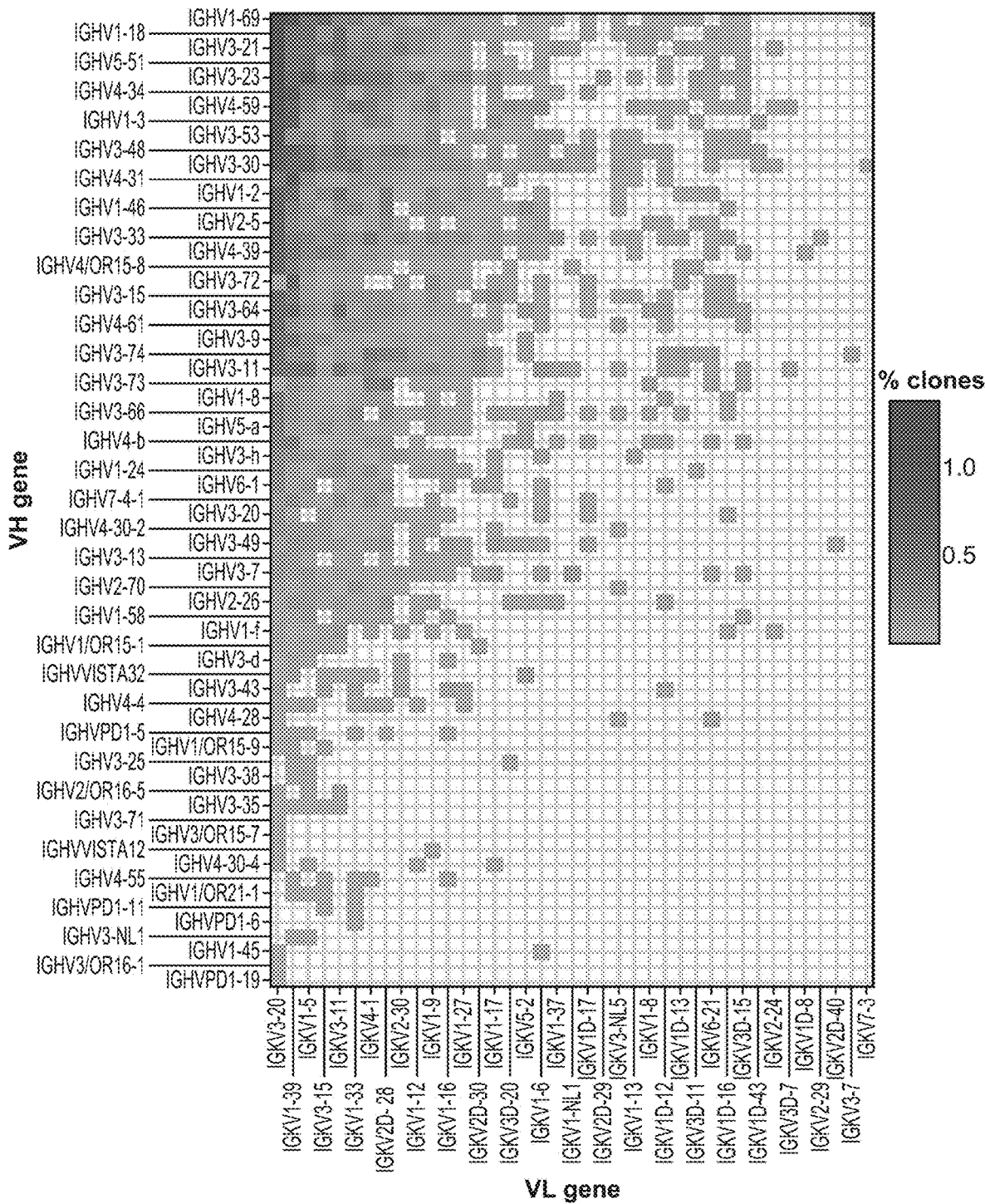

FIG. 34A is a heatmap showing antibody variable (V) gene usage from the linked scFv library. The x-axis and y-axis show light and heavy chain V genes, respectively. The color represents percent unique clone abundance in the library.

Figure 34B:
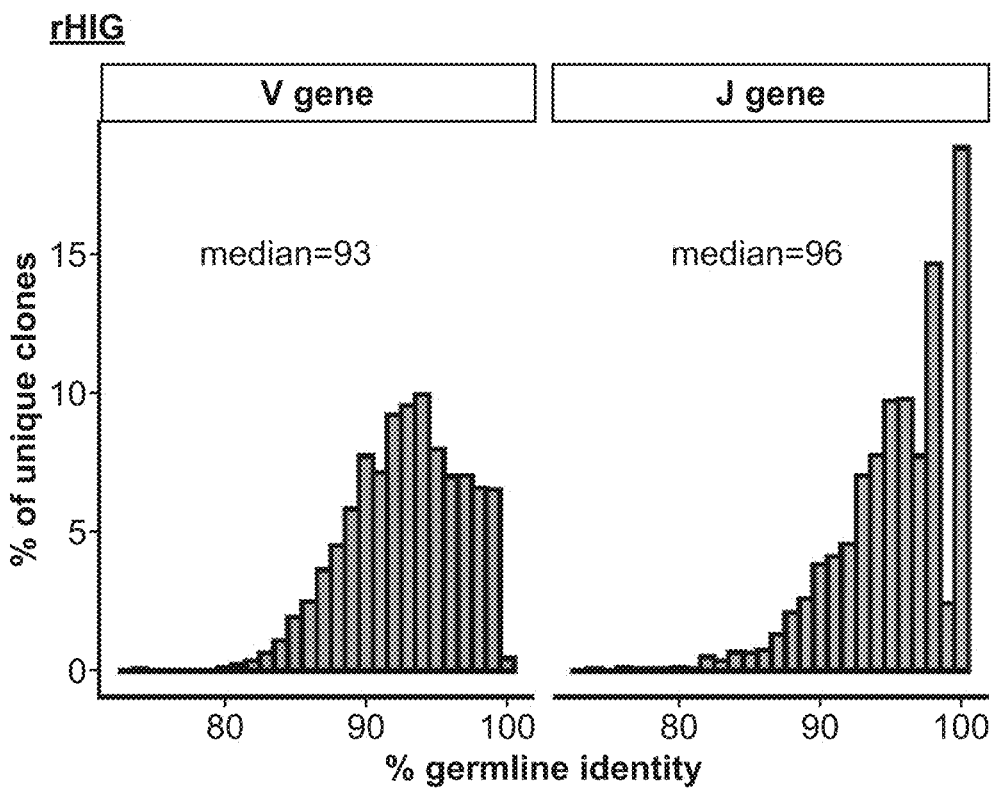

FIG. 34B is a histogram showing distribution of percent germline identity for variable gene (V; left panel) and joining gene (J; right panel), from the final CHO library.

Figure 34C:
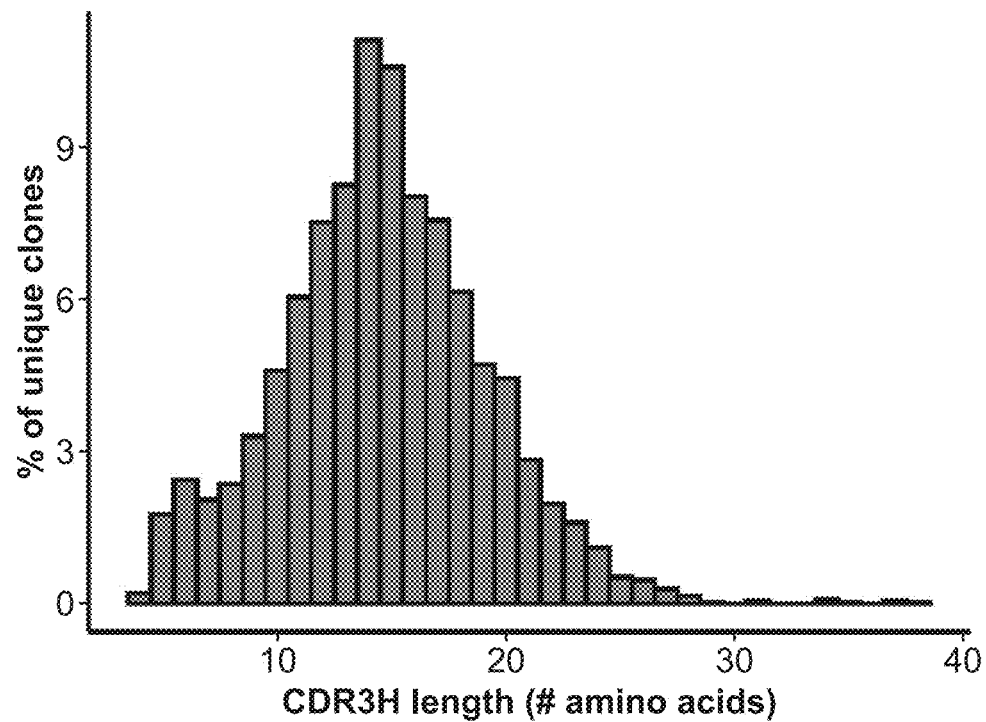

FIG. 34C is a histogram showing the distribution of heavy chain CDR3 amino acid length, from the final CHO library.

Figure 34D:
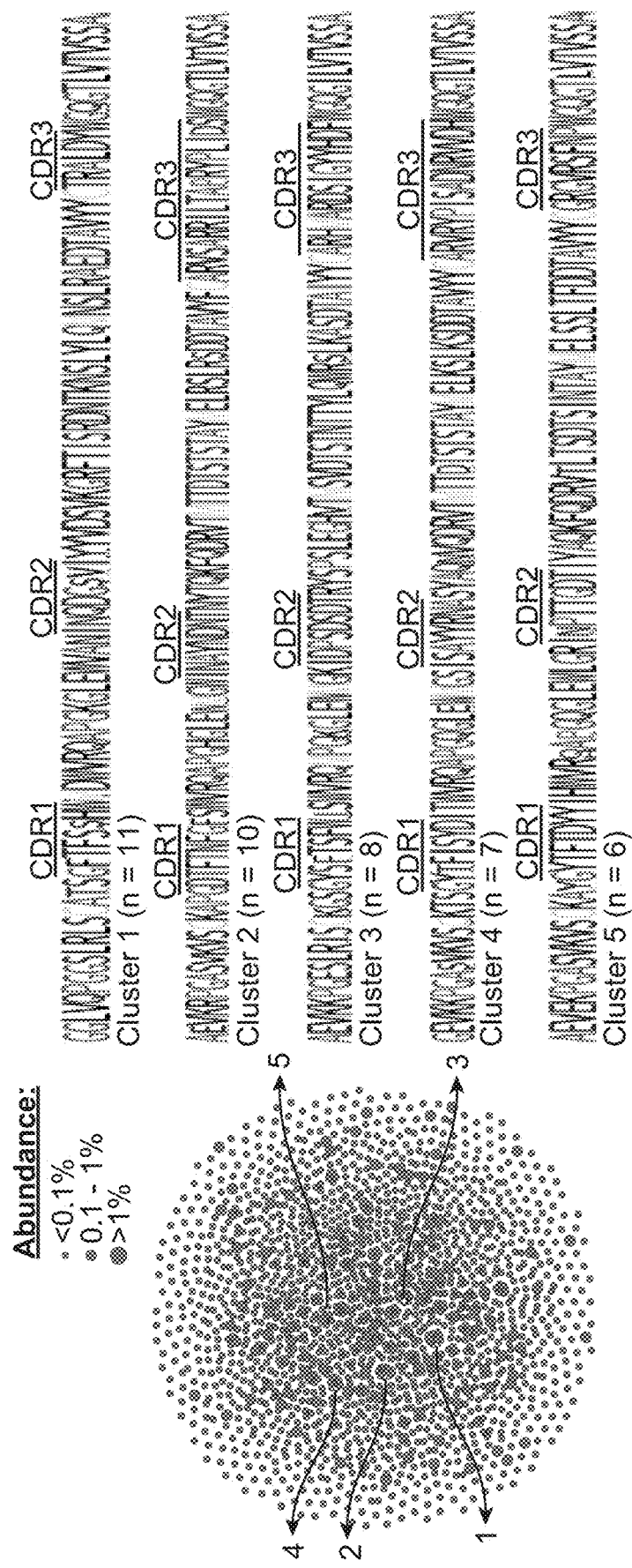

FIG. 34D. Left: The clonal cluster analysis of Rhig antibodies, modified from FIG. 4 (from the final CHO library). Right: Sequence logos of all heavy chain sequences from the top five clusters (based on clone count). The first 8 amino acids (variable region primer binding sites) are not shown. Figure discloses SEQ ID NOS 25961-25965, respectively, in order of appearance.

FIG. 35A to 35D provide results from repertoire sequencing analysis of rPIG.

Figure 35A:
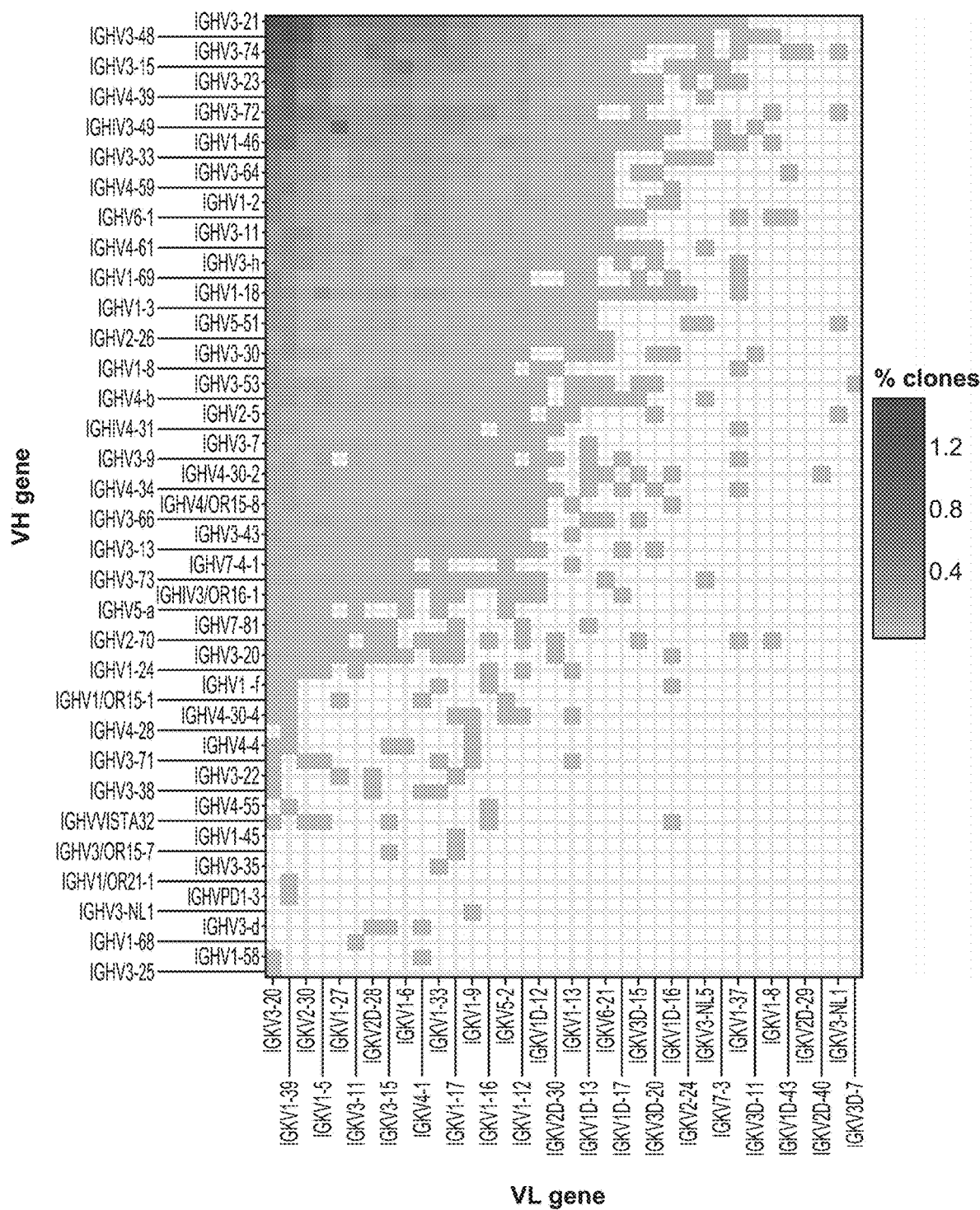

FIG. 35A is a heatmap showing antibody variable (V) gene usage from the linked scFv library. The x-axis and y-axis show light and heavy chain V genes, respectively. The color represents percent unique clone abundance in the library.

Figure 35B:
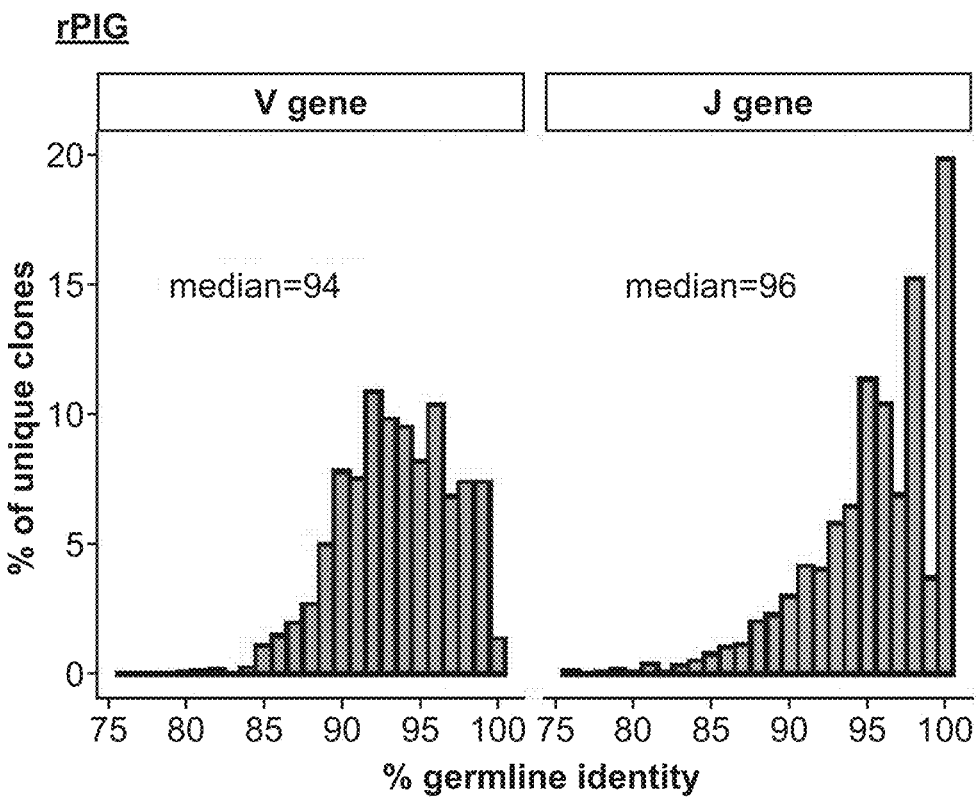

FIG. 35B is a histogram showing distribution of percent germline identity for variable gene (V; left panel) and joining gene (J; right panel), from the final CHO library.

Figure 35C:
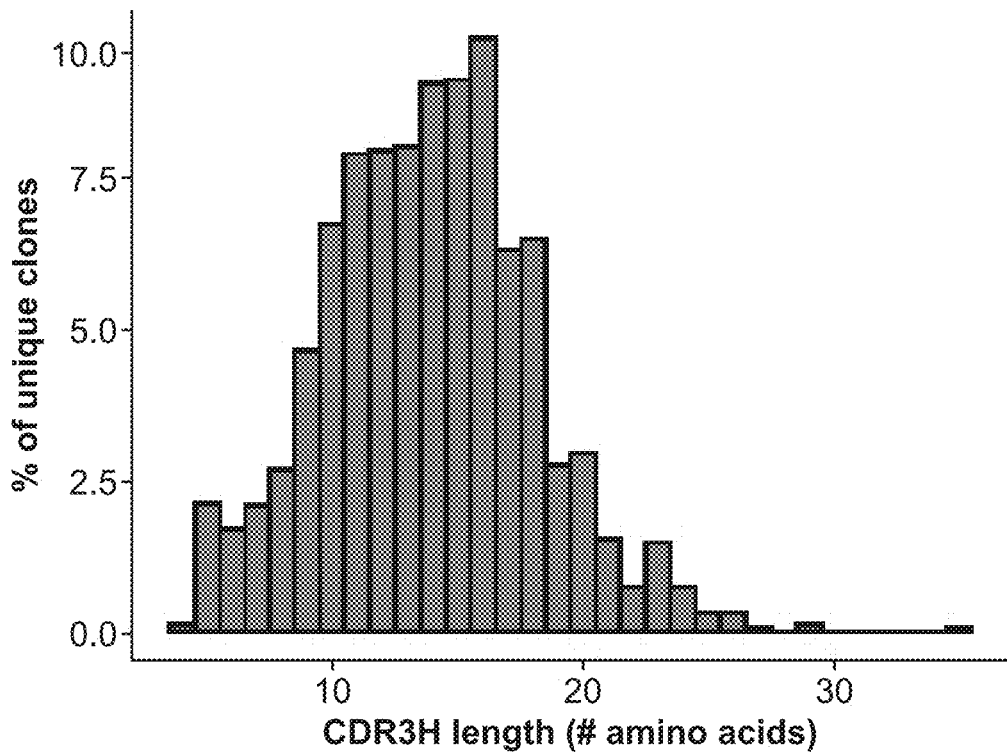

FIG. 35C is a histogram showing the distribution of heavy chain CDR3 amino acid length, from the final CHO library.

Figure 35D:
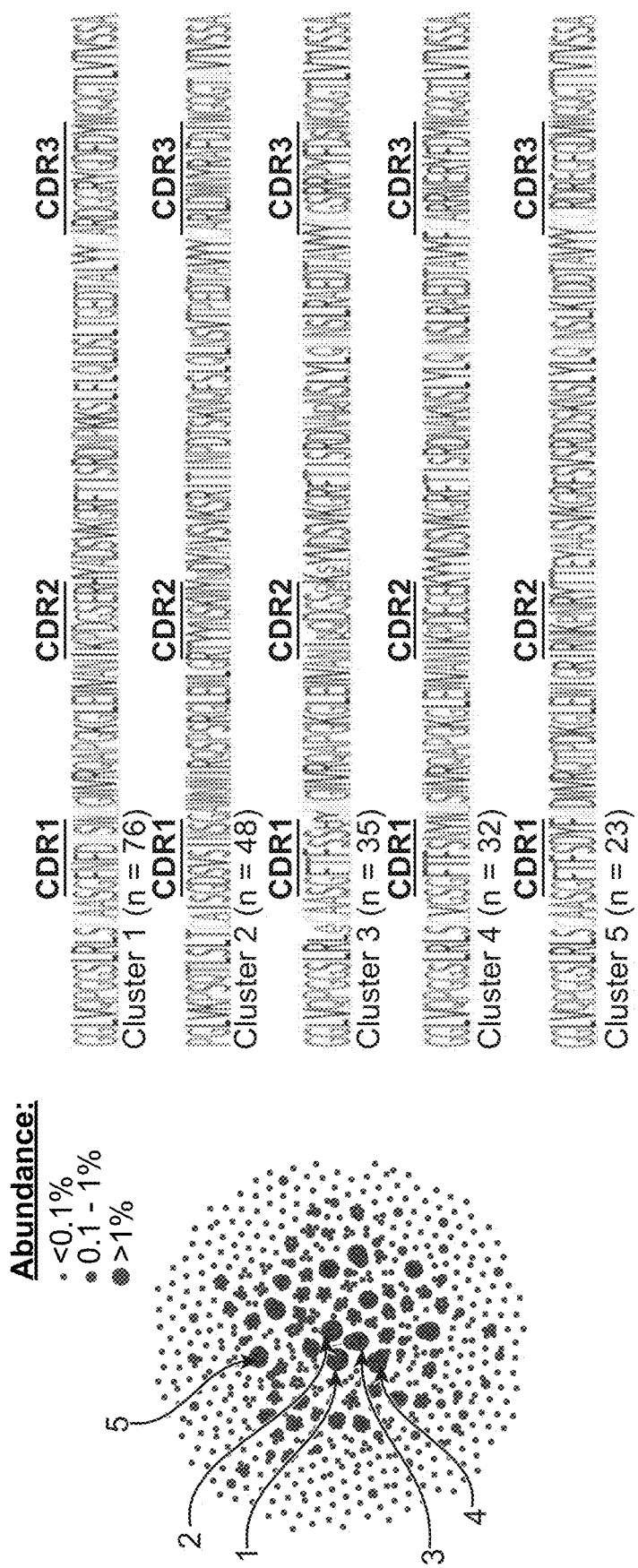

FIG. 35D. (d) Left: The clonal cluster analysis of Rpig antibodies, modified from FIG. 4 (from the final CHO library). Right: Sequence logos of all heavy chain sequences from the top five clusters (based on clone count). The first 8 amino acids (variable region primer binding sites) are not shown. Figure discloses SEQ ID NOS 25966-25970, respectively, in order of appearance.

Figures 36A, 36B:
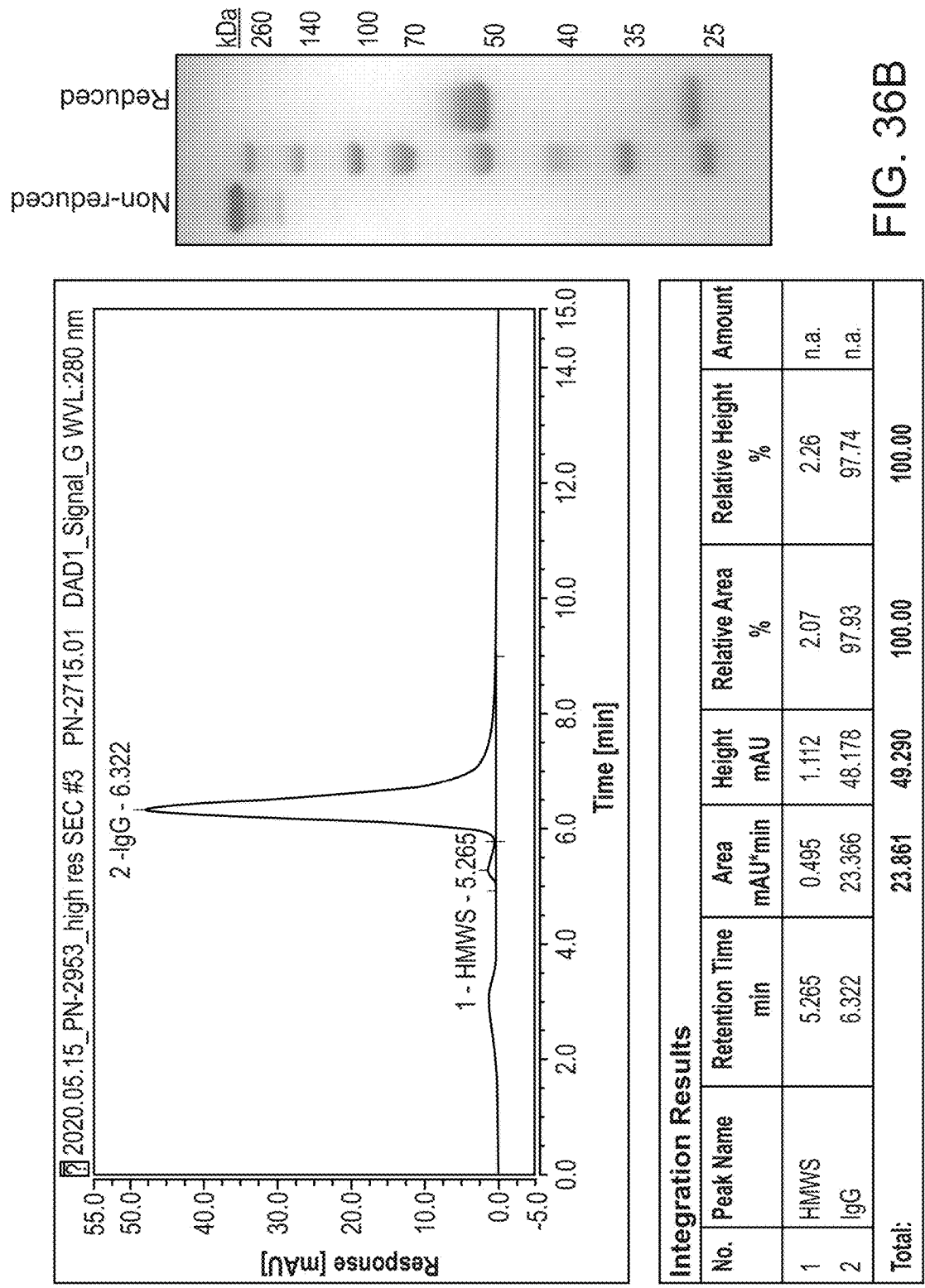

FIGS. 36A and 36B show quality control analysis of purified rHIG protein. FIG. 36A is from SEC-HPLC analysis used to assess the purity of the Protein A-purified protein. FIG. 36B is from SDS-PAGE analysis used to assess the purity of the Protein A-purified protein.

FIGS. 37A and 37B show quality control analysis of purified rPIG protein. FIG. 37A is from SEC-HPLC analysis were used to assess the purity of the Protein A-purified protein. FIG. 37B is from SDS-PAGE analysis used to assess the purity of the Protein A-purified protein.

Figure 38:
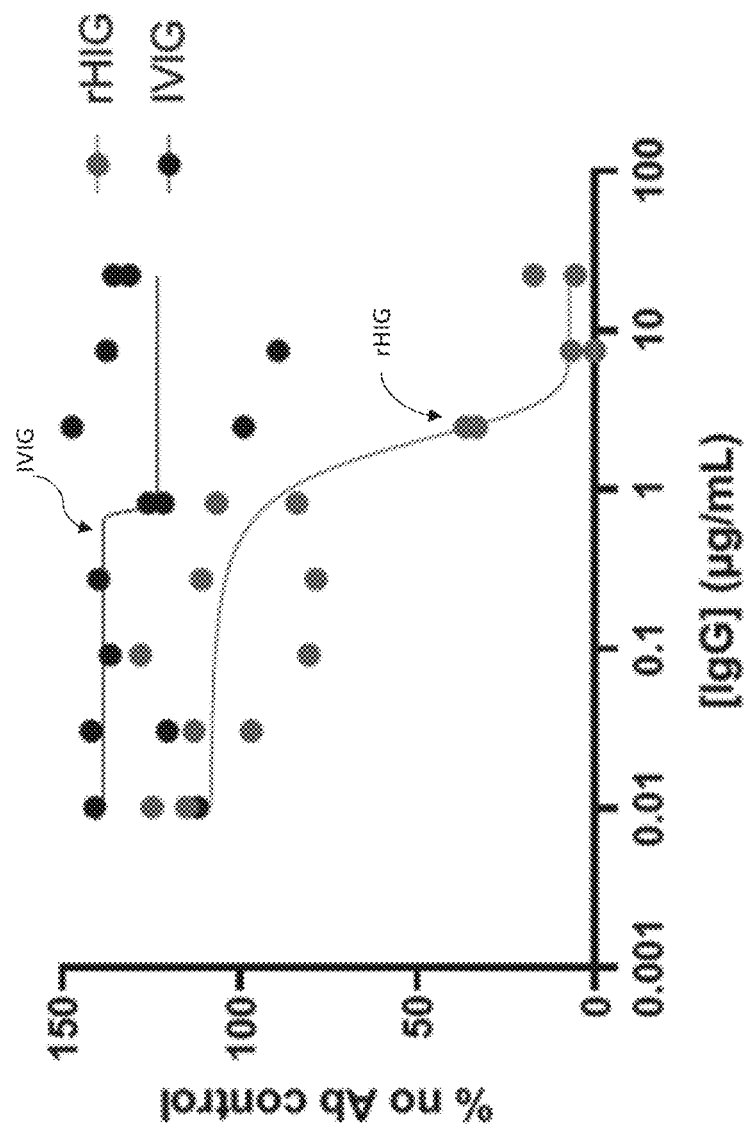

FIG. 38 provides data from *Haemophilus influenzae* serum bactericidal assay (SBA). rHIG and IVIG were serially diluted and co-incubated with $5 \times 10^4$ CFU/mL *Haemophilus influenzae* Eagan strain. After incubation, complement was added, incubated, and test samples were plated on chocolate agar. After 16 hours incubation, bacteria colony counts for each serial dilution were quantified and divided by the bacteria colony counts in the no Ab control.

Figure 39:
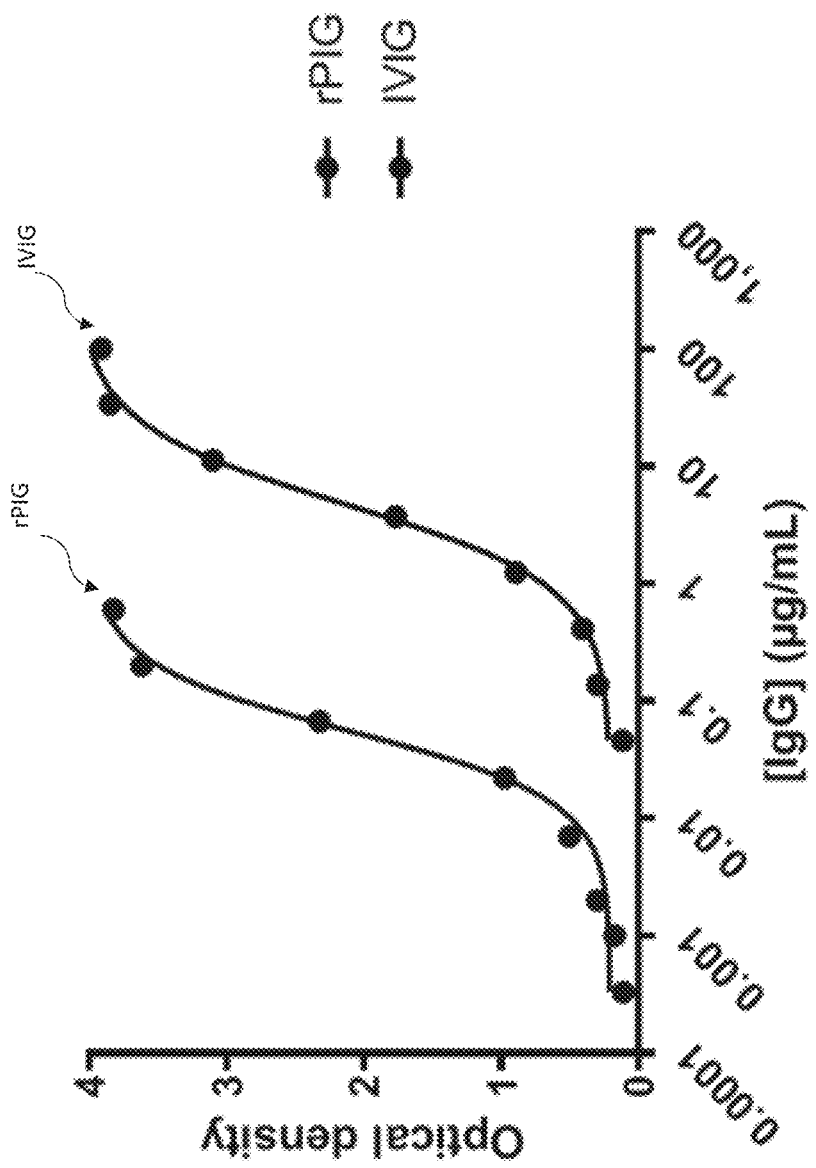

FIG. 39 provides data from Pneumococcal antibody binding assay using ELISA. Binding of serially diluted rPIG and IVIG to a pool of 23 pneumococcal polysaccharides was measured by ELISA.

Figure 40A:
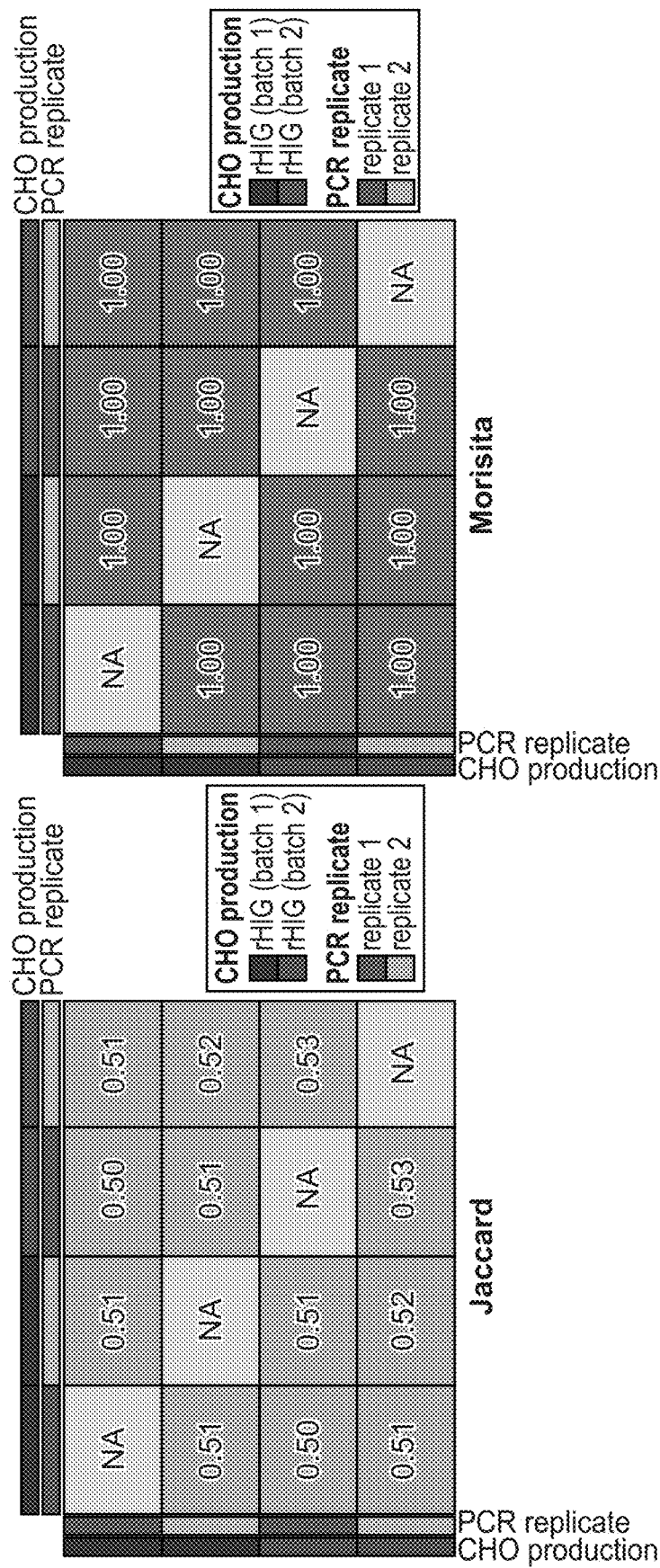
Figure 40B:
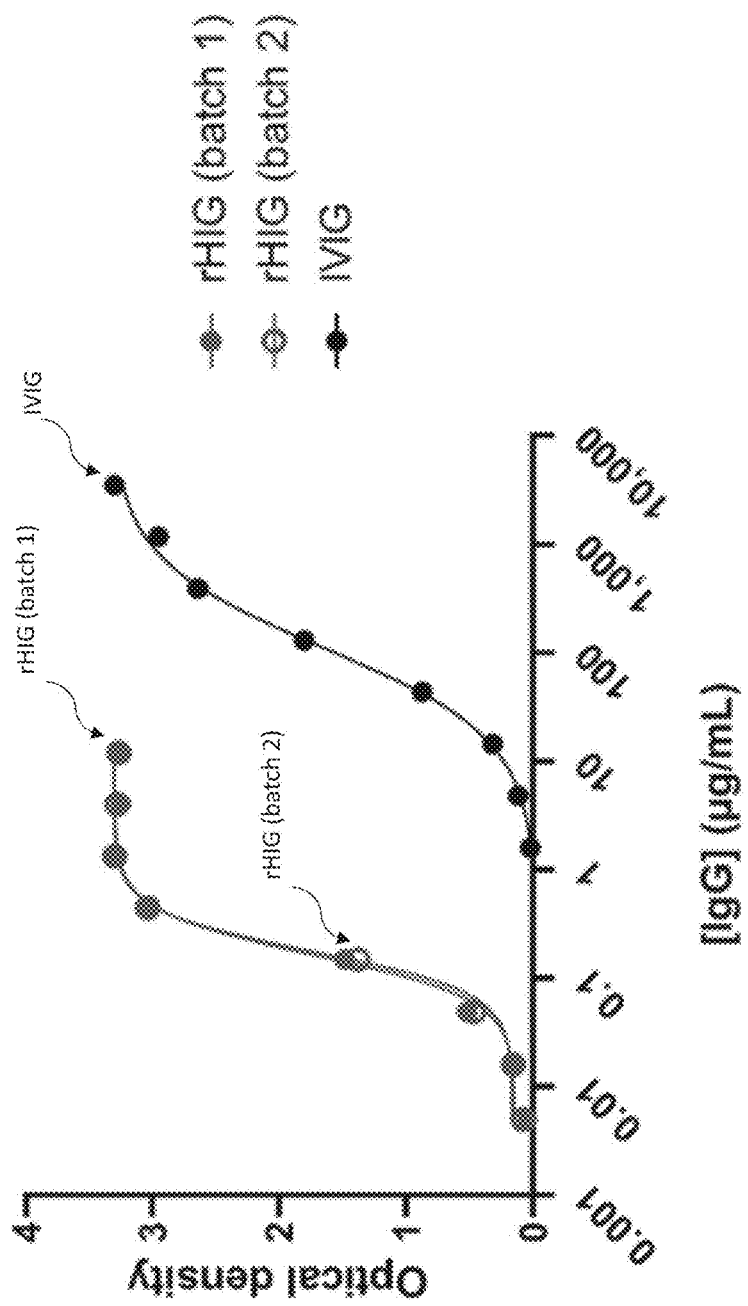

FIG. 40A to 40B show measurement of batch-to-batch variation of rHIG. (FIG. 40A) RNA antibody sequencing was performed (in duplicate) on RNA isolated from the end of replicate CHO bioreactor production runs. Jaccard (left)

and Morisita (right) analyses showed that the amount of antibody clone variation between production batches and between PCR replicates performed on each batch. Wilcoxon rank sum tests showed that the indices from the PCR replicates came from the same population as the indices from the batch replicates (p>0.05), suggesting that the variability inherent to the batches was no worse than the variability between PCR replicates. FIG. 40B show binding of the indicated batch of serially diluted rHIG and IVIG to Hib as measured by ELISA.

Figure 41A:
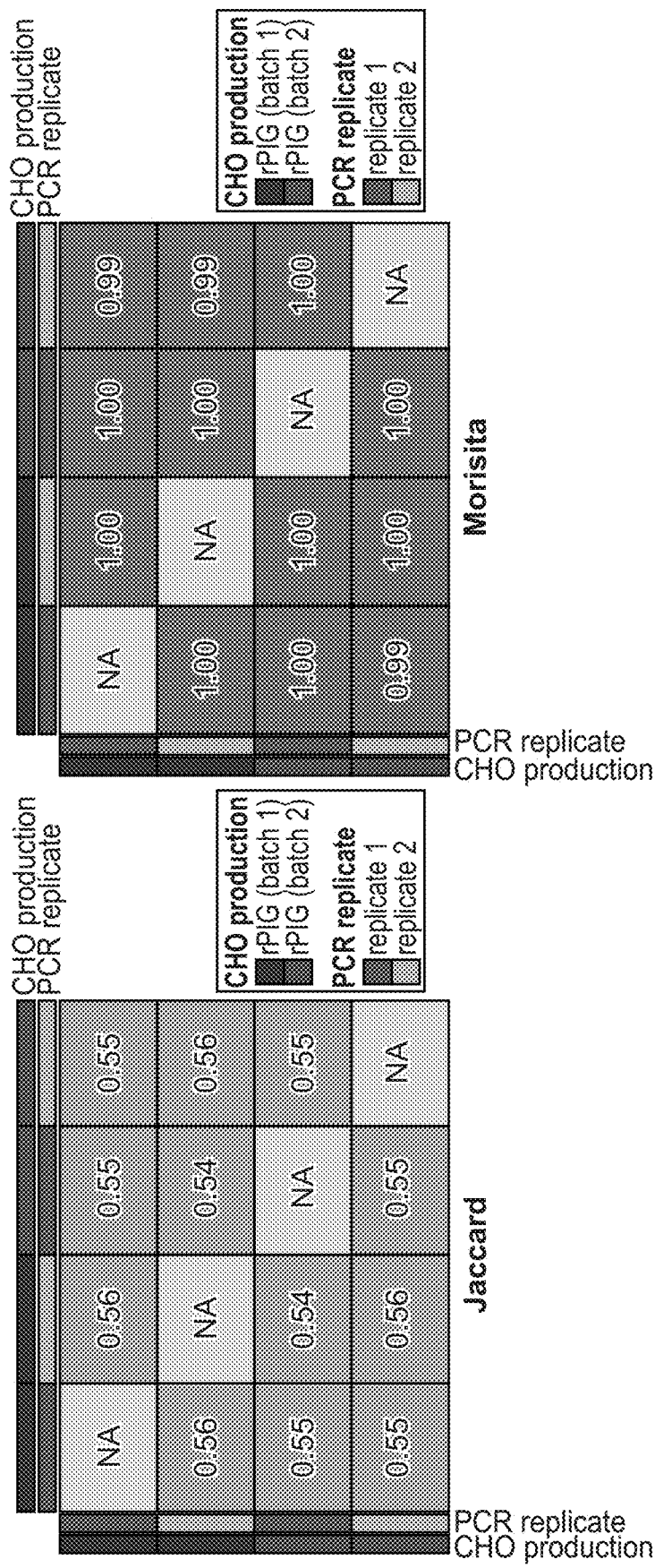
Figure 41B:
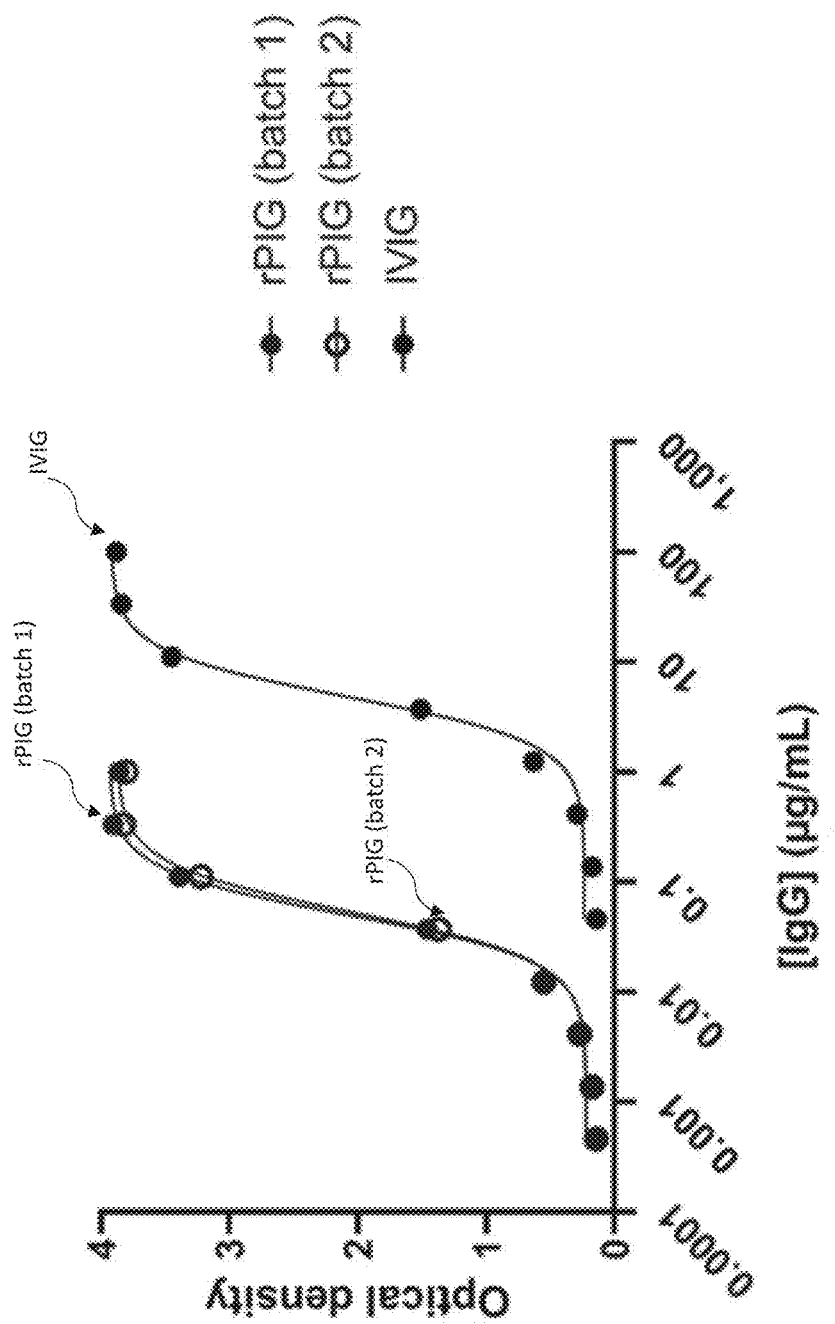

FIG. 41A and FIG. 41B show measurement of batch-to-batch variation of rPIG. (FIG. 41A) RNA antibody sequencing was performed (in duplicate) on RNA isolated from the end of replicate CHO bioreactor production runs. Jaccard (left) and Morisita (right) analyses showed that the amount of antibody clone variation between production batches and between PCR replicates performed on each batch. Wilcoxon rank sum tests showed that the indices from the PCR replicates came from the same population as the indices from the batch replicates (p>0.05), suggesting that the variability inherent to the batches was no worse than the variability between PCR replicates. FIG. 41B shows binding of the indicated batch of serially diluted rPIG and IVIG to a pool of 23 pneumococcal polysaccharides as measured by ELISA.

Figure 42B:
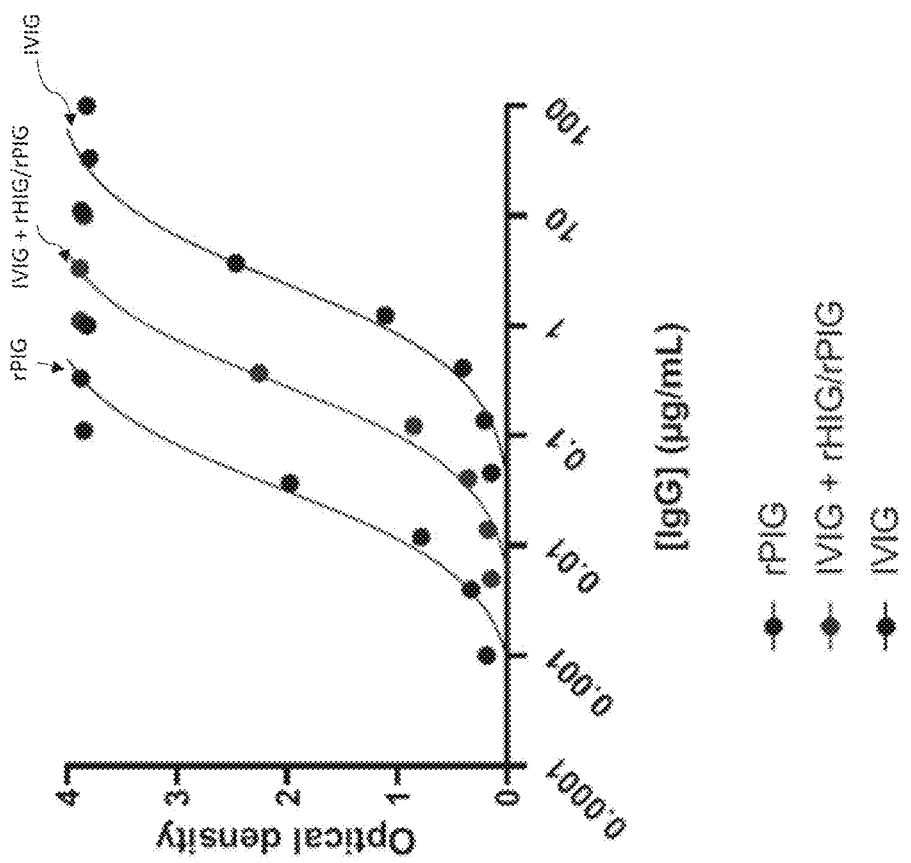
Figure 42A:
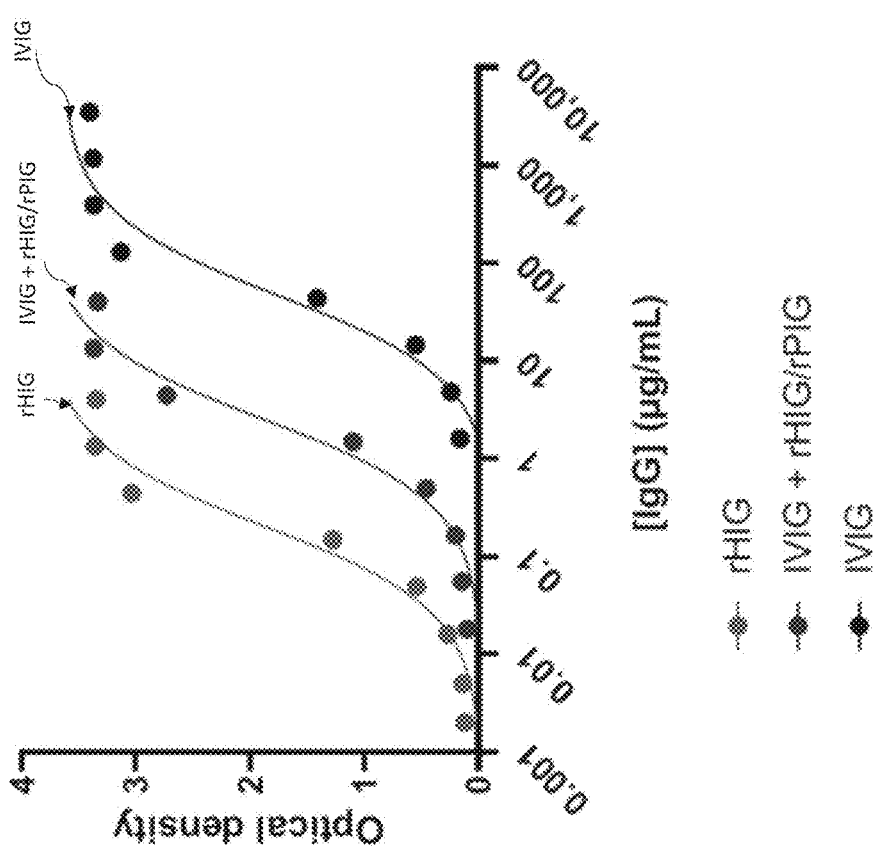

FIGS. 42A and 42B show Pneumococcal or Hib antibody binding of IVIG+rHIG/rPIG by ELISA. FIG. 42A shows binding of serially diluted rHIG, IVIG+rHIG/rPIG, and IVIG to Hib, measured by ELISA. FIG. 42B shows binding of serially diluted rPIG, IVIG+rHIG/rPIG, and IVIG to a pool of 23 pneumococcal polysaccharides, measured by ELISA.

FIG. 43A illustrates procedures for immunizing three Trianni mice weekly with T cells isolated from one human donor with ALD/MDP adjuvant. After week 5, serum from the mice was tested to confirm binding to T cells before a final boost without adjuvant 5 days prior to harvesting the organ B cells.

Figure 43B:
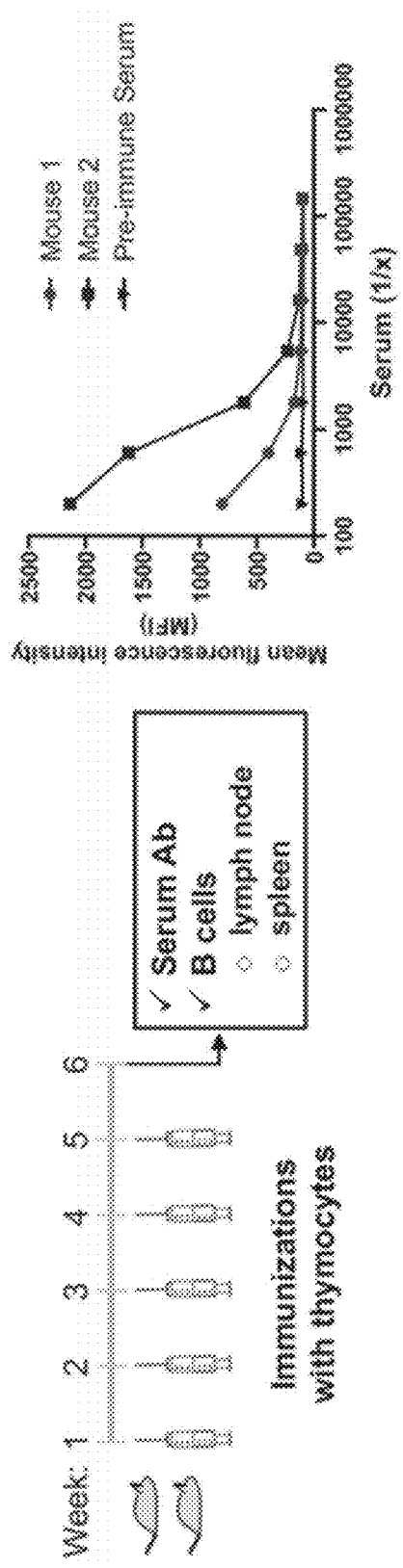

FIG. 43B illustrates procedures for immunizing two Trianni mice weekly with thymocytes isolated from five separate human donors with ALD/MDP adjuvant. After week 5, serum from the mice was tested to confirm binding to T cells before a final boost without adjuvant 5 days prior to harvesting the organ B cells.

Figure 44A:
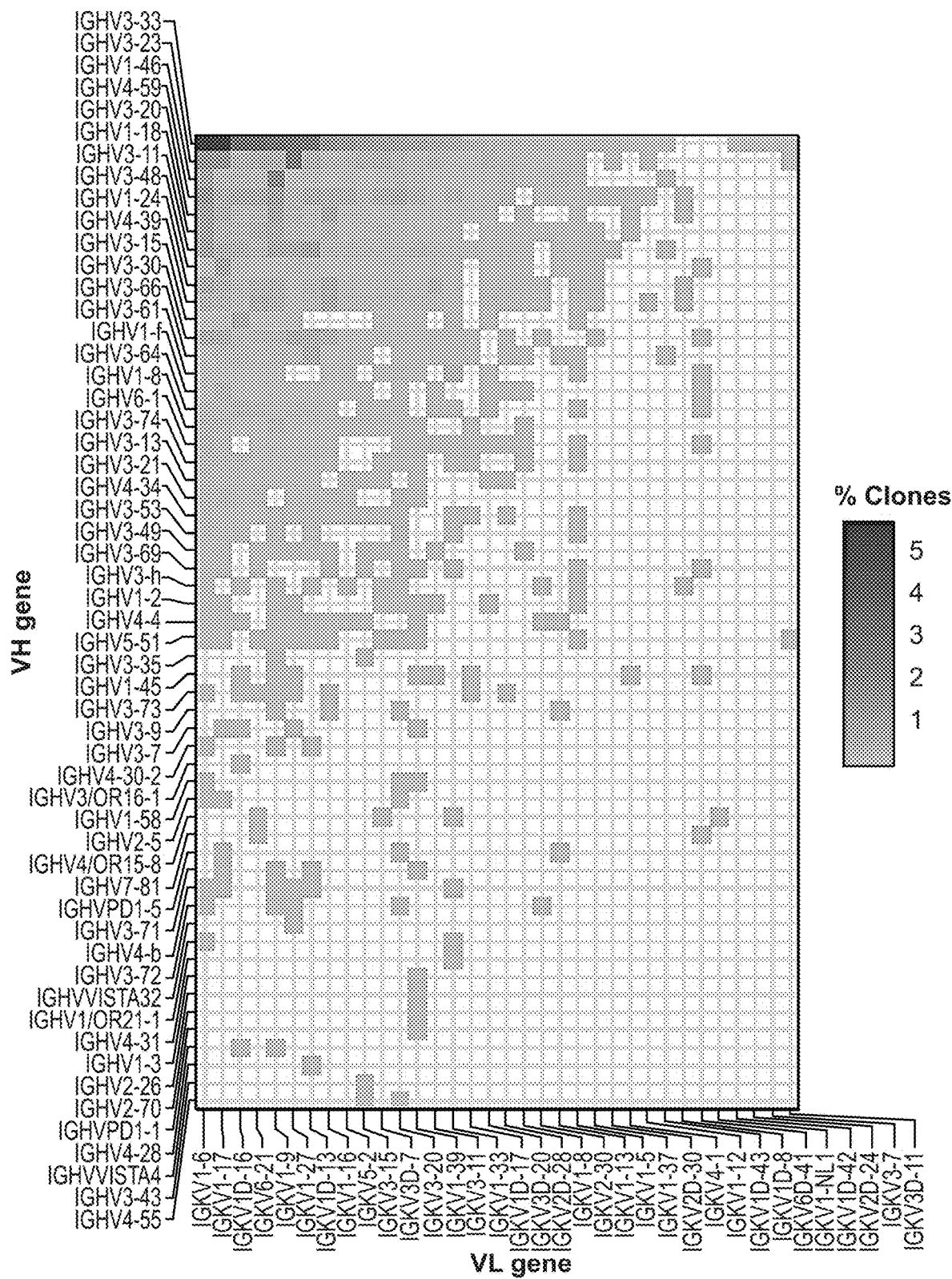

FIG. 44A is a heatmap showing antibody variable (V) gene usage from the linked scFv library (the 4 libraries combined). The x-axis and y-axis show light and heavy chain V genes, respectively. The greyscale represents percent unique clone abundance in the library.

Figure 44B:
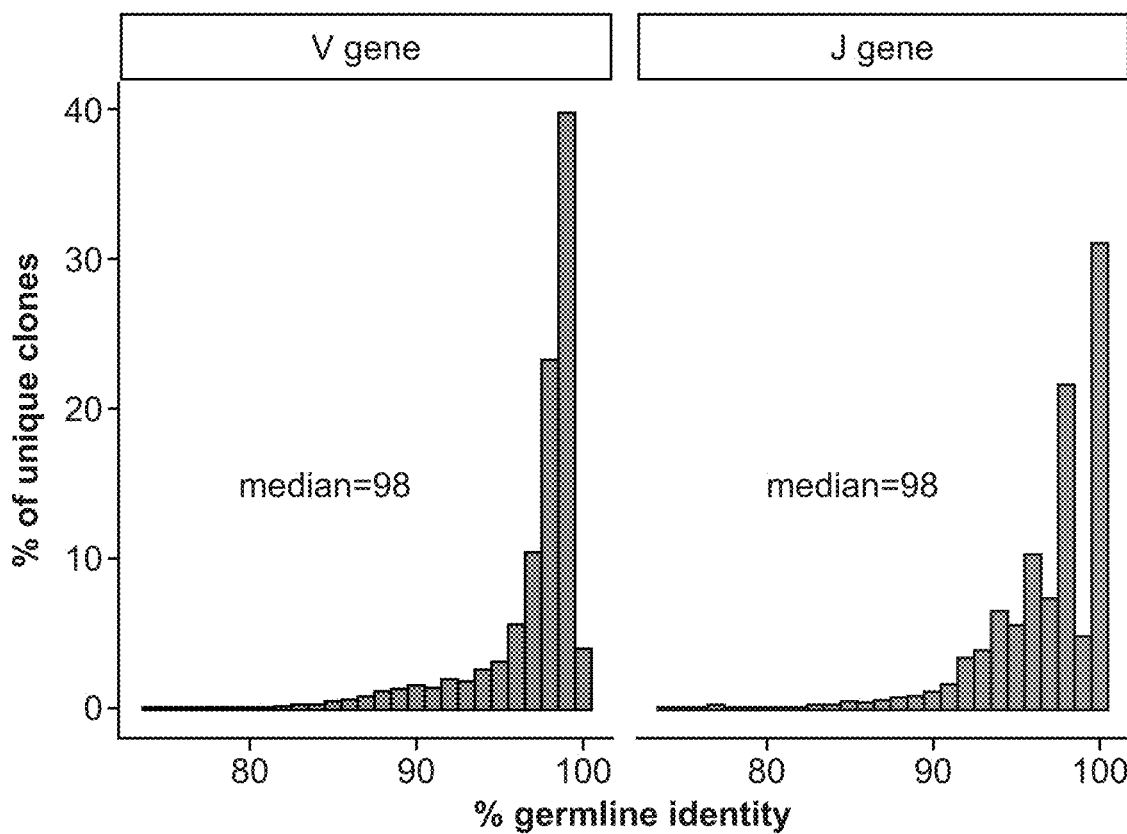

FIG. 44B provides a histogram showing distribution of percent germline identity for variable gene (V; left panel) and joining gene (J; right panel), from the final CHO library.

Figure 44C:
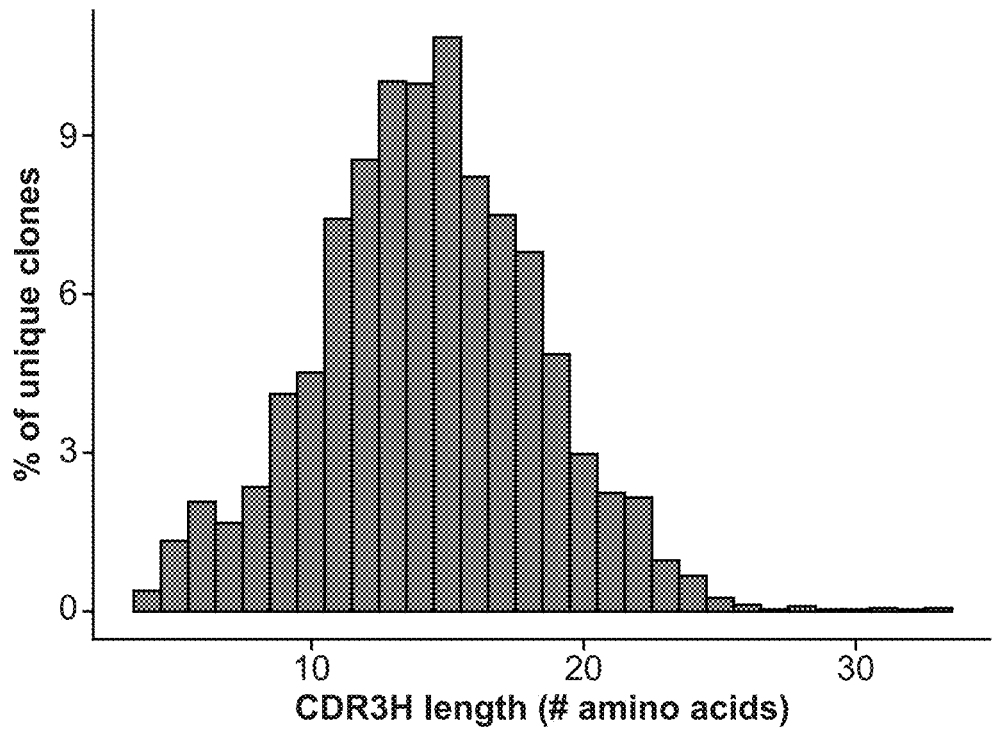

FIG. 44C is a histogram showing the distribution of heavy chain CDR3 amino acid length, from the final CHO library.

Figure 44D:
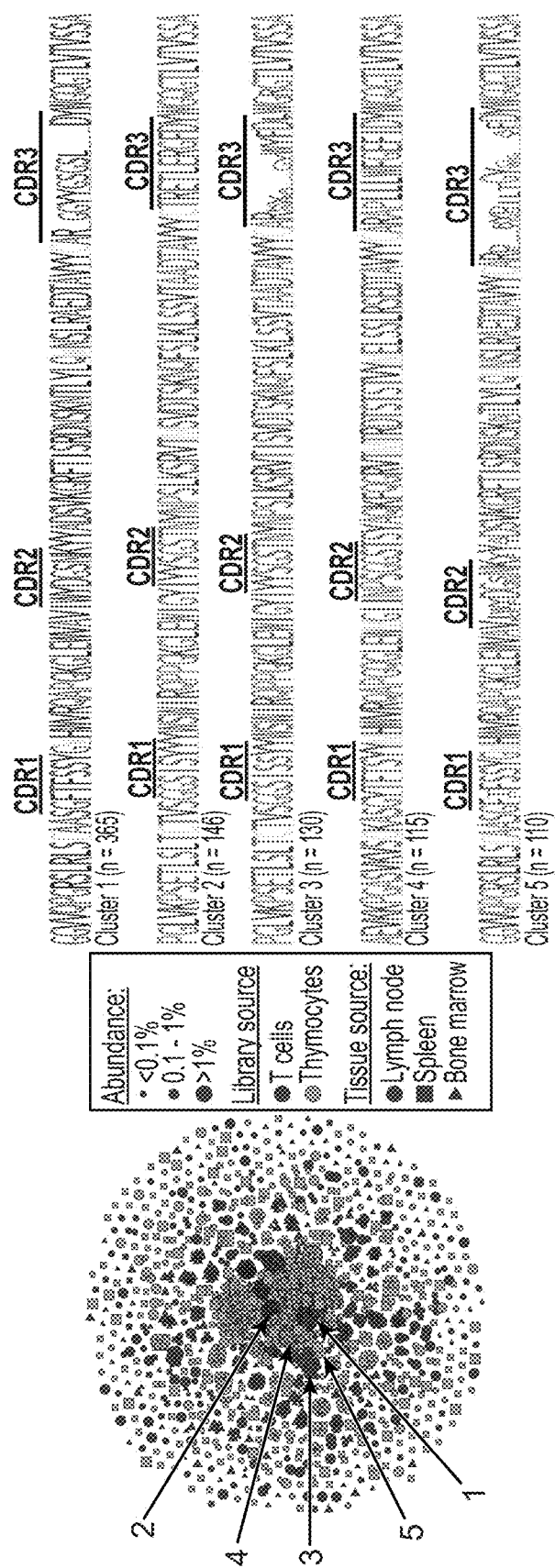

FIG. 44D. Left: The clonal cluster analysis of rhATG antibodies from FIG. 11A (from the CHO libraries). Right: Sequence logos of all heavy chain sequences from the top five clusters (based on clone count). The first 8 amino acids (variable region primer binding sites) are not shown. Figure discloses SEQ ID NOS 25971-25975, respectively, in order of appearance.

Figure 45A:
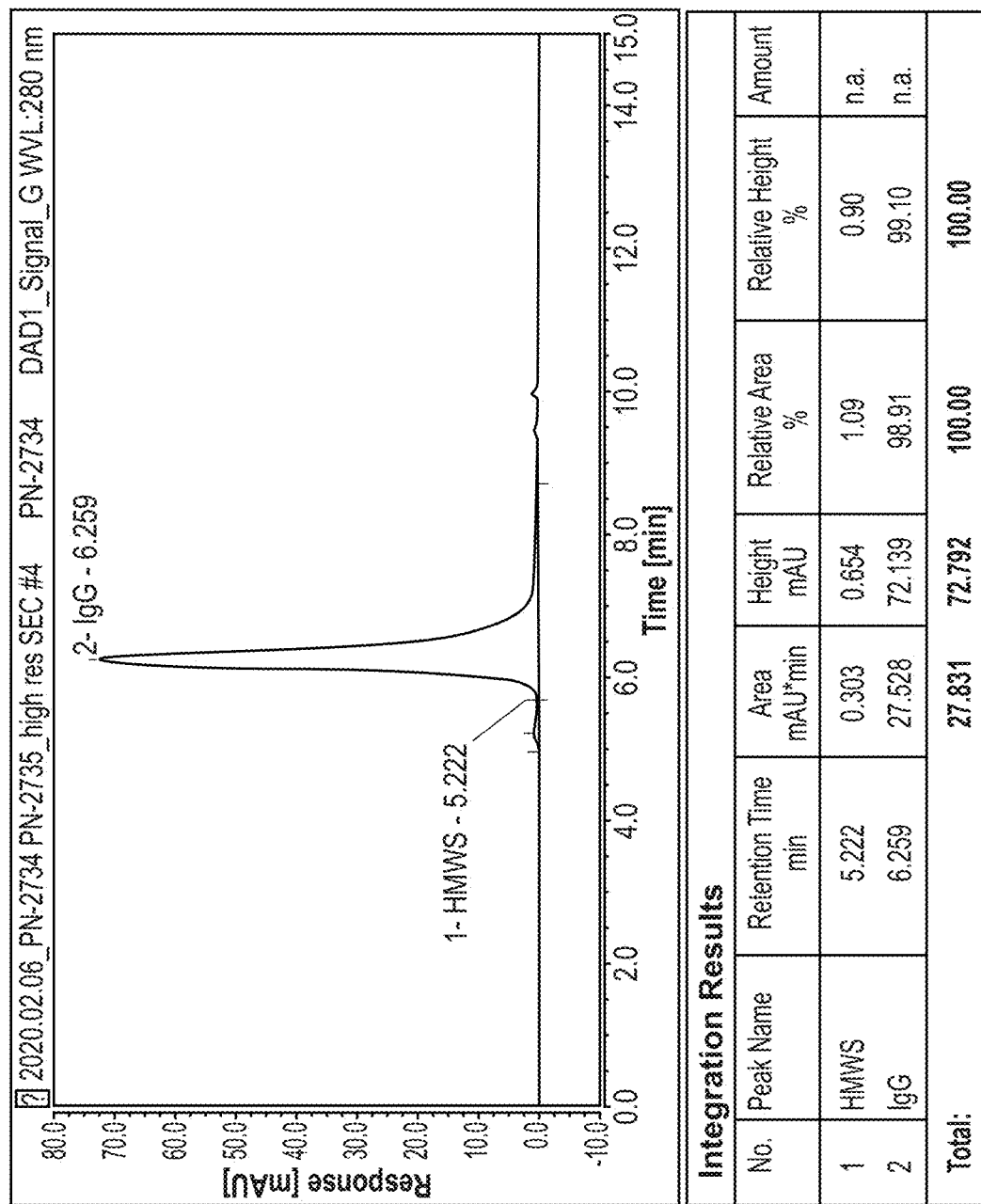
Figure 45B:
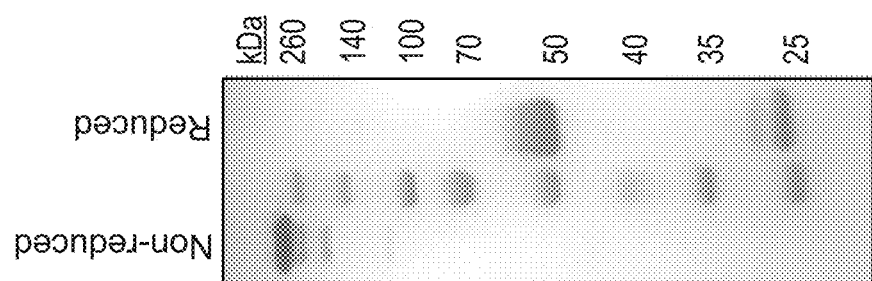

FIG. 45A-45B shows quality control analysis of purified rhATG protein. FIG. 45A shows a result from SEC-HPLC analysis used to assess the purity of the Protein A-purified protein. FIG. 45B shows a result from SDS-PAGE analysis used to assess the purity of the Protein A-purified protein.

Figures 46A, 46B:
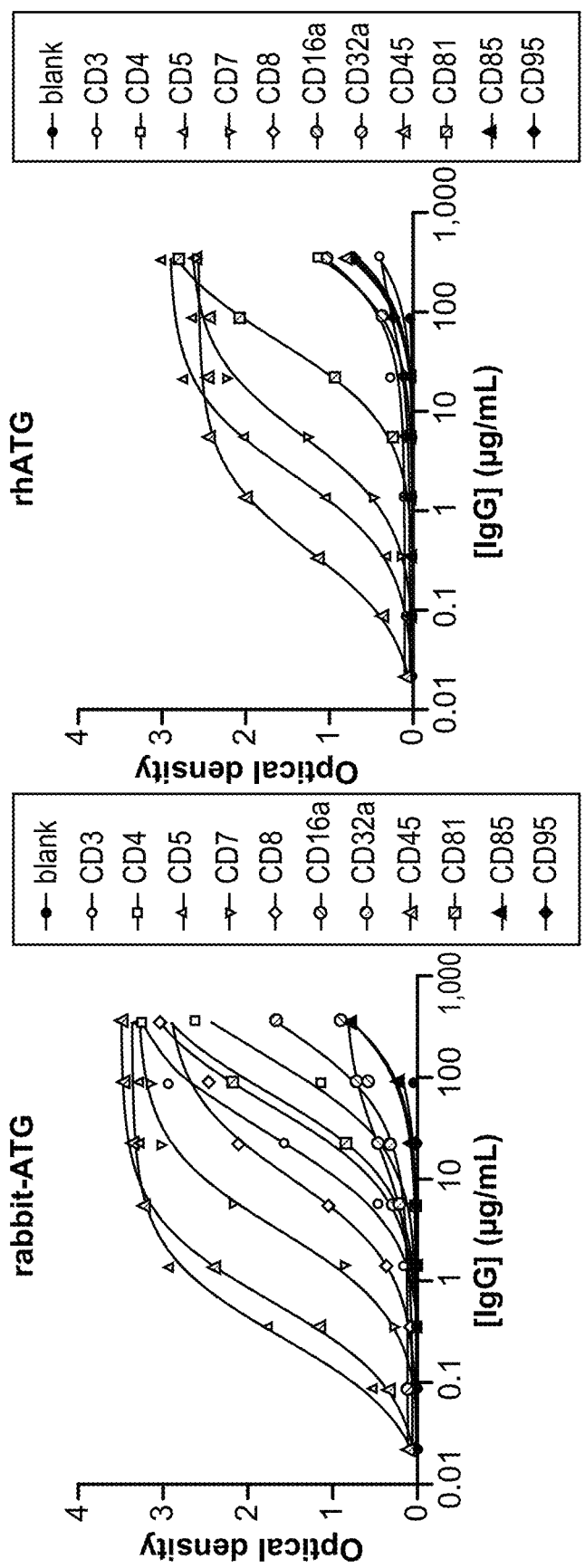

FIG. 46A-46B show ATG immune cell-specific antibody responses measure by ELISA. The indicated Immune cell antigens were coated onto ELISA plates. (FIG. 46A) rabbit-ATG was serially diluted and added to the plate. Antibody bound to antigens were quantified by anti-rabbit-HRP or anti-human-HRP, respectively. (FIG. 46B) h-ATG were serially diluted and added to the plate. Antibody bound to antigens were quantified by anti-rabbit-HRP or anti-human-HRP, respectively.

Figure 47:
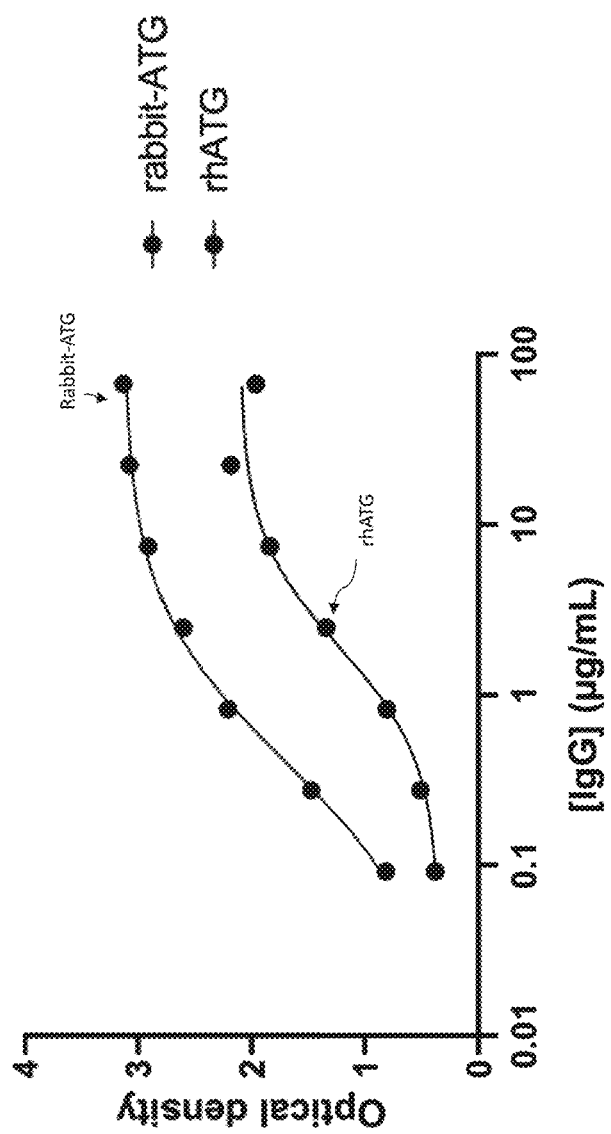

FIG. 47 shows ATG binding to red blood cells by ELISA. RBC-specific antibody response was measured by Immucor Capture-R ELISA. Rabbit-ATG and rhATG were serially diluted and added to the Immucor Capture-R plate. RBC-bound antibodies were quantified by anti-rabbit-HRP or anti-human-HRP, respectively.

Figure 48A:
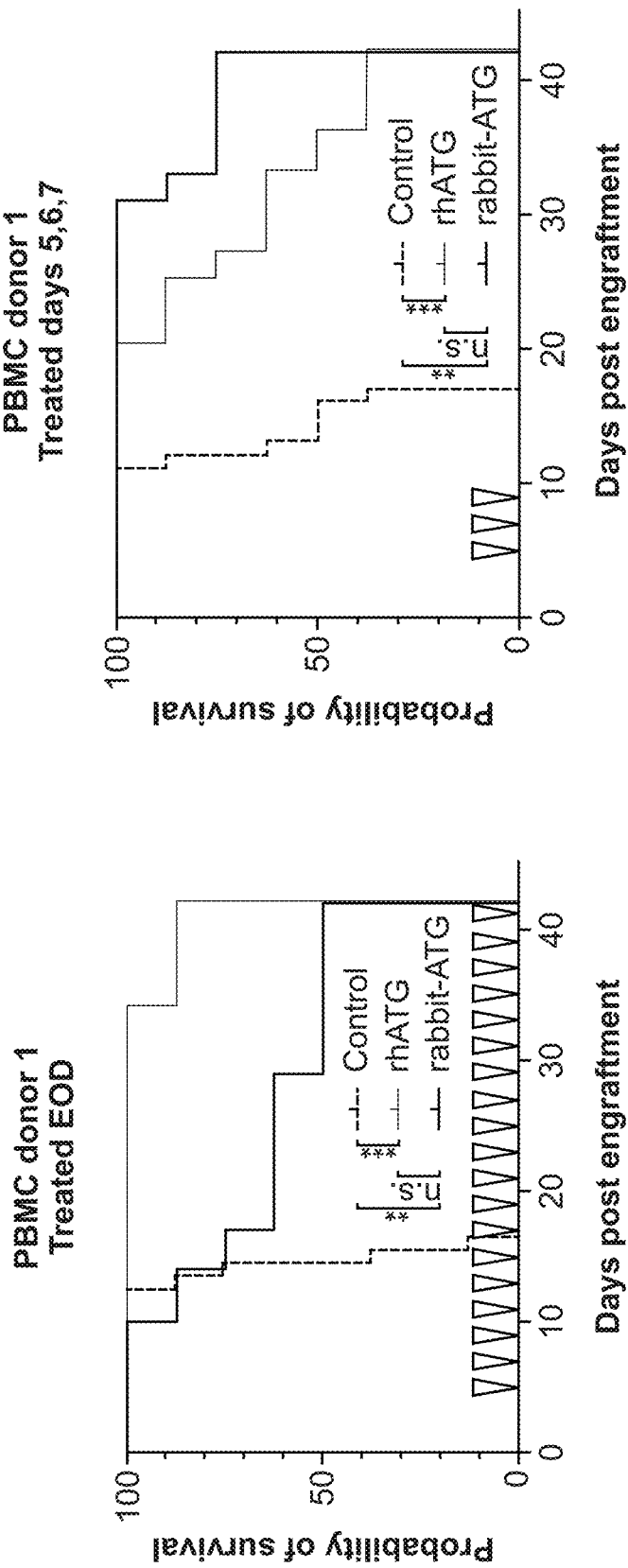
Figure 48B:
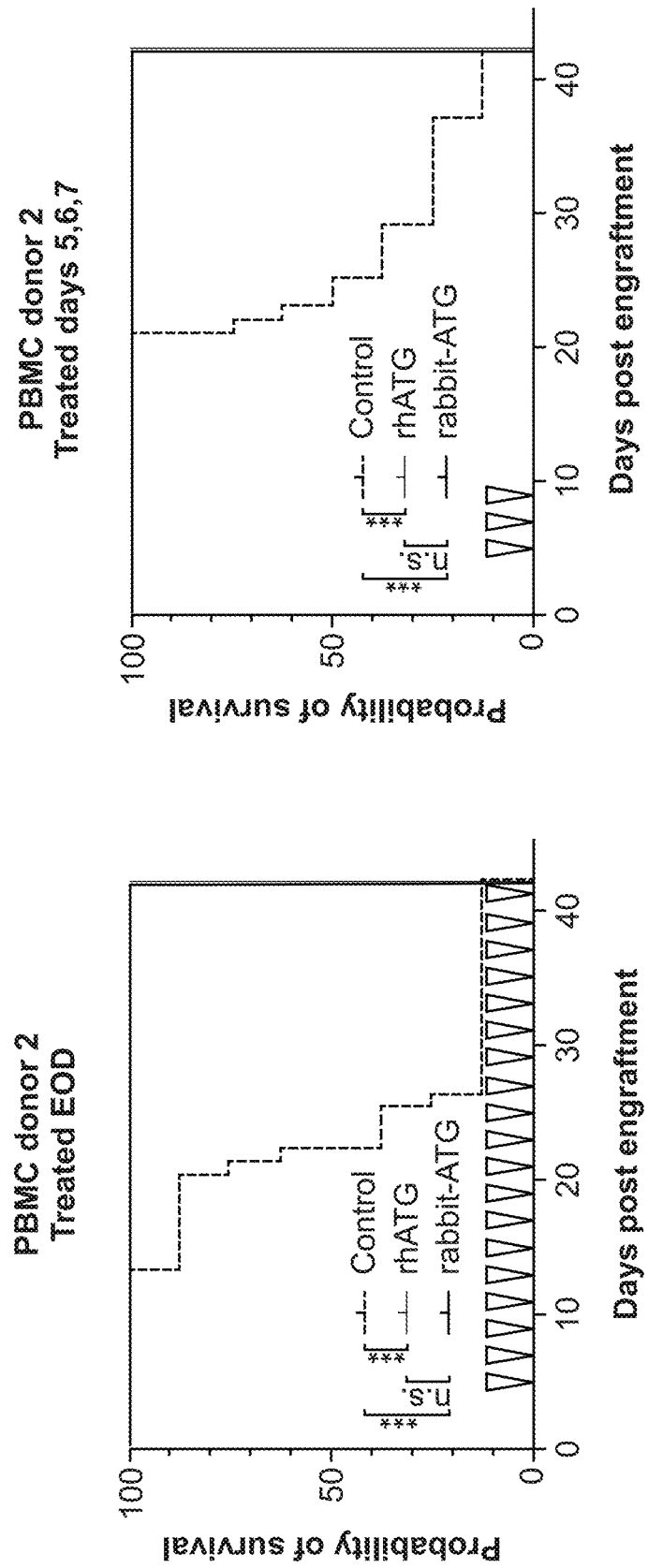

FIGS. 48A and 48B show survival of mice in the GVHD study after ATG treatment. (FIG. 48A) Eight animals per treatment group were engrafted with $10^7$ PBMC from one of two donors. Animals were treated with rhATG, rabbit-ATG, or vehicle control either every other day beginning at day 5 or on days 5, 6, and 7 (treatment days are indicated by triangles), then monitored for progression to GVHD and death.  $p<0.01$, * $p<0.001$, n.s. not significant. (FIG. 48B) Eight animals per treatment group were engrafted with $10^7$ PBMC from one of two donors. Animals were treated with rhATG, rabbit-ATG, or vehicle control either every other day beginning at day 5 or on days 5, 6, and 7 (treatment days are indicated by triangles), then monitored for progression to GVHD and death.  $p<0.01$, * $p<0.001$, n.s. not significant.

Figure 49A:
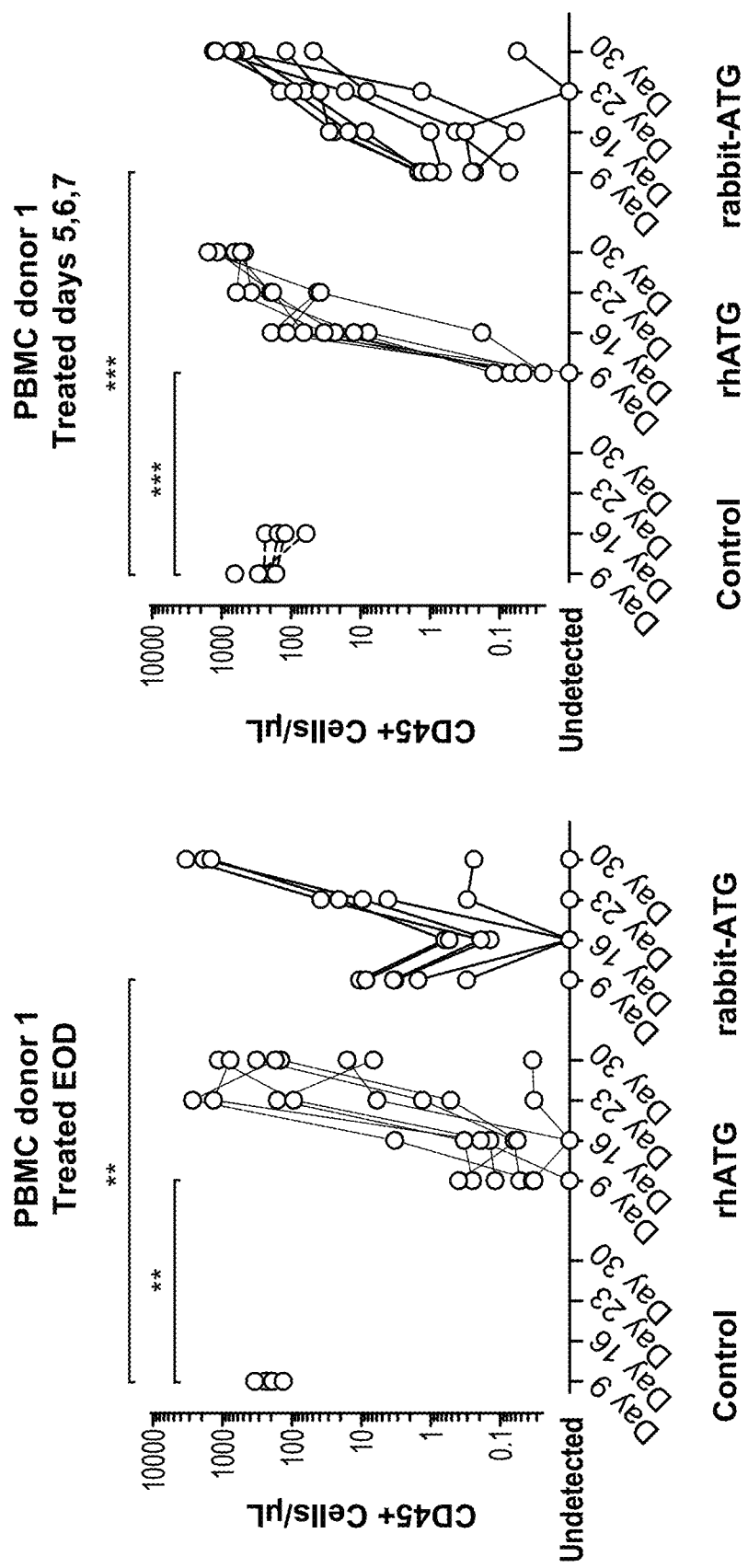
Figure 49B:
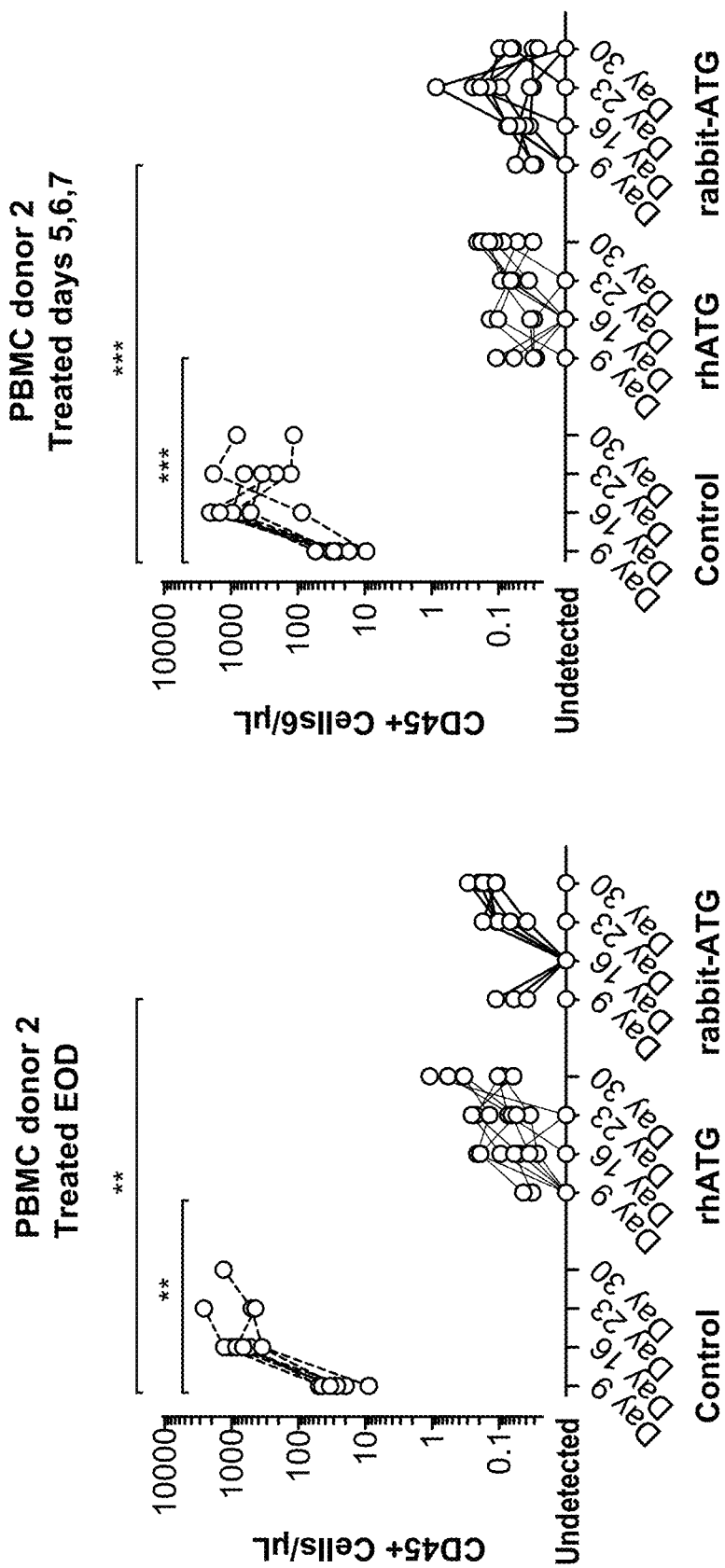

FIGS. 49A and 49B show flow cytometry of CD45+ cells from the ATG GVHD study. (FIG. 49A) Eight animals per treatment group were engrafted with $10^7$ PBMC from one of two donors. Animals were treated with rhATG, rabbit-ATG, or vehicle control either every other day beginning at day 5 or on days 5, 6, and 7. Flow cytometry was used to determine the concentration of CD45+ cells from each alive mouse on Days 9, 16, 23, and 30. Lines connect measurements from each mouse. No CD45+ cells were observed where circles intercept the x-axis.  $p<0.01$, * $p<0.001$.

(FIG. 49B) Eight animals per treatment group were engrafted with $10^7$ PBMC from one of two donors. Animals were treated with rhATG, rabbit-ATG, or vehicle control either every other day beginning at day 5 or on days 5, 6, and 7. Flow cytometry was used to determine the concentration of CD45+ cells from each alive mouse on Days 9, 16, 23, and 30. Lines connect measurements from each mouse. No CD45+ cells were observed where circles intercept the x-axis.  $p<0.01$, * $p<0.001$.

Figure 50A:
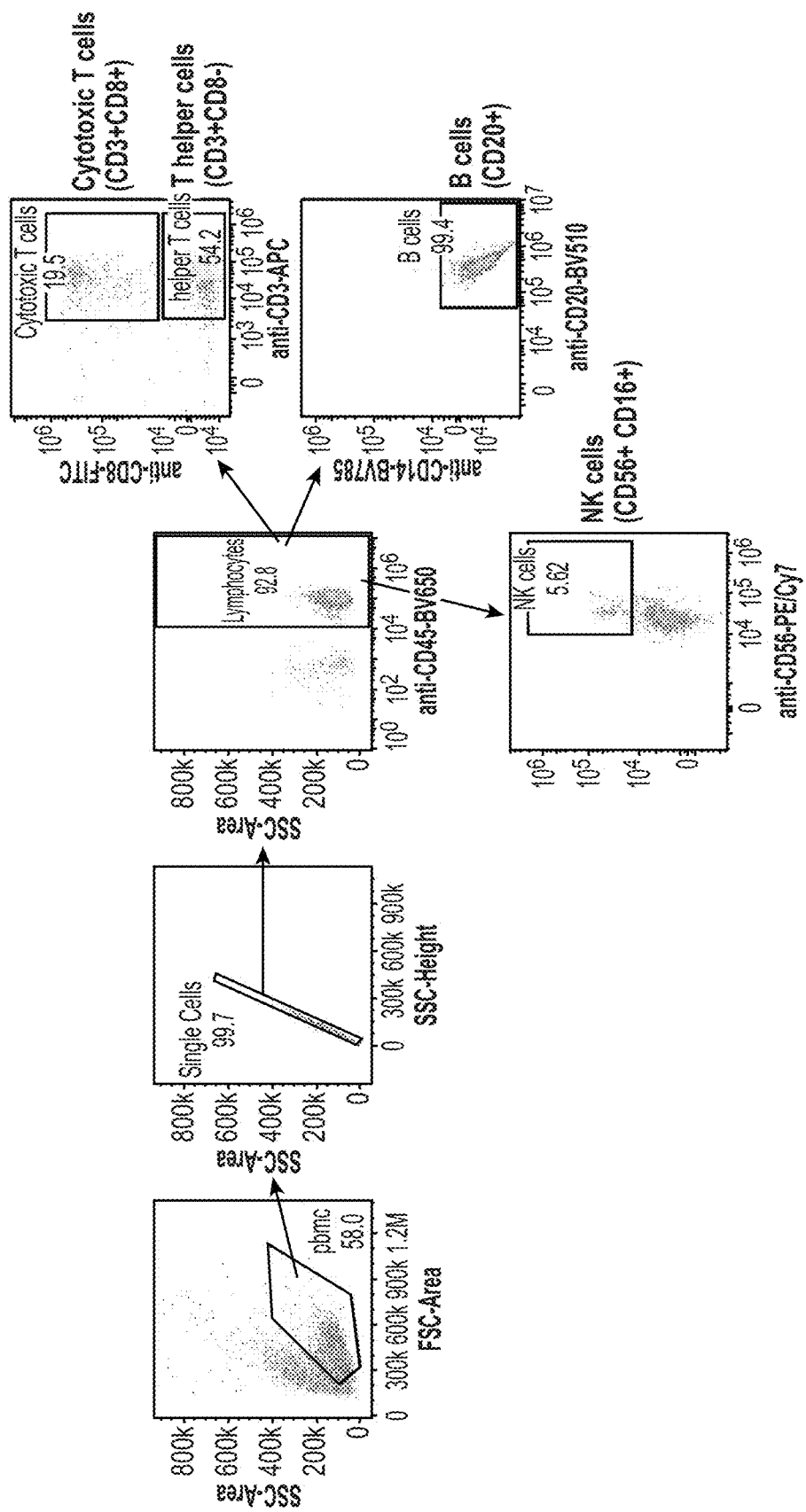
Figure 50B:
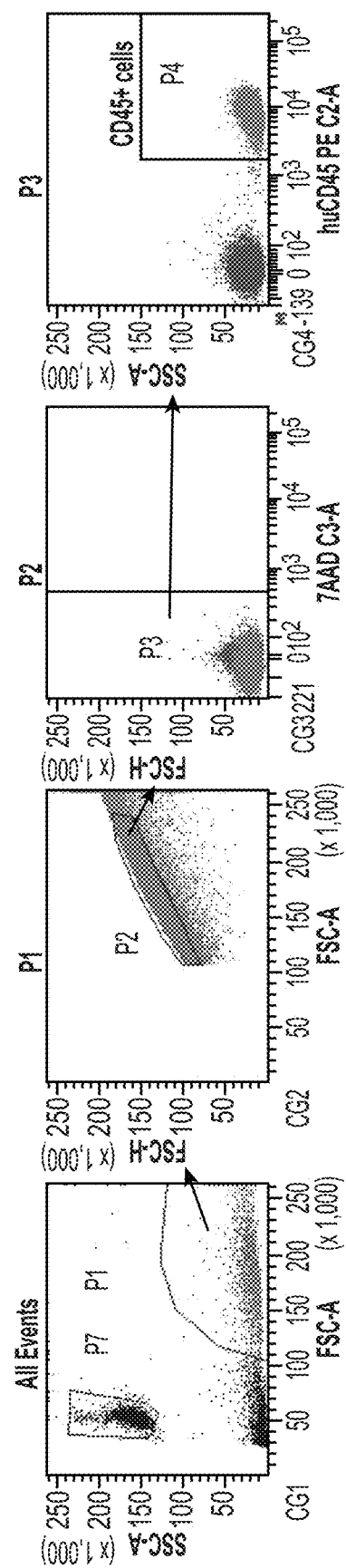

FIGS. 50A and 50B show ATG assay flow gating strategies. (FIG. 50A) Flow gating strategy for the ATG PBMC killing assay to quantify cytotoxic T cells, T helper cells, B cells, and NK cells. (FIG. 50B) Flow gating strategy of the GVH study to quantify CD45+ cells.

Figures 51A, 51B:
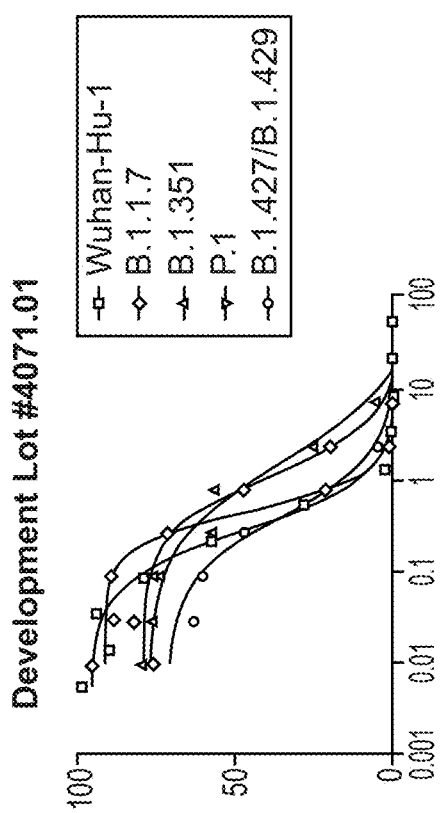

FIGS. 51A and 51B show data from SARS-CoV-2 pseudotype virus neutralization assay. Wuhan-Hu-1 as well as arising SARS-CoV-2 variants (B.1.1.7 (UK), B.1.351 (South Africa), P.1 (Japanese/Brazilian), and B.1.427/B.1.429 (California)) were psudotyped and tested.

FIG. 51A shows % of infected cells normalized to infected cells under a control condition without application of antibodies. FIG. 51B summarizes $IC_{50}$ value (μg/mL) for psudotype virus of the tested SARS-CoV-2 variants.

7. DETAILED DESCRIPTION

Definitions

Unless otherwise defined herein, scientific and technical terms used in connection with the present invention shall have the meanings that are commonly understood by those of ordinary skill in the art. Further, unless otherwise required by context, singular terms shall include pluralities and plural terms shall include the singular. Generally, nomenclatures used in connection with, and techniques of, cell and tissue culture, molecular biology, immunology, microbiology, genetics and protein and nucleic acid chemistry and hybridization described herein are those well-known and commonly used in the art. The methods and techniques of the present invention are generally performed according to conventional methods well known in the art and as described in various general and more specific references that are cited and discussed throughout the present specification unless otherwise indicated. Enzymatic reactions and purification techniques are performed according to manufacturer's specifications, as commonly accomplished in the art or as described herein. The terminology used in connection with, and the laboratory procedures and techniques of, analytical chemistry, synthetic organic chemistry, and medicinal and pharmaceutical chemistry described herein are those well-known and commonly used in the art. Standard techniques can be used for chemical syntheses, chemical analyses, pharmaceutical preparation, formulation, and delivery, and treatment of patients.

The following terms, unless otherwise indicated, shall be understood to have the following meanings:

The term "recombinant polyclonal protein", "recombinant polyclonal protein composition" or "RPP" refers to more than one recombinant antigen binding proteins (ABPs), collectively comprising more than one antigen-binding domains that specifically bind to an antigen or epitope, or multiple antigens and epitopes. The recombinant polyclonal protein or RPP can be antibodies or variants or derivatives thereof. In some embodiments, the antigen-binding domains bind an antigen or epitope with specificity and affinity similar to that of a naturally occurring antibody. In some embodiments, an RPP comprises antibodies. In some embodiments, the RPP consists essentially of antibodies. In some embodiments, an RPP is a mixture of antibodies. In some embodiments, an RPP comprises scFvs. In some embodiments, the RPP comprises an alternative scaffold. In some embodiments, the RPP consists of alternative scaffolds. In some embodiments, the RPP consists essentially of alternative scaffolds. In some embodiments, the RPP comprises an antibody fragment. In some embodiments, the RPP consists of antibody fragments. In some embodiments, the RPP consists essentially of antibody fragments.

The term "antigen binding protein" or "ABP" as used herein refers to a protein comprising one or more antigen-binding domains that specifically bind to an antigen or epitope. In some embodiments, the ABP comprises an antibody. In some embodiments, the ABP consists of an antibody. In some embodiments, the ABP consists essentially of an antibody. In some embodiments, the ABP comprises an alternative scaffold. In some embodiments, the ABP consists of an alternative scaffold. In some embodiments, the ABP consists essentially of an alternative scaffold. In some embodiments, the ABP comprises an antibody fragment. In some embodiments, the ABP consists of an antibody fragment. In some embodiments, the ABP consists essentially of an antibody fragment.

The term "antibody" is used herein in its broadest sense and includes certain types of immunoglobulin molecules comprising one or more antigen-binding domains that specifically bind to an antigen or epitope. An antibody specifically includes intact antibodies (e.g., intact immunoglobulins), antibody fragments, and multi-specific antibodies. One example of an antigen-binding domain is an antigen-binding domain formed by a $V_H$-$V_L$ dimer.

The term "alternative scaffold" refers to a molecule in which one or more regions may be diversified to produce one or more antigen-binding domains that specifically bind to an antigen or epitope. In some embodiments, the antigen-binding domain binds the antigen or epitope with specificity and affinity similar to that of naturally occurring antibodies. Exemplary alternative scaffolds include those derived from fibronectin (e.g., Adnectins™), the β-sandwich (e.g., iMab), lipocalin (e.g., Anticalins®), EETI-II/AGRP, BPTI/LACI-D1/ITI-D2 (e.g., Kunitz domains), thioredoxin peptide aptamers, protein A (e.g., Affibody®), ankyrin repeats (e.g., DARPins), gamma-B-crystallin/ubiquitin (e.g., Affilins), CTLD3 (e.g., Tetranectins), Fynomers, and (LDLR-A module) (e.g., Avimers). Additional information on alternative scaffolds is provided in Binz et al., Nat. Biotechnol., 2005 23:1257-1268; Skerra, Current Opin. in Biotech., 2007 18:295-304; and Silacci et al., J. Biol. Chem., 2014, 289: 14392-14398; each of which is incorporated by reference in its entirety. Alternative scaffolds comprise one type of RPP.

The term "antigen-binding domain" means the portion of an ABP that is capable of specifically binding to an antigen or epitope.

The terms "full length antibody," "intact antibody," and "whole antibody" are used herein interchangeably to refer to an antibody having a structure substantially similar to a naturally occurring antibody structure and having heavy chains that comprise an Fc region.

The term "immunoglobulin" refers to a class of structurally related proteins, e.g., antibodies, generally comprising two pairs of polypeptide chains: one pair of light (L) chains and one pair of heavy (H) chains. In an "intact immunoglobulin," all four of these chains are interconnected by disulfide bonds. The structure of immunoglobulins has been well characterized. See, e.g., Paul, Fundamental Immunology 7th ed., Ch. 5 (2013) Lippincott Williams & Wilkins, Philadelphia, Pa. Briefly, each heavy chain typically comprises a heavy chain variable region ($V_H$) and a heavy chain constant region ($C_H$). The heavy chain constant region typically comprises three domains, abbreviated $C_{H1}$, $C_{H2}$, and $C_{H3}$. Each light chain typically comprises a light chain variable region ($V_L$) and a light chain constant region. The light chain constant region typically comprises one domain, abbreviated $C_L$.

The term "Fc region" means the C-terminal region of an immunoglobulin heavy chain that, in naturally occurring antibodies, interacts with Fc receptors and certain proteins of the complement system. The structures of the Fc regions of various immunoglobulins, and the glycosylation sites contained therein, are known in the art. See Schroeder and Cavacini, J. Allergy Clin. Immunol., 2010, 125:S41-52, incorporated by reference in its entirety. The Fc region may be a naturally occurring Fc region, or an Fc region modified as described elsewhere in this disclosure.

The $V_H$ and $V_L$ regions may be further subdivided into regions of hypervariability ("hypervariable regions (HVRs)" also called "complementarity determining regions" (CDRs)) interspersed with regions that are more conserved. The more conserved regions are called framework regions (FRs). Each $V_H$ and $V_L$ generally comprises three CDRs and four FRs, arranged in the following order (from N-terminus to C-terminus): FR1-CDR1-FR2-CDR2-FR3-CDR3-FR4. The CDRs are involved in antigen binding, and influence antigen specificity and binding affinity of the antibody. See Kabat et al., Sequences of Proteins of Immunological Interest 5th ed.

(1991) Public Health Service, National Institutes of Health, Bethesda, Md., incorporated by reference in its entirety.

The light chain from any vertebrate species can be assigned to one of two types, called kappa (κ) and lambda (λ), based on the sequence of its constant domain.

The heavy chain from any vertebrate species can be assigned to one of five different classes (or isotypes): IgA, IgD, IgE, IgG, and IgM. These classes are also designated α, δ, ε, γ, and μ, respectively. The IgG and IgA classes are further divided into subclasses on the basis of differences in sequence and function. Humans express the following subclasses: IgG1, IgG2, IgG3, IgG4, IgA1, and IgA2.

The amino acid sequence boundaries of a CDR can be determined by one of skill in the art using any of a number of known numbering schemes, including those described by Kabat et al., supra ("Kabat" numbering scheme); Al-Lazikani et al., 1997, J. Mol. Biol., 273:927-948 ("Chothia" numbering scheme); MacCallum et al., 1996, J Mol. Biol. 262:732-745 ("Contact" numbering scheme); Lefranc et al., Dev. Comp. Immunol., 2003, 27:55-77 ("IMGT" numbering scheme); and Honegge and Plückthun, J. Mol. Biol., 2001, 309:657-70 ("AHo" numbering scheme); each of which is incorporated by reference in its entirety.

Table 1 provides the positions of CDR1-L (CDR1 of $V_L$), CDR2-L (CDR2 of $V_L$), CDR3-L (CDR3 of $V_L$), CDR1-H (CDR1 of $V_H$), CDR2-H (CDR2 of $V_H$), and CDR3-H (CDR3 of $V_H$), as identified by the Kabat and Chothia schemes. For CDR1-H, residue numbering is provided using both the Kabat and Chothia numbering schemes.

CDRs may be assigned, for example, using antibody numbering software, such as Abnum, available at www.bioinf.org.uk/abs/abnum/, and described in Abhinandan and Martin, Immunology, 2008, 45:3832-3839, incorporated by reference in its entirety.

TABLE 1

Residues in CDRs according to Kabat and Chothia numbering schemes.

| CDR | Kabat | Chothia |
| --- | --- | --- |
| CDR1-L | 24-34 | 24-34 |
| CDR2-L | 50-56 | 50-56 |
| CDR3-L | 89-97 | 89-97 |
| CDR1-H (Kabat Numbering) | 31-35B | 26-32 or 34* |
| CDR1-H (Chothia Numbering) | 31-35 | 26-32 |
| CDR2-H | 50-65 | 52-56 |
| CDR3-H | 95-102 | 95-102 |

*The C-terminus of CDR1-H, when numbered using the Kabat numbering convention, varies between 32 and 34, depending on the length of the CDR.

The "EU numbering scheme" is generally used when referring to a residue in an antibody heavy chain constant region (e.g., as reported in Kabat et al., supra).

An "antibody fragment" comprises a portion of an intact antibody, such as the antigen-binding or variable region of an intact antibody. Antibody fragments include, for example, Fv fragments, Fab fragments, F(ab')$_2$ fragments, Fab' fragments, scFv (sFv) fragments, and scFv-Fc fragments.

"Fv" fragments comprise a non-covalently-linked dimer of one heavy chain variable domain and one light chain variable domain.

"Fab" fragments comprise, in addition to the heavy and light chain variable domains, the constant domain of the light chain and the first constant domain (Cm) of the heavy chain. Fab fragments may be generated, for example, by recombinant methods or by papain digestion of a full-length antibody.

"F(ab')$_2$" fragments contain two Fab' fragments joined, near the hinge region, by disulfide bonds. F(ab')$_2$ fragments may be generated, for example, by recombinant methods or by pepsin digestion of an intact antibody. The F(ab') fragments can be dissociated, for example, by treatment with β-mercaptoethanol.

"Single-chain Fv" or "sFv" or "scFv" antibody fragments comprise a $V_H$ domain and a $V_L$ domain in a single polypeptide chain. The $V_H$ and $V_L$ are generally linked by a peptide linker. See Plückthun A. (1994). In some embodiments, the linker is a (GGGGS)$_n$ (SEQ ID NO: 5). In some embodiments, n=1, 2, 3, 4, 5, or 6. See Antibodies from Escherichia coli. In Rosenberg M. & Moore G. P. (Eds.), The Pharmacology of Monoclonal Antibodies vol. 113 (pp. 269-315). Springer-Verlag, New York, incorporated by reference in its entirety.

"scFv-Fc" fragments comprise an scFv attached to an Fc domain. For example, an Fc domain may be attached to the C-terminal of the scFv. The Fc domain may follow the $V_H$ or $V_L$, depending on the orientation of the variable domains in the scFv (i.e., $V_H$-$V_L$ or $V_L$). Any suitable Fc domain known in the art or described herein may be used. In some cases, the Fc domain comprises an IgG4 Fc domain.

The term "single domain antibody" refers to a molecule in which one variable domain of an antibody specifically binds to an antigen without the presence of the other variable domain. Single domain antibodies, and fragments thereof, are described in Arabi Ghahroudi et al., FEBS Letters, 1998, 414:521-526 and Muyldermans et al., Trends in Biochem. Sci., 2001, 26:230-245, each of which is incorporated by reference in its entirety.

A "monospecific RPP" is an RPP that comprises a binding site that specifically binds to a single epitope. An example of a monospecific RPP is a naturally occurring IgG molecule which, while divalent, recognizes the same epitope at each antigen-binding domain. The binding specificity may be present in any suitable valency.

A "polyspecific RPP" is an RPP that binds to more than one epitope. An example of a polyspecific RPP is a mixture of antibodies that bind to different serotypes of pneumococcal bacteria.

The term "monoclonal antibody" refers to an antibody from a population of substantially homogeneous antibodies. A population of substantially homogeneous antibodies comprises antibodies that are substantially similar and that bind the same epitope(s), except for variants that may normally arise during production of the monoclonal antibody. Such variants are generally present in only minor amounts. A monoclonal antibody is typically obtained by a process that includes the selection of a single antibody from a plurality of antibodies. For example, the selection process can be the selection of a unique clone from a plurality of clones, such as a pool of hybridoma clones, phage clones, yeast clones, bacterial clones, or other recombinant DNA clones. The selected antibody can be further altered, for example, to improve affinity for the target ("affinity maturation"), to humanize the antibody, to improve its production in cell culture, and/or to reduce its immunogenicity in a subject.

The term "polyclonal antibody" refers to a mixture of at least two monoclonal antibodies. Polyclonal antibodies may be either monospecific or polyspecific.

The term "chimeric antibody" refers to an antibody in which a portion of the heavy and/or light chain is derived from a particular source or species, while the remainder of the heavy and/or light chain is derived from a different source or species.

"Humanized" forms of non-human antibodies are chimeric antibodies that contain minimal sequence derived from the non-human antibody. A humanized antibody is generally a human antibody (recipient antibody) in which residues from one or more CDRs are replaced by residues from one or more CDRs of a non-human antibody (donor antibody). The donor antibody can be any suitable non-human antibody, such as a mouse, rat, rabbit, chicken, or non-human primate antibody having a desired specificity, affinity, or biological effect. In some instances, selected framework region residues of the recipient antibody are replaced by the corresponding framework region residues from the donor antibody. Humanized antibodies may also comprise residues that are not found in either the recipient antibody or the donor antibody. Such modifications may be made to further refine antibody function. For further details, see Jones et al., Nature, 1986, 321:522-525; Riechmann et al., Nature, 1988, 332:323-329; and Presta, Curr. Op. Struct. Biol., 1992, 2:593-596, each of which is incorporated by reference in its entirety.

A "human antibody" is one which possesses an amino acid sequence corresponding to that of an antibody produced by a human or a human cell, or derived from a non-human source that utilizes a human antibody repertoire or human antibody-encoding sequences (e.g., obtained from human sources or designed de novo). Human antibodies specifically exclude humanized antibodies.

An "isolated RPP" or "isolated nucleic acid" is an RPP or nucleic acid that has been separated and/or recovered from a component of its natural environment. Components of the natural environment may include enzymes, hormones, and other proteinaceous or nonproteinaceous materials. In some embodiments, an isolated RPP is purified to a degree sufficient to obtain at least 15 residues of N-terminal or internal amino acid sequence, for example by use of a spinning cup sequenator. In some embodiments, an isolated RPP is purified to homogeneity by gel electrophoresis (e.g., SDS-PAGE) under reducing or nonreducing conditions, with detection by Coomassie blue or silver stain. An isolated RPP includes an RPP in situ within recombinant cells, since at least one component of the RPP's natural environment is not present. In some aspects, an isolated RPP or isolated nucleic acid is prepared by at least one purification step. In some embodiments, an isolated RPP or isolated nucleic acid is purified to at least 80%, 85%, 90%, 95%, or 99% by weight. In some embodiments, an isolated RPP or isolated nucleic acid is purified to at least 80%, 85%, 90%, 95%, or 99% by volume. In some embodiments, an isolated RPP or isolated nucleic acid is provided as a solution comprising at least 85%, 90%, 95%, 98%, 99% to 100% RPP or nucleic acid by weight. In some embodiments, an isolated RPP or isolated nucleic acid is provided as a solution comprising at least 85%, 90%, 95%, 98%, 99% to 100% RPP or nucleic acid by volume.

"Affinity" refers to the strength of the sum total of non-covalent interactions between a single binding site of a molecule (e.g., an RPP) and its binding partner (e.g., an antigen or epitope). Unless indicated otherwise, as used herein, "affinity" refers to intrinsic binding affinity, which reflects a 1:1 interaction between members of a binding pair (e.g., RPP and antigen or epitope). The affinity of a molecule X for its partner Y can be represented by the dissociation equilibrium constant ($K_D$). The kinetic components that contribute to the dissociation equilibrium constant are described in more detail below. Affinity can be measured by common methods known in the art, including those described herein. Affinity can be determined, for example, using surface plasmon resonance (SPR) technology (e.g., BIACORE®) or biolayer interferometry (e.g., FORTEBIO®).

With regard to the binding of an RPP to a target molecule, the terms "bind," "specific binding," "specifically binds to," "specific for," "selectively binds," and "selective for" a particular antigen (e.g., a polypeptide target) or an epitope on a particular antigen mean binding that is measurably different from a non-specific or non-selective interaction (e.g., with a non-target molecule). Specific binding can be measured, for example, by measuring binding to a target molecule and comparing it to binding to a non-target molecule. Specific binding can also be determined by competition with a control molecule that mimics the epitope recognized on the target molecule. In that case, specific binding is indicated if the binding of the RPP to the target molecule is competitively inhibited by the control molecule.

The term "$k_d$" ($\text{sec}^{-1}$), as used herein, refers to the dissociation rate constant of a particular ABP-antigen interaction. This value is also referred to as the $k_{off}$ value.

The term "$k_a$" ($M^{-1} \times \text{sec}^{-1}$), as used herein, refers to the association rate constant of a particular ABP-antigen interaction. This value is also referred to as the $k_{on}$ value.

The term "$K_D$" (M), as used herein, refers to the dissociation equilibrium constant of a particular ABP-antigen interaction. $K_D = k_d/k_a$.

The term "$K_A$" ($M^{-1}$), as used herein, refers to the association equilibrium constant of a particular ABP-antigen interaction. $K_A = k_a/k_d$.

An "immunoconjugate" is an RPP conjugated to one or more heterologous molecule(s).

"Effector functions" refer to those biological activities mediated by the Fc region of an antibody, which activities may vary depending on the antibody isotype. Examples of antibody effector functions include C1q binding to activate complement dependent cytotoxicity (CDC), Fc receptor binding to activate antibody-dependent cellular cytotoxicity (ADCC), and antibody dependent cellular phagocytosis (ADCP).

When used herein in the context of two or more RPPs, the term "competes with" or "cross-competes with" indicates that the two or more RPPs compete for binding to an antigen (e.g., pneumococcus polysaccharide). In one exemplary assay, an antigen is coated on a surface and contacted with a first RPP against the antigen, after which a second RPP against the antigen is added. In another exemplary assay, a first RPP against an antigen is coated on a surface and contacted with the antigen, and then a second RPP against the antigen is added. If the presence of the first RPP against an antigen reduces binding of the second RPP, in either assay, then the RPPs compete. The term "competes with" also includes combinations of RPPs where one RPP reduces binding of another RPP, but where no competition is observed when the RPPs are added in the reverse order. However, in some embodiments, the first and second RPPs inhibit binding of each other, regardless of the order in which they are added. In some embodiments, one RPP reduces binding of another RPP to its antigen by at least 25%, at least 50%, at least 60%, at least 70%, at least 80%, at least 85%, at least 90%, or at least 95%. A skilled artisan can select the concentrations of the antibodies used in the competition assays based on the affinities of the RPPs for pneumococcus polysaccharide and the valency of the RPPs. The assays described in this definition are illustrative, and a skilled artisan can utilize any suitable assay to determine if antibodies compete with each other. Suitable assays are described, for example, in Cox et al., "Immunoassay Methods," in Assay Guidance Manual [Internet], Updated Dec. 24, 2014 (www.ncbi.nlm.nih.gov/books/NBK92434/; accessed Sep. 29, 2015); Silman et al., Cytometry, 2001, 44:30-37; and Finco et al., J. Pharm. Biomed. Anal., 2011, 54:351-358; each of which is incorporated by reference in its entirety.

The term "epitope" means a portion of an antigen the specifically binds to an RPP or an ABP. Epitopes frequently consist of surface-accessible amino acid residues and/or sugar side chains and may have specific three-dimensional structural characteristics, as well as specific charge characteristics. Conformational and non-conformational epitopes are distinguished in that the binding to the former but not the latter may be lost in the presence of denaturing solvents. An epitope may comprise amino acid residues that are directly involved in the binding, and other amino acid residues, which are not directly involved in the binding. The epitope to which an RPP or an ABP binds can be determined using known techniques for epitope determination such as, for example, testing for RPP or an ABP binding to an antigen.

Percent "identity" between a polypeptide sequence and a reference sequence, is defined as the percentage of amino acid residues in the polypeptide sequence that are identical to the amino acid residues in the reference sequence, after aligning the sequences and introducing gaps, if necessary, to achieve the maximum percent sequence identity. Alignment for purposes of determining percent amino acid sequence identity can be achieved in various ways that are within the skill in the art, for instance, using publicly available computer software such as BLAST, BLAST-2, ALIGN, MEGA-LIGN (DNASTAR), CLUSTALW, CLUSTAL OMEGA, or MUSCLE software. Those skilled in the art can determine appropriate parameters for aligning sequences, including any algorithms needed to achieve maximal alignment over the full length of the sequences being compared.

A "conservative substitution" or a "conservative amino acid substitution," refers to the substitution an amino acid with a chemically or functionally similar amino acid. Conservative substitution tables providing similar amino acids are well known in the art. By way of example, the groups of amino acids provided in TABLES 2-4 are, in some embodiments, considered conservative substitutions for one another.

TABLE 2

Selected groups of amino acids that are considered conservative substitutions for one another, in certain embodiments.

| | |
|---|---|
| Acidic Residues | D and E |
| Basic Residues | K, R, and H |
| Hydrophilic Uncharged Residues | S, T, N, and Q |
| Aliphatic Uncharged Residues | G, A, V, L, and I |
| Non-polar Uncharged Residues | C, M, and P |
| Aromatic Residues | F, Y, and W |

TABLE 3

Additional selected groups of amino acids that are considered conservative substitutions for one another, in certain embodiments.

| | |
|---|---|
| Group 1 | A, S, and T |
| Group 2 | D and E |
| Group 3 | N and Q |
| Group 4 | R and K |
| Group 5 | I, L, and M |
| Group 6 | F, Y, and W |

TABLE 4

Further selected groups of amino acids that are considered conservative substitutions for one another, in certain embodiments.

| | |
|---|---|
| Group A | A and G |
| Group B | D and E |
| Group C | N and Q |
| Group D | R, K, and H |
| Group E | I, L, M, V |
| Group F | F, Y, and W |
| Group G | S and T |
| Group H | C and M |

Additional conservative substitutions may be found, for example, in Creighton, Proteins: Structures and Molecular Properties 2nd ed. (1993) W. H. Freeman & Co., New York, N.Y. An RPP generated by making one or more conservative substitutions of amino acid residues in a parent RPP is referred to as a "conservatively modified variant."

The term "treating" (and variations thereof such as "treat" or "treatment") refers to clinical intervention in an attempt to alter the natural course of a disease or condition in a subject in need thereof. Treatment can be performed both for prophylaxis and during the course of clinical pathology. Desirable effects of treatment include preventing occurrence or recurrence of disease, alleviation of symptoms, diminish of any direct or indirect pathological consequences of the disease, preventing reinfection or associated symptom, decreasing the rate of disease progression, amelioration or palliation of the disease state, and remission or improved prognosis. Improvements in any conditions can be readily assessed according to standard methods and techniques known in the art. The population of subjects treated by the method of the disease includes subjects suffering from the undesirable condition or disease, as well as subjects at risk for development of the condition or disease.

As used herein, the term "therapeutically effective amount" or "effective amount" refers to an amount of an RPP or pharmaceutical composition provided herein that, when administered to a subject, is effective to produces the desired effect for which it is administered. The exact dose or amount will depend on the purpose of the treatment, and will be ascertainable by one skilled in the art using known techniques (see, e.g., Lloyd (1999) The Art, Science and Technology of Pharmaceutical Compounding). A therapeutically effective amount can be a "prophylactically effective amount" as prophylaxis can be considered therapy. The term "sufficient amount" means an amount sufficient to produce a desired effect.

As used herein, the term "subject" means a mammalian subject. Exemplary subjects include humans, monkeys, dogs, cats, mice, rats, cows, horses, camels, goats, rabbits, and sheep. In certain embodiments, the subject is a human. In some embodiments the subject has a disease or condition that can be treated with an RPP provided herein. In some aspects, the disease or condition is a cancer. In some aspects, the disease or condition is a viral infection.

The term "package insert" is used to refer to instructions customarily included in commercial packages of therapeutic or diagnostic products (e.g., kits) that contain information about the indications, usage, dosage, administration, combination therapy, contraindications and/or warnings concerning the use of such therapeutic or diagnostic products.

The term "pharmaceutical composition" refers to a preparation which is in such form as to permit the biological activity of an active ingredient contained therein to be effective in treating a subject, and which contains no additional components which are unacceptably toxic to the subject.

The term "plasma cell" refers to white blood cells that secrete large volumes of antibodies. They are transported by the blood plasma and the lymphatic system. B cells (for example, either germinal center naïve B cells or memory B cells) differentiate into plasma cells that produce antibody molecules closely modelled after the receptors of the precursor B cell. Once released into the blood and lymph, these antibody molecules bind to the target antigen (foreign substance) and initiate its neutralization or destruction. Terminally differentiated plasma cells express relatively few surface antigens, and do not express common pan-B cell markers, such as CD19 and CD20. Instead, plasma cells are identified through flow cytometry by their additional expression of CD138, CD78, and the Interleukin-6 receptor. In humans, CD27 is a good marker for plasma cells, naive B cells are CD27-, memory B-cells are CD27+ and plasma cells are CD27++. The surface antigen CD138 (syndecan-1) is expressed at high levels. Another important surface antigen is CD319 (SLAMF7). This antigen is expressed at high levels on normal human plasma cells. It is also expressed on malignant plasma cells in multiple myeloma. Compared with CD138, which disappears rapidly ex vivo, the expression of CD319 is considerably more stable.

The term "plasmablast" refers to antibody-secreting cells in the peripheral blood, which differentiate from activated B cells, such as memory B cells, upon stimulation with an antigen. The most immature blood cell that is considered of plasma cell lineage is the plasmablast. Plasmablasts secrete more antibodies than B cells, but less than plasma cells. They divide rapidly and are still capable of internalizing antigens and presenting them to T cells. A cell may stay in this state for several days, and then either die or irrevocably differentiate into a mature, fully differentiated plasma cell. Differentiation of mature B cells into plasma cells is dependent upon the transcription factors Blimp-1/PRDM1 and IRF4.

The term "memory B cell" refers to a B cell sub-type that are formed within germinal centers following primary infection and are important in generating an accelerated and more robust antibody-mediated immune response in the case of re-infection (also known as a secondary immune response). Memory B cells do not secrete antibody until activated by their specific antigen.

The term "naïve B cell" refers to a B cell that has not been exposed to an antigen. Once exposed to an antigen, the naïve B cell either becomes a memory B cell or a plasma cell that secretes antibodies specific to the antigen that was originally bound. Plasma cells do not last long in the circulation, this is in contrast to memory cells that last for very long periods of time.

The term "peripheral blood" refers to blood which travels through peripheral vessels. Peripheral blood is typically obtained by venipuncture (also called phlebotomy), or by finger prick for small quantities.

The term "plasma hyperimmune" refers to a polyclonal antibody preparation similar to intravenous immunoglobulin (IVIg), except that it is prepared from the plasma of donors with high titers of antibody against a specific organism or antigen. The term hyperimmune is often used interchangeably with the terms "hyperimmune gammaglobulin" and "hyperimmune globulins". Some agents against which hyperimmune globulins are available include hepatitis B, rabies, tetanus toxin, varicella-zoster, etc. Administration of hyperimmune globulin provides "passive" immunity to the patient against an agent. This is in contrast to vaccines that provide "active" immunity. However, vaccines take much longer to achieve that purpose while hyperimmune globulin provides instant "passive" short-lived immunity.

The term "activity" refers to a quantitative measurement of an RPP or antibody against an antigen, vaccine, protein, epitope, cell, bacterium, or virus. Activity can be assessed using in vivo or in vitro methods.

The term "recombinant" refers to proteins that result from the expression of recombinant DNA within living cells. Recombinant DNA is the general name for a piece of DNA that has been created by the combination of at least two separate segments of DNA.

The term "neutralization" refers to the ability of specific antibodies to block the site(s) on viruses that they use to enter their target cell. The effect of a neutralizing antibody can be negligible even with large excesses of antibody production if they lack specificity to this antigen. The production of specific antibodies can be learned for a faster response at next exposition. The reduction or destruction of a homologous infectious agent can be partial or complete and can make it no longer infectious or pathogenic to other cells.

A "variant" of a polypeptide (e.g., an antibody) comprises an amino acid sequence wherein one or more amino acid residues are inserted into, deleted from and/or substituted into the amino acid sequence relative to the native polypeptide sequence, and retains essentially the same biological activity as the native polypeptide. The biological activity of the polypeptide can be measured using standard techniques in the art (for example, if the variant is an antibody, its activity may be tested by binding assays, as described herein). Variants of the invention include fragments, analogs, recombinant polypeptides, synthetic polypeptides, and/or fusion proteins.

A "derivative" of a polypeptide is a polypeptide (e.g., an antibody) that has been chemically modified, e.g., via conjugation to another chemical moiety such as, for example, polyethylene glycol, albumin (e.g., human serum albumin), phosphorylation, and glycosylation. Unless otherwise indicated, the term "antibody" includes, in addition to antibodies comprising two full-length heavy chains and two full-length light chains, derivatives, variants, fragments, and muteins thereof, examples of which are described below.

A nucleotide sequence is "operably linked" to a regulatory sequence if the regulatory sequence affects the expression (e.g., the level, timing, or location of expression) of the nucleotide sequence. A "regulatory sequence" is a nucleic acid that affects the expression (e.g., the level, timing, or location of expression) of a nucleic acid to which it is operably linked. The regulatory sequence can, for example, exert its effects directly on the regulated nucleic acid, or through the action of one or more other molecules (e.g., polypeptides that bind to the regulatory sequence and/or the nucleic acid). Examples of regulatory sequences include promoters, enhancers and other expression control elements (e.g., polyadenylation signals). Further examples of regulatory sequences are described in, for example, Goeddel, 1990, Gene Expression Technology: Methods in Enzymology 185, Academic Press, San Diego, Calif. and Baron et al., 1995, Nucleic Acids Res. 23:3605-06.

A "host cell" is a cell that can be used to express a nucleic acid, e.g., a nucleic acid of the invention. A host cell can be a prokaryote, for example, E. coli, or it can be a eukaryote, for example, a single-celled eukaryote (e.g., a yeast or other fungus), a plant cell (e.g., a tobacco or tomato plant cell), an animal cell (e.g., a human cell, a monkey cell, a hamster cell, a rat cell, a mouse cell, or an insect cell) or a hybridoma. Examples of host cells include CS-9 cells, the COS-7 line of monkey kidney cells (ATCC CRL 1651) (see Gluzman et al., 1981, Cell 23:175), L cells, C127 cells, 3T3 cells (ATCC CCL 163), Chinese hamster ovary (CHO) cells or their derivatives such as Veggie CHO and related cell lines which grow in serum-free media (see Rasmussen et al., 1998, Cytotechnology 28:31), HeLa cells, BHK (ATCC CRL 10) cell lines, the CV1/EBNA cell line derived from the African green monkey kidney cell line CV1 (ATCC CCL 70) (see McMahan et al., 1991, EMBO J. 10:2821), human embryonic kidney cells such as 293, 293 EBNA or MSR 293, human epidermal A431 cells, human Colo205 cells, other transformed primate cell lines, normal diploid cells, cell strains derived from in vitro culture of primary tissue, primary explants, HL-60, U937, HaK or Jurkat cells. Typically, a host cell is a cultured cell that can be transformed or transfected with a polypeptide-encoding nucleic acid, which can then be expressed in the host cell.

The phrase "recombinant host cell" can be used to denote a host cell that has been transformed or transfected with a nucleic acid to be expressed. A host cell also can be a cell that comprises the nucleic acid but does not express it at a desired level unless a regulatory sequence is introduced into the host cell such that it becomes operably linked with the nucleic acid. It is understood that the term host cell refers not only to the particular subject cell but to the progeny or potential progeny of such a cell. Because certain modifications may occur in succeeding generations due to, e.g., mutation or environmental influence, such progeny may not, in fact, be identical to the parent cell, but are still included within the scope of the term as used herein.

Other Interpretational Conventions

Ranges recited herein are understood to be shorthand for all of the values within the range, inclusive of the recited endpoints. For example, a range of 1 to 50 is understood to include any number, combination of numbers, or sub-range from the group consisting of 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, and 50.

Unless otherwise indicated, reference to a compound that has one or more stereocenters intends each stereoisomer, and all combinations of stereoisomers, thereof.

Recombinant Polyclonal Proteins (RPPs)

The present disclosure provides a RPP (rZIG) that specifically binds one or more Zika antigens. The RPP comprises a plurality of ABPs specifically binding to one or more Zika antigens.

In some embodiments, the RPP comprises at least 100 ABPs each with a cognate pair of heavy chain CDR3 and light chain CDR3 sequences as shown in Table 5. In some embodiments, the RPP comprises at least 100, 500, 1000, 5000, 10,000, or 15,000 ABPs each with a cognate pair of heavy chain CDR3 and light chain CDR3 sequences as shown in Table 5. In some embodiments, the RPP comprises 100 to 500 ABPs, 500 to 1000 ABPs, 1000 to 2500 ABPs, or more than 2500 ABPs. In some embodiments, the RPP comprises 10, 100, 1,000, 10,000, 100,000 or more than 100,000 distinct ABPs.

In some embodiments, the RPP comprises scFvs. In some embodiments, the RPP consists of scFvs. In some embodiments, the RPP comprises antibody fragments. In some embodiments, the RPP consists of antibody fragments. In some embodiments, the RPP comprises recombinant full-length antibodies. In some embodiments, the RPP consists of recombinant full-length antibodies. In some embodiments, the RPP comprises human antibodies. In some embodiments, the RPP comprises humanized antibodies. In some embodiments, the RPP comprises monospecific ABPs. In some embodiments, the RPP comprises bispecific ABPs. In some embodiments, the RPP consists of ABPs of a human IgG1 subtype. In some embodiments, the RPP comprises IgGs, IgAs, or IgMs.

In some embodiments, the RPP comprises antibody fragments. The RPP can be a Fab fragment, a F(ab')$_2$ fragment an Fv fragment, or a combination thereof. A Fab fragment is a monovalent fragment having the $V_L$, $V_H$, $C_L$ and $C_{H1}$ domains; a F(ab')$_2$ fragment is a bivalent fragment having two Fab fragments linked by a disulfide bridge at the hinge region; a Fd fragment has the $V_H$ and $C_{H1}$ domains; an Fv fragment has the $V_L$ and $V_H$ domains of a single arm of an antibody; and a dAb fragment has a $V_H$ domain, a $V_L$ domain, or an antigen-binding fragment of a $V_H$ or $V_L$ domain (U.S. Pat. Nos. 6,846,634, 6,696,245, US App. Pub. No. 05/0202512, 04/0202995, 04/0038291, 04/0009507, 03/0039958, Ward et al., Nature 341:544-546, 1989).

Naturally occurring immunoglobulin chains exhibit the same general structure of relatively conserved framework regions (FR) joined by three hypervariable regions, also called complementarity determining regions or CDRs. From N-terminus to C-terminus, both light and heavy chains comprise the domains FR1, CDR1, FR2, CDR2, FR3, CDR3 and FR4. The assignment of amino acids to each domain is in accordance with the definitions of Kabat et al. in Sequences of Proteins of Immunological Interest, 5th Ed., US Dept. of Health and Human Services, PHS, NIH, NIH Publication no. 91-3242, 1991.

In some embodiments, the RPP comprises humanized antibodies. A humanized antibody has a sequence that differs from the sequence of an antibody derived from a non-human species by one or more amino acid substitutions, deletions, and/or additions, such that the humanized antibody is less likely to induce an immune response, and/or induces a less severe immune response, as compared to the non-human species antibody, when it is administered to a human subject. In one embodiment, certain amino acids in the framework and constant domains of the heavy and/or light chains of the non-human species antibody are mutated to produce the humanized antibody. In another embodiment, the constant domain(s) from a human antibody are fused to the variable domain(s) of a non-human species. In another embodiment, one or more amino acid residues in one or more CDR sequences of a non-human antibody are changed to reduce the likely immunogenicity of the non-human antibody when it is administered to a human subject, wherein the changed amino acid residues either are not critical for immunospecific binding of the antibody to its antigen, or the changes to the amino acid sequence that are made are conservative changes, such that the binding of the humanized antibody to the antigen is not significantly worse than the binding of the non-human antibody to the antigen. Examples of how to make humanized antibodies may be found in U.S. Pat. Nos. 6,054,297, 5,886,152 and 5,877,293.

Fragments or analogs of antibodies can be readily prepared by those of ordinary skill in the art following the teachings of this specification and using techniques well-known in the art. Preferred amino- and carboxy-termini of fragments or analogs occur near boundaries of functional domains. Structural and functional domains can be identified by comparison of the nucleotide and/or amino acid sequence data to public or proprietary sequence databases. Computerized comparison methods can be used to identify sequence motifs or predicted protein conformation domains that occur in other proteins of known structure and/or function. Methods to identify protein sequences that fold into a known three-dimensional structure are known. See, e.g., Bowie et al., 1991, Science 253:164.

An RPP can also be any synthetic or genetically engineered protein. For example, antibody fragments include isolated fragments consisting of the light chain variable region, "Fv" fragments consisting of the variable regions of the heavy and light chains, recombinant single chain polypeptide molecules in which light and heavy variable regions are connected by a peptide linker (scFv proteins).

Another form of an antibody fragment is a peptide comprising one or more complementarity determining regions (CDRs) of an antibody. CDRs (also termed "minimal recognition units", or "hypervariable region") can be incorporated into a molecule either covalently or noncovalently to make it an antigen binding protein. CDRs can be obtained by constructing polynucleotides that encode the CDR of interest. Such polynucleotides are prepared, for example, by using the polymerase chain reaction to synthesize the variable region using mRNA of antibody producing cells as a template (see, for example, Larrick et al., Methods: A Companion to Methods in Enzymology 2:106, 1991; Courtenay Luck, "Genetic Manipulation of Monoclonal Antibodies," in Monoclonal Antibodies: Production, Engineering and Clinical Application, Ritter et al. (eds.), page 166 (Cambridge University Press 1995); and Ward et al., "Genetic Manipulation and Expression of Antibodies," in Monoclonal Antibodies: Principles and Applications, Birch et al., (eds.), page 137 (Wiley Liss, Inc. 1995).

The variable region domains of RPPs can be any naturally occurring variable domain or an engineered version thereof. By engineered version is meant a variable region domain that has been created using recombinant DNA engineering techniques. Such engineered versions include those created, for example, from a specific antibody variable region by insertions, deletions, or changes in or to the amino acid sequences of the specific antibody. Particular examples include engineered variable region domains containing at least one CDR and optionally one or more framework amino acids from a first antibody and the remainder of the variable region domain from a second antibody.

The variable region domain may be covalently attached at a C terminal amino acid to at least one other antibody domain or a fragment thereof. Thus, for example, a $V_H$ domain that is present in the variable region domain may be linked to an immunoglobulin CH1 domain, or a fragment thereof. Similarly, a $V_L$ domain may be linked to a CK domain or a fragment thereof. In this way, for example, the antibody may be a Fab fragment wherein the antigen binding domain contains associated $V_H$ and $V_L$ domains covalently linked at their C termini to a CH1 and CK domain, respectively. The CH1 domain may be extended with further amino acids, for example to provide a hinge region or a portion of a hinge region domain as found in a Fab' fragment, or to provide further domains, such as antibody CH2 and CH3 domains.

The RPP can be ABPs comprising, e.g., the cognate pairs of heavy and light chain CDR3 sequence disclosed herein. For example, CDRs may be incorporated into known antibody framework regions (IgG1, IgG2, etc.), or conjugated to a suitable vehicle to enhance the half-life thereof. Suitable vehicles include, but are not limited to Fc, polyethylene glycol (PEG), albumin, transferrin, and the like. These and other suitable vehicles are known in the art. Such conjugated CDR peptides may be in monomeric, dimeric, tetrameric, or other form. In one embodiment, one or more water-soluble polymer is bonded at one or more specific position, for example at the amino terminus, of a binding agent.

In certain embodiments, the RPP comprises one or more water soluble polymer attachments, including, but not limited to, polyethylene glycol, polyoxyethylene glycol, or polypropylene glycol. See, e.g., U.S. Pat. Nos. 4,640,835, 4,496,689, 4,301,144, 4,670,417, 4,791,192 and 4,179,337. In certain embodiments, a derivative binding agent comprises one or more of monomethoxy-polyethylene glycol, dextran, cellulose, or other carbohydrate based polymers, poly-(N-vinyl pyrrolidone)-polyethylene glycol, propylene glycol homopolymers, a polypropylene oxide/ethylene oxide co-polymer, polyoxyethylated polyols (e.g., glycerol) and polyvinyl alcohol, as well as mixtures of such polymers. In certain embodiments, one or more water-soluble polymer is randomly attached to one or more side chains. In certain embodiments, PEG can act to improve the therapeutic capacity for a binding agent, such as an antibody. Certain such methods are discussed, for example, in U.S. Pat. No. 6,133,426, which is hereby incorporated by reference for any purpose.

An RPP can have, for example, the structure of a naturally occurring immunoglobulin. An "immunoglobulin" is a tetrameric molecule. In a naturally occurring immunoglobulin, each tetramer is composed of two identical pairs of polypeptide chains, each pair having one "light" (about 25 kDa) and one "heavy" chain (about 50-70 kDa). The amino-terminal portion of each chain includes a variable region of about 100 to 110 or more amino acids primarily responsible for antigen recognition. The carboxy-terminal portion of each chain defines a constant region primarily responsible for effector function. Human light chains are classified as kappa and lambda light chains. Heavy chains are classified as mu, delta, gamma, alpha, or epsilon, and define the antibody's isotype as IgM, IgD, IgG, IgA, and IgE, respectively. Within light and heavy chains, the variable and constant regions are joined by a "J" region of about 12 or more amino acids, with the heavy chain also including a "D" region of about 10 more amino acids. See generally, Fundamental Immunology Ch. 7 (Paul, W., ed., 2nd ed. Raven Press, N.Y. (1989)) (incorporated by reference in its entirety for all purposes). The variable regions of each light/heavy chain pair form the antibody binding site such that an intact immunoglobulin has two binding sites.

Different RPPs may bind to different domains of disease targets or act by different mechanisms of action. As indicated herein inter alia, the domain regions are designated such as to be inclusive of the group, unless otherwise indicated. For example, amino acids 4-12 refers to nine amino acids: amino acids at positions 4, and 12, as well as the seven intervening amino acids in the sequence. Other examples include antigen binding proteins that inhibit binding of a pathogen to its target cell, i.e., neutralizing activity. An antigen binding protein need not completely inhibit a binding to target cell to find use in the present invention.

The RPPs provided herein can induce various biological effects associated with binding to an antigen that comprises a vaccine. In some embodiments, an RPP provided herein prevents binding of a virus to a cell, which therein prevents entry of the virus into the cell. In some embodiments, the RPP binds to the cell surface of a patient's cells, in order to eliminate cells associated with a pathology.

The RPPs describe herein can include an Fc region, e.g., a dimer Fc polypeptide. One suitable Fc polypeptide, described in PCT application WO 93/10151 (hereby incorporated by reference), is a single chain polypeptide extending from the N-terminal hinge region to the native C-terminus of the Fc region of a human IgG1 antibody. Another useful Fc polypeptide is the Fc mutein described in U.S. Pat. No. 5,457,035 and in Baum et al., 1994, EMBO J. 13:3992-4001. The amino acid sequence of this mutein is identical to that of the native Fc sequence presented in WO 93/10151, except that amino acid 19 has been changed from Leu to Ala, amino acid 20 has been changed from Leu to Glu, and amino acid 22 has been changed from Gly to Ala. The mutein exhibits reduced affinity for Fc receptors.

Antigen-binding fragments of RPPs of the invention can be produced by conventional techniques. Examples of such fragments include, but are not limited to, Fab and F(ab')$_2$ fragments. Antibody fragments and derivatives produced by genetic engineering techniques also are contemplated.

Additional embodiments include chimeric antibodies, e.g., humanized versions of non-human (e.g., murine) monoclonal antibodies. Such humanized antibodies may be prepared by known techniques, and offer the advantage of reduced immunogenicity when the antibodies are administered to humans. In one embodiment, a humanized antibody comprises the variable domain of a murine antibody (or all or part of the antigen binding site thereof) and a constant domain derived from a human antibody. Alternatively, a humanized antibody fragment may comprise the antigen binding site of a murine antibody and a variable domain fragment (lacking the antigen-binding site) derived from a human antibody. Procedures for the production of chimeric and further engineered antibodies include those described in Riechmann et al., 1988, Nature 332:323, Liu et al., 1987, Proc. Nat. Acad. Sci. USA 84:3439, Larrick et al., 1989, Bio/Technology 7:934, and Winter et al., 1993, TIPS 14:139. In one embodiment, the chimeric antibody is a CDR grafted antibody. Techniques for humanizing antibodies are discussed in, e.g., U.S. Pat. Nos. 5,869,619, 5,225,539, 5,821, 337, 5,859,205, 6,881,557, Padlan et al., 1995, FASEB J. 9:133-39, and Tamura et al., 2000, J. Immunol. 164:1432-41.

Procedures have been developed for generating human or partially human antibodies in non-human animals. For example, mice in which one or more endogenous immunoglobulin genes have been inactivated by various means have been prepared. Human immunoglobulin genes have been introduced into the mice to replace the inactivated mouse genes. Antibodies produced in the animal incorporate human immunoglobulin polypeptide chains encoded by the human genetic material introduced into the animal. In one embodiment, a non-human animal, such as a transgenic mouse, is immunized with a vaccine, such that antibodies directed against the vaccine antigen pare generated in the animal.

Examples of techniques for production and use of transgenic animals for the production of human or partially human antibodies are described in U.S. Pat. Nos. 5,814,318, 5,569,825, and 5,545,806, Davis et al., 2003, Production of human antibodies from transgenic mice in Lo, ed. Antibody Engineering: Methods and Protocols, Humana Press, NJ:191-200, Kellermann et al., 2002, Curr Opin Biotechnol. 13:593-97, Russel et al., 2000, Infect Immun. 68:1820-26, Gallo et al., 2000, Eur J Immun. 30:534-40, Davis et al., 1999, Cancer Metastasis Rev. 18:421-25, Green, 1999, J Immunol Methods. 231:11-23, Jakobovits, 1998, Advanced Drug Delivery Reviews 31:33-42, Green et al., 1998, J Exp Med. 188:483-95, Jakobovits A, 1998, Exp. Opin. Invest. Drugs. 7:607-14, Tsuda et al., 1997, Genomics. 42:413-21, Mendez et al., 1997, Nat Genet. 15:146-56, Jakobovits, 1994, Curr Biol. 4:761-63, Arbones et al., 1994, Immunity. 1:247-60, Green et al., 1994, Nat Genet. 7:13-21, Jakobovits et al., 1993, Nature. 362:255-58, Jakobovits et al., 1993, Proc Natl Acad Sci USA. 90:2551-55. Chen, J., M. Trounstine, F. W. Alt, F. Young, C. Kurahara, J. Loring, D. Huszar. Inter'l Immunol. 5 (1993): 647-656, Choi et al., 1993, Nature Genetics 4: 117-23, Fishwild et al., 1996, Nature Biotech. 14: 845-51, Harding et al., 1995, Annals of the New York Academy of Sciences, Lonberg et al., 1994, Nature 368: 856-59, Lonberg, 1994, Transgenic Approaches to Human Monoclonal Antibodies in Handbook of Experimental Pharmacology 113: 49-101, Lonberg et al., 1995, Internal Review of Immunology 13: 65-93, Neuberger, 1996, Nature Biotechnology 14: 826, Taylor et al., 1992, Nucleic Acids Res. 20: 6287-95, Taylor et al., 1994, Inter'l Immunol. 6: 579-91, Tomizuka et al., 1997, Nature Genetics 16: 133-43, Tomizuka et al., 2000, Pro. Nat'l Acad. Sci. USA 97: 722-27, Tuaillon et al., 1993, Pro. Nat'l Acad. Sci. USA 90: 3720-24, and Tuaillon et al., 1994, J. Immunol. 152: 2912-20.

RPPs of the invention can comprise any constant region known in the art. The light chain constant region can be, for example, a kappa- or lambda-type light chain constant region, e.g., a human kappa- or lambda-type light chain constant region. The heavy chain constant region can be, for example, an alpha-, delta-, epsilon-, gamma-, or mu-type heavy chain constant regions, e.g., a human alpha-, delta-, epsilon-, gamma-, or mu-type heavy chain constant region. In one embodiment, the light or heavy chain constant region is a fragment, derivative, variant, or mutein of a naturally occurring constant region.

Techniques are known for deriving an antibody of a different subclass or isotype from an antibody of interest, i.e., subclass switching. Thus, IgG antibodies may be derived from an IgM antibody, for example, and vice versa. Such techniques allow the preparation of new antibodies that possess the antigen-binding properties of a given antibody (the parent antibody), but also exhibit biological properties associated with an antibody isotype or subclass different from that of the parent antibody. Recombinant DNA techniques may be employed. Cloned DNA encoding particular antibody polypeptides may be employed in such procedures, e.g., DNA encoding the constant domain of an antibody of the desired isotype. See also Lantto et al., 2002, Methods Mol. Biol. 178:303-16.

Single chain antibodies (scFv) may be formed by linking heavy and light chain variable domain (Fv region) fragments via an amino acid bridge (short peptide linker, e.g., a synthetic sequence of amino acid residues), resulting in a single polypeptide chain. Such single-chain Fvs (scFvs) have been prepared by fusing DNA encoding a peptide linker between DNAs encoding the two variable domain polypeptides ($V_L$ and $V_H$). The resulting polypeptides can fold back on themselves to form antigen-binding monomers, or they can form multimers (e.g., dimers, trimers, or tetramers), depending on the length of a flexible linker between the two variable domains (Kortt et al., 1997, Prot. Eng. 10:423; Kortt et al., 2001, Biomol. Eng. 18:95-108, Bird et al., 1988, Science 242:423-26 and Huston et al., 1988, Proc. Natl. Acad. Sci. USA 85:5879-83). By combining different $V_L$ and $V_H$-comprising polypeptides, one can form multimeric scFvs that bind to different epitopes (Kriangkum et al., 2001, Biomol. Eng. 18:31-40). Techniques developed for the production of single chain antibodies include those described in U.S. Pat. No. 4,946,778; Bird, 1988, Science 242:423; Huston et al., 1988, Proc. Natl. Acad. Sci. USA 85:5879; Ward et al., 1989, Nature 334:544, de Graaf et al., 2002, Methods Mol Biol. 178:379-87.

An RPP, e.g., ABPs, according to the invention may have a binding affinity for antigen target of less than or equal to 5×10⁻⁷ M, less than or equal to 1×10⁻⁷ M, less than or equal to 0.5×10⁻⁷M, less than or equal to 1×10⁻⁸M, less than or equal to 1×10⁻⁹M, less than or equal to 1×10⁻¹⁰M, less than or equal to 1×10⁻¹¹M, or less than or equal to 1×10⁻¹²M.

The affinity of an RPP, as well as the extent to which the RPP inhibits binding, can be determined by one of ordinary skill in the art using conventional techniques, for example those described by Scatchard et al. (Ann. N.Y. Acad. Sci. 51:660-672 (1949)) or by surface plasmon resonance (SPR; BIAcore, Biosensor, Piscataway, N.J.). For surface plasmon resonance, target molecules are immobilized on a solid phase and exposed to ligands in a mobile phase running along a flow cell. If ligand binding to the immobilized target occurs, the local refractive index changes, leading to a change in SPR angle, which can be monitored in real time by detecting changes in the intensity of the reflected light. The rates of change of the SPR signal can be analyzed to yield apparent rate constants for the association and dissociation phases of the binding reaction. The ratio of these values gives the apparent equilibrium constant (affinity) (see, e.g., Wolff et al., Cancer Res. 53:2560-65 (1993)).

Sequences of RPPs

CDR polypeptide sequences of recombinant antibodies generated using the methods described herein are provided in the sequence listing.

A summary of the sequences is provided in TABLE 5. ABPs of the RPP provided herein can comprise a cognate pair of heavy chain CDR3 and light chain CDR3 sequences as shown in Table 5, optionally all the cognate pairs.

In some embodiments, the RPP comprises an ABP specifically binding to one or more Zika antigens and comprising a cognate pair of heavy chain CDR3 and light chain CDR3 sequences as shown in Table 5, optionally all the cognate pairs. In particular, the heavy chain CDR3 can comprise a sequence selected from SEQ ID NO: 2, 4, 6, through 25838 (even numbers). The light chain CDR3 can comprise a sequence selected from SEQ ID NO: 1, 3, 5, through 25837 (odd numbers).

In some embodiments, the RPP is recombinantly produced using sequences derived from plasma cells or plasmablasts from at least one donor injected with the antigen or infected with Zika. In some embodiments, the sequences are obtained from antiboidies generated in a mammalian subject injected with a Zika or Denghe antigen. In some embodiments, the mammalian subject is injected or infected with Zika virus or Denghe virus. In some embodiments, the mammalian subject is injected or infected with Zika virus and Denghe virus. In some embodiments, the mammalian subject is injected with inactivated Zika virus or Denghe virus. In some embodiments, the mammalian subject is injected with Zika virus like particles (VLP), inactivated Dengue 1, Dengue 4, Dengue 3, or Dengue. In some embodiments, the donor is a human subject. In some embodiments, the donor is not a human subject. In some embodiments, the donor is a mouse.

In some embodiments, the RPP is recombinantly produced using sequences derived from plasma cells or plasmablasts from at least one donor and the activity of the RPP exceeds by at least tenfold a serum titer activity of the donor against Zika virus or a Zika antigen. In some embodiments, the activity is measured by an in vitro pathogen neutralization assay or an in vitro binding to antigen assay or an in vivo efficacy assay.

TABLE 5

CDR3 heavy and CDR3 light chain sequences

| Sequence | Description |
| --- | --- |
| 1, 3, 5, through 25837 (odd numbers) | Antibodies from Trianni mice immunized with Zika and dengue viruses - light chain CDR3 sequences |
| 2, 4, 6, through 25838 (even numbers) | Antibodies from Trianni mice immunized with Zika and dengue viruses - heavy chain CDR3 sequences |

In some embodiments, the RPP includes an ABP comprising cognate pairs of the heavy and light chain variable regions. In some embodiments, the ABP comprises CDR3 sequences disclosed herein. In some embodiments, the ABP comprises a heavy chain CDR3 having a sequence selected from SEQ ID Nos: 2, 4, 6, through 25838 (even numbers) and a light chain CDR3 has a sequence selected from SEQ ID Nos: 1, 3, 5, through 25837 (odd numbers).

In some embodiments, the ABP comprises a heavy chain CDR3 having the sequence of SEQ ID NO: [n+1] and a light chain CDR3 has the sequence of SEQ ID NO: [n], wherein n is an odd number from 1 to 25837. In some embodiments, the ABP comprises a heavy chain CDR3 having the sequence of SEQ ID NO: [n+1] or a light chain CDR3 has the sequence of SEQ ID NO: [n], wherein n is an odd number from 1 to 25837.

In some embodiments, the ABPs of the RPP comprise a heavy chain CDR1 having the sequence of GFTF $X_1X_2X_3X_4$ (SEQ ID NO: 25839).

In some embodiments, the RPP comprises an ABP comprising a heavy chain CDR1 having the sequence of GFTF [S/D][S/D][Y/H/D][A/G/Y/F] (SEQ ID NO: 25840). In some embodiments, the RPP comprises an ABP comprising a heavy chain CDR1 having a sequence selected from the group consisting of:

GFTFSSYA (SEQ ID NO: 25841);
GFTFSSYG (SEQ ID NO: 25842);
GFTFDD[Y/H]G (SEQ ID NO: 25843); and
GFTFSD[Y/D][Y/F] (SEQ ID NO: 25844)

In some embodiments, each of the ABPs in the RPP comprises a heavy chain CDR1 having the sequence selected from SEQ ID Nos: 25839-25844. In some embodiments, each of at least 5%, 10%, 25%, or 50% of the total ABPs in the RPP comprises a heavy chain CDR1 having the sequence selected from SEQ ID Nos: 25839-25844.

In some embodiments, the RPP comprises an ABP comprising a heavy chain CDR2 having the sequence of I $X_1X_2X_3G$ $X_3X_4X_5$ (SEQ ID NO: 25845).

In some embodiments, the RPP comprises an ABP comprising a heavy chain CDR2 having the sequence of I[W/S/N] [G/Y/W][S/D/N]G[G/S/D/Y][S/N/T] [T/K/I] (SEQ ID NO: 25846). In some embodiments, the RPP comprises an ABP comprising a heavy chain CDR2 having a sequence selected from the group consisting of:

ISGSGGST (SEQ ID NO: 25847);
I[W/S]YDGSNK (SEQ ID NO: 25848);
INWNG[G/D]ST (SEQ ID NO: 25849) and
ISGSG[S/Y]TI (SEQ ID NO: 25850).

In some embodiments, each of the ABPs in the RPP comprises a heavy chain CDR1 having the sequence selected from SEQ ID Nos: 25845-25850. In some embodiments, each of at least 5%, 10%, 25%, or 50% of the total ABPs in the RPP comprises a heavy chain CDR1 having the sequence selected from SEQ ID Nos: 25845-25850.

In some embodiments, the RPP comprises an ABP comprising a heavy chain CDR3 having a seqyebce selected from AKEGMVLRYFDWLWDY (SEQ ID NO: 25851);
RX$_1$X$_2$X$_3$SGX4S X$_5$FDY (SEQ ID NO: 25852);
AX$_1$X$_2$X$_3$X$_4$X$_5$X$_6$VX$_7$X$_8$X$_9$Y (SEQ ID NO: 25853);
ARX$_1$X$_2$GSX$_3$X$_4$X$_5$X$_6$DX$_7$FD X$_8$ (SEQ ID NO: 25854); and
ARDEGYX$_1$GYX$_2$LDX$_3$ (SEQ ID NO: 25855).

In some embodiments, each of the ABPs in the RPP comprises a heavy chain CDR3 having a seqyebce selected from AKEGMVLRYFDWLWDY (SEQ ID NO: 25851);
RX1X$_2$X$_3$SGX$_4$S X$_5$FDY (SEQ ID NO: 25852);
AX$_1$X$_2$X$_3$X$_4$X$_5$X$_6$VX$_7$X$_8$X$_9$Y (SEQ ID NO: 25853);
ARX$_1$X$_2$GSX$_3$X$_4$X$_5$X$_6$DX$_7$FD X$_8$ (SEQ ID NO: 25854); and
ARDEGYX$_1$GYX$_2$LDX$_3$ (SEQ ID NO: 25855).

In some embodiments, each of at least 5%, 10%, 25%, or 50% of the total ABPs om the RPP comprises a heavy chain CDR3 having a seqyebce selected from AKEGMVLRYFDWLWDY (SEQ ID NO: 25851);
RX1X$_2$X$_3$SGX$_4$S X$_5$FDY (SEQ ID NO: 25852);
AX$_1$X$_2$X$_3$X$_4$X$_5$X$_6$VX$_7$X$_8$X$_9$Y (SEQ ID NO: 25853);
ARX$_1$X$_2$GSX$_3$X$_4$X$_5$X$_6$DX$_7$FD X$_8$ (SEQ ID NO: 25854); and
ARDEGYX$_1$GYX$_2$LDX$_3$ (SEQ ID NO: 25855).

In some embodiments, the RPP comprises an ABP comprising a heavy chain CDR3 having a sequence selected from AKEGMVLRYFDWLWDY (SEQ ID NO: 25856);
R[D/E][R/L][SN/L]SG[P/W]S[G/FI]FDY (SEQ ID NO: 25857);
A[K/E/R][E/T][Q/L/T][L/W/I][LN/W/N][G/L]V[V/P/L][F/L/N][D/N]Y (SEQ ID NO: 25858);
AR[D/N][R/G]GS[S/T][G/S/W/F][W/F/Y][R/F/Y]D[W/A]FD[P/I] (SEQ ID NO: 25859); and
ARDEGY[R/S]GY[V/N]LD[T/N/S] (SEQ ID NO: 25860).

In some embodiments, the RPP comprises at least 20, 40, 50, 100 or 200 ABPs comprising:

a heavy chain CDR1 having the sequence of GFTFSSYA (SEQ ID NO: 25841), a heavy chain CDR2 having the sequence of ISGSGGST (SEQ ID NO: 25847), and a heavy chain CDR3 having the sequence of AKEGMVLRYFDWLWDY (SEQ ID NO: 25856);

a heavy chain CDR1 having the sequence of GFTFSSYG (SEQ ID NO: 25842), a heavy chain CDR2 having the sequence of I[W/S]YDGSNK (SEQ ID NO: 25848), and a heavy chain CDR3 having the sequence of R[D/E][R/L][SN/L]SG[P/W]S[G/H]FDY (SEQ ID NO: 25857);

a heavy chain CDR1 having the sequence of GFTFSSYA (SEQ ID NO: 25841), a heavy chain CDR2 having the sequence of ISGSGGST (SEQ ID NO: 25847), and a heavy chain CDR3 having the sequence of A[K/E/R][E/T][Q/L/T][L/W/I][LN/W/N][G/L]V[V/P/L][F/L/N][D/N]Y (SEQ ID NO: 25858);

a heavy chain CDR1 having the sequence of GFTFDD[Y/H]G (SEQ ID NO: 25843), a heavy chain CDR2 having the sequence of INWNG[G/D]ST (SEQ ID NO: 25849), and a heavy chain CDR3 having the sequence of AR[D/N][R/G]GS[S/T][G/S/W/F][W/F/Y][R/F/Y]D[W/A]FD[P/I] (SEQ ID NO: 25859); or a heavy chain CDR1 having the sequence of GFTFSD[Y/D][Y/F] (SEQ ID NO: 25844), a heavy chain CDR2 having the sequence of ISGSG[S/Y]TI (SEQ ID NO: 25850), and a heavy chain CDR3 having the sequence of ARDEGY[R/S]GY[V/N]LD[T/N/S] (SEQ ID NO: 25860).

In some embodiments, each of at least 5%, 10%, 25%, or 50% of the total ABPs in the RPP comprises:

a heavy chain CDR1 having the sequence of GFTFSSYA (SEQ ID NO: 25841), a heavy chain CDR2 having the sequence of ISGSGGST (SEQ ID NO: 25847), and a heavy chain CDR3 having the sequence of AKEGMVLRYFDWLWDY (SEQ ID NO: 25856);

a heavy chain CDR1 having the sequence of GFTFSSYG (SEQ ID NO: 25842), a heavy chain CDR2 having the sequence of I[W/S]YDGSNK (SEQ ID NO: 25848), and a heavy chain CDR3 having the sequence of R[D/E][R/L][SN/L]SG[P/W]S[G/H]FDY (SEQ ID NO: 25857);

a heavy chain CDR1 having the sequence of GFTFSSYA (SEQ ID NO: 25841), a heavy chain CDR2 having the sequence of ISGSGGST (SEQ ID NO: 25847), and a heavy chain CDR3 having the sequence of A[K/E/R][E/T][Q/L/T][L/W/I][LN/W/N][G/L]V[V/P/L][F/L/N][D/N]Y (SEQ ID NO: 25858);

a heavy chain CDR1 having the sequence of GFTFDD[Y/H]G (SEQ ID NO: 25843), a heavy chain CDR2 having the sequence of INWNG[G/D]ST (SEQ ID NO: 25849), and a heavy chain CDR3 having the sequence of AR[D/N][R/G]GS[S/T][G/S/W/F][W/F/Y][R/F/Y]D[W/A]FD[P/I] (SEQ ID NO: 25859); or a heavy chain CDR1 having the sequence of GFTFSD[Y/D][Y/F] (SEQ ID NO: 25844), a heavy chain CDR2 having the sequence of ISGSG[S/Y]TI (SEQ ID NO: 25850), and a heavy chain CDR3 having the sequence of ARDEGY[R/S]GY[V/N]LD[T/N/S] (SEQ ID NO: 25860).

In some embodiments, each of the ABPs comprises a unique heavy chain CDR3 and a unique light chain CDR3 sequence. In some embodiments, each of the ABPs comprises a unique heavy chain CDR3 and light chain CDR3 pair.

An oligopeptide or polypeptide is within the scope of the invention if it has an amino acid sequence that is at least 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% identical to least one of the CDRs provided herein.

In some embodiments, the RPP comprises about 10, 100, 500, 1,000, 5,000, 10,000, 50,000 or more than 100,000 distinct ABPs, each having a unique sequence. In some embodiments, the RPP comprises at least 10, 100, 500, 1,000, 5,000, 10,000, 20,000, 30,000, 40,000, 50,000 or more than 100,000 distinct ABPs, each having a unique sequence.

In some embodiments, the RPP has a binding titer to a Zika antigen at least 50 times higher than antibodies in a sample obtained from one or more donor exposed to the antigen. The binding titer can be measured by any of the methods known in the art. For example, the binding titer can be measured by anti-Zika-ELISA. In some embodiments, the binding titer of the RPP is at least 10, 100, 200, 300, 400, 500, 600, 700, 800, 900, or 1000 times higher than antibodies in a sample obtained from one or more donor exposed to the Zika antigen. The sample can be a plasma sample.

In some embodiments, the RPP has a Zika neutralization titer at least 50 times higher than antibodies in a sample obtained from one or more donor exposed to the antigen. The neutralization titer can be measured by any of the methods known in the art. For example, the neutralization titer can be measured by an in vitro or in vivo assay. In some embodiments, the neutralization titer of the RPP is at least 10, 100, 200, 300, 400, 500, 600, 700, 800, 900, or 1000 times higher than antibodies in a sample obtained from one or more donor exposed to the Zika antigen. The sample can be a plasma sample.

In some embodiments, the RPP comprises ABPs selected based on their activity. For example, the RPP comprises ABPs selected based on their binding or neutralization activity against Zika virus. In some embodiments, the ABP contains a mix of RPPs selected for their activity against different types or variants of Zika virus.

Nucleic Acids

In one aspect, the present invention provides isolated nucleic acid molecules. The nucleic acids comprise, for example, polynucleotides that encode all or part of an ABP in the RPP, for example, one or both chains of an antibody of the invention, or a fragment, derivative, mutein, or variant thereof, polynucleotides sufficient for use as hybridization probes, PCR primers or sequencing primers for identifying, analyzing, mutating or amplifying a polynucleotide encoding a polypeptide, anti-sense nucleic acids for inhibiting expression of a polynucleotide, and complementary sequences of the foregoing. The nucleic acids can be any length. They can be, for example, 5, 10, 15, 20, 25, 30, 35, 40, 45, 50, 75, 100, 125, 150, 175, 200, 250, 300, 350, 400, 450, 500, 750, 1,000, 1,500, 3,000, 5,000 or more nucleotides in length, and/or can comprise one or more additional sequences, for example, regulatory sequences, and/or be part of a larger nucleic acid, for example, a vector. The nucleic acids can be single-stranded or double-stranded and can comprise RNA and/or DNA nucleotides, and artificial variants thereof (e.g., peptide nucleic acids).

Polynucleotides encoding antibody polypeptides (e.g., heavy or light chain, variable domain only, CDRs only, or full length) can be isolated from B cells, plasma cells, or plasmablasts of a subject that has been exposed to an antigen, e.g., by being infected by virus or immunized with a vaccine. The nucleic acid can be isolated by conventional procedures such as polymerase chain reaction (PCR) or methods described herein (e.g., single cell OE-RT-PCR).

Polypeptide sequences of the CDR3 from the variable regions of the heavy and light chain variable regions are shown herein. The skilled artisan will appreciate that, due to the degeneracy of the genetic code, each of the polypeptide sequences disclosed herein is encoded by a large number of other nucleic acid sequences. The present invention provides each degenerate nucleotide sequence encoding each RPP of the invention.

Methods for hybridizing nucleic acids are well-known in the art. See, e.g., Curr. Prot. in Mol. Biol., John Wiley & Sons, N.Y. (1989), 6.3.1-6.3.6. As defined herein, a moderately stringent hybridization condition uses a prewashing solution containing 5× sodium chloride/sodium citrate (SSC), 0.5% SDS, 1.0 mM EDTA (pH 8.0), hybridization buffer of about 50% formamide, 6×SSC, and a hybridization temperature of 55° C. (or other similar hybridization solutions, such as one containing about 50% formamide, with a hybridization temperature of 42° C.), and washing conditions of 60° C., in 0.5×SSC, 0.1% SDS. A stringent hybridization condition hybridizes in 6×SSC at 45° C., followed by one or more washes in 0.1×SSC, 0.2% SDS at 68° C. Furthermore, one of skill in the art can manipulate the hybridization and/or washing conditions to increase or decrease the stringency of hybridization such that nucleic acids comprising nucleotide sequences that are at least 65, 70, 75, 80, 85, 90, 95, 98, or 99% identical to each other typically remain hybridized to each other. The basic parameters affecting the choice of hybridization conditions and guidance for devising suitable conditions are set forth by, for example, Sambrook, Fritsch, and Maniatis (1989, Molecular Cloning: A Laboratory Manual, Cold Spring Harbor Laboratory Press, Cold Spring Harbor, N.Y., chapters 9 and 11; and Curr. Prot. in Mol. Biol. 1995, Ausubel et al., eds., John Wiley & Sons, Inc., sections 2.10 and 6.3-6.4), and can be readily determined by those having ordinary skill in the art based on, for example, the length and/or base composition of the DNA.

Changes can be introduced by mutation into a nucleic acid, thereby leading to changes in the amino acid sequence of a polypeptide (e.g., an RPP) that it encodes. Mutations can be introduced using any technique known in the art. In one embodiment, one or more particular amino acid residues are changed using, for example, a site-directed mutagenesis protocol. In another embodiment, one or more randomly selected residues are changed using, for example, a random mutagenesis protocol. However, it is made, a mutant polypeptide can be expressed and screened for a desired property (e.g., binding to a virus).

In another aspect, the present invention provides nucleic acid molecules that are suitable for use as primers or hybridization probes for the detection of nucleic acid sequences of the invention. A nucleic acid molecule of the invention can comprise only a portion of a nucleic acid sequence encoding a full-length polypeptide of the invention, for example, a fragment that can be used as a probe or primer or a fragment encoding an active portion (e.g., a virus binding portion) of a polypeptide of the invention.

Probes based on the sequence of a nucleic acid of the invention can be used to detect the nucleic acid or similar nucleic acids, for example, transcripts encoding a polypeptide of the invention. The probe can comprise a label group, e.g., a radioisotope, a fluorescent compound, an enzyme, or an enzyme co-factor. Such probes can be used to identify a cell that expresses the polypeptide In another aspect, the present invention provides libraries of nucleic acids that encode for RPP or a variant or derivative thereof, derived from B cells, plasmablasts, and plasma cells. These libraries of nucleic acids are generated by isolating plasmablasts and plasma cells into single-cell reaction containers, wherein they are lysed and antibody-specific nucleic acids are purified or captured, for example on solid supports such as beads.

In some embodiments, the library is generated by obtaining a plurality of first linear polynucleotides, each comprising a first sequence encoding a heavy chain variable domain from a cognate pair from the single plasma cell or plasmablast; and a second sequence encoding a light chain variable domain from the cognate pair; and a third sequence linking the first and second sequences and comprising a restriction site; and obtaining a second linear polynucleotide, not operationally linked to the first polynucleotide, comprising a fourth sequence homologous to a portion of the first polynucleotide; and circularizing each of the plurality of first polynucleotides with the second polynucleotide to generate a library of polynucleotides encoding the library of recombinant antibodies, wherein circularization is effected through Gibson Assembly; and expressing the library of recombinant antibodies in mammalian cells comprising the library of polynucleotides encoding the recombinant antibodies, thereby generating the library of recombinant antibodies.

The present invention provides methods for performing capture of transcripts from millions of single cells in parallel. Capture of transcripts is followed by amplification of nucleic acids that encode heavy and light chain immunoglobulins, and subsequent linkage of said nucleic acids into libraries of fused constructs that encode both heavy and light chain immunoglobulins. In such libraries the native pairing of heavy and light chain immunoglobulins, as originally found in the input B cells, plasmablasts, and plasma cells, is maintained. Such methods are performed in parallel on millions of single cells, such that the resulting library of fused heavy and light chain immunoglobulin nucleic acids comprises natively paired sequences for millions of single cells. Such methods are described elsewhere (Adler et al., Mabs 9, 1282-1996, 2017; WO2020/223573 which are incorporated by reference in its entirety herein).

Vectors and Host Cells

The present invention provides vectors, each vector comprising a nucleic acid encoding a polypeptide of the invention or a portion thereof. Examples of vectors include, but are not limited to, plasmids, viral vectors, non-episomal mammalian vectors and expression vectors, for example, recombinant expression vectors.

In another aspect of the present invention, expression vectors containing the nucleic acid molecules and polynucleotides of the present invention are also provided, and host cells transformed with such vectors, and methods of producing the polypeptides are also provided. The term "expression vector" refers to a plasmid, phage, virus or vector for expressing a polypeptide from a polynucleotide sequence. Vectors for the expression of the polypeptides contain at a minimum sequence required for vector propagation and for expression of the cloned insert. An expression vector comprises a transcriptional unit comprising an assembly of (1) a genetic element or elements having a regulatory role in gene expression, for example, promoters or enhancers, (2) a sequence that encodes polypeptides and proteins to be transcribed into mRNA and translated into protein, and (3) appropriate transcription initiation and termination sequences. These sequences may further include a selection marker. Vectors suitable for expression in host cells are readily available and the nucleic acid molecules are inserted into the vectors using standard recombinant DNA techniques. Such vectors can include promoters which function in specific cells or tissues, and viral vectors for the expression of polypeptides in targeted human or animal cells.

The recombinant expression vectors of the invention can comprise a nucleic acid of the invention in a form suitable for expression of the nucleic acid in a host cell. The recombinant expression vectors include one or more regulatory sequences, selected on the basis of the host cells to be used for expression, which is operably linked to the nucleic acid sequence to be expressed. Regulatory sequences include those that direct constitutive expression of a nucleotide sequence in many types of host cells (e.g., SV40 early gene enhancer, Rous sarcoma virus promoter and cytomegalovirus promoter), those that direct expression of the nucleotide sequence only in certain host cells (e.g., tissue-specific regulatory sequences, see Voss et al., 1986, Trends Biochem. Sci. 11:287, Maniatis et al., 1987, Science 236:1237, incorporated by reference herein in their entireties), and those that direct inducible expression of a nucleotide sequence in response to particular treatment or condition (e.g., the metallothionin promoter in mammalian cells and the tet-responsive and/or streptomycin responsive promoter in both pro-karyotic and eukaryotic systems (see id.). It will be appreciated by those skilled in the art that the design of the expression vector can depend on such factors as the choice of the host cell to be transformed, the level of expression of protein desired, etc. The expression vectors of the invention can be introduced into host cells to thereby produce proteins or peptides, including fusion proteins or peptides, encoded by nucleic acids as described herein.

The invention further provides methods of making polypeptides, e.g., RPP. A variety of other expression/host systems may be utilized. Vector DNA can be introduced into prokaryotic or eukaryotic systems via conventional transformation or transfection techniques. These systems include but are not limited to microorganisms such as bacteria (for example, E. coli) transformed with recombinant bacteriophage, plasmid or cosmid DNA expression vectors; yeast transformed with yeast expression vectors; insect cell systems infected with virus expression vectors (e.g., baculovirus); plant cell systems transfected with virus expression vectors (e.g., cauliflower mosaic virus, CaMV; tobacco mosaic virus, TMV) or transformed with bacterial expression vectors (e.g., Ti or pBR322 plasmid); or animal cell systems. Mammalian cells useful in recombinant protein production include but are not limited to VERO cells, HeLa cells, Chinese hamster ovary (CHO) cell lines, or their derivatives such as Veggie CHO and related cell lines which grow in serum-free media (see Rasmussen et al., 1998, Cytotechnology 28:31) or CHO strain DX-B11, which is deficient in DHFR (see Urlaub et al., 1980, Proc. Natl. Acad. Sci. USA 77:4216-20) COS cells such as the COS-7 line of monkey kidney cells (ATCC CRL 1651) (see Gluzman et al., 1981, Cell 23:175), W138, BHK, HepG2, 3T3 (ATCC CCL 163), RIN, MDCK, A549, PC12, K562, L cells, C127 cells, BHK (ATCC CRL 10) cell lines, the CV1/EBNA cell line derived from the African green monkey kidney cell line CV1 (ATCC CCL 70) (see McMahan et al., 1991, EMBO J. 10:2821), human embryonic kidney cells such as 293, 293 EBNA or MSR 293, human epidermal A431 cells, human Colo205 cells, other transformed primate cell lines, normal diploid cells, cell strains derived from in vitro culture of primary tissue, primary explants, HL-60, U937, HaK or Jurkat cells. Mammalian expression allows for the production of secreted or soluble polypeptides which may be recovered from the growth medium.

For stable transfection of mammalian cells, it is known that, depending upon the expression vector and transfection technique used, only a small fraction of cells may integrate the foreign DNA into their genome. In order to identify and select these integrants, a gene that encodes a selectable marker (e.g., for resistance to antibiotics) is generally introduced into the host cells along with the gene of interest. Once such cells are transformed with vectors that contain selectable markers as well as the desired expression cassette, the cells can be allowed to grow in an enriched media before they are switched to selective media, for example. The selectable marker is designed to allow growth and recovery of cells that successfully express the introduced sequences. Resistant clumps of stably transformed cells can be proliferated using tissue culture techniques appropriate to the cell line employed. An overview of expression of recombinant proteins is found in Methods of Enzymology, v. 185, Goeddell, D. V., ed., Academic Press (1990). Preferred selectable markers include those which confer resistance to drugs, such as G418, hygromycin and methotrexate. Cells stably transfected with the introduced nucleic acid can be identified by drug selection (e.g., cells that have incorporated the selectable marker gene will survive, while the other cells die), among other methods.

The transformed cells can be cultured under conditions that promote expression of the polypeptide, and the polypeptide can be recovered by conventional protein purification procedures (as defined above).

In some cases, such as in expression using prokaryotic systems, the expressed polypeptides of this invention may need to be "refolded" and oxidized into a proper tertiary structure and disulfide linkages generated in order to be biologically active. Refolding can be accomplished using a number of procedures well known in the art. Such methods include, for example, exposing the solubilized polypeptide to a pH usually above 7 in the presence of a chaotropic agent. The selection of chaotrope is similar to the choices used for inclusion body solubilization; however, a chaotrope is typically used at a lower concentration. Exemplary chaotropic agents are guanidine and urea. In most cases, the refolding/oxidation solution will also contain a reducing agent plus its oxidized form in a specific ratio to generate a particular redox potential which allows for disulfide shuffling to occur for the formation of cysteine bridges. Some commonly used redox couples include cysteine/cystamine, glutathione/dithiobisGSH, cupric chloride, dithiothreitol DTT/dithiane DTT, and 2-mercaptoethanol (bME)/dithio-bME. In many instances, a co-solvent may be used to increase the efficiency of the refolding. Commonly used cosolvents include glycerol, polyethylene glycol of various molecular weights, and arginine.

In addition, the polypeptides can be synthesized in solution or on a solid support in accordance with conventional techniques. Various automatic synthesizers are commercially available and can be used in accordance with known protocols. See, for example, Stewart and Young, Solid Phase Peptide Synthesis, 2d. Ed., Pierce Chemical Co. (1984); Tam et al., J Am Chem Soc, 105:6442, (1983); Merrifield, Science 232:341-347 (1986); Barany and Merrifield, The Peptides, Gross and Meienhofer, eds, Academic Press, New York, 1-284; Barany et al., Int J Pep Protein Res, 30:705-739 (1987).

The polypeptides and proteins of the present invention can be purified according to protein purification techniques well known to those of skill in the art. These techniques involve, at one level, the crude fractionation of the proteinaceous and non-proteinaceous fractions. Having separated the peptide polypeptides from other proteins, the peptide or polypeptide of interest can be further purified using chromatographic and electrophoretic techniques to achieve partial or complete purification (or purification to homogeneity). The term "purified polypeptide" as used herein, is intended to refer to a composition, isolatable from other components, wherein the polypeptide is purified to any degree relative to its naturally-obtainable state. A purified polypeptide therefore also refers to a polypeptide that is free from the environment in which it may naturally occur. Generally, "purified" will refer to a polypeptide composition that has been subjected to fractionation to remove various other components, and which composition substantially retains its expressed biological activity. Where the term "substantially purified" is used, this designation will refer to a peptide or polypeptide composition in which the polypeptide or peptide forms the major component of the composition, such as constituting about 50%, about 60%, about 70%, about 80%, about 85%, or about 90% or more of the proteins in the composition.

Various techniques suitable for use in purification are well known to those of skill in the art. These include, for example, precipitation with ammonium sulphate, PEG, antibodies (immunoprecipitation) and the like or by heat denaturation, followed by centrifugation; chromatography such as affinity chromatography (Protein-A columns), ion exchange, gel filtration, reverse phase, hydroxylapatite, hydrophobic interaction chromatography, isoelectric focusing, gel electrophoresis, and combinations of these techniques. As is generally known in the art, it is believed that the order of conducting the various purification steps may be changed, or that certain steps may be omitted, and still result in a suitable method for the preparation of a substantially purified polypeptide. Exemplary purification steps are provided in the Examples below.

Various methods for quantifying the degree of purification of polypeptide are known to those of skill in the art in light of the present disclosure. These include, for example, determining the specific binding activity of an active fraction, or assessing the amount of peptide or polypeptide within a fraction by SDS/PAGE analysis. A preferred method for assessing the purity of a polypeptide fraction is to calculate the binding activity of the fraction, to compare it to the binding activity of the initial extract, and to thus calculate the degree of purification, herein assessed by a "—fold purification number." The actual units used to represent the amount of binding activity are, of course, be dependent upon the particular assay technique chosen to follow the purification and whether or not the polypeptide or peptide exhibits a detectable binding activity.

In some aspects, the present invention includes libraries of antibody-encoding nucleic acid vectors for site-directed integration into mammalian genomes. Such vectors include plasmids, retroviruses, and lentivirus. These libraries of vectors encode libraries of antibody sequences, which are then be used to engineer mammalian cells for production of RPPs. The libraries of nucleic acid vectors may include 10, 100, 1,000, 10,000, or more than 100,000 different antibody-encoding sequences. The sequences are derived from plasmablasts and plasma cells. These libraries of nucleic acids are generated by isolating plasmablasts and plasma cells into single-cell reaction containers, wherein they are lysed and antibody-specific nucleic acids are purified or captured, for example on solid supports such as beads. The present invention provides methods for performing capture of transcripts from millions of single cells in parallel. Capture of transcripts is followed by amplification of nucleic acids that encode heavy and light chain immunoglobulins, and subsequent linkage of said nucleic acids into libraries of fused constructs that encode both heavy and light chain immunoglobulins. In such libraries the native pairing of heavy and light chain immunoglobulins, as originally found in the input plasmablasts and plasma cells, is maintained. Such methods are performed in parallel on millions of single cells, such that the resulting library of fused heavy and light chain immunoglobulin nucleic acids comprises natively paired sequences for millions of single cells. These paired fused amplicons are then engineered into full-length antibody constructs using Gibson Assembly, restriction endonucleases, or other recombinant DNA techniques.

Engineering into full-length antibody constructs is performed on the full library en masse, such that the antibody sequence content and antibody sequence counts of the library are essentially maintained throughout the process. In some aspects, the library of expression vectors is engineered in two steps, such that the scFv amplicon is subcloned into an intermediate vector, and then a second round of Gibson Assembly, restriction digestion, or other recombinant technique is used to engineer additional domains of the antibody into the linker of the scFv. The method is described in U.S. Pat. No. 9,422,547, which is incorporated by reference in its entirety herein. The native pairing of heavy and light chain immunoglobulins is essentially maintained throughout the process of engineering into full-length expression vector libraries. The vectors are designed in various orientations, for example, two separate promoters drive expression of heavy and light chain immunoglobulins, or one promoter drives expression of both heavy and light chain immunoglobulins, and a translational skip motif is used to separately translate the heavy and light chain immunoglobulins into separate polypeptides. In some embodiments, the expression vectors comprise sequences for site-directed integration into mammalian production cells, for example, CRISPR-Cas9, Flp-In, Cre/Lox, or zinc finger recombination methods. Site-directed integration ensures that each mammalian production cell encodes a single antibody sequence, and decreases variability in expression levels between single production cells.

In another aspect, the present disclosure provides a host cell or a library of host cells, each comprising a polynucleotide encoding an ABP described herein. In some embodiments, the host cell comprises a vector or comprises a polynucleotide stably integrated into its genome. In some embodiments, the host cell comprises a polynucleotide encoding a ABP stably integrated into the genome using a Flp recombinase recognition target (FRT) landing pad or a similar method known in the art. In some embodiments, the host cell is a mammalian or prokaryotic cell. In some embodiments, the host cell is a human cell or a yeast cell. In some embodiments, the host cell is CHO cell.

In some embodiments, the host cell comprises an expression vector or integrated polynucleotide for production of RPP. In some embodiments, a library of host cells can be used produce a RPP described herein. In some embodiments, a library of host cells comprise cells selected based on their production yields or neutralization or binding titers of RPP produced by them. The host cells can be production host cells.

Methods of Producing RPPs

The RPP can be purified from host cells that comprises a gene encoding the RPP. The RPP produced from the host cells can be obtained by elution of filtered supernatant of host cell culture fluid using a Heparin HP column, using a salt gradient, or with protein A resin.

Fully human monoclonal antibodies can be generated by any number of techniques with which those having ordinary skill in the art are familiar. Such methods include, but are not limited to, Epstein Barr Virus (EBV) transformation of human peripheral blood cells (e.g., containing B lymphocytes), in vitro immunization of human B-cells, fusion of spleen cells from immunized transgenic mice carrying inserted human immunoglobulin genes, isolation from human immunoglobulin V region phage libraries, or other procedures as known in the art and based on the disclosure herein. For example, fully human monoclonal antibodies may be obtained from transgenic mice that have been engineered to produce specific human antibodies in response to antigenic challenge. Methods for obtaining fully human antibodies from transgenic mice are described, for example, by Green et al., Nature Genet. 7:13, 1994; Lonberg et al., Nature 368:856, 1994; Taylor et al., Int. Immun. 6:579, 1994; U.S. Pat. No. 5,877,397; Bruggemann et al., 1997 Curr. Opin. Biotechnol. 8:455-58; Jakobovits et al., 1995 Ann. N.Y. Acad. Sci. 764:525-35. In this technique, elements of the human heavy and light chain locus are introduced into strains of mice derived from embryonic stem cell lines that contain targeted disruptions of the endogenous heavy chain and light chain loci (see also Bruggemann et al., Curr. Opin. Biotechnol. 8:455-58 (1997)). For example, human immunoglobulin transgenes may be mini-gene constructs, or transloci on yeast artificial chromosomes, which undergo B-cell-specific DNA rearrangement and hypermutation in the mouse lymphoid tissue. Fully human monoclonal antibodies may be obtained by immunizing the transgenic mice, which may then produce human antibodies specific for the antigen target or targets. Lymphoid cells of the immunized transgenic mice can be used to produce human antibody-secreting hybridomas according to the methods described herein.

Another method for generating human antibodies of the invention includes immortalizing human peripheral blood cells by EBV transformation. See, e.g., U.S. Pat. No. 4,464,456. Such an immortalized B-cell line (or lymphoblastoid cell line) producing an RPP that specifically binds to target or targets can be identified by immunodetection methods as provided herein, for example, an ELISA, and then isolated by standard cloning techniques. The stability of the lymphoblastoid cell line producing an RPP can be improved by fusing the transformed cell lines with a murine myeloma to produce a mouse-human hybrid cell line according to methods known in the art (see, e.g., Glasky et al., Hybridoma 8:377-89 (1989)). Still another method to generate human RPPs is in vitro immunization, which includes priming human splenic B-cells with antigen targets, followed by fusion of primed with a hetero-hybrid fusion partner. See, e.g., Boerner et al., 1991 J Immunol. 147:86-95.

In certain embodiments, B-cells that are producing a RPP are selected and the light chain and heavy chain variable regions are cloned from the B-cell according to molecular biology techniques known in the art (WO 92/02551; U.S. Pat. No. 5,627,052; Babcook et al., Proc. Natl. Acad. Sci. USA 93:7843-48 (1996)) and described herein. B-cells from an immunized animal may be isolated from the spleen, lymph node, or peripheral blood sample by selecting a cell that is producing an antibody that specifically binds to the antigen target. B-cells may also be isolated from humans, for example, from a peripheral blood sample.

Methods for detecting single B-cells that are producing an antibody with the desired specificity are well known in the art, for example, by plaque formation, fluorescence-activated cell sorting, in vitro stimulation followed by detection of specific antibody, and the like. Methods for selection of specific antibody-producing B-cells include, for example, preparing a single cell suspension of B-cells in soft agar that contains the antigen target. Binding of the specific antibodies produced by the B-cell to the antigen results in the formation of a complex, which may be visible as an immunoprecipitate.

In some embodiments, specific antibody-producing B-cells are selected by using a method that allows identification natively paired antibodies. For example, a method described in Adler et al., A natively paired antibody library yields drug leads with higher sensitivity and specificity than a randomly paired antibody library, MAbs (2018), which is incorporated by reference in its entirety herein, can be employed. The method combines microfluidic technology, molecular genomics, yeast single-chain variable fragment (scFv) display, fluorescence-activated cell sorting (FACS) and deep sequencing. In short, B cells can be isolated from immunized animals and then pooled. The B cells are encapsulated into droplets with oligo-dT beads and a lysis solution, and mRNA-bound beads are purified from the droplets, and then injected into a second emulsion with an OE-RT-PCR amplification mix that generates DNA amplicons that encode scFv with native pairing of heavy and light chain Ig. Libraries of natively paired amplicons are then electroporated into yeast for scFv display. FACS is used to identify high affinity scFv. Finally, deep antibody sequencing can be used to identify all clones in the pre- and post-sort scFv libraries.

After the B-cells producing the desired antibody are selected, the specific antibody genes may be cloned by isolating and amplifying DNA or mRNA according to methods known in the art and described herein.

The methods for obtaining antibodies of the invention can also adopt various phage display technologies known in the art. See, e.g., Winter et al., 1994 Annu. Rev. Immunol. 12:433-55; Burton et al., 1994 Adv. Immunol. 57:191-280. Human or murine immunoglobulin variable region gene combinatorial libraries may be created in phage vectors that can be screened to select Ig fragments (Fab, Fv, sFv, or multimers thereof) that bind specifically to the RPP or variant or fragment thereof. See, e.g., U.S. Pat. No. 5,223, 409; Huse et al., 1989 Science 246:1275-81; Sastry et al., Proc. Natl. Acad. Sci. USA 86:5728-32 (1989); Alting-Mees et al., Strategies in Molecular Biology 3:1-9 (1990); Kang et al., 1991 Proc. Natl. Acad. Sci. USA 88:4363-66; Hoogenboom et al., 1992 J. Molec. Biol. 227:381-388; Schlebusch et al., 1997 Hybridoma 16:47-52 and references cited therein. For example, a library containing a plurality of polynucleotide sequences encoding Ig variable region fragments may be inserted into the genome of a filamentous bacteriophage, such as M13 or a variant thereof, in frame with the sequence encoding a phage coat protein. A fusion protein may be a fusion of the coat protein with the light chain variable region domain and/or with the heavy chain variable region domain. According to certain embodiments, immunoglobulin Fab fragments may also be displayed on a phage particle (see, e.g., U.S. Pat. No. 5,698,426).

In one embodiment, in a hybridoma the variable regions of a gene expressing a monoclonal antibody of interest are amplified using nucleotide primers. These primers may be synthesized by one of ordinary skill in the art, or may be purchased from commercially available sources. (See, e.g., Stratagene (La Jolla, Calif.), which sells primers for mouse and human variable regions including, among others, primers for $V_{Ha}$, $V_{Hb}$, $V_{Hc}$, $V_{Hd}$, $C_{H1}$, $V_L$ and $C_L$ regions.) These primers may be used to amplify heavy or light chain variable regions, which may then be inserted into vectors such as ImmunoZAP™H or ImmunoZAP™L (Stratagene), respectively. These vectors may then be introduced into E. coli, yeast, or mammalian-based systems for expression. Large amounts of a single-chain protein containing a fusion of the $V_H$ and $V_L$ domains may be produced using these methods (see Bird et al., Science 242:423-426, 1988).

Once cells producing antibodies according to the invention have been obtained using any of the above-described immunization and other techniques, the specific antibody genes may be cloned by isolating and amplifying DNA or mRNA therefrom according to standard procedures as described herein. The antibodies produced therefrom may be sequenced and the CDRs identified and the DNA coding for the CDRs may be manipulated as described previously to generate other antibodies according to the invention.

RPP of the present invention preferably have activity in the cell-based assays described herein and/or the in vivo assay described herein and/or bind to one or more of the antigens described herein. Accordingly, such binding agents can be identified using the assays described herein.

Other antibodies according to the invention may be obtained by conventional immunization and cell fusion procedures as described herein and known in the art.

Molecular evolution of the complementarity determining regions (CDRs) in the center of the antibody binding site also has been used to isolate antibodies with increased affinity, for example, antibodies having increased affinity for c-erbB-2, as described by Schier et al., 1996, J. Mol. Biol. 263:551.

Human, partially human, or humanized antibodies are suitable for many applications, particularly those involving administration of the antibody to a human subject, other types of antigen binding proteins. The non-human antibodies of the invention can be, for example, derived from any antibody-producing animal, such as mouse, rat, rabbit, goat, donkey, or non-human primate (such as monkey (e.g., cynomologous or rhesus monkey) or ape (e.g., chimpanzee)). Non-human antibodies of the invention can be used, for example, in in vitro and cell-culture based applications, or any other application where an immune response to the antibody of the invention does not occur, is insignificant, can be prevented, is not a concern, or is desired. In one embodiment, a non-human antibody of the invention is administered to a non-human subject. In another embodiment, the non-human antibody does not elicit an immune response in the non-human subject. In another embodiment, the non-human antibody is from the same species as the non-human subject, e.g., a mouse antibody of the invention is administered to a mouse. An antibody from a particular species can be made by, for example, immunizing an animal of that species with the desired immunogen or using an artificial system for generating antibodies of that species (e.g., a bacterial or phage display-based system for generating antibodies of a particular species), or by converting an antibody from one species into an antibody from another species by replacing, e.g., the constant region of the antibody with a constant region from the other species, or by replacing one or more amino acid residues of the antibody so that it more closely resembles the sequence of an antibody from the other species. In one embodiment, the antibody is a chimeric antibody comprising amino acid sequences derived from antibodies from two or more different species.

ABPs may be prepared, and screened for desired properties, by any of a number of conventional techniques. Certain of the techniques involve isolating a nucleic acid encoding a polypeptide chain (or portion thereof) of an RPP of interest, and manipulating the nucleic acid through recombinant DNA technology. The nucleic acid may be fused to another nucleic acid of interest, or altered (e.g., by mutagenesis or other conventional techniques) to add, delete, or substitute one or more amino acid residues, for example. Furthermore, the antigen binding proteins may be purified from cells that naturally express them (e.g., an antibody can be purified from a hybridoma that produces it), or produced in recombinant expression systems, using any technique known in the art. See, for example, Monoclonal Antibodies, Hybridomas: A New Dimension in Biological Analyses, Kennet et al. (eds.), Plenum Press, New York (1980); and Antibodies: A Laboratory Manual, Harlow and Land (eds.), Cold Spring Harbor Laboratory Press, Cold Spring Harbor, N.Y., (1988).

Any expression system known in the art can be used to make the recombinant polypeptides of the invention. Expression systems are detailed comprehensively above. In general, host cells are transformed with a recombinant expression vector that comprises DNA encoding a desired polypeptide. Among the host cells that may be employed are prokaryotes, yeast or higher eukaryotic cells. Prokaryotes include gram negative or gram-positive organisms, for example E. coli or Bacilli. Higher eukaryotic cells include insect cells and established cell lines of mammalian origin. Examples of suitable mammalian host cell lines include the COS-7 line of monkey kidney cells (ATCC CRL 1651) (Gluzman et al., 1981, Cell 23:175), L cells, 293 cells, C127 cells, 3T3 cells (ATCC CCL 163), Chinese hamster ovary (CHO) cells, HeLa cells, BHK (ATCC CRL 10) cell lines, and the CVI/EBNA cell line derived from the African green monkey kidney cell line CVI (ATCC CCL 70) as described by McMahan et al., 1991, EMBO J. 10: 2821. Appropriate cloning and expression vectors for use with bacterial, fungal, yeast, and mammalian cellular hosts are described by Pouwels et al. (Cloning Vectors: A Laboratory Manual, Elsevier, New York, 1985).

Production cell lines for monoclonal antibodies (mAbs) are typically produced by randomly inserting expression constructs into a mammalian production cell genome, for example, a CHO genome (Rita Costa et al., 2010). However, this canonical method produces cell lines with multiple copies of mAb inserted into the CHO genome. If the polyclonal antibody construct libraries were randomly inserted into the CHO genome, many clones would express multiple antibodies, which would result in frequent non-native pairing between heavy and light chain Ig. Additionally, different genome locations have different transcriptional activity levels (Kito et al., 2002), which could result in heterogeneous, inconsistent and/or unstable bioproduction. Thus, in some aspects the current invention provides a CHO cell line with a Flp recombinase recognition target (FRT) landing pad stably engineered into the genome. Such site-directed genome integration cell lines are then used for stable expression of RPP.

It will be appreciated that an antibody of the present invention may have at least one amino acid substitution, providing that the antibody retains binding specificity. Therefore, modifications to the antibody structures are encompassed within the scope of the invention. These may include amino acid substitutions, which may be conservative or non-conservative that do not destroy the binding capability of an antibody comprising the RPP. Conservative amino acid substitutions may encompass non-naturally occurring amino acid residues, which are typically incorporated by chemical peptide synthesis rather than by synthesis in biological systems. These include peptidomimetics and other reversed or inverted forms of amino acid moieties. A conservative amino acid substitution may also involve a substitution of a native amino acid residue with a normative residue such that there is little or no effect on the polarity or charge of the amino acid residue at that position.

Non-conservative substitutions can involve the exchange of a member of one class of amino acids or amino acid mimetics for a member from another class with different physical properties (e.g. size, polarity, hydrophobicity, charge). Such substituted residues can be introduced into regions of the human antibody that are homologous with non-human antibodies, or into the non-homologous regions of the molecule.

Moreover, one skilled in the art may generate test variants containing a single amino acid substitution at each desired amino acid residue. The variants can then be screened using activity assays known to those skilled in the art. Such variants could be used to gather information about suitable variants. For example, if one discovered that a change to a particular amino acid residue resulted in destroyed, undesirably reduced, or unsuitable activity, variants with such a change may be avoided. In other words, based on information gathered from such routine experiments, one skilled in the art can readily determine the amino acids where further substitutions should be avoided either alone or in combination with other mutations.

A skilled artisan will be able to determine suitable variants of the polypeptide as set forth herein using well-known techniques. In certain embodiments, one skilled in the art may identify suitable areas of the molecule that may be changed without destroying activity by targeting regions not believed to be important for activity. In certain embodiments, one can identify residues and portions of the molecules that are conserved among similar polypeptides. In certain embodiments, even areas that may be important for biological activity or for structure may be subject to conservative amino acid substitutions without destroying the biological activity or without adversely affecting the polypeptide structure.

Additionally, one skilled in the art can review structure-function studies identifying residues in similar polypeptides that are important for activity or structure. In view of such a comparison, one can predict the importance of amino acid residues in a protein that correspond to amino acid residues which are important for activity or structure in similar proteins. One skilled in the art can opt for chemically similar amino acid substitutions for such predicted important amino acid residues.

One skilled in the art can also analyze the three-dimensional structure and amino acid sequence in relation to that structure in similar polypeptides. In view of such information, one skilled in the art may predict the alignment of amino acid residues of an antibody with respect to its three-dimensional structure. In certain embodiments, one skilled in the art can choose not to make radical changes to amino acid residues predicted to be on the surface of the protein, since such residues may be involved in important interactions with other molecules.

A number of scientific publications have been devoted to the prediction of secondary structure. See Moult J., Curr. Op. in Biotech., 7(4):422-427 (1996), Chou et al., Biochem., 13(2):222-245 (1974); Chou et al., Biochem., 113(2):211-222 (1974); Chou et al., Adv. Enzymol. Relat Areas Mol. Biol., 47:45-148 (1978); Chou et al., Ann. Rev. Biochem., 47:251-276 and Chou et al., Biophys. J., 26:367-384 (1979). Moreover, computer programs are currently available to assist with predicting secondary structure. One method of predicting secondary structure is based upon homology modeling. For example, two polypeptides or proteins which have a sequence identity of greater than 30%, or similarity greater than 40% often have similar structural topologies. The recent growth of the protein structural database (PDB) has provided enhanced predictability of secondary structure, including the potential number of folds within a polypeptide's or protein's structure. See Holm et al., Nucl. Acid. Res., 27(1):244-247 (1999). It has been suggested (Brenner et al., Curr. Op. Struct. Biol., 7(3):369-376 (1997)) that there are a limited number of folds in a given polypeptide or protein and that once a critical number of structures have been resolved, structural prediction will become dramatically more accurate.

Additional methods of predicting secondary structure include "threading" (Jones, D., Curr. Opin. Struct. Biol., 7(3):377-87 (1997); Sippl et al., Structure, 4(1):15-19 (1996)), "profile analysis" (Bowie et al., Science, 253:164-170 (1991); Gribskov et al., Meth. Enzym., 183:146-159 (1990); Gribskov et al., Proc. Nat. Acad. Sci., 84(13):4355-4358 (1987)), and "evolutionary linkage" (See Holm, supra (1999), and Brenner, supra (1997)).

In certain embodiments, variants of antibodies include glycosylation variants wherein the number and/or type of glycosylation site has been altered compared to the amino acid sequences of a parent polypeptide. In certain embodiments, variants comprise a greater or a lesser number of N-linked glycosylation sites than the native protein. An N-linked glycosylation site is characterized by the sequence: Asn-X-Ser or Asn-X-Thr, wherein the amino acid residue designated as X can be any amino acid residue except proline. The substitution of amino acid residues to create this sequence provides a potential new site for the addition of an N-linked carbohydrate chain. Alternatively, substitutions which eliminate this sequence will remove an existing N-linked carbohydrate chain. Also provided is a rearrangement of N-linked carbohydrate chains wherein one or more N-linked glycosylation sites (typically those that are naturally occurring) are eliminated and one or more new N-linked sites are created. Additional preferred antibody variants include cysteine variants wherein one or more cysteine residues are deleted from or substituted for another amino acid (e.g., serine) as compared to the parent amino acid sequence. Cysteine variants can be useful when antibodies must be refolded into a biologically active conformation such as after the isolation of insoluble inclusion bodies. Cysteine variants generally have fewer cysteine residues than the native protein, and typically have an even number to minimize interactions resulting from unpaired cysteines.

According to certain embodiments, preferred amino acid substitutions are those which: (1) reduce susceptibility to proteolysis, (2) reduce susceptibility to oxidation, (3) alter binding affinity for forming protein complexes, (4) alter binding affinities, and/or (4) confer or modify other physiochemical or functional properties on such polypeptides. According to certain embodiments, single or multiple amino acid substitutions (in certain embodiments, conservative amino acid substitutions) can be made in the naturally-occurring sequence (in certain embodiments, in the portion of the polypeptide outside the domain(s) forming intermolecular contacts). In certain embodiments, a conservative amino acid substitution typically may not substantially change the structural characteristics of the parent sequence (e.g., a replacement amino acid should not tend to break a helix that occurs in the parent sequence, or disrupt other types of secondary structure that characterizes the parent sequence). Examples of art-recognized polypeptide secondary and tertiary structures are described in Proteins, Structures and Molecular Principles (Creighton, Ed., W. H. Freeman and Company, New York (1984)); Introduction to Protein Structure (C. Branden and J. Tooze, eds., Garland Publishing, New York, N.Y. (1991)); and Thornton et al. Nature 354:105 (1991), which are each incorporated herein by reference.

In certain embodiments, ABPs of the invention can be chemically bonded with polymers, lipids, or other moieties.

The binding agents may comprise at least one of the CDRs described herein incorporated into a biocompatible framework structure. In one example, the biocompatible framework structure comprises a polypeptide or portion thereof that is sufficient to form a conformationally stable structural support, or framework, or scaffold, which is able to display one or more sequences of amino acids that bind to an antigen (e.g., CDRs, a variable region, etc.) in a localized surface region. Such structures can be a naturally occurring polypeptide or polypeptide "fold" (a structural motif), or can have one or more modifications, such as additions, deletions or substitutions of amino acids, relative to a naturally occurring polypeptide or fold. These scaffolds can be derived from a polypeptide of any species (or of more than one species), such as a human, other mammal, other vertebrate, invertebrate, plant, bacteria or virus.

Typically, the biocompatible framework structures are based on protein scaffolds or skeletons other than immunoglobulin domains. For example, those based on fibronectin, ankyrin, lipocalin, neocarzinostain, cytochrome b, CP1 zinc finger, PST1, coiled coil, LACI-D1, Z domain and tendamistat domains may be used (See e.g., Nygren and Uhlen, 1997, Curr. Opin. in Struct. Biol., 7, 463-469).

It will be appreciated that the ABPs of the invention include the humanized antibodies described herein. Humanized antibodies such as those described herein can be produced using techniques known to those skilled in the art (Zhang, W., et al., Molecular Immunology. 42(12): 1445-1451, 2005; Hwang W. et al., Methods. 36(1): 35-42, 2005; Dall'Acqua W F, et al., Methods 36(1): 43-60, 2005; and Clark, M., Immunology Today. 21(8): 397-402, 2000).

Where an antibody comprises one or more of CDR3-H, and/or CDR3-L as described in Table 5, it may be obtained by expression from a host cell containing DNA coding for these sequences. A DNA coding for each CDR sequence may be determined on the basis of the amino acid sequence of the CDR and synthesized together with any desired antibody variable region framework and constant region DNA sequences using oligonucleotide synthesis techniques, site-directed mutagenesis and polymerase chain reaction (PCR) techniques as appropriate. DNA coding for variable region frameworks and constant regions is widely available to those skilled in the art from genetic sequences databases such as GenBank®.

Once synthesized, the DNA encoding an antibody of the invention or fragment thereof may be propagated and expressed according to any of a variety of well-known procedures for nucleic acid excision, ligation, transformation, and transfection using any number of known expression vectors. Thus, in certain embodiments expression of an antibody fragment may be preferred in a prokaryotic host, such as *Escherichia coli* (see, e.g., Pluckthun et al., 1989 Methods Enzymol. 178:497-515). In certain other embodiments, expression of the antibody or a fragment thereof may be preferred in a eukaryotic host cell, including yeast (e.g., *Saccharomyces cerevisiae, Schizosaccharomyces pombe*, and *Pichia pastoris*), animal cells (including mammalian cells) or plant cells. Examples of suitable animal cells include, but are not limited to, myeloma (such as a mouse NSO line), COS, CHO, or hybridoma cells. Examples of plant cells include tobacco, corn, soybean, and rice cells.

Replicable expression vectors containing DNA encoding an antibody variable and/or constant region may be prepared and used to transform an appropriate cell line, for example, a non-producing myeloma cell line, such as a mouse NSO line or a bacteria, such as *E. coli*, in which production of the antibody will occur. In order to obtain efficient transcription and translation, the DNA sequence in each vector should include appropriate regulatory sequences, particularly a promoter and leader sequence operatively linked to the variable domain sequence. Particular methods for producing antibodies in this way are generally well-known and routinely used. For example, basic molecular biology procedures are described by Maniatis et al. (Molecular Cloning, A Laboratory Manual, 2nd ed., Cold Spring Harbor Laboratory, New York, 1989; see also Maniatis et al, 3rd ed., Cold Spring Harbor Laboratory, New York, (2001)). DNA sequencing can be performed as described in Sanger et al. (PNAS 74:5463, (1977)) and the Amersham International plc sequencing handbook, and site directed mutagenesis can be carried out according to methods known in the art (Kramer et al., Nucleic Acids Res. 12:9441, (1984); Kunkel Proc. Natl. Acad. Sci. USA 82:488-92 (1985); Kunkel et al., Methods in Enzymol. 154:367-82 (1987); the Anglian Biotechnology Ltd. handbook). Additionally, numerous publications describe techniques suitable for the preparation of antibodies by manipulation of DNA, creation of expression vectors, and transformation and culture of appropriate cells (Mountain A and Adair, J R in Biotechnology and Genetic Engineering Reviews (ed. Tombs, M P, 10, Chapter 1, 1992, Intercept, Andover, UK); "Current Protocols in Molecular Biology", 1999, F. M. Ausubel (ed.), Wiley Interscience, New York).

Where it is desired to improve the affinity of ABPs according to the invention containing one or more of the above-mentioned CDRs can be obtained by a number of affinity maturation protocols including maintaining the CDRs (Yang et al., J. Mol. Biol., 254, 392-403, 1995), chain shuffling (Marks et al., Bio/Technology, 10, 779-783, 1992), use of mutation strains of $E.$ $coli.$ (Low et al., J. Mol. Biol., 250, 350-368, 1996), DNA shuffling (Patten et al., Curr. Opin. Biotechnol., 8, 724-733, 1997), phage display (Thompson et al., J. Mol. Biol., 256, 7-88, 1996) and sexual PCR (Crameri, et al., Nature, 391, 288-291, 1998). All of these methods of affinity maturation are discussed by Vaughan et al. (Nature Biotech., 16, 535-539, 1998).

It will be understood by one skilled in the art that some proteins, such as antibodies, may undergo a variety of posttranslational modifications. The type and extent of these modifications often depends on the host cell line used to express the protein as well as the culture conditions. Such modifications may include variations in glycosylation, methionine oxidation, diketopiperizine formation, aspartate isomerization and asparagine deamidation. A frequent modification is the loss of a carboxy-terminal basic residue (such as lysine or arginine) due to the action of carboxypeptidases (as described in Harris, R. J. Journal of Chromatography 705:129-134, 1995).

Pharmaceutical Compositions

Pharmaceutical compositions containing one or more of the RPPs of the present disclosure are also provided. Such compositions comprise a therapeutically or prophylactically effective amount of the polypeptides or proteins in a mixture with pharmaceutically acceptable materials.

In some embodiments, the pharmaceutical composition comprises an RPP produced using sequences derived from immune cells of a donor exposed to one or more Zika (and/or Dengue virus) antigens. In some embodiments, the pharmaceutical composition comprises RPPs produced using sequences derived from immune cells of multiple donors exposed to one or more Zika (and/or Dengue virus) antigens. The donors can be a human, non-human animal (mouse, humanized mouse, rat, humanized rat, horse, or cow) or both.

In some embodiments, the pharmaceutical composition comprises a first RPP comprising a first ABPs, wherein each of the first ABPs specifically binds to a first antigen, and a second RPP comprising a second ABPs, wherein each of the second ABPs specifically binds to a second antigen. In some embodiments, the first antigen is an antigen of Zika (and/or Dengue virus). In some embodiments, the second antigen is a different antigen of Zika (and/or Dengue virus).

In some embodiments, the pharmaceutical composition comprises about 10, 100, 500, 1,000, 5,000, 10,000, 50,000 or more than 100,000 distinct ABPs, each having a unique sequence. In some embodiments, the pharmaceutical composition comprises at least 10, 100, 500, 1,000, 5,000, 10,000, 20,000, 30,000, 40,000, 50,000 or more than 100,000 distinct ABPs, each having a unique sequence.

The pharmaceutical composition may contain formulation materials for modifying, maintaining or preserving, for example, the pH, osmolarity, viscosity, clarity, color, isotonicity, odor, sterility, stability, rate of dissolution or release, adsorption or penetration of the composition.

Suitable formulation materials include, but are not limited to, amino acids (such as glycine, glutamine, asparagine, arginine or lysine); antimicrobials; antioxidants (such as ascorbic acid, sodium sulfite or sodium hydrogen-sulfite); buffers (such as borate, bicarbonate, Tris-HCl, citrates, phosphates, other organic acids); bulking agents (such as mannitol or glycine), chelating agents (such as ethylenediamine tetraacetic acid (EDTA)); complexing agents (such as caffeine, polyvinylpyrrolidone, beta-cyclodextrin or hydroxypropyl-beta-cyclodextrin); fillers; monosaccharides; disaccharides and other carbohydrates (such as glucose, mannose, or dextrins); proteins (such as serum albumin, gelatin or immunoglobulins); coloring; flavoring and diluting agents; emulsifying agents; hydrophilic polymers (such as polyvinylpyrrolidone); low molecular weight polypeptides; salt-forming counterions (such as sodium); preservatives (such as benzalkonium chloride, benzoic acid, salicylic acid, thimerosal, phenethyl alcohol, methylparaben, propylparaben, chlorhexidine, sorbic acid or hydrogen peroxide); solvents (such as glycerin, propylene glycol or polyethylene glycol); sugar alcohols (such as mannitol or sorbitol); suspending agents; surfactants or wetting agents (such as pluronics, PEG, sorbitan esters, polysorbates such as polysorbate 20, polysorbate 80, triton, tromethamine, lecithin, cholesterol, tyloxapal); stability enhancing agents (sucrose or sorbitol); tonicity enhancing agents (such as alkali metal halides (preferably sodium or potassium chloride, mannitol sorbitol); delivery vehicles; diluents; excipients and/or pharmaceutical adjuvants. Neutral buffered saline or saline mixed with conspecific serum albumin are examples of appropriate diluents. In accordance with appropriate industry standards, preservatives such as benzyl alcohol may also be added. The composition may be formulated as a lyophilizate using appropriate excipient solutions (e.g., sucrose) as diluents. Suitable components are nontoxic to recipients at the dosages and concentrations employed. Further examples of components that may be employed in pharmaceutical formulations are presented in Remington's Pharmaceutical Sciences, $16^{th}$ Ed. (1980) and $20^{th}$ Ed. (2000), Mack Publishing Company, Easton, Pa.

Optionally, the composition additionally comprises one or more physiologically active agents, for example, an antiviral agent, plasma IVIg, etc. In various embodiments, the composition comprises one, two, three, four, five, or six physiologically active agents in addition to an RPP.

In another embodiment of the invention, the compositions disclosed herein may be formulated in a neutral or salt form. Illustrative pharmaceutically-acceptable salts include the acid addition salts (formed with the free amino groups of the protein) and which are formed with inorganic acids such as, for example, hydrochloric or phosphoric acids, or such organic acids as acetic, oxalic, tartaric, mandelic, and the like. Salts formed with the free carboxyl groups can also be derived from inorganic bases such as, for example, sodium, potassium, ammonium, calcium, or ferric hydroxides, and such organic bases as isopropylamine, trimethylamine, histidine, procaine and the like. Upon formulation, solutions will be administered in a manner compatible with the dosage formulation and in such amount as is therapeutically effective.

The carriers can further comprise any and all solvents, dispersion media, vehicles, coatings, diluents, antibacterial and antifungal agents, isotonic and absorption delaying agents, buffers, carrier solutions, suspensions, colloids, and the like. The use of such media and agents for pharmaceutical active substances is well known in the art. Except insofar as any conventional media or agent is incompatible with the active ingredient, its use in the therapeutic compositions is contemplated. Supplementary active ingredients can also be incorporated into the compositions. The phrase "pharmaceutically-acceptable" refers to molecular entities and compositions that do not produce an allergic or similar untoward reaction when administered to a human.

The optimal pharmaceutical composition will be determined by one skilled in the art depending upon, for example, the intended route of administration, delivery format, and desired dosage. See for example, Remington's Pharmaceutical Sciences, supra. Such compositions may influence the physical state, stability, rate of in vivo release, and rate of in vivo clearance of the polypeptide. For example, suitable compositions may be water for injection, physiological saline solution for parenteral administration.

Content of Pharmaceutically Active Ingredient

In typical embodiments, the active ingredient (i.e., the proteins and polypeptides of the present invention) is present in the pharmaceutical composition at a concentration of at least 0.01 mg/ml, at least 0.1 mg/ml, at least 0.5 mg/ml, or at least 1 mg/ml. In certain embodiments, the active ingredient is present in the pharmaceutical composition at a concentration of at least 1 mg/ml, 2 mg/ml, 3 mg/ml, 4 mg/ml, 5 mg/ml, 10 mg/ml, 15 mg/ml, 20 mg/ml, or 25 mg/ml. In certain embodiments, the active ingredient is present in the pharmaceutical composition at a concentration of at least 30 mg/ml, 35 mg/ml, 40 mg/ml, 45 mg/ml or 50 mg/ml. In certain embodiments, the active ingredient is present in the pharmaceutical composition at a concentration of at least 100 mg/ml, 250 mg/ml, 500 mg/ml, 750 mg/ml, 1 g/ml, 5 g/ml, 10 g/ml, or 50 g/ml.

Formulation Generally

The pharmaceutical composition can be in any form appropriate for human or veterinary medicine, including a liquid, an oil, an emulsion, a gel, a colloid, an aerosol or a solid.

The pharmaceutical composition can be formulated for administration by any route of administration appropriate for human or veterinary medicine, including enteral and parenteral routes of administration.

In some embodiments, the pharmaceutical composition is formulated for intravenous, intraperitoneal, intramuscular, or subcutaneous administration. In some embodiments, the pharmaceutical composition is formulated for intravenous injection or intravenous infusion.

In some embodiments, the pharmaceutical composition is formulated for intrathecal or intracerebroventricular administration.

In some embodiments, the pharmaceutical composition is formulated for topical administration.

Pharmacological Compositions Adapted for Injection

For intravenous, cutaneous or subcutaneous injection, or injection at the site of affliction, the active ingredient will be in the form of a parenterally acceptable aqueous solution which is pyrogen-free and has suitable pH, isotonicity and stability. Those of relevant skill in the art are well able to prepare suitable solutions using, for example, isotonic vehicles such as Sodium Chloride Injection, Ringer's Injection, Lactated Ringer's Injection. Preservatives, stabilizers, buffers, antioxidants and/or other additives can be included, as required.

In various embodiments, the unit dosage form is a vial, ampule, bottle, or pre-filled syringe. In some embodiments, the unit dosage form contains 0.01 mg, 0.1 mg, 0.5 mg, 1 mg, 2.5 mg, 5 mg, 10 mg, 12.5 mg, 25 mg, 50 mg, 75 mg, or 100 mg of the active ingredient. In some embodiments, the unit dosage form contains 125 mg, 150 mg, 175 mg, or 200 mg of the active ingredient. In some embodiments, the unit dosage form contains at least 250 mg, 1 g, 10 g, 20 g, 30 g, 40 g, 50 g, 60 g, 70 g, 80 g, 90 g, or 100 g of the active ingredient. In some embodiments, the unit dosage form contains about 250 mg, 1 g, 10 g, 20 g, 30 g, 40 g, 50 g, 60 g, 70 g, 80 g, 90 g, or 100 g of the active ingredient.

In typical embodiments, the pharmaceutical composition in the unit dosage form is in liquid form. In various embodiments, the unit dosage form contains between 0.1 mL and 50 ml of the active ingredient. In some embodiments, the unit dosage form contains 1 ml, 2.5 ml, 5 ml, 7.5 ml, 10 ml, 25 ml, or 50 ml of active ingredient.

In particular embodiments, the unit dosage form is a vial containing 1 ml of the pharmaceutical composition containing an active ingredient (e.g., RPP) at a concentration of 0.01 mg/ml, 0.1 mg/ml, 0.5 mg/ml, or 1 mg/ml. In particular embodiments, the unit dosage form is a vial containing 1 ml of the pharmaceutical composition containing an active ingredient (e.g., RPP) at a concentration of 0.01 mg/ml, 0.1 mg/ml, 0.5 mg/ml, 1 mg/ml, 2 mg/ml, 3 mg/ml, 4 mg/ml, 5 mg/ml, 10 mg/ml, 15 mg/ml, 20 mg/ml, 25 mg/ml, 30 mg/ml, 35 mg/ml, 40 mg/ml, 45 mg/ml or 50 mg/ml, 100 mg/ml, 250 mg/ml, 500 mg/ml, 750 mg/ml, 1 g/ml, 5 g/ml, 10 g/ml, or 50 g/ml. In some embodiments, the unit dosage form is a vial containing 2 ml of the pharmaceutical composition containing an active ingredient at a concentration of 0.01 mg/ml, 0.1 mg/ml, 0.5 mg/ml, 1 mg/ml, 2 mg/ml, 3 mg/ml, 4 mg/ml, 5 mg/ml, 10 mg/ml, 15 mg/ml, 20 mg/ml, 25 mg/ml, 30 mg/ml, 35 mg/ml, 40 mg/ml, 45 mg/ml or 50 mg/ml, 100 mg/ml, 250 mg/ml, 500 mg/ml, 750 mg/ml, 1 g/ml, 5 g/ml, 10 g/ml, or 50 g/ml.

In some embodiments, the pharmaceutical composition is formulated for injection of an active ingredient at a single dose or multiple doses of between 0.010 and 5 g/kg body weight. In some embodiments, the pharmaceutical composition is formulated for injection of an active ingredient at a single dose of 0.010 g/kg body weight. In some embodiments, the pharmaceutical composition is formulated for injection at a single dose of 0.01, 0.05, 0.15, 0.20, 0.25, 0.30, 0.35, 0.40, 0.45, 0.50, 0.55, 0.60, 0.65, 0.70, 0.75, 0.80, 0.85, 0.90, 0.95, or 0.1 g/kg body weight.

In some embodiments, the unit dose contains at least 0.1 g, 0.5 g, 1 g, 1.5 g, 2 g, 2.5 g, 3 g, 3.5 g, 4 g, 5 g, 10 g, 20 g, 30 g, 40 g, or 50 g of the active ingredient (e.g., RPP). In some embodiments, the unit dose contains about 0.1 g, 0.5 g, 1 g, 1.5 g, 2 g, 2.5 g, 3 g, 3.5 g, 4 g, 5 g, 10 g, 20 g, 30 g, 40 g, or 50 g of the active ingredient (e.g., RPP).

The amount of active ingredient which can be combined with a carrier material to produce a single dosage form will generally be that amount of the compound which produces a therapeutic effect.

The pharmaceutical compositions may conveniently be presented in unit dosage form.

The unit dosage form will typically be adapted to one or more specific routes of administration of the pharmaceutical composition.

In some embodiments, the pharmaceutical composition in the unit dosage form is in solid form, such as a lyophilate, suitable for solubilization.

In some embodiments, the unit dosage form is suitable for subcutaneous, intradermal, or intramuscular administration include preloaded syringes, auto-injectors, and auto-inject pens, each containing a predetermined amount of the pharmaceutical composition described hereinabove.

In various embodiments, the unit dosage form is a preloaded syringe, comprising a syringe and a predetermined amount of the pharmaceutical composition. In certain preloaded syringe embodiments, the syringe is adapted for subcutaneous administration. In certain embodiments, the syringe is suitable for self-administration. In particular embodiments, the preloaded syringe is a single use syringe.

In certain embodiments, the unit dosage form is an auto-inject pen. The auto-inject pen comprises an auto-inject pen containing a pharmaceutical composition as described herein. In some embodiments, the auto-inject pen delivers a predetermined volume of pharmaceutical composition. In other embodiments, the auto-inject pen is configured to deliver a volume of pharmaceutical composition set by the user.

7.1.1. Mixtures of Plasma IVIg with Recombinant Hyperimmunes

In some embodiments, a recombinant hyperimmune is spiked into conventional plasma IVIg to increase the antipathogen titer of IVIg. In some embodiments, several antipathogen recombinant hyperimmunes are spiked into conventional plasma IVIg. Any number of spike-ins can be mixed with plasma IVIg to generate increased titers against any number of pathogens.

In some embodiments, the spike-in recombinant hyperimmunes are mixed with plasma IVIg by the pharmacist. In some embodiments, the spike-in recombinant hyperimmunes are mixed with plasma IVIg by the manufacturer.

Methods of Treating a Disease Responsive to an RPP

In another aspect, methods are presented for treating a subject having a disease responsive to an RPP. The disease can be a viral infection, e.g., Zika virus or Dengue virus. In some embodiments, the method comprises administering the pharmaceutical composition, the RPP disclosed herein to a patient infected with Zika virus, Dengue virus, or other related viral infection.

In vivo and/or in vitro assays may optionally be employed to help identify optimal dosage ranges. The precise dose to be employed in the formulation will also depend on the route of administration, and the seriousness of the condition, and should be decided according to the judgment of the practitioner and each subject's circumstances. Effective doses may be extrapolated from dose-response curves derived from in vitro or animal model test systems.

The actual amount administered, and rate and time-course of administration, will depend on the nature and severity of disease being treated. Prescription of treatment, e.g. decisions on dosage etc., is within the responsibility of general practitioners and other medical doctors, and typically takes account of the disorder to be treated, the condition of the individual patient, the site of delivery, the method of administration and other factors known to practitioners. Examples of the techniques and protocols mentioned above can be found in Remington's Pharmaceutical Sciences, 16th edition, Osol, A. (ed), 1980.

In some embodiments, the pharmaceutical composition is administered by injection, infusion, or by topical application. In some embodiments, the pharmaceutical composition is administered by intravenous infusion.

In some embodiments, the pharmaceutical composition is administered at a dose of 0.01, 0.05, 0.15, 0.20, 0.25, 0.30, 0.35, 0.40, 0.45, 0.50, 0.55, 0.60, 0.65, 0.70, 0.75, 0.80, 0.85, 0.90, 0.95, or 0.1 g active ingredient (RPP)/kg body weight.

In some embodiments, the pharmaceutical composition is administered at a dose of about 0.01, 0.05, 0.15, 0.20, 0.25, 0.30, 0.35, 0.40, 0.45, 0.50, 0.55, 0.60, 0.65, 0.70, 0.75, 0.80, 0.85, 0.90, 0.95, or 0.1 g active ingredient (RPP)/kg body weight. In some embodiments, the pharmaceutical composition is administered at a dose of more than 0.01, 0.05, 0.15, 0.20, 0.25, 0.30, 0.35, 0.40, 0.45, 0.50, 0.55, 0.60, 0.65, 0.70, 0.75, 0.80, 0.85, 0.90, 0.95, or 0.1 g active ingredient (RPP)/kg body weight.

In some embodiments, the pharmaceutical composition is administered once a day, 2-4 times a day, 2-4 times a week, once a week, or once every two weeks.

In some embodiments, the pharmaceutical composition is administered once, twice, three times, four times, five times, or more. In some embodiments, the pharmaceutical composition is administered once a day for one, two, three, four, five, or more days. In some embodiments, the pharmaceutical composition is administered until the desired outcome is observed.

In some embodiments, the pharmaceutical composition is administered with plasma IVIg.

In some embodiments, the method further comprises administering one or more additional therapeutic agents. In some embodiments, the additional therapeutic agent is an immune stimulatory or suppressive agent.

In some embodiments, the RPP is administered in an amount sufficient as prophylaxis against infectious disease when administered to a subject. In some embodiments, the RPP is administered in an amount sufficient to clear infectious disease in an individual actively fighting infection.

8. EXAMPLES

Below are examples of specific embodiments for carrying out the present invention. The examples are offered for illustrative purposes only, and are not intended to limit the scope of the present invention in any way. Efforts have been made to ensure accuracy with respect to numbers used (e.g., amounts, temperatures, etc.), but some experimental error and deviation should, of course, be allowed for.

The practice of the present invention will employ, unless otherwise indicated, conventional methods of protein chemistry, biochemistry, recombinant DNA techniques and pharmacology, within the skill of the art. Such techniques are explained fully in the literature. See, e.g., T. E. Creighton, Proteins: Structures and Molecular Properties (W. H. Freeman and Company, 1993); A. L. Lehninger, Biochemistry (Worth Publishers, Inc., current addition); Sambrook, et al., Molecular Cloning: A Laboratory Manual (2nd Edition, 1989); Methods In Enzymology (S. Colowick and N. Kaplan eds., Academic Press, Inc.); Remington's Pharmaceutical Sciences, 18th Edition (Easton, Pa.: Mack Publishing Company, 1990); Carey and Sundberg Advanced Organic Chemistry 3rd Ed. (Plenum Press) Vols A and B(1992).

Example 1: Generation of rCIG Using Immunized Mice

Two RPPs targeting COVID-19 were produced, one selected for binding to the SARS-CoV-2 receptor binding domain (RBD) and the other for binding to the SARS-CoV-2 spike 51 protein, using Trianni immunized mice as the donors. The heavy and light chain CDR3 sequences are provided in Table 5 above.

First, transgenic mice carrying inserted human immunoglobulin genes were immunized with a protocol comprising adjuvant, RBD, and inactivated SARS-CoV-2 virus. Footpad injections were performed on two Trianni Mice twice weekly for four weeks. Before the final boosts, the serum titer of thymocyte antibodies was assessed by flow cytometry, using a dilution series of RBD and Spike 51 antigen. A strong serum response was observed in the animals, with one animal showing a slightly stronger response. Lymph nodes (popliteal, inguinal, axillary, and mesenteric) were surgically removed after sacrifice. Single cell suspensions for each animal were made by manual disruption followed by passage through a 70 μm filter. Next, the EasySep™ Mouse Pan-B Cell Isolation Kit (Stemcell Technologies) negative selection kit was used to isolate B cells from each sample. The lymph node B cell populations were quantified by counting on a C-Chip hemocytometer (Incyto) and assessed for viability using Trypan blue. The cells were then diluted to 5,000-6,000 cells/mL in phosphate-buffered saline (PBS) with 12% OptiPrep™ Density Gradient Medium (Sigma). This cell mixture was used for microfluidic encapsulation. Approximately one million B cells from each of the six animals were run through an emulsion droplet microfluidics platform.

A DNA library encoding scFv from RNA of single cells, with native heavy-light Ig pairing intact, was generated using the emulsion droplet microfluidics platform or vortex emulsions. The method for generating the DNA library comprises the steps of 1) poly(A)+mRNA capture, 2) multiplexed overlap extension reverse transcriptase polymerase chain reaction (OE-RT-PCR), and 3) nested PCR to remove artifacts and add adapters for deep sequencing or yeast display libraries. The scFv libraries are generated from approximately one million B cells from each animal that achieved a positive titer.

For poly(A)+mRNA capture, a custom designed co-flow emulsion droplet microfluidic chip fabricated from glass (Dolomite) was used. The microfluidic chip has two input channels for fluorocarbon oil (Dolomite), one input channel for the cell suspension mix described above, and one input channel for oligo-dT beads (NEB) at 1.25 mg/ml in cell lysis buffer (20 mM Tris pH 7.5, 0.5 M NaCl, 1 mM ethylenediaminetetraacetic acid (EDTA), 0.5% Tween-20, and 20 mM dithiothreitol). The input channels are etched to 50 μm by 150 μm for most of the chip's length, narrow to 55 μm at the droplet junction, and were coated with hydrophobic Pico-Glide (Dolomite). Three Mitos P-Pump pressure pumps (Dolomite) were used to pump the liquids through the chip. Droplet size depends on pressure, but typically droplets of ~45 μm diameter were optimally stable. Emulsions were collected into chilled 2 ml microcentrifuge tubes and incubated at 40° C. for 15 minutes for mRNA capture. The beads were extracted from the droplets using Pico-Break (Dolomite). In some embodiments, similar single cell partitioning emulsions are made using a vortex.

For multiplex OE-RT-PCR, glass Telos droplet emulsion microfluidic chips were used (Dolomite). mRNA-bound beads were re-suspended into OE-RT-PCR mix and injected into the microfluidic chips with a mineral oil-based surfactant mix (available commercially from GigaGen) at pressures that generate 27 μm droplets. The OE-RT-PCR mix contains 2x one-step RT-PCR buffer, 2.0 mM $MgSO_4$, SuperScript III reverse transcriptase, and Platinum Taq (Thermo Fisher Scientific), plus a mixture of primers directed against the IgK C region, the IgG C region, and all V regions. The overlap region is a DNA sequence that encodes a Gly-Ser rich scFv linker sequence. The DNA fragments were recovered from the droplets using a droplet breaking solution (available commercially from GigaGen) and then purified using QIAquick PCR Purification Kit (Qiagen). In some embodiments, similar OE-RT-PCR emulsions were made using a vortex.

For nested PCR, the purified OE-RT-PCR product was first run on a 1.7% agarose gel for 80 minutes at 150 V. A band at 1200-1500 base pair (bp) corresponding to the linked product was excised and purified using NucleoSpin Gel and PCR Clean-up Kit (Macherey Nagel). PCR was then performed to add adapters for Illumina sequencing or yeast display; for sequencing, a randomer of seven nucleotides is added to increase base calling accuracy in subsequent next generation sequencing steps. Nested PCR was performed with 2× NEBNext High-Fidelity amplification mix (NEB) with either Illumina adapter containing primers or primers for cloning into the yeast expression vector. The nested PCR product was run on a 1.2% agarose gel for 50 minutes at 150V. A band at 800-1100 bp was excised and purified using NucleoSpin Gel and PCR Clean-up Kit (Macherey Nagel).

The OE-RT-PCR products were used as template in a nested PCR to add adapters for yeast surface display. *S. cerevisiae* cells (ATCC) were electroporated (Bio-Rad Gene Pulser II; 0.54 kV, 25 uF, infinite resistance) with the PCR product combined with a linearized vector for in vivo homologous recombination and inducible expression of scFv protein. Transformed yeast were expanded, induced with galactose, and approximately $2 \times 10^6$ induced yeast cells were stained with anti-c-Myc (Thermo Fisher Scientific) followed by a FITC-conjugated secondary antibody (Thermo Fisher Scientific), and biotinylated SARS CoV-2 RBD or Spike (1200 nM final concentration) followed by APC-streptavidin (Thermo Fisher Scientific); an scFv library specific for an unrelated target was used as a negative control. Yeast cells were then sorted (BD Influx) and 20-30× $10^3$ double-positive cells (FITC/APC+) were recovered. For further specificity, a second round of sorting using the same antigen was performed and $50 \times 10^3$ double-positive yeast was recovered.

The flow-sorted scFv were then subjected to sequencing (Illumina). Sequences identified using yeast scFv sorting with SARS-CoV-2 RBD are listed as Sequences 5083 through 6630, and sequences identified using yeast scFv sorting with SARS-CoV-2 Spike S1 are listed as Sequences 6631 through 8390. In some embodiments, sequences comprising Sequences 5083 through 8390 are used to generate an RPPs with binding and neutralization activity against SARS-CoV-2.

In certain embodiments, rCIG is an RPP comprising antibodies derived from one, two, four, eight, twelve, 50, or 100 mice. In certain embodiments, rCIG is an RPP comprising, 10, 100, 1,000, 10,000, 100,000, or more than 100,000 distinct antibody sequences. In certain embodiments, rCIG is an RPP comprising antibodies at various molar ratios, or antibodies comprising substantially similar molar ratios. In certain embodiments, these RPPs comprise therapeutics for COVID-19. In other embodiments, any single antibody from the RPP is used as a therapeutic for COVID-19. In certain embodiments, any single antibody or RPP is used as a therapeutic for any kind of coronavirus infection in human patients.

Example 2: Generation of RPP with Activity Against SARS CoV-2 from Convalescent COVID-19 Human Donors

Overview

Multiple rCIG (recombinant anti-coronavirus 19 hyperimmune gammaglobulin), i.e., RPP antibody pools with activity against COVID-19 antigens, were generated using B cells from convalescent COVID-19 donors. The sequence identifiers of the heavy and light chain CDR3 sequences are provided in Table 5, above, corresponding the sequences found in the sequence listing.

The rCIG drug is a fully recombinant IgG1/IgK polyclonal antibody preparation, comprising >1,000 unique antibody sequences at various ratios. The antibody sequences were derived from COVID-19 convalescent human donor peripheral blood mononuclear cells (PBMCs).

First, COVID-19 patients underwent IRB-approved consent at clinical sites, and approximately 50 mL of blood from each donor was obtained. Each sample was assessed for residual SARS CoV-2 using CDC qPCR assays. Additionally, each serum sample was tested for seroconversion using anti-SARS CoV-2 ELISA. The 16 high-titer convalescent COVID-19 donors were selected and custom microfluidics was used to capture natively paired antibody sequences from millions of donor B cells. The captured, natively paired, nucleic acid sequences were then expressed as yeast scFv libraries, and subjected to flow cytometry to enrich for binders against SARS CoV-2 RBD. Antibody nucleic acid sequences were purified from the sorted yeast clones and then engineered into full-length IgG1 antibody expression constructs, still retaining native pairing between heavy and light chain Ig.

The flow-sorted scFv were subjected to sequencing (Illumina). Sequences identified using yeast scFv sorting with SARS-CoV-2 RBD are listed as Sequences 1 through 4760, and sequences identified using yeast scFv sorting with SARS-CoV-2 Spike S1 are listed as Sequences 4761 through 5082. In some embodiments, sequences comprising Sequences 1 through 5082 are used to generate an RPPs with binding and neutralization activity against SARS-CoV-2. In some embodiments, single antibodies comprising Sequences 1 through 5082 are used as a therapeutic for COVID-19, or any coronavirus infection in patients.

To convert the scFv libraries into full-length CHO expression libraries (RPPs), nested outer PCR primers were used to add adapters with overhangs for Gibson assembly to the 5' and 3' ends of the scFv library. Then NEBuilder HiFi DNA Assembly Master Mix (NEB, Ipswich, Mass., USA) was used to insert the scFv library into a vector containing a single promoter, a secretory leader sequence for light chain Ig and the remainder of the IgG1 constant region, creating a cloned scFv library. This intermediate library was transformed into $E.\ coli$, spread onto LB-ampicillin plates, 0.5-1 million colonies were scraped and pooled for a plasmid purification using ZymoPURE II Plasmid Maxiprep Kits (Zymo Research, Irvine, Calif., USA). To create the full-length antibody library, a second Gibson assembly was performed by linearizing the product of GA1 with BamHI-HF (NEB, Ipswich, Mass., USA) and using it as a vector to insert a synthetic amplicon containing a portion of the light chain Ig constant region, a poly(A) signal for light chain Ig, a promoter for the IgG gene and a secretory leader sequence for the IgG gene. The full-length library was then transformed into $E.\ coli$ and spread on LB-ampicillin plates Over 0.5 million colonies are scraped and plasmid is purified with a ZymoPURE II Plasmid Maxiprep Kits (Zymo Research) to make the full-length recombinant hyperimmune maxiprep library for transfection.

The adherent Flp-In™-CHO cell line was adapted with a genomically integrated FRT site (Thermo Fisher Scientific, Waltham, Mass., USA) to suspension culture. For all steps in the adaptation process, "Ham's F-12" refers to Ham's F-12 (with L-glutamine, Thermo Fisher Scientific, Waltham, Mass., USA) plus 10% FBS (Thermo Fisher Scientific, Waltham, Mass., USA) and "BalanCD" refers to BalanCD CHO Growth A (Irvine Scientific) with 4 mM Glutamax (Thermo Fisher Scientific, Waltham, Mass., USA). To adapt this cell line to suspension, the cells were first passaged into a mixture of 50% Ham's F-12 plus 50% BalanCD in T-flasks. Cells were next passaged into 25% Ham's F-12 plus 75% BalanCD and switched to shaking Erlenmeyer flasks. Cells were then passaged into 10% Ham's F-12, 90% BalanCD+0.2% anti-clumping agent (Irvine Scientific, Santa Ana, Calif., USA) and banked for future use.

100 million of the adapted Flp-In CHO cells were transfected per recombinant hyperimmune library using an Amaxa Nucleofector 4D (SG buffer, pulse DU133; Lonza, Basel, Switzerland). These cells were plated into shaking Erlenmeyer flasks and recovered in an incubator at 37° C. and 125 rpm for 48 hours. After 48 hours, the cells were counted to determine viability, cells were seeded at 1 million cells/mL, and selection was started using 600 µg/mL Hygromycin-B (Gemini Bio, West Sacramento, Calif., USA) in fresh media. Cells were counted and media was changed every 2-3 days during the 7-day selection. The libraries were kept on 600 µg/mL Hygromycin-B (Gemini Bio, West Sacramento, Calif., USA) during expansion until viability exceeded 95%. When cells were >95% viable and doubling every 24 hours, the cell line was banked for liquid nitrogen storage.

CHO cells stably expressing antibody libraries were grown in media consisting of 90% BalanCD CHO Growth A Medium (Irvine Scientific, Santa Ana, Calif.), 9% Ham's F-12 (Thermo Fisher Scientific, Waltham, Mass., USA), 1% FBS (ThermoFisher Scientific), 4 mM Glutamax (Thermo Fisher Scientific, Waltham, Mass., USA), 0.2% anti-clumping agent (Irvine Scientific, Santa Ana, Calif., USA). For small-scale production, cells were seeded at $1\times10^6$ cells/mL into 50 mL media in a 250 mL Erlenmeyer flask and grown at 37° C., 5% $CO_2$, 125 rpm. Cells were continually grown under these conditions and supplemented with 7.5 mL CHO Feed 1 (Irvine Scientific, Santa Ana, Calif., USA) on days 2, 4 and 7 of the production run. Supernatant was harvested on Day 8 by centrifugation followed by filtration through a 0.22 µm 250 mL filter bottle (EMD Millipore, Burlington, Mass., USA) with 1 µm pre-filter (EMD Millipore, Burlington, Mass., USA). Harvested cell culture fluid (HCCF) was stored at 4° C. until Protein A purification. For large-scale production of the plasma cell recombinant hyperimmune, cells were grown in the same media but with some modifications to the production conditions. A seed train was used to scale the cultures from $2\times10^7$ cells to $1.2\times10^{10}$ cells at 37° C. Cells were then seeded at $1\times10^6$ cells/mL in 2 L in a 5 L flask (in triplicate; Day 0). On Day 2 the temperature was shifted from 37° C. to 33° C. Each flask was fed with 300 mL CHO Feed 1 (Irvine Scientific, Santa Ana, Calif., USA) on days 2, 4, 6, 8, 10, and 13 of the culture. Supernatant was harvested on Day 14.

After harvest, HCCF was purified with MabSelect SuRe Protein A resin (GE Life Sciences, Marlborough, Mass., USA) using the following buffers: Equilibration, Chase, Wash 2 (25 mM Tris, 150 mM NaCl, pH 7.4), Wash 1 (25 mM Tris, 1 M NaCl, pH 7.4), Elution (20 mM citric acid, pH 3.0), Neutralization (100 mM Tris, pH 8.0 for small scale, 1 M Tris, pH 9.0 for large scale). The column was sanitized before and after use with 0.1 N NaOH. For the large-scale production of the plasma cell recombinant hyperimmune, an additional Wash 3 consisting of 0.5 M arginine, pH 7.4 was used, followed by an additional wash with Wash 2 before elution. The order of purification steps was: Equilibration, Load, Chase, Wash 1, Wash 2, (large scale: Wash 3, Wash 2), Elution, Neutralization (added manually into tubes used for collection of eluate fractions). The recombinant hyperimmunes (RPPs) were concentrated using Vivaspin 20, 30 kDa molecular weight cut off spin concentrators (Sartorius, Gottingen, Germany) and formulated in PBS (small-scale productions) or 0.2 M glycine, pH 4.5 (large scale production), followed by 0.22 µm filtration.

This processed resulted in integration of a single heavy-light chain-paired transgene into the genomic FRT site of individual CHO cells, creating cell pools, or "research cell banks" (RCBs). In certain embodiments, these RCBs are combined to create a CHO polyclonal master cell bank (MCB).

In certain embodiments, rCIG is an RPP comprising antibodies derived from one, two, four, eight, twelve, 50, or 100 human donors. In certain embodiments, rCIG is an RPP comprising, 10, 100, 1,000, 10,000, 100,000, or more than 100,000 distinct antibody sequences. In certain embodiments, rCIG is an RPP comprising antibodies at various molar ratios, or antibodies comprising substantially similar molar ratios. In certain embodiments, these RPPs comprise therapeutics for COVID-19. In other embodiments, any single antibody from the RPP is used as a therapeutic for COVID-19. In certain embodiments, any single antibody or RPP is used as a therapeutic for any kind of coronavirus infection in human patients.

Upstream GMP manufacturing is carried out using this MCB and standard GMP protocols in single-use fed-batch bioreactors. The rCIG protein is purified with Protein A resin and standard downstream recombinant antibody processing steps, including anion and cation exchange, viral inactivation and filtration, and diafiltration/ultrafiltration (DF/UF). Viral clearance studies and full MCB characterization are performed. A plasma-derived IVIG is used as a reference control for protein quality assessment. Plasma-derived IVIG is the best available reference control, since it comprises a diverse set of antibodies, like rCIG, and serves as a baseline for an immunoglobulin that is not highly reactive against SARS CoV-2. Lot release assays include a battery of assays typically used to assess purity, such as SEC HPLC, CE-SDS, host cell protein, and potency, such as anti-SARS CoV-2 ELISA. Anti-SARS CoV-2 ELISA, SEC HPLC, and CD-SDS is used to infer identity.

Quantitative PCR (qPCR) is used to confirm the absence of SARS CoV-2 RNA present in donor PBMCs.

Host Cell Line Development

A large-scale screen was performed to identify a parental host cell clone for targeted integration of rCIG expression construct libraries.

Figure 1:
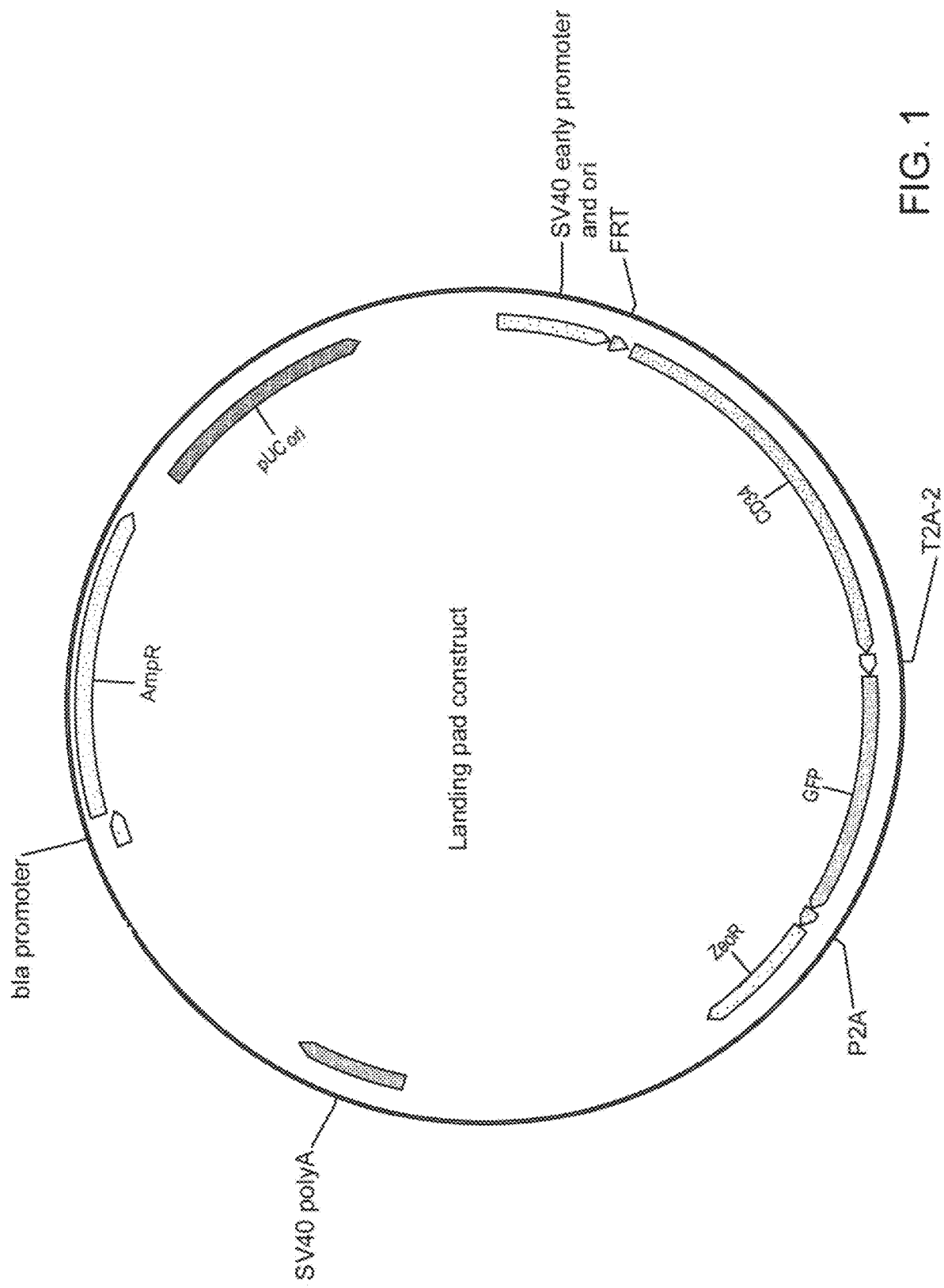

First, a landing pad construct (PMD-4681) was designed and synthesized. PMD-4681 was based on pFRT-lacZeo (ThermoFisher), with some modifications (FIG. 1). In place of the LacZ expression construct a cassette was inserted coding for expression of CD34 and GFP. The CD34, GFP, and downstream Zeocin resistance genes (ZeoR present in original plasmid) were separated by 2A motifs (T2A-2 or P2A) to allow for translation of three separate polypeptide chains. The CD34 sequence was sourced as a gBlock from IDT. The GFP sequence was sourced from ATUM (DasherGFP).

The GMP suspension CHO line CHOZN® GS−/− was obtained from Sigma Aldrich. Cells were sent to Bionova Scientific (Fremont, Calif.) to generate a working cell bank (WCB). A vial of cells from the WCB was thawed from LN2 and expanded. PMD-4681 was linearized using a restriction enzyme and purified via ethanol precipitation. Cells were then transfected with the FRT-GFP-Zeocin landing pad by random integration using Lonza's Nucleofector™ 4D, SE kit. Cells recovered overnight in an incubator and were plated the next day into minipools at 5,000 cells per well, across ten 96-well plates in selective media. The remaining cells were plated and selected together as a bulk pool control. Wells were fed every seven days until at least 80% confluency was reached.

A total of 236 minipools grew out and were screened in parallel for high GFP expression via flow cytometry and low copy number with a Copy Number Variation assay (CNV). Minipools with a copy number less than 2.5 and GFP expression at least 50% of the bulk pool were expanded into shaking adaptation. Expanded pools were also re-tested for GFP expression and confirmed via flow cytometry. Once minipools were expanded, vial aliquots were frozen down.

Minipool vials were thawed and allowed to recover. Cells were then adapted to a liquid counterpart of the semisolid media used for single cell cloning. Minipools were deemed fully adapted when cells would show consistent doubling times and high viability (>90%). Adapted cells were then plated into semisolid media for the Molecular Devices ClonePix3 single cell cloning platform. Single cell imaging was obtained on day 0 of cell plating in semisolid media to confirm monoclonality. Clonal cell colonies reached outgrowth in fourteen days. Clonal cell colonies were picked and deposited as one colony per well of a 96-well plate. Each clone was then expanded, re-adapted to selection media, and cryopreserved. Doubling times were calculated and clones with less than a 30-hour doubling time were chosen for further development. Expanded clones were retested for GFP expression and copy number.

Each clone was then transfected in duplicate using the BioRad Gene Pulser Xcell™ Total System with a monoclonal antibody (mAb)-cyan fluorescent protein (CFP) construct to test expression titer. Transfection conditions were optimized such that clonal lines were >90% viable at time of transfection and at least >70% viable post-transfection. CFP expression was evaluated via flow cytometry 3 days post transfection to determine relative transfection efficiency >35%. After full selection and recovery, cell lines were tested in a 10-day TPP (bioreactor tubes) shaking production run in duplicate. Titers for candidate cell lines ranged 50-100 mg/L. A single clone (CSS-1286) derived from minipool CSS-1144 was selected for further development.

Agilent SureSelect was used to confirm the number of copies and genome location of the landing pad in CSS-1286. SureSelect enriches for a targeted area of interest within the CHO genome and allows for high throughput sequencing using Illumina. In this case, the landing pad site was targeted for enrichment using custom probes.

Genomic DNA was extracted from CSS-1286 and fragmented for sequencing. Complementary oligonucleotide probes ("baits"), were designed to enrich target DNA sequences. When exposed to the genomic DNA library, the baits bound to the sequence of interest and were pulled down via magnetic bead enrichment. Illumina sequencing adapters were then added to the enriched DNA fragments and amplified via PCR, resulting in an enrichment of the fragments of interest. Fragments were analyzed on an Illumina MiSeq.

The data were analyzed using the Horizon Discovery CHO genome sequence as a reference. Sequences were mapped to the reference landing pad sequence. Any chimeric reads, sequences containing both partial landing pad sequences and CHO genome sequences were extracted and mapped back to the CHO genome. This allowed for identification of where the landing pad had inserted into the CSS-1286 genome.

To confirm copy number using an orthogonal method, CSS-1286 was sent to Cergentis for Targeted Locus Amplification (TLA) (Hottentot et al., 2007). Targeted DNA sequences close in physical space were crosslinked. The targeted sequences were then digested and then ligated back together, forming circles of DNA. Inverse PCR was performed, using the targeted sequence as the initial binding region for amplification. This created large libraries of DNA that were then be sequenced using Illumina sequencing. Sequences were then mapped back to the reference Horizon Discovery CHO genome to determine copy number and genome integration location. TLA and SureSelect identified the same single genome location.

Antibody Library Cloning

Figure 2A:
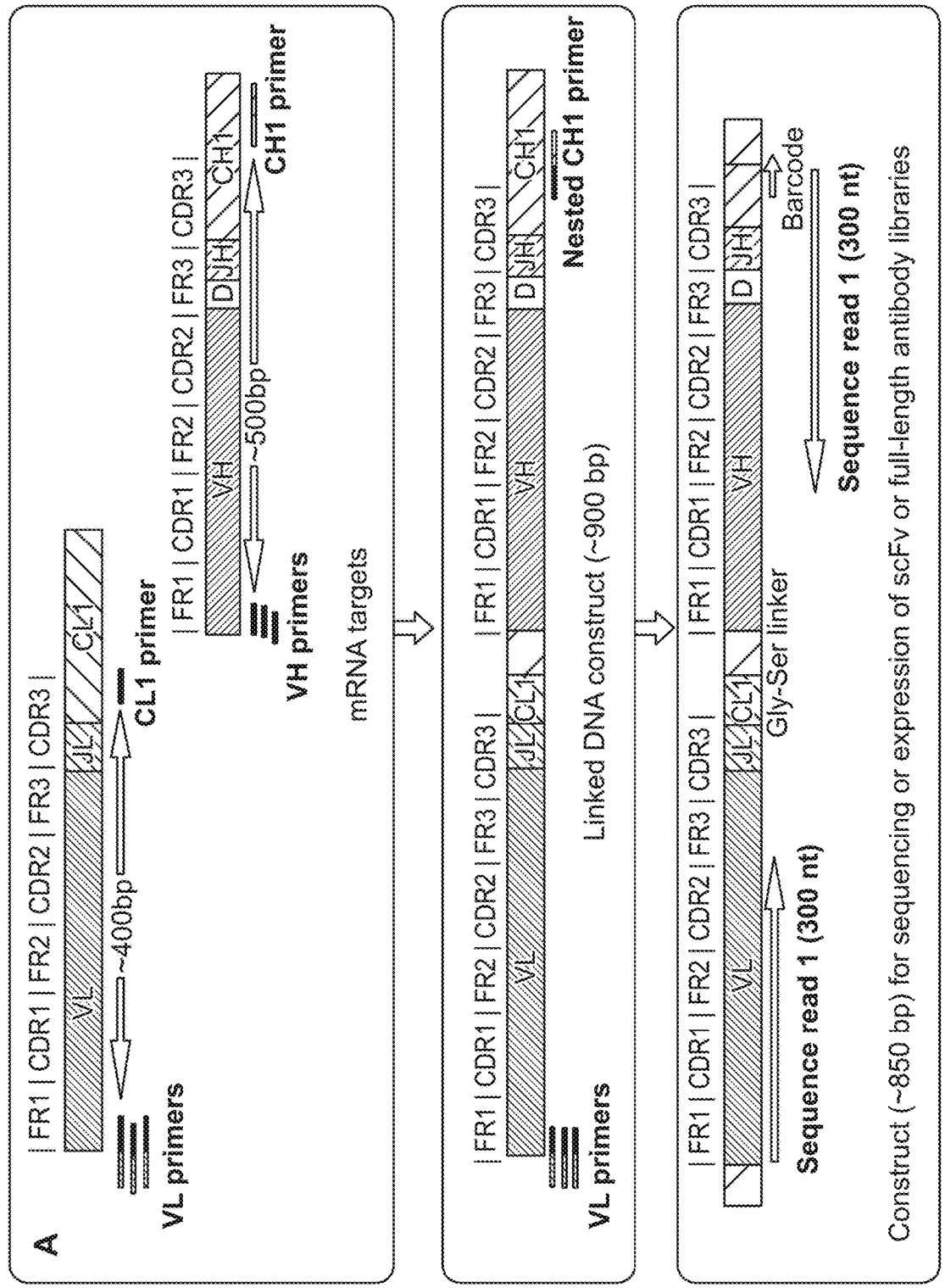
Figure 2B:
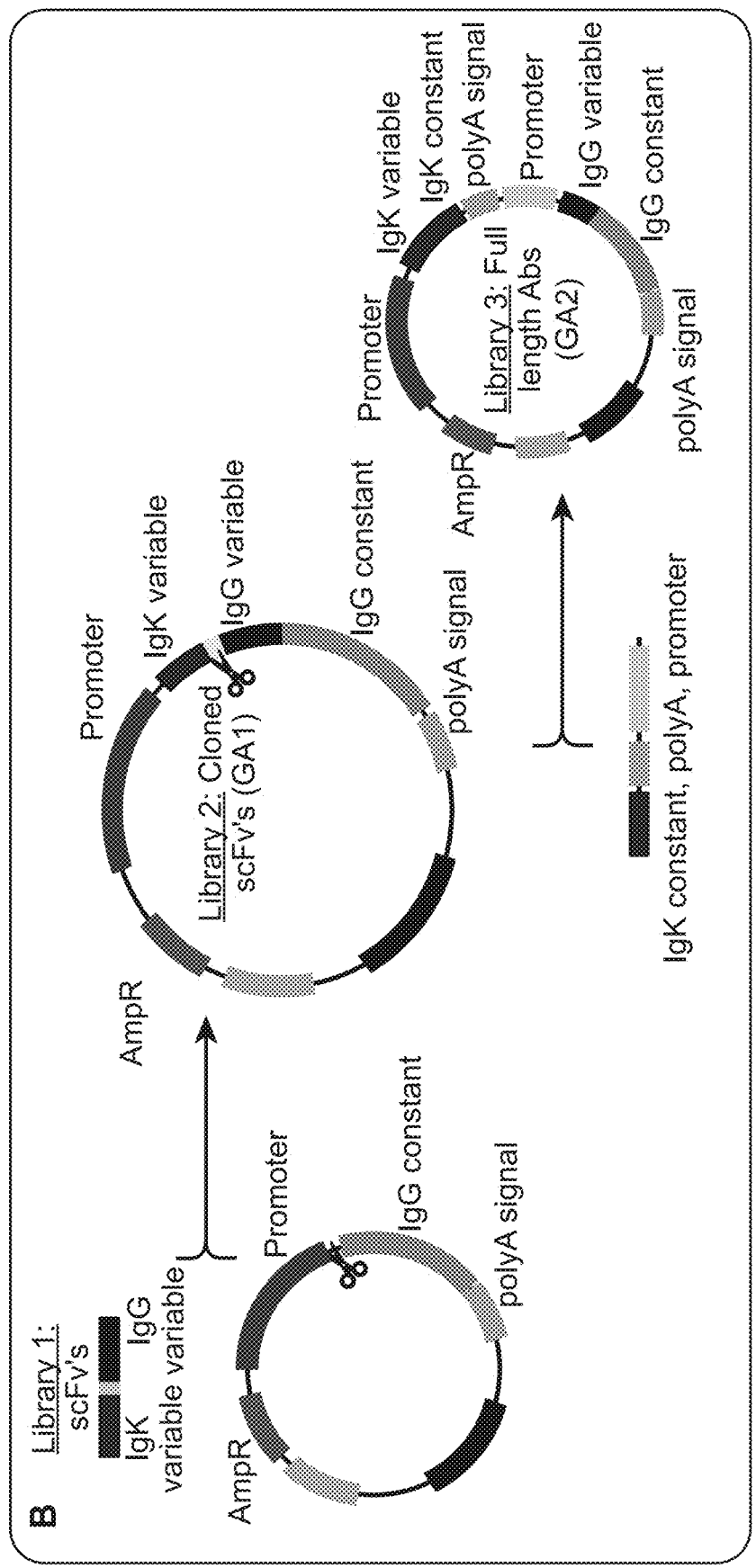

Generation of amplicon libraries comprised three steps: (i) poly(A)+mRNA capture, (ii) multiplexed overlap extension reverse transcriptase polymerase chain reaction (OE-RT-PCR), and (iii) nested PCR to remove artifacts and add adapter sequences for Illumina sequencing or cloning into antibody expression vectors (FIGS. 2A and 2B).

First, PBMCs were collected from 50 human donors (median age 52; range 20-71), either presumed positive by symptoms or confirmed positive by nasal swab test (Roche) at the collection site. No follow-up nasal swab qPCR assay was required to show viral clearance. The median days since onset of symptoms was 23 days (range 12-42). Donors were consented under an IRB protocol by a CRO and shipped to GigaGen overnight at ambient temperature. The serum fraction was isolated for each of the 50 donors. Each serum was assayed for reactivity against SARS CoV-2 Spike protein and SARS CoV-2 RBD protein, using ELISA (FIGS. 3A-3D). 33 of the donors bound to Spike and/or RBD. The 16 highest titer donors were then selected for library generation (Library 1 to 8).

Next, PBMC samples from each of the 16 "high titer" donors were assayed the for SARS CoV-2 virus using CDC qPCR assays (FIGS. 3A-3D). None of the 16 donors showed any detectable SARS CoV-2 RNA. 1.5-2 million B cells were isolated from each of the 16 high titer donors into fluorocarbon oil (Dolomite) emulsion microdroplets with lysis buffer (20 mM Tris pH 7.5, 0.5 M NaCl, 1 mM EDTA, 0.5% Tween-20, and 20 mM DTT) and oligo(dT) beads (New England Biolabs Inc.; NEB), using an emulsion droplet microfluidic chip. Typically, >3 million single cells were processed per hour, with >99% of cell-containing droplets containing single cells. Beads were separated from the droplets using Pico-Break solution (Dolomite). Multiplex OE-RT-PCR was then performed in emulsions, using purified RNA-bound beads as template, to generate single chain variable fragment (scFv) amplicons that linked the heavy and light chain Ig from single B cells (Adler et al., 2017). Pools of 2 high titer donors were amplified in the emulsions, for a total of 8 emulsion reactions.

The OE-RT-PCR products were used as template in a nested PCR to add adapters for yeast surface display. $S.$ $cerevisiae$ cells (ATCC) were electroporated (Bio-Rad Gene Pulser II; 0.54 kV, 25 uF, infinite resistance) with the PCR product combined with a linearized vector for in vivo homologous recombination and inducible expression of scFv protein. Transformed yeast were expanded, induced with galactose, and approximately $2 \times 10^6$ induced yeast cells were stained with anti-c-Myc (Thermo Fisher Scientific) followed by a FITC-conjugated secondary antibody (Thermo Fisher Scientific), and biotinylated SARS CoV-2 RBD or Spike (1200 nM final concentration) followed by APC-streptavidin (Thermo Fisher Scientific); an scFv library specific for an unrelated target was used as a negative control. Yeast cells were then sorted (BD Influx) and $20\text{-}30\times 10^3$ double-positive cells (FITC/APC+) were recovered. For further specificity, a second round of sorting using the same antigen was performed and $50 \times 10^3$ double-positive yeast 2-donor library were recovered.

An average of 1.1% of the expressed antibodies were RBD-specific after the first sort, suggesting that most antibodies in the original convalescent COVID-19 repertoires are not specific to SARS CoV-2. Plasmid scFvs from each of the 8 sorted libraries were subjected to PCR to amplify the scFv and add adapters for Illumina sequencing. A randomer of seven nucleotides was added to increase base calling accuracy in subsequent Illumina sequencing steps. Sequencing on a MiSeq (Illumina) showed that each sorted library comprised a median of 129 antibodies (range: 83 to 209).

Figure 4:
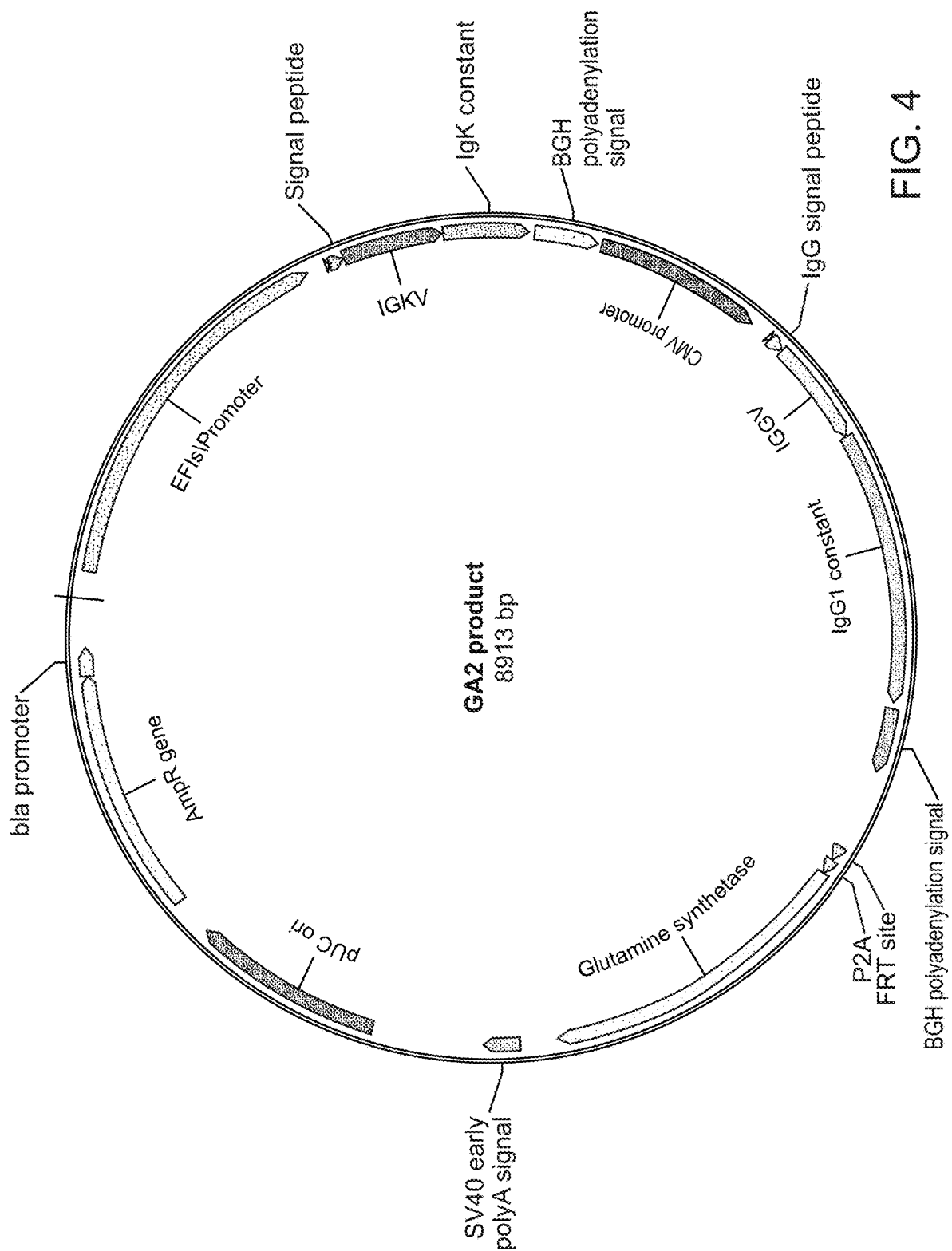
FIG. 4 illustrates a map for a fully assembled antibody expression plasmid.
Figure 7A:
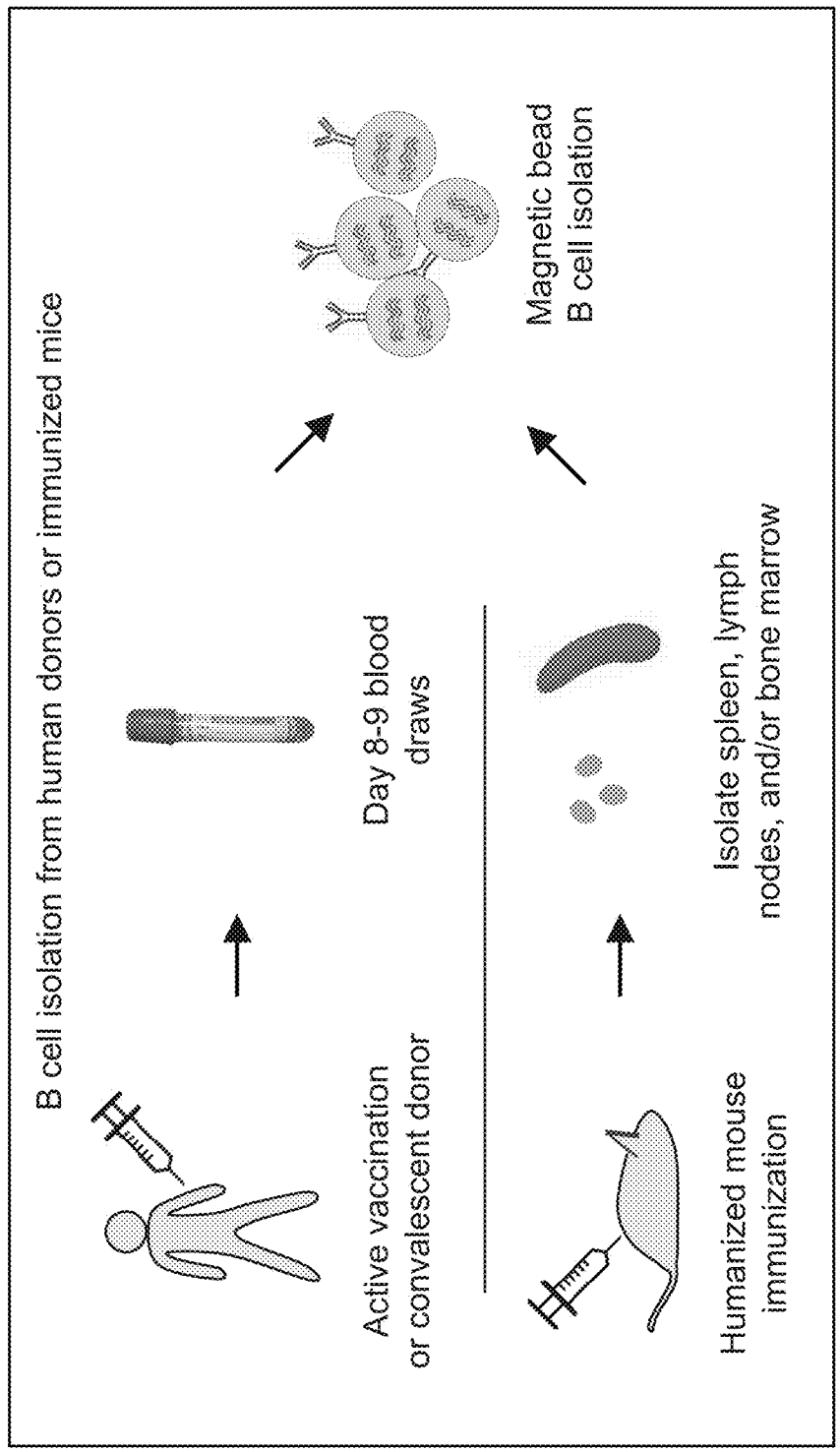
FIG. 7A illustrates the process of isolating B cells from human donors (vaccinated or convalescent) or immunized humanized mice.
Figure 7B:
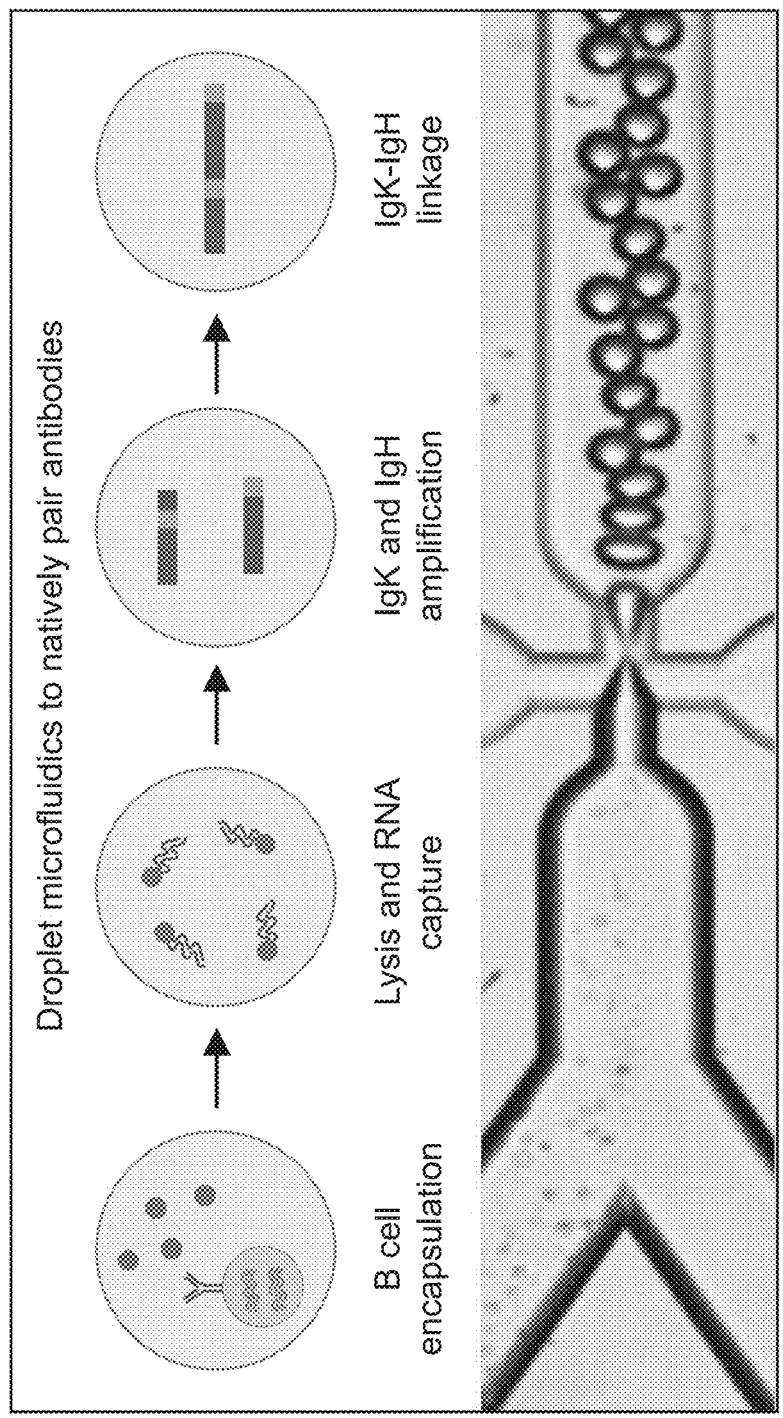
FIG. 7B illustrates the process of capturing natively paired antibody sequences from millions of single cells using droplet microfluidics.
Figure 7E:
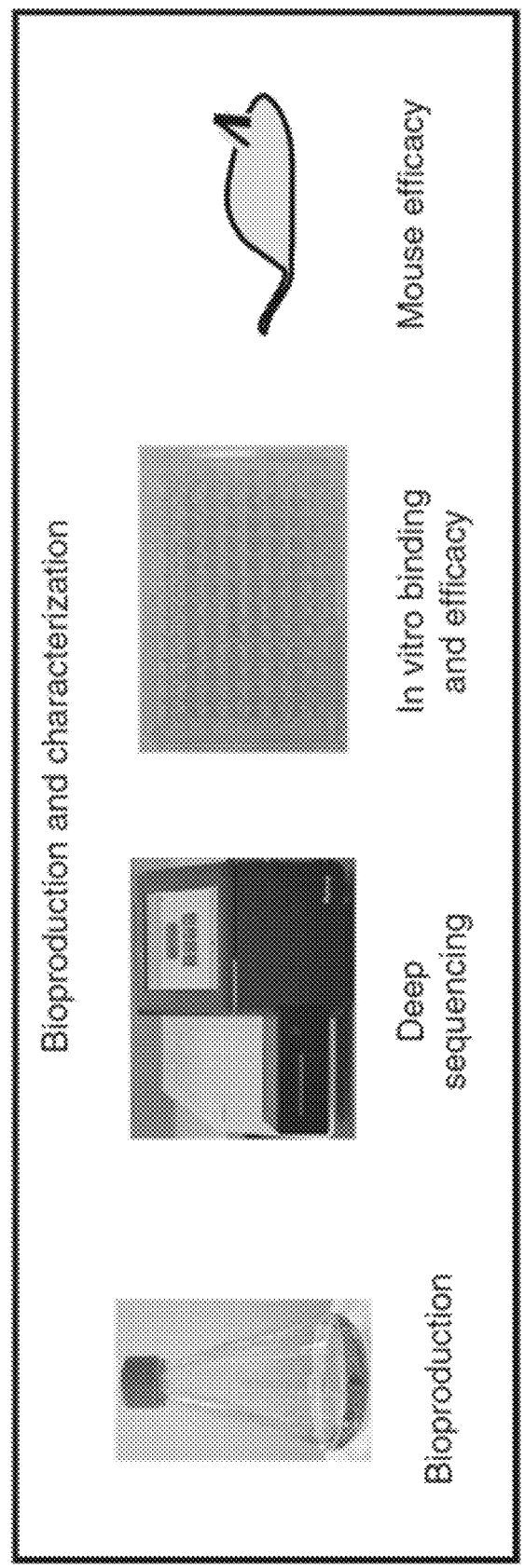
FIG. 7E illustrates bioproduction and characterizations. The libraries were characterized by deep sequencing, in vitro binding and efficacy assays, and/or in vivo mouse efficacy studies.

To convert the 8 sorted scFv libraries into full-length antibody libraries, a cloning pipeline was developed to convert the 8 scFv libraries into full-length CHO expression libraries (FIG. 4). First, nested outer PCR primers added adapters with overhangs for Gibson assembly to the 5' and 3' ends of the scFv library. Then Gibson Assembly (NEB) was used to insert the scFv library into a vector containing a single promoter, a secretory leader sequence for light chain Ig and the remainder of the IgG constant region, creating a cloned scFv library. To create the full-length antibody library, another Gibson Assembly was used to insert a synthetic amplicon containing a portion of the light chain Ig constant region, a poly(A) signal for light chain Ig, a promoter for the IgG gene and a secretory leader sequence for the IgG gene.

The base plasmid for antibody expression was derived from pCDNA5/FRT (ThermoFisher), with some modifications (FIG. 4). The original plasmid (purchased from ThermoFisher) contained a CMV promoter followed by the protein open reading frame and finally a BGH polyadenylation sequence. The assembled antibody expression plasmid (after the second Gibson Assembly) contains an EF1-alpha promoter (sourced from pEF1a-IRES, Takara Bio), followed by an $H.$ $sapiens$ IgG signal peptide, the IgK variable region sourced from the donor B cell, and the IgK constant region. Next is a BGH polyadenylation sequence (same sequence as in the original plasmid), followed by the CMV promoter (from the original plasmid), the IgG signal peptide, IgG variable region sourced from the donor B cell, IgG constant region and a second BGH polyadenylation sequence (from the original plasmid). The hygromycin resistance gene in the original plasmid was replaced with the glutamine synthetase gene (sourced from pCGS3, MilliporeSigma) preceded by a 2A motif The full-length rCIG plasmid libraries were then transformed en masse into $E.$ $coli$ and then spread on LB-carbenicillin plates. >1 million colonies were typically scraped and plasmid was purified with a Maxi prep kit (Qiagen) to make the full-length Maxi prep library, which was then transfected into parental CHO cells, as described below. RCB and MCB Generation The 8 full-length rCIG library maxipreps were used to create 8 polyclonal RCBs, which could be used to produce RPP. First, a vial from the bank of parental CSS-1286 cells was thawed out and recovered. CSS-1286 cells were taken off Zeocin selection the day before transfection. CSS-1286 cells were co-transfected with the full-length rCIG library maxiprep and a recombinase plasmid using the Gene Pulser Xcell™ Total System in growth media. The host cell then expresses the Flp recombinase off the recombinase plasmid to promote recombination of each donor full-length rCIG library into the landing pad site of CSS-1286. Transfected cells were recovered in static flasks for 72 hours at 37° C., 5% $CO_2$ and then subjected to GS selection to produce stable pools of cells expressing rCIG antibodies. The cells were provided a media change with selective media every seven days for approximately 14 days until fully selected.

The selected cells were expanded and cryopreserved, generating 8 polyclonal rCIG RCBs, which could be used to produce RPP. Small-scale production of RPP in shake flasks was performed for each rCIG RCB, and the protein products were subjected to a battery of tests, including anti-SARS CoV-2 ELISA and a Spike:ACE2-inhibition ELISA. The anti-SARS CoV-2 binding ELISA showed that the scFv-sorted rCIG products were typically >10,000-fold more potent than plasma-derived IVIG, and ranged from 147- to 1,394-fold more potent binding than matched convalescent serum/plasma. The potential for SARS CoV-2 neutralization was assessed using a Spike:ACE2-inhibition ELISA and pseudotype neutralization assays. Preliminary results showed that neutralization was generally consistent between the ELISA and pseudotype neutralization methods. Plasma-derived IVIG showed no detectable neutralization. The scFv-sorted rCIG library products were 32.7-1,500-fold more potent than matched convalescent serum/plasma, generally consistent with the trends observed in the anti-SARS CoV-2 binding ELISA experiments. No library that was tested showed anti-RBC agglutination or anti-HLA reactivity.

A mixture of the 8 RCBs is prepared to generate an MCB for GMP production of RPPs, simultaneously maximizing antibody diversity and neutralizing activity, while retaining low off-target reactivity. The mixture of RCBs is generated by thawing the chosen RCBs and then mixing them at a predetermined ratio, i.e., not necessarily in equivalent ratios. A panel of assays is used to characterize rCIG drug candidate produced at small scale from the mixture of RCBs (FIGS. 5 and 6). The MCB is characterized using standard assays, including *mycoplasma*, adventitious viruses, hamster antibodies, and sterility. The MCB is also assessed for phenotypic stability using a standard cell aging protocol.

Bioproduction of rCIG

The MCB are expanded in a seed train. The seed train is used to inoculate large-scale bioreactors, for example, 200 L single use bioreactors (SUBs). Bioproduction of RPP is monitored for a variety of parameters, including viability, IgG titer, glucose, and metabolites. Bioproduction continues for 14 days or until cell viability drops below 80%. The harvested cell culture fluid (HCCF) is then be used for downstream purification.

The GMP downstream process is designed to selectively purify antibody from the harvested cell culture fluid (HCCF), and then further polish the material by removing residual host cell protein (HCP), aggregate, and other impurities. DNA and virus are also inactivated and removed, and the final material is formulated at the desired concentration in the final buffer.

The steps of downstream production include, e.g., standard Protein A purification; subjecting the eluant to a pH 3.5 hold for viral inactivation; and polishing using cation-exchange (CEX), anion-exchange (AEX), and viral clearance filters; ultrafiltration/diafiltration (UF/DF) and sterile filtration for final formulation of the drug substance.

Antibody RNA Sequencing for Process Monitoring

Currently, no technology exists to reliably quantify the individual protein components of mixtures of more than 1,000 proteins. As such, the individual antibody protein components of plasma-derived antibody products such as IVIG remain unknown. Using current technologies, antibody sequencing can only be performed on individual purified proteins, such as monoclonal antibodies. Therefore, lot release metrics for plasma-derived antibody products do not include antibody sequencing.

Like plasma-derived antibody products, rCIG comprise >1,000 different antibodies. Unlike plasma-derived antibody products, rCIG is manufactured from a CHO master cell bank that expresses RNA that encodes >1,000 different antibodies. Unlike protein sequencing, sequencing of RNA mixtures is technologically mature, very high-throughput, and quantitative. Therefore, Illumina sequencing of antibody RNA ("antibody RNA-seq") expressed by CHO cells is used as a method to assesses antibody diversity at the end of bioproduction.

Small-scale (2.5-5 L) engineering runs are used to establish control ranges in the Jaccard and Morisita indices (Rempala & Seweryn, 2013) between the MCB and harvest day. The Jaccard metric assesses the overlap of antibody sequences between two given samples, whereas the Morisita index assesses the quantitative consistency of antibody sequences between two given samples. Thus, Jaccard assesses maintenance of antibody diversity, and Morisita assesses maintenance of antibody frequencies.

Sufficient replicates are performed to generate a median and standard deviation for Jaccard and Morisita indices from production runs that produce protein product above a critical minimal cutoff for rCIG potency. These ranges are used to monitor and assess GMP manufacturing at the 200 L scale.

Example 3: Generation of Recombinant Hyperimmune Globulins from Diverse B-Cell Repertoires Plasma-derived polyclonal antibody therapeutics, such as intravenous immunoglobulin, have multiple drawbacks, including low potency, impurities, insufficient supply and batch-to-batch variation. The present disclosure describes a microfluidics and molecular genomics strategy for capturing diverse mammalian antibody repertoires to create recombinant multivalent hyperimmune globulins. The method generates of diverse mixtures of thousands of recombinant antibodies, enriched for specificity and activity against therapeutic targets. Each hyperimmune globulin product comprised thousands to tens of thousands of antibodies derived from convalescent or vaccinated human donors or from immunized mice. Using this approach, Applicant generated hyperimmune globulins with potent neutralizing activity against severe acute respiratory syndrome coronavirus-2 (SARS-CoV-2) in under 3 months, Fc-engineered hyperimmune globulins specific for Zika virus that lacked antibody-dependent enhancement of disease, and hyperimmune globulins specific for lung pathogens present in patients with primary immune deficiency. To address the limitations of rabbit-derived anti-thymocyte globulin, Applicant generated a recombinant human version and demonstrated its efficacy in mice against graft-versus-host disease.

The technology described here generates recombinant hyperimmune globulins for diverse conditions through high-throughput microfluidics, genomics and mammalian cell engineering. B cells from human donors or mice are run through a microfluidic platform, heavy and light chain immunoglobulin nucleic acid sequences are fused on a single-cell level to create antibody repertoires, antibody repertoires are engineered into full-length expression constructs en masse, and then the full-length antibody expression constructs are stably introduced en masse into Chinese hamster ovary (CHO) cells in a site-directed manner. The technology disclosed herein was applied to develop $10^3$ to $10^4$ diverse recombinant hyperimmune globulin drug candidates to address unmet clinical needs for the COVID-19 pandemic, Zika virus disease, primary immune deficiency (PID) and transplant tolerance. The drug candidates were validated in vivo and/or in vitro for each of the four clinical applications.

Results

Capturing Diverse Antibody Repertoires as CHO Libraries and RPPs

Mammalian antibody repertoires are extremely diverse, comprising as many as $10^7$ antibody clonotypes. Advanced molecular technology is required to capture a substantial fraction of a mammalian donor's diverse antibody repertoire. Applicant used methods for generating millions-diverse libraries of natively paired heavy and light chain immunoglobulin sequences in yeast. That method used microfluidics to isolate millions of single B cells per hour into picoliter droplets for lysis, followed by overlap extension—reverse transcriptase—polymerase chain reaction (OE-RT-PCR), to generate libraries of natively paired single chain variable fragments (scFv).

Because antibody repertoires often contain many antibodies not directed against the target(s) of interest, a variety of enrichment methods (FIG. 7A-7E) were used. For ATG, Zika virus, *Haemophilus influenzae* b (Hib) and *Streptococcus pneumoniae* (pneumococcus), immunogens were administered to human donors or humanized mice before sampling antibody-producing cells. For SARS-CoV-2, convalescent donors were recruited who recently tested positive for COVID-19, made yeast display scFv libraries from donor B cells and sorted the libraries derived from these donors to enrich for antibodies directed against SARS-CoV-2 antigen. In all cases, the output was a library of thousands to tens of thousands of natively paired scFv DNAs, enriched for activity against their respective target(s).

Next, each library of scFv DNAs was used to produce natively paired full-length antibody expression constructs, which were then engineered into mammalian cells for production of recombinant hyperimmune globulins (FIG. 7A-7E). Cloning into full-length antibody expression constructs was performed en masse, that is, to perform all molecular steps on full libraries rather than individual clones. Briefly, the protocol involved a series of two Gibson assemblies, which are referred to as Gibson assembly 1 (GA1) and Gibson assembly 2 (GA2) (FIGS. 12A and 12B). In GA1, the scFv library was inserted into a vector backbone that contained a promoter, a fragment of the IgG1 constant domain and a poly(A) signal. In GA2, the GA1 plasmid was linearlized, and subcloned it into a DNA fragment that contained a fragment of the IgK constant domain, a second poly(A) signal and a second promoter.

Production cell lines for monoclonal antibodies are typically produced by randomly inserting expression constructs into the CHO genome. This method produces cell lines with genomic insertion of multiple copies of the expression construct. If polyclonal antibody construct libraries are inserted randomly into the CHO genome, because each cell might contain several inserted transgenes, many clones would express multiple antibodies, which would result in frequent nonnative pairing between heavy and light chain immunoglobulin. Additionally, different genome locations have different transcriptional activity levels, which could result in heterogeneous, inconsistent and/or unstable bioproduction. Applicant therefore used CHO cell lines engineered with a Flp recombinase recognition target landing pad (FIG. 13E). These cell lines were then used for stable expression of recombinant hyperimmune globulins or RPPs in polyclonal cell banks.

Recombinant Hyperimmune Globulins or RPPs for SARS-CoV-2

To address the urgent unmet clinical need of the COVID-19 pandemic, methods provided herein were to build recombinant hyperimmune globulins against SARS-CoV-2, which is referred to as recombinant coronavirus-2 immune globulin, or rCIG. In March 2020, 50 human donors were recruited from a single clinic in Louisiana who either had tested positive for SARS-CoV-2 by nasal swab PCR testing or had shown symptoms of COVID-19 around the time of a major local outbreak. First, anti-SARS-CoV-2 plasma titer was assessed for each of the donors using the S1 and receptor binding domain (RBD) regions of SARS-CoV-2 spike glycoprotein (FIG. 8A and Table 6). A wide range of half-maximum effective concentration ($EC_{50}$) values was observed among patients who tested positive for COVID-19 (range 0.0056-9.94 mg ml$^{-1}$). 16 donors with high plasma antibody titers was selected and used to build yeast scFv display libraries from pools of two donors, for a total of eight libraries. The libraries comprised a median of 70,940 antibodies (range 54,986-156,592, Table 7).

Applicant used flow sorting to enrich for anti-SARS-CoV-2 antibodies in the eight yeast scFv libraries (FIG. 8B, FIGS. 14A-14B and Table 7). One round of flow sorting suggested that a median of 0.99% of antibodies (range 0.42-2.29%) were directed against SARS-CoV-2. After two rounds of sorting, a median of 62.7% of unsorted antibody sequences were human IgG1 subtype (range 51.5-83.4%), whereas in the sorted libraries a median of 82.4% of antibody sequences were human IgG1 subtype (range 63.6-92.2%), suggesting that the COVID-19 antibody response was generally dominated by IgG1 antibodies. Next, full-length polyclonal antibody preparations were generated from each of the eight scFv libraries. The antibodies were formatted as human IgG1, regardless of the initial IgG subtype. Anti-SARS-CoV-2 enzyme-linked immunosorbent assay (ELISA), spike:ACE2 blocking assays and pseudotype and live virus neutralization assays were used to assess the relative activity of each of the eight antibody libraries (FIG. 8F, FIGS. 15 and 17A-17C and Table 7). The eight scFv-sorted CHO cell banks were used in a way that sought to balance high antibody diversity with high anti-SARS-CoV-2 pseudotype neutralization titer (Table 8) and used the combined cell bank to generate rCIG protein product (FIG. 18A-18B). In preparation for manufacturing rCIG for clinical trials, a comprehensive polishing strategy was developed. Stress testing showed that the polished protein quality and function was highly stable, suggesting that rCIG was amenable to large-scale manufacturing (FIG. 19A-19D). This entire process, from delivery of the first donor sample to laboratory-scale generation of the rCIG protein product, was completed in less than 3 months.

Antibody RNA sequencing of the final CHO cell bank indicated that the rCIG drug candidate comprised a diverse set of 12,500 antibodies (FIG. 8C and Table 9). Additional repertoire analysis of the linked scFv and CHO cell bank libraries for rCIG was performed, including variable gene usage frequency, divergence from germline, CDR3H length distribution and sequence logos of the most abundant clonal clusters (FIG. 20A-20D, FIG. 21A-21C). Anti-SARS-CoV-2 ELISA suggested that the binding titer of rCIG was between 99- and 747-fold higher than corresponding plasma (FIG. 8D, FIG. 15 and Table 7 and 9). ELISAs with several natural variants of SARS-CoV-2 and antigens from related viruses, including SARS-CoV and Middle East respiratory syndrome (MERS) CoV, showed that rCIG bound a broader variety of antigen targets than IVIG or a neutralizing CoV-2 monoclonal antibody (mAb; FIG. 8E, FIG. 22 and Table 9). SARS-CoV-2 pseudotype virus neutralization assay was performed with psudotype virus of several SARS-CoV-2 variants (B.1.1.7 (UK), B.1.351 (South Africa), P.1 (Japanese/Brazilian), and B.1.427/B.1.429 (California)). The result showed that rCIG neutralizes the psudotype virus of the variants in a concentration dependent matter, with an $IC_{50}$ within 6-fold of the $IC_{50}$ determined using the Wuhan-Hu-1 psudoviral particle (FIG. 51 and FIG. 52). The rCIG RPP therefore has broad activity across variants against which individual monoclonal antibodies are not active.

Finally, spike:ACE2 blocking assays, pseudotype virus neutralization assays and live SARS-CoV-2 neutralization assays suggested that the neutralizing titer of rCIG was between 44- and 1,767-fold higher than corresponding convalescent plasma (FIG. 8F, FIGS. 16A and 16B, and Tables 7 and 9).

Antibody RNA sequencing of the CHO cells and SARS-CoV-2 ELISA binding and SARS-CoV-2 pseudotype neu-(possibly inappropriate) choices about viral epitope targets, the potency of an rZIG product produced without enrichment by flow sorting was assessed. To this end, the unsorted scFv library and CHO engineering technology to create rZIG CHO cell banks with a wild type human IgG1 isotype (rZIG-IgG1) or a mutated human IgG1 with abrogated Fc receptor (FcR) binding (rZIG-LALA) were used. Antibody RNA sequencing of IgG sequences in the rZIG cell banks suggested that the rZIG-IgG1 comprised 33,642 antibodies and rZIG-LALA comprised 26,708 antibodies (FIG. 9A and Table 11). A Morisita overlap of 86% and a Jaccard overlap of 58% between the rZIG-IgG1 and rZIG-LALA libraries suggested that the cell banks comprised substantially similar antibody repertoires. Additional repertoire analysis of the linked scFv and CHO cell bank libraries for rZIG was performed, including variable gene usage frequency, divergence from germline, CDR3 length distribution and sequence logos of the most abundant clonal clusters (FIG. 25A-25D). CDR1, CDR2 and CDR3 sequences of 5 clusters provided in FIG. 25D are also summarized in the below table.

| Cluster | CDR1 | CDR2 | CDR3 |
| --- | --- | --- | --- |
| 1 | GFTFSSYA (SEQ ID NO: 25841) | ISGSGGST (SEQ ID NO: 25847) | AKEGMVLRYFDWLWDY (SEQ ID NO: 25856) |
| 2 | GFTFSSYG (SEQ ID NO: 25842) | I[W/S]YDGSNK (SEQ ID NO: 25848) | R[D/E][R/L][S/V/L]SG[P/W]S[G/H]FDY (SEQ ID NO: 25857) |
| 3 | GFTFSSYA (SEQ ID NO: 25841) | ISGSGGST (SEQ ID NO: 25847) | A[K/E/R][E/T][Q/L/T][L/W/I][L/V/W/N][G/L]V[V/P/L][F/L/N][D/N]Y (SEQ ID NO: 25858) |
| 4 | GFTFDD[Y/H]G (SEQ ID NO: 25843) | INWNG[G/D]ST (SEQ ID NO: 25849) | AR[D/N][R/G]GS[S/T][G/S/W/F][W/F/Y][R/F/Y]D[W/A]FD[P/I] (SEQ ID NO: 25859) |
| 5 | GFTFSD[Y/D][Y/F] (SEQ ID NO: 25844) | ISGSG[S/Y]TI (SEQ ID NO: 25850) | ARDEGY[R/S]GY[V/N]LD[T/N/S] (SEQ ID NO: 25860) | tralization of rCIG protein generated from replicate 3-1 bioreactor runs did not show significant batch-to-batch variation in antibody sequence content (Wilcoxon rank sum test, P>0.05) or in vitro pseudotype neutralization (Feltz and Miller's asymptotic test, P>0.05; FIGS. 23A and 23B).

Recombinant Hyperimmune Globulin or RPP for Zika Virus

To address the Zika pandemic, the method described herein was to build recombinant hyperimmune globulins or RPP against Zika virus, which is referred to as recombinant Zika immune globulin, or rZIG. To create rZIG RPP, human-transgenic mice (Trianni) was used that expressed a complete repertoire of human antibody sequences. The mice were immunized with Zika virus antigens (FIGS. 24A and 24B). To explore the ability to engineer an rZIG that would not exhibit antibody-dependent enhancement (ADE), a safety concern for anti-Zika therapeutic antibodies, Applicant additionally boosted with four inactivated dengue virus serotypes.

B cells from the immunized animals and microfluidics technology were used to create an scFv library of natively paired IgGs. The resulting scFv library comprised approximately 119,700 IgG-IgK clonotypes (Table 10). Because enrichment by flow sorting is time-consuming and makes Applicant used these CHO cell banks to produce rZIG-IgG1 and rZIG-LALA hyperimmune globulins at laboratory scale (FIG. 26A-26B, FIG. 27A-27B).

Anti-Zika virus ELISA showed that both rZIG-LALA and rZIG-IgG1 had >75-fold higher titers against Zika virus than a human Zika positive serum sample (FIG. 28 and Table 11). Both rZIG-LALA and rZIG-IgG1 had anti-dengue binding activity across four serotypes, with pooled $EC_{50}$ values showing strong correlation with anti-Zika $EC_{50}$ values (linear regression, $R^2$=0.9993, F-statistic P<0.001; FIG. 9B, FIG. 29 and Table 10). In contrast, although both rZIG-LALA and rZIG-IgG1 had strong activity in a Zika pseudotype neutralization assay (FIG. 30), there was no correlation between Zika and pooled dengue neutralization (linear regression, $R^2$=0.00271, F-statistic P>0.05; FIG. 9C and FIG. 31). Applicant investigated whether the abrogated Fc function of rZIG-LALA could decrease ADE in a Zika pseudotype virus assay (FIG. 32). Both Zika+ human serum and rZIG-IgG1 showed considerable ADE, whereas rZIG-LALA showed no detectable ADE (FIG. 9D). Antibody RNA sequencing of the CHO cells and anti-Zika virus ELISA binding of rZIG-IgG1 and rZIG-LALA protein generated from replicate bioproduction runs did not show significant batch-to-batch variation in antibody sequence content (Wilcoxon rank sum test, P>0.05), and batch-to-batch anti-Zika virus ELISA results were indistinguishable (FIG. 33A-33B).

IVIG Spike-In for Patients with Primary Immunodeficiencies

Plasma-derived IVIG acts as antibody replacement for patients with humoral primary immunodeficiencies ("PID"), who have low serum IgG titers. However, it has insufficient antipathogen activity for certain patients at-risk for PID. To address this unmet clinical need, Applicant manufactured recombinant hyperimmune globulins or RPPs directed against pneumococcus and Hib bacteria, designed as multivalent 'spike-ins' for plasma-derived IVIG, that is, recombinant *Haemophilus* immune globulin (rHIG) and recombinant pneumococcus immune globulin (rPIG). Note that rHIG and rPIG are not replacements for IVIG, but rather supplements meant to increase the efficacy of IVIG. A full recombinant replacement for IVIG would require much broader antipathogen activity.

Healthy human donors were recruited and administered vaccines directed against pneumococcus or Hib. Eight to nine days after vaccination, peripheral blood mononuclear cells (PBMCs) were collected and shipped to our microfluidics processing facility. B cells from the PBMCs were selected and millions of cells were run through the microfluidics platform (Table 12), and then the scFv libraries and the CHO engineering technology were used to create IgG1 CHO cell banks for rHIG and rPIG. Heavy chain antibody RNA sequencing of the cell banks indicated that rHIG comprised 49,206 IgG sequences and rPIG comprised 17,938 IgG sequences (FIG. 10A and Table 13 and 14). Additional repertoire analysis of the linked scFv and CHO cell bank libraries for rHIG and rPIG was performed, including variable gene usage frequency, divergence from germline, CDR3 length distribution and sequence logos of the most abundant clonal clusters (FIGS. 34A-34D and 35A-35D). These CHO cell banks were used to produce rHIG and rPIG hyperimmune globulins at laboratory scale (FIGS. 36A-36B and 37A-37B).

Anti-Hib ELISA indicated that rHIG had 233-fold higher titer than plasma-derived IVIG (FIG. 10B and Table 13). A serum bactericidal assay demonstrated that rHIG was strongly active against two different Hib strains, whereas no bactericidal activity was observed for plasma-derived IVIG (FIG. 10C, FIG. 38 and Table 13). An ELISA against a combination of 23 pneumococcus serotypes showed that rPIG has 85-fold higher titer than plasma-derived IVIG (FIG. 39 and Table 14). ELISA for individual pneumococcus serotypes showed that rPIG was at least fivefold higher titer than plasma-derived IVIG for 13 out of 16 serotypes measured, indicating broadly enriched multivalent reactivity and significantly higher than IVIG overall across all separate ELISAs combined (Wilcoxon signed rank test, P=0.00123; FIG. 10D and Table 14). Finally, semiquantitative serotype-specific opsonophagocytosis assays suggested that rPIG was as effective or more effective than plasma-derived IVIG at cell killing for 15 out of 16 serotypes tested, and had significantly higher activity than IVIG across all separate opsonophagocytosis assays combined (Wilcoxon signed rank test, P=0.00251; FIG. 10D and Table 14). Antibody RNA sequencing of the CHO cells and anti-Hib or antipneumococcal ELISA binding of rHIG or rPIG protein generated from replicate bioproduction runs, respectively, did not show significant batch-to-batch variation in antibody sequence content (Wilcoxon rank sum test, P>0.05), and batch-to-batch antipathogen ELISA results were indistinguishable (FIGS. 40A-40B and 41A-41B).

To simulate the potential clinical application, rHIG and rPIG were mixed in with plasma-derived IVIG (IVIG+rHIG/rPIG) at a ratio of 1:1:8 (rHIG:rPIG:IVIG), producing a product with 18.3-fold higher titer than plasma IVIG for Hib and 8.3-fold higher titer than plasma IVIG for a pool of 23 pneumococcus serotypes (FIGS. 42A-42B and Table 15). A Hib mouse challenge model using IVIG+rHIG/rPIG as prophylactic treatment showed significantly lower bacterial loads in the blood (Welch t-test, P<0.001) and peritoneal fluid (Welch t-test, P<0.001) as compared to plasma IVIG alone (FIG. 10E).

Recombinant Human ATG RPP for Transplant Tolerance

To encourage tolerance of grafts, transplant physicians use a variety immunosuppressive drugs, such as rabbit-ATG, which is manufactured by injecting rabbits with human thymocytes and isolating antibodies from the rabbit serum. However, rabbit-ATG can cause allergic reactions and other complications in humans, and the drug shows significant variation in potency across lots. To improve on rabbit-ATG, a recombinant human ATG, or rhATG RPP, derived from transgenic mice that express human antibodies (Trianni) were used. The mice were immunized with either human T cells or human fetal thymocytes (FIG. 43A-43B). B cells from the immunized animals and the microfluidics technology were used to create four scFv libraries of natively paired IgGs: bone marrow cells from T-cell immunized mice, lymph node cells from T-cell immunized mice, lymph node cells from thymocyte immunized mice and spleen cells from thymocyte immunized mice. The resulting scFv libraries comprised a range of 13,314 to 34,324 IgG-IgK clonotypes (Table 16). Additional repertoire analysis of the linked scFv and CHO cell bank libraries for rhATG was performed, including variable gene usage frequency, divergence from germline, CDR3 length distribution and sequence logos of the most abundant clonal clusters (FIG. 44A-44D). The CHO engineering technology was used to make cell banks from each of the four libraries.

Protein from each of the CHO cell banks was produced, and then pooled in equal mass equivalents to create rhATG (FIG. 45A-45B). Sequencing of individual libraries suggests that the pool comprised 49,885 antibodies (FIG. 11A and Table 17). Then ELISA was performed for a panel of known cell surface antigen targets for rabbit-ATG and observed that rhATG bound several immune cell surface targets, but only a subset of the targets bound by rabbit-ATG (FIG. 46A-46B). To investigate further, in vitro cell killing assays were performed with human PBMCs, which showed that rhATG and rabbit-ATG were not significantly different in cell killing potency against cytotoxic T cells and helper T cells (linear mixed effects model, P>0.05), whereas rhATG is significantly stronger than rabbit-ATG at killing B cells (linear mixed effects model, P<0.01) but significantly weaker than rabbit-ATG at killing natural killer cells (linear mixed effects model, P<0.01; FIG. 11B). Anti-erythrocyte binding assays were also performed, which suggested that rhATG has less off-target activity than rabbit-ATG (FIG. 47).

The efficacy of rhATG in vivo was also studied, using a graft-versus-host (GVH) model in which human PBMCs were grafted onto immune-incompetent mice. Animals (n=8 per PBMC donor) were dosed with rhATG, rabbit-ATG or vehicle control, either every other day for 5 weeks starting 5 days after the PBMC graft, or only on days 5, 6 and 7 after the graft. Two different PBMC donors were tested for each dosing regimen. After 42 days, rhATG was not significantly different from rabbit-ATG for survival (log-rank pairwise tests, P>0.05) and was superior to vehicle control for survival (log-rank pairwise tests, P<0.001), in both dosing schemes across multiple PBMC donors (FIG. 11C and FIG. 48A-48B). In both dosing regimens across both PBMC donors, immune cell (CD45$^+$) expansion was not significantly different between rhATG and rabbit-ATG (linear mixed effects model, P>0.05), whereas for the vehicle control immune cell counts were significantly higher than rhATG at day 9 (Wilcoxon rank sum tests, P<0.01; FIG. 11D and FIG. 49A-49B). The conclusion was that although rhATG and rabbit-ATG did not share identical antigen targets, the drugs had similar efficacy in vivo.

DISCUSSION

Applicant demonstrated the generation of multivalent, $10^3$ to $10^4$ diverse recombinant hyperimmune antibody drugs (RPPs) from convalescent human blood donors, vaccinated human blood donors and humanized mouse repertoires. The drug candidates were validated using in vitro and in vivo methods, highlighting their advantages over plasma-derived incumbents. The technology combines methods in microfluidics, genomics and mammalian cell engineering. Contrasted against previous methods for generating recombinant polyclonal antibodies, our drug candidates had hundreds-fold higher antibody diversity and therefore represented higher fractions of antigen-reactive repertoires. Their advantages over plasma-derived products include higher potency, the ability to scale production without collecting further donors, consistency of production and the ability to modulate pharmacologic problems such as ADE. The technology is fast, producing a master cell bank against a poorly characterized virus (SARS-CoV-2) in less than 3 months. The rCIG product (GIGA-2050) has now been manufactured at a good manufacturing practice (GMP) facility. GMP production was similar to the methods described in this study, except that upstream bioproduction was performed in a single use bioreactor at the 250-liter scale and downstream purification was scaled equivalently.

Emerging viruses are a constant and unpredictable threat to human health. In the past two decades alone, the world has seen outbreaks of Ebola virus, SARS, MERS, 2009 H1N1 swine flu, Zika Virus and SARS-CoV-2, among others. Notwithstanding recent successes in rapid development of SARS-CoV-2 prophylactic vaccines, previous vaccine development efforts required very long development timelines. Development of broadly neutralizing monoclonal antibodies is often confounded by the difficulty of identifying broadly neutralizing epitopes, and escape variants can emerge over time. Because of such issues, convalescent COVID-19 plasma emerged as a promising approach early in the COVID-19 pandemic. However, convalescent plasma is difficult to manufacture at scale because convalescent plasma supply is constrained and each plasma donor supplies enough therapeutic for only 1-2 patients. The conclusion was that rCIG was a promising alternative to COVID-19 convalescent plasma due to significantly higher potency against live virus (Wilcoxon rank sum test, P=0.02869) and the ability to scale GMP production without the need to recruit more donors.

Although Zika virus has been less widespread and less deadly than SARS-CoV-2, Zika can spread from mother to fetus in utero, resulting in birth defects such as microcephaly. As of July 2020, there was no FDA-approved vaccine or therapy for Zika virus. Zika virus disease is complicated by ADE, a phenomenon in which poorly neutralizing antibodies enhance viral infection by bringing virus particles to cells that express FcR. This problem is particularly troublesome for individuals who have been previously infected with dengue, a related flavivirus, since many anti-dengue antibodies are poor neutralizers against Zika virus and vice versa. ADE is a safety concern in the development of plasma-derived hyperimmune globulins and vaccines. The conclusion was that rZIG-LALA was a promising alternative to plasma-derived drugs, due to high neutralizing potency against Zika virus and complete abrogation of the risk of ADE.

Although plasma-derived IVIG reduces rates of serious infections in PID, many patients still suffer frequent serious infections that require hospitalization. In particular, about 78% of serious lung infections are caused by pneumococcus and Hib bacteria. Clinicians have improved outcomes by further increasing IVIG doses, suggesting that, however, bacterial species are often incredibly diverse; for example, there are 90 known pneumococcus serotypes, complicating therapeutic development. The conclusion was that a polyvalent IVIG+rHIG/rPIG product had strong potential to address unmet clinical needs in patients with PID through increased potency against key pathogens.

In 2019, nearly 40,000 solid organ transplants were performed in the USA alone (www.unos.org). Transplantation generally introduces at least some mismatch between the human leukocyte antigen genotypes of the donor and host. This frequently results in some host-versus-graft effects, leading to loss of the graft and other serious complications. The work provided herein suggested that rhATG could one day address unmet clinical needs in transplant tolerance.

Our technology for generating recombinant hyperimmune globulins combines the advantages of recombinant antibodies (purity, consistency, potency) with the advantages of plasma-derived antibodies (proven efficacy, diversity, polyvalence, in vivo affinity maturation). The study disclosed herein has shown how the technology can improve existing plasma-derived products such as IVIG and rabbit-ATG. Polyclonal antibodies contain drugs with different mechanisms of action, potentially increasing efficacy; for example, rCIG may contain some antibodies optimized to block binding of virus to ACE2 and other antibodies optimized to clear virus through complement fixation. In the future, our technology could be used to develop drugs with new mechanisms of action, for example, antitumor antibody mixtures or antiplasma cell mixtures to cure humoral-driven autoimmune disease. It could also be extended to develop recombinant polyclonal IgM or IgA. To strengthen readiness against future pandemics, recombinant hyperimmune globulin cell banks against the most pressing biodefense threats could be produced preemptively.

Methods

Generating Paired Heavy and Light Chain Libraries

Generation of scFv libraries from antibody-producing cells comprises three steps: (1) poly(A)+mRNA capture, (2) multiplexed OE-RT-PCR) and (3) nested PCR. Briefly, a microfluidic device captures single cells in droplets with a mixture of lysis buffer and oligo dT beads (NEB). After the cell is lysed and messenger RNA is bound to the bead, the emulsion is broken and the mRNA-containing beads are purified. Next, an emulsion is created using OE-RT-PCR reagents including a pool of primers directed against the IgK C region, the IgG C region and all V regions (Table 18), and the mRNA-bound beads as a template. The emulsion is subjected to thermal cycling, which creates complementary DNA, amplifies the IgK and IgG variable regions and links them together in an scFv format. Then the emulsion is broken and the linked scFv DNA product is extracted and purified. The purified scFv product is then amplified using nested PCR to remove artifacts and add adapter sequences. Depending on the adapter sequences, the product can be used for deep sequencing, yeast display libraries or full-length CHO expression.

To convert the scFv libraries into full-length CHO expression libraries, nested outer PCR primers were first used to add adapters with overhangs for Gibson assembly to the 5' and 3' ends of the scFv library (for rCIG, this was done after yeast scFv display enrichment, as described in the next section). Then NEBuilder HiFi DNA Assembly Master Mix (NEB) was used to insert the scFv library into a vector containing a single promoter, a secretory leader sequence for light chain immunoglobulin and the remainder of the IgG1 constant region, creating a cloned scFv library (GA1 backbone, FIG. 12A-12E; GenBank accession number MW079271). This intermediate library (GA1 product, FIG. 12A-12E; example plasmid sequence provided as GenBank accession number MW079272) was transformed into *E. coli* and plasmids were purified by either (1) spreading onto LB-ampicillin plates, scraping 0.5-1 million colonies and pooling or (2) inoculating directly into LB-ampicillin broth and growing overnight. Plasmid purification was performed using ZymoPURE II Plasmid Maxiprep Kits (Zymo Research). To create the full-length antibody library, a second Gibson assembly was performed by linearizing the GA1 product with BamHI-HF (rHIG) or NheI-HF (rCIG, rPIG, rhATG and rZIG) (NEB) and using it as a vector to insert a synthetic amplicon (Supplementary FIG. 2, GenBank accession number MW079275) containing a portion of the light chain immunoglobulin constant region, a poly(A) signal for light chain immunoglobulin, a promoter for the IgG gene and a secretory leader sequence for the IgG gene. The full-length library was then transformed into *E. coli* and spread on LB-ampicillin plates. >0.5 million colonies were combined and plasmid was purified with a ZymoPURE II Plasmid Maxiprep Kits (Zymo Research) to make the full-length recombinant hyperimmune globulin maxiprep library for transfection (GA2 product, FIG. 13A-13E; example plasmid sequence provided as GenBank accession number MW079273). When the transformed *E. coli* were inoculated directly into LB-ampicillin medium, a small volume of cells was plated to calculate the total number of transformants. In some cases, ampicillin was used for both plates and medium, whereas in other cases carbenicillin was used instead of ampicillin. Paired heavy and light chain libraries were made only once from each sample.

Enrichment for Antigen Binders by Yeast scFv Display

Polyclonal COVID-19 scFv libraries were sorted to enrich for relevant sequences. Briefly, yeast surface display scFv libraries were generated using COVID-19 scFv DNA libraries and a custom yeast surface display vector transformed by electroporation into EBY100 yeast strain (MYA-4941, ATCC). Surface displayed scFv sequences include a C-terminal myc tag to identify scFv expression with 1 µl per sample of undiluted anti-myc primary (A21281, Thermo Fisher Scientific) and 1 µl per sample of undiluted AF488 secondary antibody (A11039; Thermo Fisher Scientific). Binding to antigen was identified by staining with soluble biotinylated SARS-CoV-2 RBD antigen (SPD-C82E9, Acro Biosystems) at 1,200 nM and APC-streptavidin (SA1005, Thermo Fisher Scientific). Stained yeast libraries were sorted on a FACSMelody (BD Biosciences, with BD fluorescent activated cell sorting (FACS) Chorus software v.1.3.3) and double positive (AF488$^+$/APC$^+$) cells were collected. The gating strategy is outlined in FIG. 14A-14B. The collected cells were expanded and sorted again to further enrich the libraries. After the second round of sorting, cells were expanded a third time before plasmid isolation with a Zymoprep Yeast Plasmid Miniprep kit (Zymo Research). The plasmid libraries were then used as template for barcoding PCR and subsequent analysis by deep sequencing (Illumina). Plasmid from twice-sorted libraries was used as template for PCR toward full-length CHO antibody expression. Yeast scFv sorting was performed only once from each yeast scFv library.

Bioproduction of rHIG and rhATG

Adapted Flp-In-CHO cells stably expressing antibody libraries were grown in media consisting of 90% BalanCD CHO Growth A Medium (Irvine Scientific), 9% Ham's F-12 (Thermo Fisher Scientific), 1% FBS (Thermo Fisher Scientific), 4 mM Glutamax (Thermo Fisher Scientific), 0.2% anticlumping agent (Irvine Scientific), 600 µg ml$^{-1}$ Hygromycin-B (Gemini Bio). Protein production was performed at either small (250 ml) or medium (5 l) scale. For small-scale production, cells were seeded at $1 \times 10^6$ cells per ml into 50 ml of media in a 250 ml Erlenmeyer flask and grown at 37° C., 5% $CO_2$, 125 r.p.m. Cells were continually grown under these conditions and supplemented with 7.5 ml of CHO Feed 1 (Irvine Scientific) on days 2, 4 and 7 of the production run. Supernatant was harvested on days 8 or 9 by centrifugation followed by filtration through a 0.22-µm 250 ml filter bottle (MilliporeSigma) with a 1 µm prefilter (MilliporeSigma). Harvested cell culture fluid (HCCF) was stored at 4° C. (if less than 1 week) or at −80° C. (if more than 1 week) until Protein A purification. For medium-scale production, cells were grown in the same media. Cells were then seeded at $1 \times 10^6$ cells per ml in 2.3 l in a 5 l flask (in duplicate, day 0). Each flask was fed with 345 ml of CHO Feed 1 (Irvine Scientific) on days 2 and 4 of the culture. Cultures were gathered on days 8 or 9. Each of the four rhATG protein libraries were produced separately. Bioproduction was performed twice each for rHIG and rhATG.

Bioproduction of rPIG, rZIG and rCIG

CSS-1286 CHO cells stably expressing antibody libraries were grown in media without glutamine (EX-CELL CHOZN Advanced, MilliporeSigma). Protein production was performed at either small (500 ml flask) or medium (5 l flask) scale. For small-scale production, cells were seeded at $0.5 \times 10^6$ cells per ml into 100 ml media in a 500 ml Erlenmeyer flask and grown at 37° C., 5% $CO_2$, 125 r.p.m. Cells were continually grown under these conditions and supplemented with 15 ml of CHO Feed 1 (MilliporeSigma) on day 3, and 10 ml of CHO Feed 1 (MilliporeSigma) on days 6 and 8 of the production run. Starting on day 3, glucose was measured each day and supplemented to 6 gl$^{-1}$ if below 4 gl$^{-1}$. Supernatant was harvested after cell viability peak and before dropping below 70% viability between days 9 and 11, centrifuged and filtered through a 0.22-µm 250 ml filter bottle (MilliporeSigma) with a 1 µm prefilter (MilliporeSigma). HCCF was stored at 4° C. (if less than 1 week) or at −80° C. (if more than 1 week) until Protein A purification. For medium-scale production, cells were grown in the same media. Cells were seeded at $0.5 \times 10^6$ cells per ml in 2.2 L in a 5 L flask (in duplicate, day 0). Each flask was fed with 330 ml of CHO Feed 1 (MilliporeSigma) on day 3 and 220 ml of CHO Feed 1 (MilliporeSigma) on days 6 and 8 of the production run. Starting on day 3, glucose was measured each day and supplemented to 6 g L$^{-1}$ if below 4 gl$^{-1}$. Cultures were gathered on days 10-12. Bioproduction was performed three times for rCIG and twice each for rZIG and rPIG.

Protein Production and Characterization

After harvest, HCCF was purified using MabSelect PrismA (Cytiva) using 1×PBS (Teknova) for running and wash buffer, 0.1 M Citrate, pH 3.0 (Teknova) for elution and 1 M sodium citrate pH 6.0 (Teknova) for neutralization. The protocol was 10 column volumes (CV) of equilibration, HCCF loading, 10 CV of washing and 5-10 CV of elution followed by cleaning-in-place with 1 M NaOH. HCCF was loaded with a 1-min residence time. Eluted material was neutralized to a pH of roughly 4.5 and centrifuged to remove any precipitation. This material was dialyzed into 0.2 M glycine, pH 4.5 (Teknova) using a 20K molecular weight cutoff dialysis cassette (Thermo Fisher Scientific) and optionally concentrated up to 30 mg ml$^{-1}$ using a 50 kDa molecular weight cutoff spin device (MilliporeSigma). Final material was sterilized with a 0.22 μm filter and quantified by A280 (NanoDrop, Thermo Fisher Scientific). For rhATG, each of the four libraries were purified by Protein A separately and then equally pooled based on mass.

Purity of the protein was determined by size-exclusion-HPLC. Here, 20 μg of material at 1 mg ml$^{-1}$ was injected over a 300 Å, 2.7 μm, 7.8×300 mm size-exclusion column (Agilent) using a mobile phase of 25 mM phosphate, 200 mM NaCl pH 7.0 with 10% acetonitrile at 1 ml min$^{-1}$. The percentage of monomer was determined by integrating the product peaks and reporting the percent area corresponding to roughly 150 kDa. The product was further characterized by running 2 μg on a 12% SDS-PAGE gel under reduced and nonreduced buffering conditions and imaged after staining with SimplyBlue SafeStain (Thermo Fisher Scientific).

Protein production was performed once for each of the bioproduction runs.

Statistical Analysis

All statistical tests were performed on nonnormalized data, two-sided without adjustments to type I error rates. A significance threshold of $\alpha=0.05$ was used for all statistical tests. All statistical analyses were conducted using R v.3.6.2.

For FIG. 8F, a Wilcoxon rank sum test was used to compare the minimum concentration to achieve SARS-CoV-2 live virus neutralization between convalescent plasma measurements (n=16) and rCIG measurements (n=2).

For FIG. 9B, simple linear regression was used to calculate the coefficient of determination ($R^2$) between Zika and dengue ELISA $EC_{50}$ values. $EC_{50}$ values for all dengue serotypes were pooled for the analysis. Significance of the regression model was determined using an F-statistic with 1 and 10 degrees of freedom (d.f.). All measurements were performed in a single experiment. No power analysis was carried out to predetermine an appropriate sample size for this experiment.

For FIG. 9C, simple linear regression was used to calculate the coefficient of determination ($R^2$) between Zika and dengue pseudotype neutralization half-maximum inhibitory concentration ($IC_{50}$) values. $IC_{50}$ values for all dengue serotypes were pooled for the analysis. Significance of the regression model was determined using an F-statistic with 1 and 10 d.f. All measurements were performed in a single experiment. No power analysis was carried out to predetermine an appropriate sample size for this experiment.

For FIG. 10D, fold improvement over IVIG, by assay (ELISA or opsonophagocytosis) was tested using a one-sample Wilcoxon signed rank test, with the null hypothesis that the median equals 1, that is, $H_0=1$. For each assay, all individual serotypes were pooled using a single Wilcoxon signed rank test. Values for each individual serotype were generated by dividing the mean of duplicate rPIG measurements by the mean of duplicate IVIG measurements. All measurements were performed in a single experiment. No power analysis was carried out to predetermine an appropriate sample size for this experiment.

For FIG. 10E, Welch's t-tests were used to compare colony forming units (CFU) Hib per ml between test groups and d.f. were 7.87 for IVIG+rHIG/rPIG (500 mg kg$^{-1}$) and 7.13 for IVIG+rHIG/rPIG (200 mg kg$^{-1}$) in peritoneal fluid, and were 10.87 for IVIG+rHIG/rPIG (500 mg kg$^{-1}$) and 8.03 for IVIG+rHIG/rPIG (200 mg kg$^{-1}$) in blood. All measurements were performed in a single experiment. No power analysis was carried out to predetermine an appropriate sample size for this experiment.

For FIG. 11B, linear mixed effects models were used to compute P values for each of the four cell types, with group and concentration as fixed effects and PBMC donor as a random effect to account for the dependence of repeated measures: the d.f. were 31 for each of the four models. All measurements were performed in a single experiment. No power analysis was carried out to predetermine an appropriate sample size for this experiment.

For FIG. 11C and FIG. 48A-48B, Kaplan-Meier survival models were fit on time to mortality and pairwise log-rank tests were performed to compare median survival between treatment groups. All measurements were performed in a single experiment. No power analysis was carried out to predetermine an appropriate sample size for this experiment.

For FIG. 11D and FIGS. 49A-49B, linear mixed effects models were used to compute P values for trends in CD45$^+$ cell counts in each of the four GVH experiments (2 PBMC donors×2 drug dosing regimens=4 experiments) with day as a fixed effect and PBMC donor as a random effect to account for the dependence of repeated measures. A Wilcoxon rank sum test was used to compare CD45$^+$ cell counts on day 9 for saline negative control versus rhATG and saline negative control versus rabbit-ATG, in each of the four GVH experiments (2 PBMC donors×2 drug dosing regimens=4 experiments). No power analysis was carried out to predetermine an appropriate sample size for this experiment.

For FIGS. 23A-23C, 33A-33B, 40A-40B and 41A-41B, it was assessed whether batch-to-batch variation was more significant than the variability inherent to the assays used to make the measurements.

For rCIG pseudotype neutralization assays (FIG. 23A-23C), Feltz and Miller's asymptotic test was used to determine whether the coefficient of variation of three bioproduction batch $IC_{50}$ measurements (18%) was different from the coefficient of variation of eight $IC_{50}$ measurements on a fourth bioproduction batch (17%).

To assess batch variation in antibody sequence content, the Wilcoxon rank sum test was used to test whether the Jaccard or Morisita indices from PCR replicates from each bioproduction batch came from the same populations as the Jaccard or Morisita indices among bioproduction batches. Sequencing was performed in a single experiment. No power analysis was carried out to predetermine an appropriate sample size for this experiment.

Data Availability

Plasmid and cloning insert sequences are available on GenBank (GA1 backbone, GenBank accession number MW079271; GA1 product, GenBank accession number MW079272; synthetic amplicon insert, GenBank accession number MW079275; GA2 product, example plasmid sequence provided as GenBank accession number MW079273; PMD-4681, GenBank accession number MW079274. Sequencing data are available in the Short Read Archive under project identifier PRJNA649279.

Methods

Sourcing Human Materials

Local ethical regulations were followed and informed consent was obtained for all human sample collection.

rCIG: A contract research organization (CRO; Access Biologics, New Orleans, La., USA) recruited under sample collection protocol #PRO00026464 (Advarra, Columbia, Md., USA) approved by Institutional Review Board (IRB) and included if donors were 12-46 days (average 24 days+/−14 days) from the onset of two or more COVID-19 symptoms (fever, cough, shortness of breath, sore throat, and pneumonia). Sixty mL of whole blood was collected in ACD tubes, de-identified, and transported overnight to GigaGen for processing. 16 donors with high SARS CoV-2 Spike antigen-specific antibodies by ELISA (as described below) were included in rCIG and were predominantly Caucasian (87.5%), female (75%), aged 49 (+/−17 years), collected 21 days (+/−6 days) from onset of symptoms, and were approximately equally distributed, with 6 donors with 2 symptoms, 6 donors with 3 symptoms, and 4 donors with 4 symptoms.

rHIG: A contract research organization (BloodCenter Wisconsin, Milwaukee, Wis., USA) vaccinated two donors (Donor 1, a 26-year-old Caucasian female, and Donor 2, a 21-year-old Asian male) with PedvaxHIB vaccine (Merck, Kenilworth, N.J., USA). Leukapheresis was performed eight or nine days later to obtain PBMCs. In parallel, plasma was isolated from separate blood draws on the day of leukapheresis and prior to vaccination. ELISA was performed against Hib (Alpha Diagnostics, San Antonio, Tex., USA; see methods below) on the plasma samples to confirm a response to the vaccine as compared to plasma from the same donors prior to vaccination. Sample collection protocols were approved by IRB protocol #PRO00028063 (Medical College of Wisconsin/Froedtert Hospital IRB) to GigaGen. Informed consent was obtained from all participants and samples were shipped to GigaGen de-identified.

rPIG: A contract research organization (AllCells, Alameda, Calif., USA) vaccinated three donors (Donor 1, 57-year-old Caucasian male; Donor 2, 44-year-old Caucasian male; Donor 3, 35-year-old Caucasian/Asian male) with Pneumovax®23 vaccine (Merck, Kenilworth, N.J., USA). 60 mL blood draw was performed eight days later. Plasma and pan-B cells were isolated from whole blood (see methods below). ELISA was performed against a mixture of all 23 pneumococcal polysaccharides (Alpha Diagnostics, San Antonio, Tex., USA; see methods below) on the plasma samples to confirm response to the vaccine. Sample collection protocols were approved by IRB protocol #7000-SOP-045 (Alpha IRB, San Clemente, Calif., USA) to AllCells. Informed consent was obtained from all participants and samples were shipped to GigaGen de-identified.

Processing Human Materials

For whole blood, PBMCs and plasma were isolated using density gradient centrifugation SepMate tubes with Lymphoprep medium (StemCell Technologies, Vancouver, BC, Canada). To isolate pan-B cells from PBMCs (from either whole blood or a leukopak), the Human EasySep Pan-B Cell Enrichment Kit (StemCell, Vancouver, BC, Canada) was used. After isolation, the cells were cryopreserved using CryoStor® CS10 (StemCell Technologies, Vancouver, BC, Canada). Immediately prior to generating paired heavy and light chain libraries, cells were thawed, washed in cold DPBS+0.5% BSA, assessed for viability with Trypan blue on a disposable hemocytometer (Bulldog Bio, Portsmouth, N.H., USA) or with AOPI on a Cellometer K2 (Nexcelom Bioscience, Lawrence, Mass., USA), and then re-suspended in 12% OptiPrep™ Density Gradient Medium (Sigma, St. Louis, Mo., USA) at 5,000-10,000 cells per µl. This cell mixture was used for microfluidic encapsulation as described below.

Immunization of Trianni Mouse® Mice

Local ethical regulations were followed for mouse immunizations, by Antibody Solutions IACUC (Sunnyvale, Calif., USA).

Humanized mice were engineered by Trianni (San Francisco, Calif., USA). Trianni mice were bred and obtained from Charles River Laboratories (Wilmington, Mass., USA). All mice were male and 12-15 weeks old at the start of the immunization process. Antibody Solutions (Santa Clara, Calif., USA) performed all Trianni Mouse immunizations. Local ethical regulations were followed for mouse immunizations by the Antibody Solutions IACUC. The mice were ear marked for identification by the breeder and housed in individually ventilated cages (Innovive, San Diego, Calif., USA) and racks with HEPA filtered air at a density of up to 5 mice per cage. The animal room was lighted entirely with artificial fluorescent lighting, with a controlled 12 h light/dark cycle (7 am to 7 pm light). The normal temperature and relative humidity ranges in the animal rooms were 20-22.2° C. and 30-70%, respectively. The animal rooms were set to have up to 10 air exchanges per hour. Sunnyvale municipal tap water and rodent chow (Teklad Global, Indianapolis, Ind., USA) were provided ad libitum.

rZIG: Two Trianni humanized mice were immunized consecutively weekly with Zika VLP, inactivated Dengue 1, inactivated Dengue 4, inactivated Dengue 3, then inactivated Dengue 2 with alhydrogel/muramyl dipeptide (ALD/MDP) adjuvant. Animals were checked for antibody titer and boosted with Zika VLPs without adjuvant 5 days before harvest (Antibody Solutions, Santa Clara, Calif., USA).

rhATG: Two Trianni humanized mice were immunized weekly with human thymocytes from 5 de-identified specimens acquired from a CRO (Vitalant Research Institute, San Francisco, Calif., USA) for 5 weeks with ALD/MDP adjuvant and boosted on week 6 without adjuvant. Three Trianni mice were immunized weekly for 5 weeks with Pan T cells (StemCell, Vancouver, Canada) in ALD/MDP isolated from PBMCs from 1 de-identified donor (StemCell), checked for an elevated antigen-specific antibody titer, and boosted with the same cells 5 days before harvest without adjuvant (Antibody Solutions, Santa Clara, Calif., USA).

After sacrifice, spleen, lymph nodes, and/or bone marrow were harvested and processed into a single cell suspension. Samples from multiple mice were pooled together by tissue and pan-B cells were isolated from spleen and lymph node tissue using the EasySep Mouse Pan-B Cell Enrichment Kit (StemCell Technologies, Vancouver, BC, Canada). CD138+ cells were isolated from bone marrow using Miltenyi CD138+ mouse microbeads (Miltenyi, Bergisch Gladbach, Germany). After isolation, the cells were cryopreserved using CryoStor® CS10 (StemCell Technologies, Vancouver, BC, Canada).

Generating Paired Heavy and Light Chain Libraries

Generation of scFv libraries from antibody-producing cells (Adler et al., 2017) comprises three steps: (i) poly(A)+ mRNA capture, (ii) multiplexed overlap extension reverse transcriptase polymerase chain reaction (OE-RT-PCR), and (iii) nested PCR. Briefly, a microfluidic device captures single cells in droplets with a mixture of lysis buffer and oligo dT beads (NEB, Ipswich, Mass., USA). After the cell is lysed and mRNA is bound to the bead, the emulsion is broken, and the mRNA-containing beads are purified. Next, an emulsion is created using OE-RT-PCR reagents and the beads as template. The emulsion is subjected to thermal cycling which creates cDNA, amplifies the IgK and IgG variable regions, and links them together in an scFv format. Then the emulsion is broken and the linked scFv DNA product is extracted and purified. The purified scFv product is then amplified using nested PCR to remove artifacts and add adapter sequences. Depending on the adapter sequences, the product can be used for deep sequencing, yeast display libraries, or full-length CHO expression.

To convert the scFv libraries into full-length CHO expression libraries, nested outer PCR primers were first used to add adapters with overhangs for Gibson assembly to the 5' and 3' ends of the scFv library (for rCIG, this was done after yeast scFv display enrichment, as described in the next section). Then NEBuilder HiFi DNA Assembly Master Mix (NEB, Ipswich, Mass., USA) was used to insert the scFv library into a vector containing a single promoter, a secretory leader sequence for light chain Ig and the remainder of the IgG1 constant region, creating a cloned scFv library. This intermediate library was transformed into E. coli and plasmids were purified by either (a) spreading onto LB-ampicillin plates, scraping 0.5-1 million colonies and pooling or (b) inoculating directly into LB-ampicillin broth and growing overnight. Plasmid purification was performed using ZymoPURE II Plasmid Maxiprep Kits (Zymo Research, Irvine, Calif., USA). To create the full-length antibody library, a second Gibson assembly was performed by linearizing the product of GA1 with BamHI-HF (rHIG) or NheI-HF (rCIG, rPIG, rhATG, and rZIG) (NEB, Ipswich, Mass., USA) and using it as a vector to insert a synthetic amplicon containing a portion of the light chain Ig constant region, a poly(A) signal for light chain Ig, a promoter for the IgG gene and a secretory leader sequence for the IgG gene. The full-length library was then transformed into E. coli and spread on LB-ampicillin plates. >0.5 million colonies were combined and plasmid with a ZymoPURE II Plasmid Maxiprep Kits (Zymo Research, Irvine, Calif., USA) was purified to make the full-length recombinant hyperimmune maxiprep library for transfection. When the transformed E. coli were inoculated directly into LB-ampicillin broth, a small volume of cells was plated to calculate the total number of transformants. In some cases ampicillin was used for both plates and broth, in other cases carbenicillin was used instead. Paired heavy and light chain libraries were made only once from each sample.

Enrichment for Antigen Binders by Yeast scFv Display

Polyclonal COVID-19 scFv libraries were sorted (Adler et al., 2017) to enrich for relevant sequences. Briefly, yeast surface display scFv libraries were generated using COVID-19 scFv DNA libraries and a custom yeast surface display vector transformed by electroporation into EBY100 yeast strain (MYA-4941; ATCC, Manassas, Va., USA). Surface displayed scFv sequences include a C-terminal myc tag to identify scFv expression with an anti-myc primary (A21281; Thermo Fisher Scientific, Waltham, Mass., USA) and AF488 secondary antibody (A11039; Thermo Fisher Scientific, Waltham, Mass., USA). Binding to antigen was identified by staining with soluble biotinylated SARS CoV-2 receptor binding domain antigen (SPD-C82E9; Acro Biosystems, Newark, Del., USA) at 1200 nM and APC-streptavidin (SA1005; Thermo Fisher Scientific, Waltham, Mass., USA). Stained yeast libraries were sorted on a FACSMelody (BD Biosciences, San Jose, Calif., USA) and double positive (AF488+/APC+) cells were collected. The gating strategy is outlined in Supplementary Figure S2. The collected cells were expanded and sorted again to further enrich the libraries. After the second round of sorting, cells were expanded a third time prior to plasmid isolation with a Zymoprep Yeast Plasmid Miniprep kit (Zymo Research, Irvine, Calif., USA). The plasmid libraries were then used as template for barcoding PCR and subsequent analysis by deep sequencing (Illumina, San Diego, Calif., USA). Plasmid from twice-sorted libraries was used as template for PCR towards full-length CHO antibody expression. Yeast scFv sorting was performed only once from each yeast scFv library.

Cell Line Used for rHIG and rhATG

The adherent Flp-In™-CHO cell line with a genetically integrated FRT site (Thermo Fisher Scientific, Waltham, Mass., USA) was adapted to suspension culture. For all steps in the adaptation process, "Ham's F-12" refers to Ham's F-12 (with L-glutamine, Thermo Fisher Scientific, Waltham, Mass., USA) plus 10% FBS (Thermo Fisher Scientific, Waltham, Mass., USA), and "BalanCD" refers to BalanCD CHO Growth A (Irvine Scientific, Santa Ana, Calif., USA) with 4 mM Glutamax (Thermo Fisher Scientific, Waltham, Mass., USA). To adapt this cell line to suspension, the cells were first passaged into a mixture of 50% Ham's F-12 plus 50% BalanCD in T-flasks. Cells were next passaged into 25% Ham's F-12 plus 75% BalanCD and switched to shaking Erlenmeyer flasks. Cells were then passaged into 10% Ham's F-12, 90% BalanCD+0.2% anti-clumping agent (Irvine Scientific, Santa Ana, Calif., USA) and banked for future use.

Approximately 100 million of the adapted Flp-In CHO cells were transfected per recombinant hyperimmune globulin library using an Amaxa Nucleofector 4D (SG buffer, pulse DU133; Lonza, Basel, Switzerland). These cells were plated into shaking Erlenmeyer flasks and recovered in an incubator at 37° C., 5% $CO_2$, 125 rpm. After 48 hours, the cells were counted to determine viability, cells were seeded at 1 million cells/mL, and selection was started using 600 µg/mL Hygromycin-B (Gemini Bio, West Sacramento, Calif., USA) in fresh media. Cells were counted and media was changed every 2-3 days during the 7-day selection. The libraries were kept on 600 µg/mL Hygromycin-B (Gemini Bio, West Sacramento, Calif., USA) during expansion until viability exceeded 95%. When cells were >95% viable and doubling every 24 hours, the adapted Flp-In™-CHO cell line was banked for liquid nitrogen storage. Before banking, cells were sampled from each library, RNA was purified, and antibody RNA-seq (Illumina, San Diego, Calif., USA) was performed to assess the diversity of the libraries (Table 13 and 17).

Cell Line Used for rPIG, rZIG, and rCIG

A landing pad construct (FIG. 13E, PMD-4681; GenBank accession number MW079274) was designed and cloned at GigaGen. PMD-4681 was based on pFRT-lacZeo (Thermo Fisher Scientific, Waltham, Mass., USA), with some modifications. In place of the LacZ expression construct a cassette was inserted coding for expression of CD34 and GFP. The CD34, GFP, and downstream Zeocin resistance genes (ZeoR present in pFRT-lacZeo) were separated by 2A motifs (T2A or P2A) to allow for translation of three separate polypeptide chains. The CD34 sequence was sourced as a gBlock from IDT (Coralville, Iowa, USA). The GFP sequence was sourced from ATUM (DasherGFP; Newark, Calif., USA).

The GMP suspension CHO line CHOZN® GS-/- was obtained from MilliporeSigma (St. Louis, Mo., USA). PMD-4681 was linearized using ScaI-HF and purified via ethanol precipitation. Cells were transfected with the linearized DNA using Amaxa Nucleofector 4D, SE kit, pulse CM-150 (Lonza, Basel, Switzerland). Cells recovered overnight in an incubator and were plated the next day into minipools at approximately 5,000 cells per well, across ten 96-well plates in selective media. The remaining cells were plated and selected together as a bulk pool control. Wells were topped off with fresh media every seven days until at least 80% confluency was reached.

A total of 236 minipools grew out and were screened in parallel for high GFP expression via flow cytometry and low copy number with a quantitative PCR Copy Number Variation (CNV) assay. Minipools with a copy number less than 2.5 and GFP expression at least 50% of the bulk pool were expanded into shaking adaptation. Expanded pools were re-tested for GFP expression via flow cytometry.

Cells were then adapted to BalanCD CHO Growth A in preparation for plating into semi-solid media. Minipools were deemed fully adapted when cells showed consistent doubling times and high viability (>90%). Adapted cells were plated into semisolid media for the Molecular Devices (Fremont, Calif., USA) ClonePix3 single cell cloning platform. Single cell imaging was obtained on day 0 of cell plating in semisolid media to confirm monoclonality. After 14 days, clonal cell colonies were picked and deposited as one colony per well of a 96-well plate. Each clone was then expanded, re-adapted to selection media, and cryopreserved. Doubling times were calculated and clones with less than a 30-hour doubling time were chosen for further development. Expanded clones were retested for GFP expression and copy number.

Remaining clones were transfected in duplicate using the Gene Pulser Xcell Total System (BioRad, Hercules, Calif., USA) per guidelines from MilliporeSigma (St. Louis, Mo., USA) for use with CHOZN GS with a monoclonal antibody (mAb)-cyan fluorescent protein (FrostyCFP, ATUM, Newark, Calif., USA) construct to test expression titer. CFP expression was evaluated via flow cytometry 3 days post transfection to confirm transfection efficiency >35%. After full selection and recovery, cell lines were tested in a 10-day fed batch TPP shaking production run in duplicate. Titers for candidate cell lines ranged from 50-100 mg/L. A single clone (CSS-1286) was selected to use for recombinant hyperimmune expression.

For transfection of recombinant hyperimmune globulins into CSS-1286, approximately 50 million cells were transfected per recombinant hyperimmune globulin library using the BioRad Gene Pulser Xcell Total System (Hercules, Calif., USA), per guidelines from MilliporeSigma (St. Louis, Mo., USA) for use with CHOZN GS. The cells were plated into T-75 flasks (approximately 10 million cells per flask) and recovered in an incubator at 37° C., 5% $CO_2$ for 72 hours. After 72 hours, the cells were counted to determine viability and then seeded into 100 mL fresh media without glutamine (EX-CELL CD CHO Fusion, MilliporeSigma, St. Louis, Mo., USA) in a 500 mL Erlenmeyer flask. Cells were counted and media was changed every 2-3 days during the ~14-day selection. When cells were >95% viable and doubling every 24 hours, the cell line was banked for liquid nitrogen storage. Before banking, cells were sampled from each library, RNA was purified, and antibody RNA-seq (Illumina, San Diego, Calif., USA) was performed to assess the diversity of the libraries (Tables 9, 11, 14).

Bioproduction of rHIG and rhATG RPP

Adapted Flp-In™-CHO cells stably expressing antibody libraries were grown in media consisting of 90% BalanCD CHO Growth A Medium (Irvine Scientific, Santa Ana, Calif., USA), 9% Ham's F-12 (Thermo Fisher Scientific, Waltham, Mass., USA), 1% FBS (Thermo Fisher Scientific, Waltham, Mass., USA), 4 mM Glutamax (Thermo Fisher Scientific, Waltham, Mass., USA), 0.2% anti-clumping agent (Irvine Scientific, Santa Ana, Calif., USA), 600 µg/mL Hygromycin-B (Gemini Bio, West Sacramento, Calif., USA). Protein production was performed at either small (250 mL) or medium (5 L) scale. For small-scale production, cells were seeded at $1\times10^6$ cells/mL into 50 mL media in a 250 mL Erlenmeyer flask and grown at 37° C., 5% $CO_2$, 125 rpm. Cells were continually grown under these conditions and supplemented with 7.5 mL CHO Feed 1 (Irvine Scientific, Santa Ana, Calif., USA) on Days 2, 4 and 7 of the production run. Supernatant was harvested on Day 8 or 9 by centrifugation followed by filtration through a 0.22 µm 250 mL filter bottle (MilliporeSigma, St. Louis, Mo., USA) with 1 µm pre-filter (MilliporeSigma, St. Louis, Mo., USA). Harvested cell culture fluid (HCCF) was stored at 4° C. (if less than 1 week) or at −80° C. (if more than one week) until Protein A purification. For medium-scale production, cells were grown in the same media. Cells were then seeded at $1\times10^6$ cells/mL in 2.3 L in a 5 L flask (in duplicate; Day 0). Each flask was fed with 345 mL CHO Feed 1 (Irvine Scientific, Santa Ana, Calif., USA) on Days 2 and 4 of the culture. Cultures were harvested on Day 8 or 9. Each of the four rhATG protein libraries were produced separately.

Bioproduction of rPIG, rZIG, and rCIG RPP

CSS-1286 CHO cells stably expressing antibody libraries were grown in media without glutamine (EX-CELL CHOZN Advanced; MilliporeSigma, St. Louis, Mo., USA). Protein production was performed at either small (250 mL) or medium (5 L) scale. For small-scale production, cells were seeded at $0.5\times10^6$ cells/mL into 100 mL media in a 500 mL Erlenmeyer flask and grown at 37° C., 5% $CO_2$, 125 rpm. Cells were continually grown under these conditions and supplemented with 15 mL CHO Feed 1 (MilliporeSigma, St. Louis, Mo., USA) on Day 3, and 10 mL CHO Feed 1 (MilliporeSigma, St. Louis, Mo., USA) on Days 6 and 8 of the production run. Starting on Day 3, glucose was measured each day and supplemented to 6 g/L if below 4 g/L. Supernatant was harvested after cell viability peak and before dropping below 90% viability between Days 9-11, centrifuged and filtered through a 0.22 µm 250 mL filter bottle (MilliporeSigma, St. Louis, Mo., USA) with 1 µm pre-filter (MilliporeSigma, St. Louis, Mo., USA). HCCF was stored at 4° C. (if less than 1 week) or at −80° C. (if more than one week) until Protein A purification. For medium-scale production, cells were grown in the same media. Cells were seeded at $0.5\times10^6$ cells/mL in 2.2 L in a 5 L flask (in duplicate; Day 0). Each flask was fed with 330 mL CHO Feed 1 (MilliporeSigma, St. Louis, Mo., USA) on Day 3 and 220 mL CHO Feed 1 (MilliporeSigma, St. Louis, Mo., USA) on Days 6 and 8 of the production run. Starting on Day 3, glucose was measured each day and supplemented to 6 g/L if below 4 g/L. Cultures were harvested on Day 10-12.

RPP Protein Production and Characterization

After harvest, HCCF was purified using a 1 mL or 5 mL HiTrap MabSelect PrismA Protein A Column (GE Life Sciences, Marlborough, Mass., USA) using the following buffers: 1×PBS pH 7.0-7.4 (Teknova, Hollister, Calif., USA) for running and wash buffer, 0.1 M Citrate Buffer, pH 3.0 (Teknova, Hollister, Calif., USA) for elution buffer, 1 M Sodium Citrate, pH 6.0 (Teknova, Hollister, Calif., USA) for neutralization. The column was washed at 10 mL/min until UV was stable, then sample was injected at 5 mL/min. The column was washed with 10 column volumes at 10 mL/min. Protein was eluted using elution buffer at 5 mL/min, collecting 1 mL fractions. Fractions were then pooled. Pooled sample was neutralized slowly using 1 M Sodium Citrate to a pH of ~5.0. Neutralized sample was centrifuged at 5000×g to remove any precipitation, then dialyzed overnight into 0.2 M glycine, pH 4.5 (Teknova, Hollister, Calif., USA) using a 20K MWCO Dialysis Cassette (Thermo Fisher Scientific, Waltham, Mass., USA). Buffer was changed once, then sample was removed, spun down to remove any precipitant, filtered through a 0.22 μm filter and quantified by A280 (NanoDrop; Thermo Fisher Scientific, Waltham, Mass., USA). For rhATG, each of the four libraries were purified by Protein A separately and then equally pooled based on mass.

Purity of the protein was determined by SEC-HPLC. 20 μg of material at 1 mg/mL was injected over a 300 Å, 2.7 μm, 7.8×300 mm size exclusion column (Agilent, Santa Clara, Calif., USA) using a mobile phase of 25 mM phosphate, 200 mM NaCl pH 7.0 with 10% acetonitrile at 1 mL/min. The percent monomer was determined by integrating the product peaks and reporting the percent area corresponding to ~150 kDa. The product was further characterized by running 2 μg on a 12% SDS-PAGE gel under reduced and non-reduced buffering conditions, and imaged after staining with SimplyBlue SafeStain (Thermo Fisher Scientific, Waltham, Mass., USA).

Medium-Scale Production, Polishing, and Stress Testing of rCIG

For bioreactor production at 3 L scale, a seed train protocol was devised to mimic the number of passages required for production at up to 2,000 L scale. For each bioreactor production run, a single vial of rCIG cell bank was thawed at 37° C. and the contents of the vial were transferred to 10 mL of EX-CELL CD CHO Fusion media (MilliporeSigma, St. Louis, Mo., USA). The cells were then centrifuged for 5 minutes at 500×g. The supernatant was aspirated and discarded, and the cells were re-suspended in 5 mL of EX-CELL CD CHO Fusion. The entire volume of cells was seeded into a 250 mL non-baffled, vented shake flask at a final volume of 50 mL. The shake flask was incubated at 37° C., 5% $CO_2$, >80% humidity and 125 RPM (25 mm orbital diameter). Three days post thaw the viable cell density (VCD) was $4.0$-$6.0\times10^6$ vc/mL with a viability ≥90%. At this point the cells were passaged using EX-CELL CD CHO Fusion into a 1000 mL shake flask at a seeding density of $0.4\times10^6$ vc/mL. In a similar manner, the culture was passaged once more into a 1000 mL shake flask, and then two more times into 1000 mL spinner flasks. The final passage before bioreactor inoculation was done in EX-Cell Advanced CHO Fed Batch media (MilliporeSigma, St. Louis, Mo., USA).

Three days after completing the fifth passage, three 3 L Mobius single-use bioreactors (MilliporeSigma, St. Louis, Mo., USA) were seeded using the culture. Each bioreactor was prepared with 1300 mL of EX-Cell Advanced CHO Fed Batch media and then seeded at a VCD of $0.4\pm0.1\times10^6$ vc/mL. Additional media was added if required to have an initial working volume of 1600 mL. Each bioreactor was controlled using the following set points: temperature setpoint Days 0-4 setpoint 37° C.; temperature Days 4-14 setpoint 32° C.; dissolved oxygen setpoint 30%; pH Days 0-3 7.0±0.2; pH Days 3-14 7.0±0.1. EX-Cell Advanced CHO Feed (MilliporeSigma, St. Louis, Mo., USA) and Cellvento 4Feed COMP (MilliporeSigma, St. Louis, Mo., USA) were added on Days 3, 5, 7, 9, and 11. Feed volumes were determined as a percentage of the current bioreactor volume, such that EX-Cell Advanced CHO Feed was added at 4% of the volume of the bioreactor and Cellvento 4Feed COMP was added at 2% of the volume of the bioreactor. Glucose levels were monitored daily, and starting on Day 3 were maintained above 4 g/L by adding a 45% Glucose solution until levels reached 6 g/L. The bioreactors were harvested after 14 days of culture. 5-10 million cells were collected from each bioreactor for antibody repertoire sequencing (FIG. 23A-23B).

For purification and polishing, an empty column was packed with MabSelect Sure PrismA resin (Cytiva, Marlborough, Mass., USA) and equilibrated with 20 mM phosphate, 150 mM NaCl, pH 7.4. Harvested cell-culture fluid was loaded at 20-40 g/L, washed with 20 mM phosphate, 500 mM NaCl, pH 7.4 and 50 mM phosphate, pH 6.0, and eluted with 50 mM sodium acetate, pH 3.5. The pH of the Protein A eluate was adjusted to 3.5 using 1 M acetic acid and the material was subjected to a 1 hour viral hold, after which it was adjusted to pH 5 using 1 M Tris-HCl, pH 9 and filtered to remove particulate. A second column was packed with POROS XS (Thermo Fisher Scientific, Waltham, Mass., USA) cation exchange (CEX) resin and equilibrated with 50 mM sodium acetate, pH 5.0. The filtered neutralized low pH hold pool was loaded on this column at 14-21 g/L, washed with 50 mM sodium acetate, 100 mM sodium chloride, pH 5.0, and eluted over a 20 CV gradient to 50 mM sodium acetate, 400 mM sodium chloride, pH 5.0. The product eluted with several distinct peaks, of which only the first was collected. The pooled CEX eluate was diluted with 20 mM tris-acetate, pH 7.4 to <8 mS/cm, then flowed through a Sartobind Q (Sartorious, Gottingen, Germany) anion-exchange membrane. The flowthrough was concentrated using a 30K molecular weight cutoff cellulose acetate tangential flow filtration cartridge (MilliporeSigma, St. Louis, Mo., USA), then diafiltered with 200 mM glycine pH 4.5 and sterile-filtered.

For stress testing, polished rCIG at 15 mg/mL in 200 mM glycine, pH 4.5 was incubated at 40° C. for 14 days. Separately, aliquots were subjected to 3 or 25 freeze-thaw cycles in a −80° C. freezer or dry ice/ethanol bath. The stressed samples were run on SEC-HPLC and SARS CoV-2 S1 ELISA and compared to a control that was stored at 4° C.

Deep Antibody Repertoire Sequencing

Deep antibody sequencing libraries were prepared as described previously (Adler et al., 2017), quantified using a KAPA quantitative PCR Illumina Library Quantification Kit (Roche, Mannheim, Germany), and diluted to 17.5 pM. Libraries were sequenced on a MiSeq (Illumina, San Diego, Calif., USA) using a 500 cycle MiSeq Reagent Kit v2, according to the manufacturer's instructions. To make sequencing libraries, tailed-end PCR was used to add Illumina sequencing adapters to the 5' and 3' ends of the constructs of interest. For scFv libraries (after droplet emulsion breaking or yeast plasmid isolation), a forward read of 340 cycles was used to capture the light chain CDR3 sequence, and a reverse read of 162 cycles was used to capture the linked heavy chain CDR3 sequence. For CHO libraries, the full-length heavy chain sequence was obtained using overlapping forward and reverse reads of 251 cycles. To determine the number of antibody clones in the final CHO cell libraries and for generating the clonal cluster analysis figures, 5-10 million CHO cells were harvested prior to a production run. For the batch-to-batch variation analysis, 5-10 million CHO cells were harvested at the conclusion of the replicate production runs, and a median of 855,746 sequence reads were obtained for each sequencing library (range: 658,013 to 1,113,968).

To determine the Fc subtype of a library, the heavy chain was amplified with a primer that binds further into the constant domain to add the Illumina sequencing adapter to the 3' end; the first 60 bp of the constant domain was sequenced to determine the subtype, which was linked to the corresponding CDR3H that was simultaneously sequenced. Each library was sequenced one time.

Sequence analysis, including error correction, reading frame identification, and FR/CDR junction calls was performed using our previously reported bioinformatics pipeline (Adler et al., 2017). Reads with E>1 (E is the expected number of errors) were discarded, to retain sequences for which the most probable number of base call errors is zero. Clones are defined as sequences with unique CDR3 amino acid sequences (CDR3K+CDR3H for scFv clones, CDR3H only for CHO clones). A more conservative clone count is also provided (combined CDR3), where unique clones were combined if they had 1 amino acid difference for 5-6 amino acid long CDR3s, or if they had 1-2 amino acid differences for >6 amino acid long CDR3s; this applies to a concatenation of CDR3K+CDR3H for scFv clones or CDR3H only for CHO clones).

For the clonal cluster analysis, USEARCH (Edgar, 2010) to compute the total amino acid differences between each pairwise alignment of full-length heavy chain sequences with abundance ≥0.01% in each CHO cell bank. Then the R package graph (version 1.2.4.1) was used to generate clustering plots for the pairwise alignments. The sequences were represented as "nodes", with the color (and sometimes shape) defined in the respective figures. The size of the nodes reflects the frequency of the clone (small, <0.1%; medium, 0.1-1%; large, >1%). "Edges" are the links between nodes, which indicate pairwise alignments with <5 amino acid differences. The layout with graphopt (niter=3000, charge=0.03) option was used to format the output. To visualize the sequences within a library, the top five clusters containing the highest number of connected nodes/sequences were selected. These sequences were aligned and visualized as sequence logos using the R package msa 1.16.0.

To assess antibody repertoire overlap between libraries, Jaccard and Morisita indices were computed using the R package tcR (version 2.3.2). Shannon entropy and Simpson diversity indices were calculated using the R package vegan 2.5.5. Heavy chain V and J gene identities were measured using the USEARCH[49]-local algorithm with the germline database as reference. For the heatmaps showing the pairing of VH and VL genes, the germline divergence histograms, and the histograms showing the distribution of heavy chain CDR3 length, each unique clone was plotted once (i.e., not scaled by sequencing read abundance).

To estimate the error rate due to RNA/cDNA amplification, a region of the heavy chain constant domain from the rCIG libraries (the region used to determine the heavy chain subtype) was sequenced, after performing the same amplification process as the final polyclonal libraries. The total error rate for this region was 0.3%, then using Illumina's quality (Q) score for each sequenced base, the estimated sequencing error rate for this region was determined to be 0.052%. Thus, the estimated maximum error rate from our amplification process is 0.3%-0.052%=0.248% (which may still contain some error due to natural sequence variation in the constant domain).

Sequencing data are available in the Short Read Archive (SRA) under project identifier PRJNA649279.

In vitro Efficacy Studies rCIG: Anti-SARS CoV-2 antibody reactivities were measured using a protocol based on published ELISA methods (Amanat et al., 2020). In brief, SARS CoV-2 Spike and RBD (wild type and variant proteins; Sino Biological, Wayne, Pa., USA) were used to coat ELISA plates at 2 µg/mL. Serial dilutions of antibody preparations including test plasma and recombinant products, positive control monoclonal antibodies (CR3022; Absolute Antibody, San Diego, Calif., USA, and SAD-535; Acro Biosystems, Newark, Del., USA) and negative control IVIG (Gamunex; Grifols, S. A., Sant Cugat, Spain) were performed in dilution buffer (1×PBS+0.05% Tween+0.3% dry milk) in singlet. Quantitative measurements were performed on a plate reader (Molecular Devices, Fremont, Calif., USA) and analyzed using Softmax Pro (Version 7.1; Molecular Devices, Fremont, Calif., USA) to calculate the EC50 concentrations of samples. The concentration of total IgG was calculated by Cedex Bioanalyzer Human IgG assay (Roche, Mannheim, Germany).

Blocking of binding between Spike RBD and ACE2 was demonstrated by ELISA (BPS Bioscience, San Diego, Calif., USA). In brief, SARS CoV-2 Spike RBD protein was coated onto an ELISA plate, serial dilutions of test plasma and recombinant products, positive control monoclonal antibodies (CR3022; Absolute Antibody, San Diego, Calif., USA, and SAD-S35; Acro Biosystems, Newark, Del., USA) and negative control IVIG (Gamunex; Grifols, S. A., Sant Cugat, Spain) were performed in singlet in dilution buffer (1×PBS+0.05% Tween+0.3% dry milk). After incubation, ACE2-His was added at 2.5 ng/mL. After further incubation, anti-His-horseradish peroxidase was added. The plate was developed for a chemiluminescent readout. Quantitative measurements were performed on a plate reader (Molecular Devices, Fremont, Calif., USA) and analyzed using Softmax Pro (Version 7.1; Molecular Devices, Fremont, Calif., USA) to calculate the EC50 concentrations of samples.

The SARS CoV-2 pseudotype virus neutralization assay was performed in a 96-well plate using ACE2 expressing HEK-293T target cells (CRL-11268; ATCC, Manassas, Va., USA) transiently transfected with TMPRSS-2 expression plasmid. The GFP reporter pseudotype virus expressing SARS-CoV-2 spike (Integral Molecular, Philadelphia, Pa., USA) was mixed with test plasma, test rCIG, positive control monoclonal antibodies (CR3022; Absolute Antibody, San Diego, Calif., USA, and SAD-S35; Acro Biosystems, Newark, Del., USA) and negative control IVIG (Gamunex; Grifols, S. A., Sant Cugat, Spain) at a five-fold dilution series in singlet. After one-hour incubation, $4 \times 10^4$ cells target cells were added to each well and incubated at 37° C. for 48 hours. After incubation, the media was removed from all wells without disturbing the adherent cells. TrypLE (Thermo Fisher Scientific, Waltham, Mass., USA) was added to each well and incubated for 3 minutes at 37° C. Media was added to stop trypsinization and cells were stained with DAPI and passed through a 30-40 µm filter (Pall Corporation, Port Washington, N.Y., USA) before quantifying GFP+ cells using a Cytoflex LX (Beckman Coulter, Indianapolis, Ind., USA). Flow cytometry data were analyzed by FlowJo (BD Biosciences, San Jose, Calif., USA).

SARS CoV-2 microneutralization assays were performed at the Regional Biocontainment Laboratory at Duke University Medical Center (Durham, N.C., USA) in a 96-well plate format using Vero E6 cells (CRL-1586; ATCC, Manassas, Va., USA) infected with 100 TCID50 dose of the 2019-nCoV/USA-WA1/2020 strain. Test and control samples were initially diluted to 1:50, then a 12-step, two-fold serial dilution of test antibodies was performed before infection of the cells; every test or control was run in duplicate. IVIG (Gamunex; Grifols, S. A., Sant Cugat, Spain) was used as negative control. Cell-only control wells were included alongside virus-only treated wells. Following 4 days of infection, culture media was removed, and cell monolayer was fixed with 10% neutral buffered formalin (NBF) and stained with 0.1% Crystal Violet. Absorbance at 590 nm or visual inspection was used to measure the monolayer condition/level of infection. Neutralization was reported as the lowest concentration of sample that prevents cytopathic effect in the monolayer of cells.

rZIG: Zika- and Dengue-specific antibodies were measured by ELISA. A 96-well microtiter plate was coated with either 2 µg/ml Zika or Dengue Serotype 1, 2, 3, or 4 recombinant envelope proteins (ProSpec Bio, East Brunswick, N.J., USA) in 1× carbonate coating buffer (BioLegend, San Diego, Calif., USA) and incubated overnight at 4° C. After blocking the coated plate with ultrablock buffer (Bio-Rad, Hercules, Calif., USA) and washing with PBS+ 0.05% Tween-20 (Teknova, Hollister, Calif., USA), eight-step three-fold serial dilutions in assay buffer (1×PBS+ 0.05% Tween+0.3% dry milk) were performed on rZIG-IgG1, rZIG-LALA, Zika/Dengue+serum positive control (Seracare, Milford, Mass., USA), and a negative control IVIG (Gamunex; Grifols, S. A., Sant Cugat, Spain). Dilutions were added in duplicate and incubated at 37° C. for 1 hour. Next, 1:2500 secondary rabbit anti-human IgG horseradish peroxidase conjugate (Southern Biotech 6140-05, Birmingham, Ala., USA) was added, and the plate was washed and developed using 3,3',5,5'-tetramethylbenzidine (TMB) substrate solution (Thermo Fisher Scientific, Waltham, Mass., USA). The reaction was halted after 8 minutes using sulfuric acid stopping solution (Southern Biotech, Birmingham, Ala., USA). Quantitative absorbance measurements were performed on a SpectraMax i3x plate reader (Molecular Devices, Fremont, Calif., USA) at 450 nm and 620 nm. Standard curves (OD450-620) were artificially set to max out at 2.97 absorbance value. EC50 values were calculated by non-linear regression analysis using GraphPad Prism v8 (San Diego, Calif., USA).

Zika and Dengue in vitro pseudotype neutralization assays were performed at Vitalant Research Institute (VRI, San Francisco, Calif., USA). rZIG, a Zika/Dengue-specific immune sera (UWIS; de-identified sample screened positive for Zika and Dengue 1-4 by University of the West Indies), monoclonal antibody positive control (UWI-mAb1; IgG1 isotype cloned from de-identified donor by University of the West Indies, found to be cross-reactive to Zika and Dengue 1-4), and IVIG negative control (Gamunex; Grifols, S. A., Sant Cugat, Spain) were co-incubated with reporter virus particles (RVPs; Integral Molecular, Philadelphia, Pa., USA) expressing both luciferase and flavivirus-specific glycoproteins as previously described. Briefly, BHK/DC-SIGN cells (CRL-325; ATCC, Manassas, Va., USA) were seeded in black 96-well plates and then incubated with a 7-step, 3-fold serial dilution of antibodies pre-incubated for one hour at 37° C. with RVPs and tested in duplicate. After 72 hours cells were lysed and luciferase activity measured using lysis buffer and firefly luciferase substrate following manufacturer's guidelines (Promega, Madison, Wis., USA). Infection-induced relative light units (RLU) in the presence of test articles were calculated as the RLU of the test article divided by the RLU of a no-serum control infection. The amount of protein required to inhibit 50% of the maximum untreated Zika or Dengue RLUs (IC50) was calculated by non-linear regression analysis using GraphPad Prism v8 (San Diego, Calif., USA).

Zika pseudotype assays for in vitro antibody-dependent enhancement (ADE) were performed at VRI. rZIG, the Zika/Dengue-specific immune sera UWIS, the monoclonal antibody positive control UWI-mAb1, and IVIG negative control (Gamunex; Grifols, S. A., Sant Cugat, Spain) were serially diluted and co-incubated with Zika pseudotype RVPs at 37° C. for 1 hour before addition to K562 chronic myelogenous leukemia cells (CCL-243; Manassas, Va., USA) in U-bottom 96-well plates in triplicate. After a 72 hour incubation at 37° C., cells were harvested, lysed, and infection-induced relative light units (RLU) in the presence of test articles were calculated as the RLU of the test article divided by the RLU of a no antibody control infection (to determine the reported fold-increase in infection).

rHIG: The Human Anti-Hib-PRP IgG ELISA kit (#980-100-PHG, Alpha Diagnostics, San Antonio, Tex., USA) was used for anti-Hib ELISA titers. Serial dilutions of test articles were performed in Low NSB (non-specific binding) sample diluent in singlet. IVIG (Gamunex; Grifols, S. A., Sant Cugat, Spain) was used as a reference control. Quantitative measurements were performed on a plate reader (Molecular Devices, Fremont, Calif., USA) at 450 nm. EC50 values were calculated using SoftMax Pro v8 (Molecular Devices, Fremont, Calif., USA).

In vitro serum bactericidal assay neutralization studies for Hib were performed at ImQuest (Frederick, Md., USA). The *Haemophilus influenzae* strain ATCC 10211 was obtained from ATCC (Manassas, Va., USA) as a lyophilized stock and was propagated as recommended by the supplier. The Eagan strain was obtained from Zeptometrix (Buffalo, N.Y., USA). Colonies from an overnight incubation on chocolate agar plates were inoculated into growth media (Brain Heart Infusion, or BHI broth; BD Biosciences, San Jose, Calif., USA, with 2% Fildes enrichment; Remel, San Diego, Calif., USA) and allowed to achieve an optical density of 625 nm ($OD_{625}$) of approximately 0.4. The culture was adjusted to an OD625 of 0.15, which is equivalent to approximately $5 \times 10^8$ colony forming units (CFU)/mL. The culture was further diluted to $5 \times 10^4$ CFU/mL in dilution buffer (Hanks Balanced Salt Solution; Gibco, Waltham, Mass., USA, with 2% Fildes enrichment; Remel, San Diego, Calif., USA). The density of the bacterial culture used in the assay was confirmed by plating 50 µL of the $5 \times 10^3$ and $5 \times 10^2$ dilutions in duplicate on chocolate agar and enumerating the colonies following incubation at 37° C./5% CO2 for 24 hours. rHIG and IVIG (Gamunex; Grifols, S. A., Sant Cugat, Spain) reference control were diluted three-fold in buffer, starting at 200 µg/mL such that a total of ten total dilutions were evaluated in singlet. 10 µL of each dilution of test article was added in duplicate to a 96-well microtiter plate. ATCC 10211 bacteria at a concentration of approximately $5 \times 10^4$ CFU/mL were then added to the plate in a volume of 20 µL, such that the total in-well bacterial density would be $1 \times 10^4$ CFU/20 Following an incubation of 15 minutes at 37° C./5% CO2, 25 µL of baby rabbit complement (Pel-Freez; Rogers, Ark., USA) and 25 µL of dilution buffer was added to each well. The plate was incubated at 37° C./5% CO2 for 60 minutes. Following the incubation, 5 µL of each reaction mixture was diluted in 45 µL of dilution buffer and the entire 50 µL was plated on chocolate agar plates. The plates were incubated for approximately 16 hours at 37° C./5% CO2. Following incubation, bacterial colonies were enumerated. The fold-dilution of the test article that killed >50% of the bacteria is the serum bactericidal index (SBI).

rPIG: The Human Anti-S. Pneumococcal vaccine (Pneumovax/CPS23) IgG ELISA kit (Alpha Diagnostics #560-190-23G, San Antonio, Tex., USA) was used in parallel with the human anti-*S. pneumoniae* CWPS/22F IgG ELISA kit (#560-410-C22, Alpha Diagnostics, San Antonio, Tex., USA) for initial assessment of anti-pneumococcal titers against a pool of all 23 polysaccharides included in the vaccine.

Serotype-specific antibodies were measured by ELISA and opsonophagocytosis. The concentrations of serotype-specific IgG antibody were calculated using the standard reference serum, lot 007SP (National Institute for Biological Standards and Control; Hertfordshire, UK), using the standardized pneumococcal reference ELISA as previously described. Briefly, 96-well flat-bottomed microtiter plates were coated with capsular polysaccharide antigens (LGC Standards, Teddington, UK) from pneumococcal serotypes 1, 3, 4, 5, 6A, 6B, 7F, 9V, 12F, 14, 18C, 19A, 19F, 22F, 23F, and 33F. All samples were tested in duplicate and double absorbed with CWPS and with purified serotype 22F polysaccharide to neutralize the anti-cell wall polysaccharide and nonspecific homologous antibodies to serotype 22F, except for the 22F assay which was absorbed with CWPS Multi, as described in the WHO reference ELISA protocol. Plates were washed, and a titration of rPIG and reference control IVIG (Gamunex; Grifols, S. A., Sant Cugat, Spain) was performed. Plates were incubated and washed again, and prediluted alkaline phosphatase-conjugated goat anti-human IgG (Thermo Fisher Scientific, Waltham, Mass., USA) was added to each well. After another incubation, the plates were washed a final time and p-nitrophenyl phosphate substrate (MilliporeSigma, St. Louis, Mo., USA) was added. Following a final incubation, the reaction was stopped by adding 3 M NaOH (Thermo Fisher Scientific, Waltham, Mass., USA) to each well. Plates were read using a microtiter plate reader (SPECTROstar Omega; BMG Labtech, Buckinghamshire, UK) at 405 and 620 nm.

The opsonophagocytic indices (OI) to the same pneumococcal serotypes were evaluated by multiplexed opsonophagocytic assay, as previously described. In brief, frozen aliquots of target pneumococci were thawed, washed twice with opsonization buffer B (HBSS with Ca and Mg, 0.1% gelatin, and 10% fetal bovine serum), and diluted to the proper bacterial density (approximately $2 \times 10^5$ CFUs/mL each serotype). Equal volumes of four bacterial suspensions chosen for simultaneous analysis were pooled. Duplicate serially diluted test articles (20 µL/well) were mixed with 10 µL of bacterial suspension in each well of a microplate. After 30 minutes of incubation at room temperature with shaking at 700 rpm, 10 µL of 3- to 4-week-old rabbit complement (Pel-Freeze, Rogers, Ark., USA) and 40 µL of differentiated HL60 cells ($10^7$ cells; CCL-240, ATCC, Manassas, Va., USA) were added. Plates were incubated in a 37° C./5% CO2 incubator with shaking at 700 rpm. After being incubated for 45 minutes, plates were placed on ice for 20 minutes, and an aliquot of the final reaction mixture (10 µL) was spotted onto four different Todd-Hewitt broth with 0.5% yeast extract and 0.75% agar (THY) plate. When the fluid was absorbed into the agar, an equal volume of overlay agar containing one of four antibiotics (optochin, spectinomycin, streptomycin, or trimethoprim) was applied to each THY agar plate. After overnight incubation at 37° C., the number of bacterial colonies in the agar plates was enumerated. IVIG was used as reference control (Gamunex; Grifols, S. A., Sant Cugat, Spain). The OI was defined as the test product dilution that kills 50% of bacteria and was determined by linear interpolation.

rhATG: To assess relative amount and specificity of rhATG, an ELISA was performed on antigens known to be expressed on thymocytes and previously described as having rabbit-ATG reactivity.[41] Rabbit-ATG positive control was from Sanofi Genzyme (Thymogobulin; Cambridge, Mass., USA). T cell antigens (CD3, CD4, CD5, CD7, CD8, CD16a, CD32a, CD45, CD81, CD85 CD95) were purchased from Sino Biological (Wayne, Pa., USA) and individually coated onto 96-well ELISA plates (Thermo Fisher Scientific, Waltham, Mass., USA) at 1 µg/mL in 1× carbonate coating buffer (BioLegend, San Diego, Calif., USA). After an overnight incubation at 4° C., coated plates were washed and blocked (Bio-Rad, Hercules, Calif., USA) for 1 hour. Polyclonal products were diluted to 200 µg/mL of total IgG and an 8-step 1:3 titration in assay buffer (1×PBS+0.05% Tween+0.3% dry milk) was performed. The antibody titrations were added to each antigen and incubated for 1 hour at 37° C. 1:2500 polyclonal HRP goat anti-rabbit IgG (E28002; Novodiax, Hayward, Calif., USA) or 1:2500 mouse anti-human IgG HRP (109-035-088; Jackson ImmunoResearch, West Grove, Pa., USA) were diluted 1:2500 and incubated on the plate for 1 hour. Plates were washed, developed using 1-step ultra TMB substrate (Thermo Fisher Scientific, Waltham, Mass., USA), and stopped with 1 N HCl. Plates were read by a spectrophotometer (Molecular Devices, Fremont, Calif., USA) at 450 nm and analyzed with Softmax Pro (v7; Molecular Devices, Fremont, Calif., USA).

To assess off-target antibody binding a red blood cell antigen binding assay was performed, using the Capture-R kit (Immucor, Norcross, Ga., USA). Using a dilution of test article (Thymoglobulin or rhATG) or positive control from the Immucor kit, samples were added to the plate and incubated for 1 hr at 37° C. in singlets. ELISA plates were washed and incubated with 1:2500 polyclonal HRP goat anti-rabbit IgG (E28002; Novodiax, Hayward, Calif., USA) or 1:2500 mouse anti-human IgG HRP (109-035-088; Jackson ImmunoResearch, West Grove, Pa., USA). Subsequently, plates were washed and developed with ultra-TMB substrate (Thermo Fisher Scientific, Waltham, Mass.) and the reaction was stopped with 3 M NaOH (Thermo Fisher Scientific, Waltham, Mass., USA) and read the plate on a spectrophotometer at 450 nm.

To determine in vitro function of rhATG, peripheral blood mononuclear cells were isolated from whole blood acquired from a CRO (StemCell Technologies, Vancouver, Canada) and frozen. PBMCs were thawed, washed, and plated at $1.5 \times 10^5$ cells/well in singlets. Thymoglobulin or rhATG were diluted five-fold starting at 40 µg/mL total IgG and co-incubated with each donor PBMC. Cells were co-incubated overnight at 37° C. After incubation, cells were washed, FcR blocked, and stained for CD45 (clone H130; BioLegend #304008, San Diego, Calif., USA), CD3 (clone UCHT1; BioLegend #300439, San Diego, Calif., USA), CD8 (clone BW135/80; Miltenyi #130-113-157, Bergisch Gladbach, Germany), CD20 (clone 2H7; BioLegend, San Diego, Calif.), CD56 (clone 5.1H11; BioLegend #362509, San Diego, Calif., USA), and CD16 (clone 3G8; BioLegend #302017, San Diego, Calif., USA). 1 µL of each antibody was used per $1.5 \times 10^5$ cells. Flow cytometry was performed using a Cytoflex LX (Beckman Coulter, Indianapolis, Ind., USA) with CytExpert (2.3.1.22) and a consistent collection volume of 150 seconds per well was implemented for every sample. The data were analyzed by FlowJo v10 (BD Biosciences, San Jose, Calif., USA). Cell counts after antibody co-incubation relative to no-antibody control (% cells) were calculated. Results were graphed in GraphPad Prism v8 (San Diego, Calif., USA). The gating strategy is outlined in FIG. 50A.

In Vivo Mouse Efficacy Studies

Ethical approval was obtained by Institutional Animal Care and Use Committees (IACUCs) at either SSI (Copenhagen, Denmark) for the Hib challenge model or Jackson Laboratory (Sacramento, Calif., USA) for the GVH model.

IVIG+rHIG/rPIG: For IVIG+rHIG/rPIG in vivo challenge studies, the *Haemophilus* influenza strain ATCC 10211 was grown on chocolate agar plates overnight at 35° C. and 5% CO2. Single overnight colonies were resuspended in sterile saline to $1.5 \times 10^8$ CFU/mL. This suspension was diluted in BHI broth to $1.5 \times 10^7$ CFU/mL and further diluted in BHI broth with 5% mucin and 2% hemoglobin to $1.5 \times 10^4$ CFU/mL. In an IACUC-approved protocol (SSI, Copenhagen, Denmark), Balb/cJ mice (Taconic, Rensselaer, N.Y., USA; n=6 per group) were inoculated with single 0.5 mL intraperitoneal doses of $10^5$ CFU/mL ATCC 10211, and then randomized into treatment groups by animal identifier. All mice were female, age 6-8 weeks. The temperature and humidity were registered daily in the animal facilities. The temperature was 22° C.+/−2° C. and can be regulated by heating and cooling. The humidity was 55 +/−10%. The air changes per hour were approximately 8-12 times (70-73 times per hours inside cages), and light/dark period was in 12-hours interval of 6 am-6 pm/6 pm-6 am. The mice had free access to domestic quality drinking water and food (Teklad Global diet 2916C, Envigo, Indianapolis, Ind., USA) and occasionally peanuts and sunflower seeds (Koge Korn A/S, Koge, Denmark). The mice were housed in IVC cages, 6-8 mice per cage, with bedding from Tapvei. Further, the animals were offered Enviro-Dri nesting material and cardboard houses (Bio-Serv, Flemington, N.J., USA).

Approximately 1 hour before inoculation, mice were treated orally with 45 µL Nurofen (30 mg/kg) as pain relief. Twenty-four hours prior to Hib inoculation, mice were intravenously administered 200 mg/kg IVIG+rHIG/rPIG mixture, 500 mg/kg IVIG+rHIG/rPIG mixture, 500 mg/kg IVIG (Gamunex; Grifols, S. A., Sant Cugat, Spain), or saline (no treatment). For the ciprofloxacin positive control, one hour after Hib inoculation, mice were dosed with 20 mg/kg ciprofloxacin. Mice were scored for clinical signs of infection, then after 6 hours all animals were sacrificed and blood and peritoneal fluid was collected for CFU determination by serial dilution and plating of 0.02 ml spots on chocolate agar plates.

rhATG was tested for ability to delay GVHD in immunodeficient NOD scid gamma (NSG) mice (genotype: NOD.Cg-Prkdc$^{scid}$ Il2rg$^{tm1Wjl}$/SzJ), compared against rabbit-ATG (Thymoglobulin; Sanofi Genzyme, Cambridge, Mass.) and a vehicle control. All mice were female, age 6-8 weeks. The mice were ear notched for identification and housed in individually ventilated polysulfonate cages with HEPA filtered air at a density of up to 5 mice per cage. The animal room was lighted entirely with artificial fluorescent lighting, with a controlled 12 hour light/dark cycle (6 am to 6 pm light). The normal temperature and relative humidity ranges in the animal rooms were 22-26° C. and 30-70%, respectively. The animal rooms were set to have up to 15 air exchanges per hour. Filtered tap water, acidified to a pH of 2.5 to 3.0, and standard rodent chow was provided ad libitum.

Each animal was grafted with approximately $1 \times 10^7$ PBMC of a single human donor. On Day 5 after PBMC engraftment, animals were randomized by weight and dosed intravenously every other day for two weeks with 5.5 mg/kg rhATG (n=8), 6.5 mg/kg Thymoglobulin (n=8), or a vehicle control (n=8), or Days 5, 6, and 7 post-engraftment with 5.5 mg/kg rhATG (n=8), 6.5 mg/kg Thymoglobulin (n=8), or a vehicle control (n=8). Two PBMC donors were tested for each dosing regimen (2 PBMC donors ×2 dosing regimens×3 treatment groups×8 animals per group=96 animals). Animals were assessed for clinical signs of mortality daily. Mice were euthanized by CO2 asphyxiation before final study take down if they showed >20% weight loss from their starting weight or a combination of the following clinical signs: >10-20% weight loss from their starting weight, cold to touch, lethargic, pale, hunched posture and scruffy coat. 50 µL of blood was drawn from all alive animals on Days 9, 16, 23, and 30 post-engraftment via retro-orbital bleed, and flow cytometry stained for Human (hu)CD45-PE (clone HI30; BioLegend #304008, San Diego, Calif., USA) and 7AAD (BioLegend, San Diego, Calif., USA); 50 µL of CountBright beads (Thermo Fisher Scientific, Waltham, Mass., USA) were added to each sample prior to acquisition. Flow cytometric data acquisition was performed using the BD Biosciences FACSCanto flow cytometer (San Jose, Calif., USA), and data were acquired and analyzed using BD Biosciences FACSDiva™ software (version 8; San Jose, Calif., USA); lymphocytes, singlet, live cells, and CD45+ cells were gated and cell numbers quantified relative to CountBright beads. The gating strategy is outlined in FIG. 50B.

9. INCORPORATION BY REFERENCE

All publications, patents, patent applications and other documents cited in this application are hereby incorporated by reference in their entireties for all purposes to the same extent as if each individual publication, patent, patent application or other document were individually indicated to be incorporated by reference for all purposes.

10. EQUIVALENTS

Whereas various specific embodiments have been illustrated and described, the above specification is not restrictive. It will be appreciated that various changes can be made without departing from the spirit and scope of the invention(s). Many variations will become apparent to those skilled in the art upon review of this specification.

SEQUENCE LISTING (25975 sequences)

SEQ ID NO: 1 - protein, 9 aa, Homo sapiens
  Light chain CDR3 for antibody 1 (IGKV5-2)
LQHDNFPWT

SEQ ID NO: 2 - protein, 13 aa, Homo sapiens
  Heavy chain CDR3 for antibody 1 (IGHV4-34)
ASNFYYYYYGMDV

SEQ ID NO: 3 - protein, 9 aa, Homo sapiens
  Light chain CDR3 for antibody 2 (IGKV1-9)
QQLNSYPLT

SEQ ID NO: 4 - protein, 13 aa, Homo sapiens
  Heavy chain CDR3 for antibody 2 (IGHV4-59)
ARDAGYSSSWFDY

SEQ ID NO: 5 - protein, 9 aa, Homo sapiens
  Light chain CDR3 for antibody 3 (IGKV1-17)
LQHNSYPYT

SEQ ID NO: 6 - protein, 11 aa, Homo sapiens
  Heavy chain CDR3 for antibody 3 (IGHV3-33)
ARDRSSGPFDY

SEQ ID NO: 7 - protein, 9 aa, Homo sapiens
  Light chain CDR3 for antibody 4 (IGKV6-21)
HQSSSLPYT

SEQ ID NO: 8 - protein, 16 aa, Homo sapiens
  Heavy chain CDR3 for antibody 4 (IGHV3-23)
AKEGMVLRYFDWLWDY

SEQ ID NO: 9 - protein, 9 aa, Homo sapiens
  Light chain CDR3 for antibody 5 (IGKV1-16)
QQYNSYPYT

SEQ ID NO: 10 - protein, 18 aa, Homo sapiens
  Heavy chain CDR3 for antibody 5 (IGHV4-59)
AREGDYVWGSYRPNWFDP

SEQ ID NO: 11 - protein, 9 aa, Homo sapiens
  Light chain CDR3 for antibody 6 (IGKV1-39)
QQSYRTPLT

SEQ ID NO: 12 - protein, 13 aa, Homo sapiens
  Heavy chain CDR3 for antibody 6 (IGHV3-11)
ARDGGAAAGTWDS

SEQ ID NO: 13 - protein, 9 aa, Homo sapiens
  Light chain CDR3 for antibody 7 (IGKV5-2)
LQHDNFPYT

SEQ ID NO: 14 - protein, 14 aa, Homo sapiens
  Heavy chain CDR3 for antibody 7 (IGHV3-23)
AKSRIVGALYYFDY

SEQ ID NO: 15 - protein, 9 aa, Homo sapiens
  Light chain CDR3 for antibody 8 (IGKV5-2)
LQHDNFPWT

SEQ ID NO: 16 - protein, 13 aa, Homo sapiens
  Heavy chain CDR3 for antibody 8 (IGHV4-39)
ARQWPSGYWYFDL

SEQ ID NO: 17 - protein, 9 aa, Homo sapiens
  Light chain CDR3 for antibody 9 (IGKV5-2)
LQHDNFPWT

SEQ ID NO: 18 - protein, 13 aa, Homo sapiens
  Heavy chain CDR3 for antibody 9 (IGHV4-39)
ARREVVGGRGFDY

SEQ ID NO: 19 - protein, 9 aa, Homo sapiens
  Light chain CDR3 for antibody 10 (IGKV1D-16)
QQYNSYPFT

SEQ ID NO: 20 - protein, 11 aa, Homo sapiens
  Heavy chain CDR3 for antibody 10 (IGHV4-59)
AREMGHDTFDI

SEQ ID NO: 21 - protein, 9 aa, Homo sapiens
  Light chain CDR3 for antibody 11 (IGKV1-16)
QQYNSYPYT

SEQ ID NO: 22 - protein, 18 aa, Homo sapiens
  Heavy chain CDR3 for antibody 11 (IGHV1-46)
ARDGDYVWGSYRSDWFDP

SEQ ID NO: 23 - protein, 9 aa, Homo sapiens
  Light chain CDR3 for antibody 12 (IGKV3-20)
QQYGSSPLT

SEQ ID NO: 24 - protein, 12 aa, Homo sapiens
  Heavy chain CDR3 for antibody 12 (IGHV1-18)
ARILFYGDYFDY

SEQ ID NO: 25 - protein, 9 aa, Homo sapiens
  Light chain CDR3 for antibody 13 (IGKV1D-16)
QQYNSYPLT

SEQ ID NO: 26 - protein, 15 aa, Homo sapiens
  Heavy chain CDR3 for antibody 13 (IGHV3-30)
ARGAMVRGVDYGMDV

SEQ ID NO: 27 - protein, 9 aa, Homo sapiens
  Light chain CDR3 for antibody 14 (IGKV1D-16)
QQYHSYPYT

SEQ ID NO: 28 - protein, 12 aa, Homo sapiens
  Heavy chain CDR3 for antibody 14 (IGHV1-46)
ARGLTGDHAVDI

SEQ ID NO: 29 - protein, 9 aa, Homo sapiens
  Light chain CDR3 for antibody 15 (IGKV1-6)
LQDYNYPYT

SEQ ID NO: 30 - protein, 9 aa, Homo sapiens
  Heavy chain CDR3 for antibody 15 (IGHV1-18)
ARGKDWFDP

SEQ ID NO: 31 - protein, 9 aa, Homo sapiens
  Light chain CDR3 for antibody 16 (IGKV1D-16)
QQYNSFPLT

SEQ ID NO: 32 - protein, 16 aa, Homo sapiens
  Heavy chain CDR3 for antibody 16 (IGHV4-59)
ARGRYFEWLLGDVFDI

SEQ ID NO: 33 - protein, 9 aa, Homo sapiens
  Light chain CDR3 for antibody 17 (IGKV1-27)
QKYNSAPYT

SEQ ID NO: 34 - protein, 14 aa, Homo sapiens
  Heavy chain CDR3 for antibody 17 (IGHV3-33)
ARGAAAGNFYGLDV

SEQ ID NO: 35 - protein, 9 aa, Homo sapiens
  Light chain CDR3 for antibody 18 (IGKV1-6)
LQDYNYPRT

SEQ ID NO: 36 - protein, 17 aa, Homo sapiens
  Heavy chain CDR3 for antibody 18 (IGHV1-18)
ARDRAFTMVRGVPPFDY

SEQ ID NO: 37 - protein, 9 aa, Homo sapiens
  Light chain CDR3 for antibody 19 (IGKV1-6)
LQDYNYPYT

SEQ ID NO: 38 - protein, 17 aa, Homo sapiens
  Heavy chain CDR3 for antibody 19 (IGHV1-18)
ARDEGYDILTGYPHFDY

SEQ ID NO: 39 - protein, 9 aa, Homo sapiens
  Light chain CDR3 for antibody 20 (IGKV1-6)
LQDFNYPRT

SEQ ID NO: 40 - protein, 18 aa, Homo sapiens
  Heavy chain CDR3 for antibody 20 (IGHV4-59)
AREGHYYTSGSYYKAFDY

SEQ ID NO: 41 - protein, 9 aa, Homo sapiens
  Light chain CDR3 for antibody 21 (IGKV1-39)
QQSYSTPFT

SEQ ID NO: 42 - protein, 17 aa, Homo sapiens
  Heavy chain CDR3 for antibody 21 (IGHV4-59)
ARDFLVRGEGSYYGMDV

SEQ ID NO: 43 - protein, 9 aa, Homo sapiens
  Light chain CDR3 for antibody 22 (IGKV3D-20)
QQYGSSPYT

SEQ ID NO: 44 - protein, 17 aa, Homo sapiens
  Heavy chain CDR3 for antibody 22 (IGHV3-33)
ARGYCSRTSCYLYYFDY

SEQ ID NO: 45 - protein, 9 aa, Homo sapiens
  Light chain CDR3 for antibody 23 (IGKV1-39)
QQSYSTPLT

SEQ ID NO: 46 - protein, 15 aa, Homo sapiens
  Heavy chain CDR3 for antibody 23 (IGHV3-20)
ARDRGSSGWRDWFDP

SEQ ID NO: 47 - protein, 9 aa, Homo sapiens
  Light chain CDR3 for antibody 24 (IGKV3-15)
QQYNNWPLT

SEQ ID NO: 48 - protein, 14 aa, Homo sapiens
  Heavy chain CDR3 for antibody 24 (IGHV4-39)
ARQDYDILTGLFDY

SEQ ID NO: 49 - protein, 9 aa, Homo sapiens
  Light chain CDR3 for antibody 25 (IGKV1-17)
LQHNSYPPT

SEQ ID NO: 50 - protein, 13 aa, Homo sapiens
  Heavy chain CDR3 for antibody 25 (IGHV3-23)
ASPFNWNDGFFDY

SEQ ID NO: 51 - protein, 9 aa, Homo sapiens
  Light chain CDR3 for antibody 26 (IGKV1-27)
QKYNSAPYT

SEQ ID NO: 52 - protein, 12 aa, Homo sapiens
  Heavy chain CDR3 for antibody 26 (IGHV3-33)
ARGYFGSGYAHF

SEQ ID NO: 53 - protein, 9 aa, Homo sapiens
  Light chain CDR3 for antibody 27 (IGKV6-21)
HQSTSLPFT

SEQ ID NO: 54 - protein, 12 aa, Homo sapiens
  Heavy chain CDR3 for antibody 27 (IGHV4-39)
ARHGSGSSYFDY

SEQ ID NO: 55 - protein, 9 aa, Homo sapiens
  Light chain CDR3 for antibody 28 (IGKV3-20)
QQYGSSPRT

SEQ ID NO: 56 - protein, 16 aa, Homo sapiens
  Heavy chain CDR3 for antibody 28 (IGHV1-24)
ATEDSSSTYYYYGLDV

SEQ ID NO: 57 - protein, 9 aa, Homo sapiens
  Light chain CDR3 for antibody 29 (IGKV1-9)
QQLKSYLYT

SEQ ID NO: 58 - protein, 15 aa, Homo sapiens
  Heavy chain CDR3 for antibody 29 (IGHV1-18)
ARGYCSSTSCYYFDY

SEQ ID NO: 59 - protein, 9 aa, Homo sapiens
  Light chain CDR3 for antibody 30 (IGKV5-2)
LQHDKFPYT

SEQ ID NO: 60 - protein, 18 aa, Homo sapiens
  Heavy chain CDR3 for antibody 30 (IGHV3-33)
ARGYYGSGNFYKDSGMDV

SEQ ID NO: 61 - protein, 9 aa, Homo sapiens
  Light chain CDR3 for antibody 31 (IGKV1-6)
LQDYNYPYT

SEQ ID NO: 62 - protein, 14 aa, Homo sapiens
  Heavy chain CDR3 for antibody 31 (IGHV3-33)
ARDWNDVYYYGMDV

SEQ ID NO: 63 - protein, 9 aa, Homo sapiens
  Light chain CDR3 for antibody 32 (IGKV2-30)
MQGTHWPLT

SEQ ID NO: 64 - protein, 13 aa, Homo sapiens
  Heavy chain CDR3 for antibody 32 (IGHV3-11)
ARDEGYRGYVLDT

SEQ ID NO: 65 - protein, 9 aa, Homo sapiens
  Light chain CDR3 for antibody 33 (IGKV5-2)
LQHDNFPYT

SEQ ID NO: 66 - protein, 9 aa, Homo sapiens
  Heavy chain CDR3 for antibody 33 (IGHV3-33)
ARATVGVDY

SEQ ID NO: 67 - protein, 10 aa, Homo sapiens
  Light chain CDR3 for antibody 34 (IGKV3-11)
QQRSNWPIFT

SEQ ID NO: 68 - protein, 8 aa, Homo sapiens
  Heavy chain CDR3 for antibody 34 (IGHV3-23)
AKETGNNY

SEQ ID NO: 69 - protein, 9 aa, Homo sapiens
  Light chain CDR3 for antibody 35 (IGKV3-20)
QQYGSSPYT

SEQ ID NO: 70 - protein, 13 aa, Homo sapiens
  Heavy chain CDR3 for antibody 35 (IGHV3-33)
ARRYRSGWYPFDY

SEQ ID NO: 71 - protein, 9 aa, Homo sapiens
  Light chain CDR3 for antibody 36 (IGKV1D-16)
QQYNSYPYT

SEQ ID NO: 72 - protein, 13 aa, Homo sapiens
  Heavy chain CDR3 for antibody 36 (IGHV3-33)
ARDQRYSSGWYDY

SEQ ID NO: 73 - protein, 9 aa, Homo sapiens
  Light chain CDR3 for antibody 37 (IGKV1-6)
LQDHNYPYT

SEQ ID NO: 74 - protein, 12 aa, Homo sapiens
  Heavy chain CDR3 for antibody 37 (IGHV3-33)
ARESGGSYSFDY

SEQ ID NO: 75 - protein, 9 aa, Homo sapiens
  Light chain CDR3 for antibody 38 (IGKV1-9)
QQLNSYPWT

SEQ ID NO: 76 - protein, 12 aa, Homo sapiens
  Heavy chain CDR3 for antibody 38 (IGHV4-59)
ARDRSGWAYFDY

SEQ ID NO: 77 - protein, 9 aa, Homo sapiens
  Light chain CDR3 for antibody 39 (IGKV6-21)
HQSSSLPLT

SEQ ID NO: 78 - protein, 12 aa, Homo sapiens
  Heavy chain CDR3 for antibody 39 (IGHV3-33)
TRGYSSKSYFDY

SEQ ID NO: 79 - protein, 9 aa, Homo sapiens
  Light chain CDR3 for antibody 40 (IGKV1-6)
LQDYNYPYT

SEQ ID NO: 80 - protein, 13 aa, Homo sapiens
  Heavy chain CDR3 for antibody 40 (IGHV3-33)
ARKAYGDYFYFDY

SEQ ID NO: 81 - protein, 8 aa, Homo sapiens
  Light chain CDR3 for antibody 41 (IGKV3D-7)
QQDYNLLT

SEQ ID NO: 82 - protein, 18 aa, Homo sapiens
  Heavy chain CDR3 for antibody 41 (IGHV3-33)
ARREGIVGATTYYYGMDV

SEQ ID NO: 83 - protein, 9 aa, Homo sapiens
  Light chain CDR3 for antibody 42 (IGKV1-6)
LQDYNYPRT

SEQ ID NO: 84 - protein, 15 aa, Homo sapiens
  Heavy chain CDR3 for antibody 42 (IGHV4-59)
ARDLGHYYGSVSIDY

SEQ ID NO: 85 - protein, 9 aa, Homo sapiens
  Light chain CDR3 for antibody 43 (IGKV1-17)
LQQNSYPWT

SEQ ID NO: 86 - protein, 11 aa, Homo sapiens
  Heavy chain CDR3 for antibody 43 (IGHV4-59)
ARSLRYSVFDY

SEQ ID NO: 87 - protein, 9 aa, Homo sapiens
  Light chain CDR3 for antibody 44 (IGKV1-6)
LQDYNYPRT

SEQ ID NO: 88 - protein, 14 aa, Homo sapiens
  Heavy chain CDR3 for antibody 44 (IGHV4-39)
ARDSGYDYYYGMDV

SEQ ID NO: 89 - protein, 9 aa, Homo sapiens
  Light chain CDR3 for antibody 45 (IGKV1-6)
LQDYNYPFT

SEQ ID NO: 90 - protein, 15 aa, Homo sapiens
  Heavy chain CDR3 for antibody 45 (IGHV3-33)
ARRICSGGSCSLFDY

SEQ ID NO: 91 - protein, 11 aa, Homo sapiens
  Light chain CDR3 for antibody 46 (IGKV3-11)
QQRSNWPPTWT

SEQ ID NO: 92 - protein, 13 aa, Homo sapiens
  Heavy chain CDR3 for antibody 46 (IGHV4-39)
ARHVLLWFGEFDP

SEQ ID NO: 93 - protein, 9 aa, Homo sapiens
  Light chain CDR3 for antibody 47 (IGKV1D-16)
QQYSSYPYT

SEQ ID NO: 94 - protein, 9 aa, Homo sapiens
  Heavy chain CDR3 for antibody 47 (IGHV3-13)
ARDRWYFDL

SEQ ID NO: 95 - protein, 9 aa, Homo sapiens
  Light chain CDR3 for antibody 48 (IGKV1D-16)
QQYNSYPYT

SEQ ID NO: 96 - protein, 14 aa, Homo sapiens
  Heavy chain CDR3 for antibody 48 (IGHV3-33)
ARDRIAAASSDFDC

SEQ ID NO: 97 - protein, 10 aa, Homo sapiens
  Light chain CDR3 for antibody 49 (IGKV1-39)
QQSYSTPMYT

SEQ ID NO: 98 - protein, 11 aa, Homo sapiens
  Heavy chain CDR3 for antibody 49 (IGHV3-33)
ARDRVLTPFDY

SEQ ID NO: 99 - protein, 9 aa, Homo sapiens
  Light chain CDR3 for antibody 50 (IGKV1-6)
LQDYNYPYT

SEQ ID NO: 100 - protein, 15 aa, Homo sapiens
  Heavy chain CDR3 for antibody 50 (IGHV3-33)
ARDTGYSSSWNWFDP

SEQ ID NO: 101 - protein, 9 aa, Homo sapiens
  Light chain CDR3 for antibody 51 (IGKV1-6)
LQDYNYPPT

SEQ ID NO: 102 - protein, 12 aa, Homo sapiens
  Heavy chain CDR3 for antibody 51 (IGHV3-33)
ARDLVGATPFDY

SEQ ID NO: 103 - protein, 9 aa, Homo sapiens
  Light chain CDR3 for antibody 52 (IGKV1-6)
LQDYNYPYT

SEQ ID NO: 104 - protein, 7 aa, Homo sapiens
  Heavy chain CDR3 for antibody 52 (IGHV1-46)
AREGGDY

SEQ ID NO: 105 - protein, 9 aa, Homo sapiens
  Light chain CDR3 for antibody 53 (IGKV1D-13)
QQFNNYPHT

SEQ ID NO: 106 - protein, 13 aa, Homo sapiens
  Heavy chain CDR3 for antibody 53 (IGHV3-53)
ARSGSYWGYYFDY

SEQ ID NO: 107 - protein, 9 aa, Homo sapiens
  Light chain CDR3 for antibody 54 (IGKV1-9)
QQLNSYPYT

SEQ ID NO: 108 - protein, 12 aa, Homo sapiens
  Heavy chain CDR3 for antibody 54 (IGHV3-13)
VREAGIPDAFDI

SEQ ID NO: 109 - protein, 9 aa, Homo sapiens
  Light chain CDR3 for antibody 55 (IGKV3D-7)
QQDYTLPLT

SEQ ID NO: 110 - protein, 12 aa, Homo sapiens
  Heavy chain CDR3 for antibody 55 (IGHV4-61)
ARVYSSGWLFDY

SEQ ID NO: 111 - protein, 9 aa, Homo sapiens
  Light chain CDR3 for antibody 56 (IGKV1-17)
LQHNSYPRT

SEQ ID NO: 112 - protein, 14 aa, Homo sapiens
  Heavy chain CDR3 for antibody 56 (IGHV3-33)
AREGYSSNWYDFDY

SEQ ID NO: 113 - protein, 9 aa, Homo sapiens
  Light chain CDR3 for antibody 57 (IGKV1-6)
LQDYNYPRT

SEQ ID NO: 114 - protein, 20 aa, Homo sapiens
  Heavy chain CDR3 for antibody 57 (IGHV3-20)
ARDLCSSTSCYGYYYYGMDV

SEQ ID NO: 115 - protein, 9 aa, Homo sapiens
  Light chain CDR3 for antibody 58 (IGKV1D-16)
QQYNSYPYT

SEQ ID NO: 116 - protein, 13 aa, Homo sapiens
  Heavy chain CDR3 for antibody 58 (IGHV3-33)
ARRATLVRGVFDP

SEQ ID NO: 117 - protein, 9 aa, Homo sapiens
  Light chain CDR3 for antibody 59 (IGKV1-6)
LQDYNYPWT

SEQ ID NO: 118 - protein, 14 aa, Homo sapiens
  Heavy chain CDR3 for antibody 59 (IGHV3-33)
ARDKTYPLSYGMDV

SEQ ID NO: 119 - protein, 9 aa, Homo sapiens
  Light chain CDR3 for antibody 60 (IGKV1-6)
LQDYNYPWT

SEQ ID NO: 120 - protein, 13 aa, Homo sapiens
  Heavy chain CDR3 for antibody 60 (IGHV4-59)
ARTMVRGVAPFDY

SEQ ID NO: 121 - protein, 9 aa, Homo sapiens
  Light chain CDR3 for antibody 61 (IGKV1-9)
QQLNSYPRT

SEQ ID NO: 122 - protein, 16 aa, Homo sapiens
  Heavy chain CDR3 for antibody 61 (IGHV4-59)
ARDTPYYSGSGRPFDS

SEQ ID NO: 123 - protein, 9 aa, Homo sapiens
  Light chain CDR3 for antibody 62 (IGKV1-16)
QQYNSYPLT

SEQ ID NO: 124 - protein, 9 aa, Homo sapiens
  Heavy chain CDR3 for antibody 62 (IGHV3-30)
ARDNWGFDY

SEQ ID NO: 125 - protein, 9 aa, Homo sapiens
  Light chain CDR3 for antibody 63 (IGKV3-20)
QQYGSSPYT

SEQ ID NO: 126 - protein, 19 aa, Homo sapiens
  Heavy chain CDR3 for antibody 63 (IGHV5-51)
ARHGEKGKRITMVRGSLDV

SEQ ID NO: 127 - protein, 9 aa, Homo sapiens
  Light chain CDR3 for antibody 64 (IGKV1-17)
LQHNSYPPT

SEQ ID NO: 128 - protein, 14 aa, Homo sapiens
  Heavy chain CDR3 for antibody 64 (IGHV1-46)
ARRGIVGALDAFDI

SEQ ID NO: 129 - protein, 9 aa, Homo sapiens
  Light chain CDR3 for antibody 65 (IGKV1-39)
QQSYSTPIT

SEQ ID NO: 130 - protein, 18 aa, Homo sapiens
  Heavy chain CDR3 for antibody 65 (IGHV1-46)
ARDLTGRTENYYYYGMDV

SEQ ID NO: 131 - protein, 9 aa, Homo sapiens
  Light chain CDR3 for antibody 66 (IGKV1-17)
LQHNSYPYT

SEQ ID NO: 132 - protein, 12 aa, Homo sapiens
  Heavy chain CDR3 for antibody 66 (IGHV3-33)
ARDRAYRGSLDY

SEQ ID NO: 133 - protein, 9 aa, Homo sapiens
  Light chain CDR3 for antibody 67 (IGKV1-9)
QQLNGYPFT

SEQ ID NO: 134 - protein, 13 aa, Homo sapiens
  Heavy chain CDR3 for antibody 67 (IGHV4-28)
ARKGATGYYGMDV

SEQ ID NO: 135 - protein, 9 aa, Homo sapiens
  Light chain CDR3 for antibody 68 (IGKV1-17)
LQHNSYPYT

SEQ ID NO: 136 - protein, 19 aa, Homo sapiens
  Heavy chain CDR3 for antibody 68 (IGHV1-18)
ARDDILTGYSLYYYYGMDV

SEQ ID NO: 137 - protein, 9 aa, Homo sapiens
  Light chain CDR3 for antibody 69 (IGKV1-9)
QQLNSYPWT

SEQ ID NO: 138 - protein, 15 aa, Homo sapiens
  Heavy chain CDR3 for antibody 69 (IGHV3-33)
ARDRGWKAPGYGMDV

SEQ ID NO: 139 - protein, 9 aa, Homo sapiens
  Light chain CDR3 for antibody 70 (IGKV1-39)
QQSYSTPYT

SEQ ID NO: 140 - protein, 10 aa, Homo sapiens
  Heavy chain CDR3 for antibody 70 (IGHV3-23)
AKGDRWRFDP

SEQ ID NO: 141 - protein, 9 aa, Homo sapiens
  Light chain CDR3 for antibody 71 (IGKV1-6)
LQDYNYPYT

SEQ ID NO: 142 - protein, 16 aa, Homo sapiens
  Heavy chain CDR3 for antibody 71 (IGHV4-59)
ARYSGSYYGDYYGMDV

SEQ ID NO: 143 - protein, 9 aa, Homo sapiens
  Light chain CDR3 for antibody 72 (IGKV1-17)
LQHNSYPYT

SEQ ID NO: 144 - protein, 18 aa, Homo sapiens
  Heavy chain CDR3 for antibody 72 (IGHV3-23)
AKDRITGTTYGYYSGLDV

SEQ ID NO: 145 - protein, 9 aa, Homo sapiens
  Light chain CDR3 for antibody 73 (IGKV1D-13)
QQFNNYPRT

SEQ ID NO: 146 - protein, 20 aa, Homo sapiens
  Heavy chain CDR3 for antibody 73 (IGHV1-f)
ATGLITFVRGVILTYRSFDY

SEQ ID NO: 147 - protein, 9 aa, Homo sapiens
  Light chain CDR3 for antibody 74 (IGKV1D-13)
QQFNNYPHT

SEQ ID NO: 148 - protein, 13 aa, Homo sapiens
  Heavy chain CDR3 for antibody 74 (IGHV4-39)
ARHEVMVRGVFDY

SEQ ID NO: 149 - protein, 9 aa, Homo sapiens
  Light chain CDR3 for antibody 75 (IGKV1-6)
LQDYNYPYT

SEQ ID NO: 150 - protein, 12 aa, Homo sapiens
  Heavy chain CDR3 for antibody 75 (IGHV3-13)
AREAGIPDAFDI

SEQ ID NO: 151 - protein, 9 aa, Homo sapiens
  Light chain CDR3 for antibody 76 (IGKV1D-16)
QQYNSYPYT

SEQ ID NO: 152 - protein, 13 aa, Homo sapiens
  Heavy chain CDR3 for antibody 76 (IGHV3-33)
VSTGDSYYYVMDV

SEQ ID NO: 153 - protein, 9 aa, Homo sapiens
  Light chain CDR3 for antibody 77 (IGKV1D-13)
QQFNNYPYT

SEQ ID NO: 154 - protein, 11 aa, Homo sapiens
  Heavy chain CDR3 for antibody 77 (IGHV3-33)
ARDKSSGWSDY

SEQ ID NO: 155 - protein, 9 aa, Homo sapiens
  Light chain CDR3 for antibody 78 (IGKV1D-13)
QQFNNYPHT

SEQ ID NO: 156 - protein, 15 aa, Homo sapiens
  Heavy chain CDR3 for antibody 78 (IGHV3-23)
AKDGSYYDYYYGMDV

SEQ ID NO: 157 - protein, 9 aa, Homo sapiens
  Light chain CDR3 for antibody 79 (IGKV1-6)
LQDYNYPRT

SEQ ID NO: 158 - protein, 17 aa, Homo sapiens
  Heavy chain CDR3 for antibody 79 (IGHV3-33)
ARGFSGYDGYYYYGMDV

SEQ ID NO: 159 - protein, 9 aa, Homo sapiens
  Light chain CDR3 for antibody 80 (IGKV5-2)
LQHDNFPLT

SEQ ID NO: 160 - protein, 20 aa, Homo sapiens
  Heavy chain CDR3 for antibody 80 (IGHV3-23)
AKGMGGLRYFDWPHYYGMDV

SEQ ID NO: 161 - protein, 9 aa, Homo sapiens
  Light chain CDR3 for antibody 81 (IGKV1-17)
LQHNSYPRT

SEQ ID NO: 162 - protein, 9 aa, Homo sapiens
  Heavy chain CDR3 for antibody 81 (IGHV1-8)
ARGRLDFDY

SEQ ID NO: 163 - protein, 9 aa, Homo sapiens
  Light chain CDR3 for antibody 82 (IGKV1D-16)
QQYDSYPWT

SEQ ID NO: 164 - protein, 11 aa, Homo sapiens
  Heavy chain CDR3 for antibody 82 (IGHV3-33)
AREAANWGFDY

SEQ ID NO: 165 - protein, 9 aa, Homo sapiens
  Light chain CDR3 for antibody 83 (IGKV1D-16)
QQYNSYPLT

SEQ ID NO: 166 - protein, 14 aa, Homo sapiens
  Heavy chain CDR3 for antibody 83 (IGHV3-33)
ARTTAAAGPRDFQH

SEQ ID NO: 167 - protein, 9 aa, Homo sapiens
  Light chain CDR3 for antibody 84 (IGKV3-11)
QQRSNWMYT

SEQ ID NO: 168 - protein, 10 aa, Homo sapiens
  Heavy chain CDR3 for antibody 84 (IGHV3-23)
AKEQWLVLDY

SEQ ID NO: 169 - protein, 9 aa, Homo sapiens
  Light chain CDR3 for antibody 85 (IGKV1-9)
QQLNSYPYT

SEQ ID NO: 170 - protein, 15 aa, Homo sapiens
  Heavy chain CDR3 for antibody 85 (IGHV3-33)
ARDHLTGYYYYGMDV

SEQ ID NO: 171 - protein, 9 aa, Homo sapiens
  Light chain CDR3 for antibody 86 (IGKV3D-20)
QQYGSSPWT

SEQ ID NO: 172 - protein, 15 aa, Homo sapiens
  Heavy chain CDR3 for antibody 86 (IGHV3-33)
ARDSRPEIIGPPFDY

SEQ ID NO: 173 - protein, 9 aa, Homo sapiens
  Light chain CDR3 for antibody 87 (IGKV1-9)
QQVKSYPYT

SEQ ID NO: 174 - protein, 12 aa, Homo sapiens
  Heavy chain CDR3 for antibody 87 (IGHV1-46)
AREDYDIDGMDV

SEQ ID NO: 175 - protein, 9 aa, Homo sapiens
  Light chain CDR3 for antibody 88 (IGKV1-6)
LQDYNYPLT

SEQ ID NO: 176 - protein, 14 aa, Homo sapiens
  Heavy chain CDR3 for antibody 88 (IGHV3-33)
ARAGSGYDRDWFDP

SEQ ID NO: 177 - protein, 9 aa, Homo sapiens
  Light chain CDR3 for antibody 89 (IGKV1-17)
LQHNGYPLT

SEQ ID NO: 178 - protein, 10 aa, Homo sapiens
  Heavy chain CDR3 for antibody 89 (IGHV3-33)
ARENSTPLDY

SEQ ID NO: 179 - protein, 9 aa, Homo sapiens
  Light chain CDR3 for antibody 90 (IGKV1-6)
LQDYNYPWT

SEQ ID NO: 180 - protein, 18 aa, Homo sapiens
  Heavy chain CDR3 for antibody 90 (IGHV3-33)
ARDRDRYGSGTYPDAIDI

SEQ ID NO: 181 - protein, 9 aa, Homo sapiens
  Light chain CDR3 for antibody 91 (IGKV1-17)
LQHNSYPRT

SEQ ID NO: 182 - protein, 11 aa, Homo sapiens
  Heavy chain CDR3 for antibody 91 (IGHV3-33)
ARDTWDDYFDY

SEQ ID NO: 183 - protein, 9 aa, Homo sapiens
  Light chain CDR3 for antibody 92 (IGKV1-6)
LQDYNYPWT

SEQ ID NO: 184 - protein, 9 aa, Homo sapiens
  Heavy chain CDR3 for antibody 92 (IGHV4-59)
AGGSWDFDY

SEQ ID NO: 185 - protein, 9 aa, Homo sapiens
  Light chain CDR3 for antibody 93 (IGKV1D-16)
QQYYSYPRT

SEQ ID NO: 186 - protein, 13 aa, Homo sapiens
  Heavy chain CDR3 for antibody 93 (IGHV3-33)
ARDYCGGDCYLDY

SEQ ID NO: 187 - protein, 9 aa, Homo sapiens
  Light chain CDR3 for antibody 94 (IGKV3-20)
QQYGSSPRT

SEQ ID NO: 188 - protein, 14 aa, Homo sapiens
  Heavy chain CDR3 for antibody 94 (IGHV1-18)
ARCFGSGSYGWFDP

SEQ ID NO: 189 - protein, 9 aa, Homo sapiens
  Light chain CDR3 for antibody 95 (IGKV1-6)
LQDYNYPWT

SEQ ID NO: 190 - protein, 14 aa, Homo sapiens
  Heavy chain CDR3 for antibody 95 (IGHV3-33)
ARDGYDFLTGPFDY

SEQ ID NO: 191 - protein, 9 aa, Homo sapiens
  Light chain CDR3 for antibody 96 (IGKV1-17)
LQHNSYPYT

SEQ ID NO: 192 - protein, 11 aa, Homo sapiens
  Heavy chain CDR3 for antibody 96 (IGHV3-33)
ARARYTTGLDY

SEQ ID NO: 193 - protein, 9 aa, Homo sapiens
  Light chain CDR3 for antibody 97 (IGKV3-11)
QQRSNWPPT

SEQ ID NO: 194 - protein, 14 aa, Homo sapiens
  Heavy chain CDR3 for antibody 97 (IGHV3-33)
ARDREQQLVRYFDY

SEQ ID NO: 195 - protein, 9 aa, Homo sapiens
  Light chain CDR3 for antibody 98 (IGKV1-16)
QQYNSYPRT

SEQ ID NO: 196 - protein, 13 aa, Homo sapiens
  Heavy chain CDR3 for antibody 98 (IGHV3-33)
AKEDGDYHHYFDY

SEQ ID NO: 197 - protein, 9 aa, Homo sapiens
  Light chain CDR3 for antibody 99 (IGKV1-6)
LQDYNHPFT

SEQ ID NO: 198 - protein, 17 aa, Homo sapiens
  Heavy chain CDR3 for antibody 99 (IGHV3-33)
ARVYYDILTGYSPAFDI

SEQ ID NO: 199 - protein, 9 aa, Homo sapiens
  Light chain CDR3 for antibody 100 (IGKV1-6)
LQDYNYPYT

SEQ ID NO: 200 - protein, 13 aa, Homo sapiens
  Heavy chain CDR3 for antibody 100 (IGHV4-34)
ASNFYYYYYGMDV

SEQ ID NO: 201 - protein, 9 aa, Homo sapiens
  Light chain CDR3 for antibody 101 (IGKV1-6)
LQDYNYPWT

SEQ ID NO: 202 - protein, 17 aa, Homo sapiens
  Heavy chain CDR3 for antibody 101 (IGHV3-33)
ARESLKLGIYYYYGMDV

SEQ ID NO: 203 - protein, 9 aa, Homo sapiens
  Light chain CDR3 for antibody 102 (IGKV1-9)
QQLISYPLT

SEQ ID NO: 204 - protein, 21 aa, Homo sapiens
  Heavy chain CDR3 for antibody 102 (IGHV3-33)
ARKRLYDILTGYYKAYYGMDV

SEQ ID NO: 205 - protein, 9 aa, Homo sapiens
  Light chain CDR3 for antibody 103 (IGKV1-17)
LQHNSFPLT

SEQ ID NO: 206 - protein, 17 aa, Homo sapiens
  Heavy chain CDR3 for antibody 103 (IGHV3-33)
ARGEQWLGYYYYYGMDV

SEQ ID NO: 207 - protein, 9 aa, Homo sapiens
  Light chain CDR3 for antibody 104 (IGKV1-6)
LQDYNYPYT

SEQ ID NO: 208 - protein, 14 aa, Homo sapiens
  Heavy chain CDR3 for antibody 104 (IGHV3-33)
ARQYSYGYPYYFDY

SEQ ID NO: 209 - protein, 9 aa, Homo sapiens
  Light chain CDR3 for antibody 105 (IGKV1-16)
QQYNSYPIT

SEQ ID NO: 210 - protein, 9 aa, Homo sapiens
  Heavy chain CDR3 for antibody 105 (IGHV3-30)
ARDYFHYDY

SEQ ID NO: 211 - protein, 9 aa, Homo sapiens
  Light chain CDR3 for antibody 106 (IGKV3-11)
QQRINWPWT

SEQ ID NO: 212 - protein, 9 aa, Homo sapiens
  Heavy chain CDR3 for antibody 106 (IGHV4-59)
AREGGSGSL

SEQ ID NO: 213 - protein, 9 aa, Homo sapiens
  Light chain CDR3 for antibody 107 (IGKV1-17)
LQHNSYPWT

SEQ ID NO: 214 - protein, 14 aa, Homo sapiens
  Heavy chain CDR3 for antibody 107 (IGHV3-33)
ARDNILTAYYLFDY

SEQ ID NO: 215 - protein, 9 aa, Homo sapiens
  Light chain CDR3 for antibody 108 (IGKV1-6)
LQDYNYPRT

SEQ ID NO: 216 - protein, 12 aa, Homo sapiens
  Heavy chain CDR3 for antibody 108 (IGHV3-33)
AREGDILTGYSL

SEQ ID NO: 217 - protein, 9 aa, Homo sapiens
  Light chain CDR3 for antibody 109 (IGKV6-21)
HQSSNLPYT

SEQ ID NO: 218 - protein, 16 aa, Homo sapiens
  Heavy chain CDR3 for antibody 109 (IGHV1-8)
AREGTMVRGVTYAFDI

SEQ ID NO: 219 - protein, 9 aa, Homo sapiens
  Light chain CDR3 for antibody 110 (IGKV3-20)
QHYGSSPYT

SEQ ID NO: 220 - protein, 13 aa, Homo sapiens
  Heavy chain CDR3 for antibody 110 (IGHV3-33)
ARTDYYFYYGLDV

SEQ ID NO: 221 - protein, 9 aa, Homo sapiens
  Light chain CDR3 for antibody 111 (IGKV1D-16)
QQYNSYPYT

SEQ ID NO: 222 - protein, 12 aa, Homo sapiens
  Heavy chain CDR3 for antibody 111 (IGHV3-33)
ARVDAAAPYFDY

SEQ ID NO: 223 - protein, 9 aa, Homo sapiens
  Light chain CDR3 for antibody 112 (IGKV3-20)
QQYGSSPYT

SEQ ID NO: 224 - protein, 13 aa, Homo sapiens
  Heavy chain CDR3 for antibody 112 (IGHV3-33)
ARGDNWNDGGFDY

SEQ ID NO: 225 - protein, 9 aa, Homo sapiens
  Light chain CDR3 for antibody 113 (IGKV1-17)
LQHNSYPWT

SEQ ID NO: 226 - protein, 10 aa, Homo sapiens
  Heavy chain CDR3 for antibody 113 (IGHV3-33)
ARDGSGSQPI

SEQ ID NO: 227 - protein, 9 aa, Homo sapiens
  Light chain CDR3 for antibody 114 (IGKV3-20)
LQYGSSPYT

SEQ ID NO: 228 - protein, 16 aa, Homo sapiens
  Heavy chain CDR3 for antibody 114 (IGHV3-33)
ARGGRSDWLYYYGMDV

SEQ ID NO: 229 - protein, 9 aa, Homo sapiens
  Light chain CDR3 for antibody 115 (IGKV1-17)
LQHNSYPWT

SEQ ID NO: 230 - protein, 17 aa, Homo sapiens
  Heavy chain CDR3 for antibody 115 (IGHV3-33)
VREGGLLWVGELSLFDY

SEQ ID NO: 231 - protein, 9 aa, Homo sapiens
  Light chain CDR3 for antibody 116 (IGKV1-6)
LQDYKSPFT

SEQ ID NO: 232 - protein, 20 aa, Homo sapiens
  Heavy chain CDR3 for antibody 116 (IGHV3-23)
AKDREMAATSHYYYYYGMDV

SEQ ID NO: 233 - protein, 9 aa, Homo sapiens
  Light chain CDR3 for antibody 117 (IGKV1-6)
LQDYNYPYT

SEQ ID NO: 234 - protein, 20 aa, Homo sapiens
  Heavy chain CDR3 for antibody 117 (IGHV3-11)
ARGGATLIRGLIDYYYGMDV

SEQ ID NO: 235 - protein, 9 aa, Homo sapiens
  Light chain CDR3 for antibody 118 (IGKV1D-13)
QQFNNYPYT

SEQ ID NO: 236 - protein, 18 aa, Homo sapiens
  Heavy chain CDR3 for antibody 118 (IGHV3-33)
ARGLLWFGVSYYYYGMDV

SEQ ID NO: 237 - protein, 8 aa, Homo sapiens
  Light chain CDR3 for antibody 119 (IGKV1-5)
QQYNSYWT

SEQ ID NO: 238 - protein, 16 aa, Homo sapiens
  Heavy chain CDR3 for antibody 119 (IGHV3-33)
ARAVYYGSGSSLIMDV

SEQ ID NO: 239 - protein, 9 aa, Homo sapiens
  Light chain CDR3 for antibody 120 (IGKV1-6)
LQDYNYPYT

SEQ ID NO: 240 - protein, 16 aa, Homo sapiens
  Heavy chain CDR3 for antibody 120 (IGHV3-33)
ARGYDMLTGDYYGMDV

SEQ ID NO: 241 - protein, 9 aa, Homo sapiens
  Light chain CDR3 for antibody 121 (IGKV1-6)
QQEYNYPLT

SEQ ID NO: 242 - protein, 13 aa, Homo sapiens
  Heavy chain CDR3 for antibody 121 (IGHV1-46)
ARVKLGSLGAFDI

SEQ ID NO: 243 - protein, 9 aa, Homo sapiens
  Light chain CDR3 for antibody 122 (IGKV6-21)
HQSSSLPLT

SEQ ID NO: 244 - protein, 11 aa, Homo sapiens
  Heavy chain CDR3 for antibody 122 (IGHV3-33)
ARDILTGFLDH

SEQ ID NO: 245 - protein, 9 aa, Homo sapiens
  Light chain CDR3 for antibody 123 (IGKV1-39)
QQSYSTPWT

SEQ ID NO: 246 - protein, 18 aa, Homo sapiens
  Heavy chain CDR3 for antibody 123 (IGHV4-39)
ARQYYFGSGNYYRGWFDP

SEQ ID NO: 247 - protein, 9 aa, Homo sapiens
  Light chain CDR3 for antibody 124 (IGKV3-20)
QQYGSSPRT

SEQ ID NO: 248 - protein, 18 aa, Homo sapiens
  Heavy chain CDR3 for antibody 124 (IGHV3-23)
AKEGNYYGSGSYWGYFDP

SEQ ID NO: 249 - protein, 8 aa, Homo sapiens
  Light chain CDR3 for antibody 125 (IGKV3-20)
QQYGRSFT

SEQ ID NO: 250 - protein, 13 aa, Homo sapiens
  Heavy chain CDR3 for antibody 125 (IGHV4-39)
ARHHYGSGSLRDY

SEQ ID NO: 251 - protein, 9 aa, Homo sapiens
  Light chain CDR3 for antibody 126 (IGKV1D-16)
QQYNSYPYT

SEQ ID NO: 252 - protein, 16 aa, Homo sapiens
  Heavy chain CDR3 for antibody 126 (IGHV3-23)
AKEGMVLRYFDWLWDY

SEQ ID NO: 253 - protein, 9 aa, Homo sapiens
  Light chain CDR3 for antibody 127 (IGKV1-6)
LQDYNYPRT

SEQ ID NO: 254 - protein, 20 aa, Homo sapiens
  Heavy chain CDR3 for antibody 127 (IGHV1-18)
AREVGIAVAGTLYYYYGMDV

SEQ ID NO: 255 - protein, 9 aa, Homo sapiens
  Light chain CDR3 for antibody 128 (IGKV1D-16)
QQYNSYPRT

SEQ ID NO: 256 - protein, 11 aa, Homo sapiens
  Heavy chain CDR3 for antibody 128 (IGHV3-33)
ARAGIAAVFDY

SEQ ID NO: 257 - protein, 8 aa, Homo sapiens
  Light chain CDR3 for antibody 129 (IGKV1D-13)
QQFNNYPT

SEQ ID NO: 258 - protein, 18 aa, Homo sapiens
  Heavy chain CDR3 for antibody 129 (IGHV3-33)
ARDRYYDILTGYYMGFDY

SEQ ID NO: 259 - protein, 9 aa, Homo sapiens
  Light chain CDR3 for antibody 130 (IGKV1-6)
LQDYNYPWT

SEQ ID NO: 260 - protein, 14 aa, Homo sapiens
  Heavy chain CDR3 for antibody 130 (IGHV3-33)
ARRGSPLRPSHLDV

SEQ ID NO: 261 - protein, 10 aa, Homo sapiens
  Light chain CDR3 for antibody 131 (IGKV3-11)
QQRSNWPALT

SEQ ID NO: 262 - protein, 8 aa, Homo sapiens
  Heavy chain CDR3 for antibody 131 (IGHV3-23)
EKSAGEDV

SEQ ID NO: 263 - protein, 8 aa, Homo sapiens
  Light chain CDR3 for antibody 132 (IGKV3-11)
QQRSNWLT

SEQ ID NO: 264 - protein, 18 aa, Homo sapiens
  Heavy chain CDR3 for antibody 132 (IGHV1-8)
ARSRIAAAGIYYYYGMDV

SEQ ID NO: 265 - protein, 9 aa, Homo sapiens
  Light chain CDR3 for antibody 133 (IGKV1-17)
LQHNSYPIT

SEQ ID NO: 266 - protein, 17 aa, Homo sapiens
  Heavy chain CDR3 for antibody 133 (IGHV3-23)
AKDGSFYSSGWYDAFDI

SEQ ID NO: 267 - protein, 9 aa, Homo sapiens
  Light chain CDR3 for antibody 134 (IGKV1-9)
QQLNSYPYT

SEQ ID NO: 268 - protein, 13 aa, Homo sapiens
  Heavy chain CDR3 for antibody 134 (IGHV4-39)
ARHPPSRDYGMDV

SEQ ID NO: 269 - protein, 9 aa, Homo sapiens
  Light chain CDR3 for antibody 135 (IGKV1-17)
LQHNSYPRT

SEQ ID NO: 270 - protein, 17 aa, Homo sapiens
  Heavy chain CDR3 for antibody 135 (IGHV4-34)
AGLRFFDWLFDYYGMDV

SEQ ID NO: 271 - protein, 9 aa, Homo sapiens
  Light chain CDR3 for antibody 136 (IGKV1-39)
QQSYSTPYT

SEQ ID NO: 272 - protein, 13 aa, Homo sapiens
  Heavy chain CDR3 for antibody 136 (IGHV1-18)
ARSITMVRGVIGY

SEQ ID NO: 273 - protein, 9 aa, Homo sapiens
  Light chain CDR3 for antibody 137 (IGKV1-6)
LQDYNYPYT

SEQ ID NO: 274 - protein, 21 aa, Homo sapiens
  Heavy chain CDR3 for antibody 137 (IGHV3-23)
AKDIDYYGSGSYPLYYYGMDV

SEQ ID NO: 275 - protein, 9 aa, Homo sapiens
  Light chain CDR3 for antibody 138 (IGKV1-17)
LQYNSYPWT

SEQ ID NO: 276 - protein, 15 aa, Homo sapiens
  Heavy chain CDR3 for antibody 138 (IGHV3-30)
ARRGYGSGSPDAFDL

SEQ ID NO: 277 - protein, 9 aa, Homo sapiens
  Light chain CDR3 for antibody 139 (IGKV1-6)
LQDYNYMYT

SEQ ID NO: 278 - protein, 18 aa, Homo sapiens
  Heavy chain CDR3 for antibody 139 (IGHV3-33)
ARDGYSGYDYYYYYGMDV

SEQ ID NO: 279 - protein, 9 aa, Homo sapiens
  Light chain CDR3 for antibody 140 (IGKV3-11)
QQRSNWPLT

SEQ ID NO: 280 - protein, 11 aa, Homo sapiens
  Heavy chain CDR3 for antibody 140 (IGHV3-33)
ARGSGSYAFDS

SEQ ID NO: 281 - protein, 10 aa, Homo sapiens
  Light chain CDR3 for antibody 141 (IGKV1-17)
LQHNSYPMYT

SEQ ID NO: 282 - protein, 8 aa, Homo sapiens
  Heavy chain CDR3 for antibody 141 (IGHV3-23)
AETFLFDY

SEQ ID NO: 283 - protein, 9 aa, Homo sapiens
  Light chain CDR3 for antibody 142 (IGKV3D-7)
QQDYNLPYT

SEQ ID NO: 284 - protein, 11 aa, Homo sapiens
  Heavy chain CDR3 for antibody 142 (IGHV3-74)
ARDRGNWGFDY

SEQ ID NO: 285 - protein, 9 aa, Homo sapiens
  Light chain CDR3 for antibody 143 (IGKV1-6)
LQDYNYPYT

SEQ ID NO: 286 - protein, 15 aa, Homo sapiens
  Heavy chain CDR3 for antibody 143 (IGHV3-33)
VCVLYDYGDYVGFDY

SEQ ID NO: 287 - protein, 9 aa, Homo sapiens
  Light chain CDR3 for antibody 144 (IGKV1-6)
LQDYNYPRT

SEQ ID NO: 288 - protein, 16 aa, Homo sapiens
  Heavy chain CDR3 for antibody 144 (IGHV1-18)
ARYFDWLLRDYYGMDV

SEQ ID NO: 289 - protein, 9 aa, Homo sapiens
  Light chain CDR3 for antibody 145 (IGKV3D-7)
QQDYEFPLT

SEQ ID NO: 290 - protein, 12 aa, Homo sapiens
  Heavy chain CDR3 for antibody 145 (IGHV4-61)
ARVDSSGWFFDY

SEQ ID NO: 291 - protein, 9 aa, Homo sapiens
  Light chain CDR3 for antibody 146 (IGKV1D-16)
QQYDSYPYT

SEQ ID NO: 292 - protein, 14 aa, Homo sapiens
  Heavy chain CDR3 for antibody 146 (IGHV3-33)
VRDAMGATTAWFDP

SEQ ID NO: 293 - protein, 9 aa, Homo sapiens
  Light chain CDR3 for antibody 147 (IGKV3-20)
QLYGSSPYT

SEQ ID NO: 294 - protein, 17 aa, Homo sapiens
  Heavy chain CDR3 for antibody 147 (IGHV1-24)
ATEGYDILPGYYNVLDY

SEQ ID NO: 295 - protein, 9 aa, Homo sapiens
  Light chain CDR3 for antibody 148 (IGKV1-17)
LQHNSYPFT

SEQ ID NO: 296 - protein, 12 aa, Homo sapiens
  Heavy chain CDR3 for antibody 148 (IGHV3-23)
AKDGWFGESLDY

SEQ ID NO: 297 - protein, 9 aa, Homo sapiens
  Light chain CDR3 for antibody 149 (IGKV1-6)
LQDYNYPRT

SEQ ID NO: 298 - protein, 23 aa, Homo sapiens
  Heavy chain CDR3 for antibody 149 (IGHV4-59)
ARERTYSDILPGYYEDYYYGMDV

SEQ ID NO: 299 - protein, 9 aa, Homo sapiens
  Light chain CDR3 for antibody 150 (IGKV1-39)
QQSYSTPYT

SEQ ID NO: 300 - protein, 9 aa, Homo sapiens
  Heavy chain CDR3 for antibody 150 (IGHV4-59)
ARGGASFDY

SEQ ID NO: 301 - protein, 9 aa, Homo sapiens
  Light chain CDR3 for antibody 151 (IGKV1-9)
QQGNTYSRT

SEQ ID NO: 302 - protein, 11 aa, Homo sapiens
  Heavy chain CDR3 for antibody 151 (IGHV4-4)
AREAYYYGLDV

SEQ ID NO: 303 - protein, 9 aa, Homo sapiens
  Light chain CDR3 for antibody 152 (IGKV1-9)
QQLNSYPYT

SEQ ID NO: 304 - protein, 19 aa, Homo sapiens
  Heavy chain CDR3 for antibody 152 (IGHV3-33)
ARGVRLRYFDPYYYYGMDV

SEQ ID NO: 305 - protein, 9 aa, Homo sapiens
  Light chain CDR3 for antibody 153 (IGKV1-6)
LQDYNYPYT

SEQ ID NO: 306 - protein, 17 aa, Homo sapiens
  Heavy chain CDR3 for antibody 153 (IGHV3-23)
AKDGIGELSYYYYGMDV

SEQ ID NO: 307 - protein, 9 aa, Homo sapiens
  Light chain CDR3 for antibody 154 (IGKV1-6)
LQDYNYTWT

SEQ ID NO: 308 - protein, 14 aa, Homo sapiens
  Heavy chain CDR3 for antibody 154 (IGHV3-23)
ANWAYDILTGYLDY

SEQ ID NO: 309 - protein, 8 aa, Homo sapiens
  Light chain CDR3 for antibody 155 (IGKV1D-13)
QQFNNYYT

SEQ ID NO: 310 - protein, 18 aa, Homo sapiens
  Heavy chain CDR3 for antibody 155 (IGHV1-18)
ARDRYYYDSGSYYYGMDV

SEQ ID NO: 311 - protein, 9 aa, Homo sapiens
  Light chain CDR3 for antibody 156 (IGKV1-6)
LQDYNYPRT

SEQ ID NO: 312 - protein, 15 aa, Homo sapiens
  Heavy chain CDR3 for antibody 156 (IGHV3-33)
ARRGYNDYDPYGMDV

SEQ ID NO: 313 - protein, 9 aa, Homo sapiens
  Light chain CDR3 for antibody 157 (IGKV3-20)
QQYGSSPRT

SEQ ID NO: 314 - protein, 15 aa, Homo sapiens
  Heavy chain CDR3 for antibody 157 (IGHV1-24)
ATHWDLRYYYYGMDV

SEQ ID NO: 315 - protein, 9 aa, Homo sapiens
  Light chain CDR3 for antibody 158 (IGKV1-6)
LQDYNYPWT

SEQ ID NO: 316 - protein, 20 aa, Homo sapiens
  Heavy chain CDR3 for antibody 158 (IGHV3-33)
SRGGATLVRGVIDYYYGMDV

SEQ ID NO: 317 - protein, 9 aa, Homo sapiens
  Light chain CDR3 for antibody 159 (IGKV1-6)
LQDYNYPWT

SEQ ID NO: 318 - protein, 18 aa, Homo sapiens
  Heavy chain CDR3 for antibody 159 (IGHV3-33)
ARERDYYGSGSYPDAFDI

SEQ ID NO: 319 - protein, 9 aa, Homo sapiens
  Light chain CDR3 for antibody 160 (IGKV1-6)
LQDYNYPYT

SEQ ID NO: 320 - protein, 10 aa, Homo sapiens
  Heavy chain CDR3 for antibody 160 (IGHV3-23)
AKDHYGDYPY

SEQ ID NO: 321 - protein, 9 aa, Homo sapiens
  Light chain CDR3 for antibody 161 (IGKV5-2)
LQHDNFPWT

SEQ ID NO: 322 - protein, 13 aa, Homo sapiens
  Heavy chain CDR3 for antibody 161 (IGHV4-59)
ARDAGYSSSWFDY

SEQ ID NO: 323 - protein, 9 aa, Homo sapiens
  Light chain CDR3 for antibody 162 (IGKV1-6)
LQDYNYPWT

SEQ ID NO: 324 - protein, 17 aa, Homo sapiens
  Heavy chain CDR3 for antibody 162 (IGHV3-33)
ARAYYDILTGYSYYFDY

SEQ ID NO: 325 - protein, 8 aa, Homo sapiens
  Light chain CDR3 for antibody 163 (IGKV3D-7)
QQDYNLVT

SEQ ID NO: 326 - protein, 17 aa, Homo sapiens
  Heavy chain CDR3 for antibody 163 (IGHV4-59)
ARRITMVREIIITAFDY

SEQ ID NO: 327 - protein, 9 aa, Homo sapiens
  Light chain CDR3 for antibody 164 (IGKV1D-16)
QQYNSYPYT

SEQ ID NO: 328 - protein, 18 aa, Homo sapiens
  Heavy chain CDR3 for antibody 164 (IGHV6-1)
ARDQYSYGPYYYYYGMDV

SEQ ID NO: 329 - protein, 9 aa, Homo sapiens
  Light chain CDR3 for antibody 165 (IGKV1-6)
LQDYNYPRT

SEQ ID NO: 330 - protein, 12 aa, Homo sapiens
  Heavy chain CDR3 for antibody 165 (IGHV3-33)
ARKGYDMHEFDI

SEQ ID NO: 331 - protein, 10 aa, Homo sapiens
  Light chain CDR3 for antibody 166 (IGKV1-9)
QQLDSYPMYT

SEQ ID NO: 332 - protein, 11 aa, Homo sapiens
  Heavy chain CDR3 for antibody 166 (IGHV3-13)
AREAIIGPFDY

SEQ ID NO: 333 - protein, 9 aa, Homo sapiens
  Light chain CDR3 for antibody 167 (IGKV1-6)
LQDYNSPYT

SEQ ID NO: 334 - protein, 15 aa, Homo sapiens
  Heavy chain CDR3 for antibody 167 (IGHV3-23)
AKEALRYFDWSGMDV

SEQ ID NO: 335 - protein, 9 aa, Homo sapiens
  Light chain CDR3 for antibody 168 (IGKV1-9)
QQLNSYPYT

SEQ ID NO: 336 - protein, 14 aa, Homo sapiens
  Heavy chain CDR3 for antibody 168 (IGHV1-2)
ARDYYGSGNYYMGY

SEQ ID NO: 337 - protein, 9 aa, Homo sapiens
  Light chain CDR3 for antibody 169 (IGKV1-17)
LQHNSYPYT

SEQ ID NO: 338 - protein, 12 aa, Homo sapiens
  Heavy chain CDR3 for antibody 169 (IGHV3-33)
AREGTRWVYFDY

SEQ ID NO: 339 - protein, 9 aa, Homo sapiens
  Light chain CDR3 for antibody 170 (IGKV1D-16)
QQYNSYPLT

SEQ ID NO: 340 - protein, 15 aa, Homo sapiens
  Heavy chain CDR3 for antibody 170 (IGHV3-33)
ARGYYYGSGSFPVDY

SEQ ID NO: 341 - protein, 9 aa, Homo sapiens
  Light chain CDR3 for antibody 171 (IGKV3-11)
QQRSNWPWT

SEQ ID NO: 342 - protein, 11 aa, Homo sapiens
  Heavy chain CDR3 for antibody 171 (IGHV4-59)
ARDGVRGVFDI

SEQ ID NO: 343 - protein, 9 aa, Homo sapiens
  Light chain CDR3 for antibody 172 (IGKV1D-16)
QQYNSYPFT

SEQ ID NO: 344 - protein, 12 aa, Homo sapiens
  Heavy chain CDR3 for antibody 172 (IGHV3-23)
AKEYDILTGYFH

SEQ ID NO: 345 - protein, 9 aa, Homo sapiens
  Light chain CDR3 for antibody 173 (IGKV1D-16)
QQYNSYPYT

SEQ ID NO: 346 - protein, 13 aa, Homo sapiens
  Heavy chain CDR3 for antibody 173 (IGHV3-33)
ANTGDSYYYDMDV

SEQ ID NO: 347 - protein, 9 aa, Homo sapiens
  Light chain CDR3 for antibody 174 (IGKV3D-20)
QQYGYSPLT

SEQ ID NO: 348 - protein, 14 aa, Homo sapiens
  Heavy chain CDR3 for antibody 174 (IGHV3-23)
AKDRYRGYEGLFDY

SEQ ID NO: 349 - protein, 9 aa, Homo sapiens
  Light chain CDR3 for antibody 175 (IGKV1-6)
LQDYNFPFT

SEQ ID NO: 350 - protein, 17 aa, Homo sapiens
  Heavy chain CDR3 for antibody 175 (IGHV3-66)
ARVQYDILTGYSPYFDN

SEQ ID NO: 351 - protein, 9 aa, Homo sapiens
  Light chain CDR3 for antibody 176 (IGKV1-17)
LQHNSYPWT

SEQ ID NO: 352 - protein, 12 aa, Homo sapiens
  Heavy chain CDR3 for antibody 176 (IGHV3-33)
ARDPGYYYGLDV

SEQ ID NO: 353 - protein, 9 aa, Homo sapiens
  Light chain CDR3 for antibody 177 (IGKV1-6)
LQDYNYPYT

SEQ ID NO: 354 - protein, 24 aa, Homo sapiens
  Heavy chain CDR3 for antibody 177 (IGHV3-20)
ARGRITMVRGVIINPLDYYNGMDV

SEQ ID NO: 355 - protein, 9 aa, Homo sapiens
  Light chain CDR3 for antibody 178 (IGKV1-6)
LQDYNYPRT

SEQ ID NO: 356 - protein, 14 aa, Homo sapiens
  Heavy chain CDR3 for antibody 178 (IGHV3-33)
ARGGYSGYRYYFDY

SEQ ID NO: 357 - protein, 9 aa, Homo sapiens
  Light chain CDR3 for antibody 179 (IGKV1-6)
LQDYNYPYT

SEQ ID NO: 358 - protein, 11 aa, Homo sapiens
  Heavy chain CDR3 for antibody 179 (IGHV3-33)
AREGAVARFDY

SEQ ID NO: 359 - protein, 9 aa, Homo sapiens
  Light chain CDR3 for antibody 180 (IGKV3-20)
QQYGSSPYT

SEQ ID NO: 360 - protein, 13 aa, Homo sapiens
  Heavy chain CDR3 for antibody 180 (IGHV3-33)
ARQSSGWFDAFDI

SEQ ID NO: 361 - protein, 9 aa, Homo sapiens
  Light chain CDR3 for antibody 181 (IGKV1-17)
LQHNSYPYT

SEQ ID NO: 362 - protein, 11 aa, Homo sapiens
  Heavy chain CDR3 for antibody 181 (IGHV1-24)
ATELGLYYFDY

SEQ ID NO: 363 - protein, 9 aa, Homo sapiens
  Light chain CDR3 for antibody 182 (IGKV3-15)
QQYNNWPYT

SEQ ID NO: 364 - protein, 18 aa, Homo sapiens
  Heavy chain CDR3 for antibody 182 (IGHV3-33)
ARGGYSSGWDYYYYGMDV

SEQ ID NO: 365 - protein, 9 aa, Homo sapiens
  Light chain CDR3 for antibody 183 (IGKV1-17)
LQHNSFPYT

SEQ ID NO: 366 - protein, 17 aa, Homo sapiens
  Heavy chain CDR3 for antibody 183 (IGHV4-39)
ARVLRYFDWLSHDAFDI

SEQ ID NO: 367 - protein, 9 aa, Homo sapiens
  Light chain CDR3 for antibody 184 (IGKV1-17)
LQHTSYPFT

SEQ ID NO: 368 - protein, 13 aa, Homo sapiens
  Heavy chain CDR3 for antibody 184 (IGHV1-2)
ARDGVRGSFGMDV

SEQ ID NO: 369 - protein, 9 aa, Homo sapiens
  Light chain CDR3 for antibody 185 (IGKV1D-16)
QQYNSYPFT

SEQ ID NO: 370 - protein, 13 aa, Homo sapiens
  Heavy chain CDR3 for antibody 185 (IGHV3-33)
ARVDTMVRGVMAY

SEQ ID NO: 371 - protein, 9 aa, Homo sapiens
  Light chain CDR3 for antibody 186 (IGKV3-20)
QQYGSSPYT

SEQ ID NO: 372 - protein, 19 aa, Homo sapiens
  Heavy chain CDR3 for antibody 186 (IGHV3-33)
TRDPHYDILTGYAYYGMDV

SEQ ID NO: 373 - protein, 9 aa, Homo sapiens
  Light chain CDR3 for antibody 187 (IGKV1-6)
LQDYNYPRT

SEQ ID NO: 374 - protein, 12 aa, Homo sapiens
  Heavy chain CDR3 for antibody 187 (IGHV3-33)
ARDSSGWSHFDY

SEQ ID NO: 375 - protein, 9 aa, Homo sapiens
  Light chain CDR3 for antibody 188 (IGKV3-11)
QQRSNWPRT

SEQ ID NO: 376 - protein, 10 aa, Homo sapiens
  Heavy chain CDR3 for antibody 188 (IGHV1-18)
AREQRLGFDY

SEQ ID NO: 377 - protein, 9 aa, Homo sapiens
  Light chain CDR3 for antibody 189 (IGKV3D-7)
QQDYKLPLT

SEQ ID NO: 378 - protein, 11 aa, Homo sapiens
  Heavy chain CDR3 for antibody 189 (IGHV1-46)
AREEDLGAFDI

SEQ ID NO: 379 - protein, 9 aa, Homo sapiens
  Light chain CDR3 for antibody 190 (IGKV1-6)
LQDYNYPLT

SEQ ID NO: 380 - protein, 19 aa, Homo sapiens
  Heavy chain CDR3 for antibody 190 (IGHV3-30)
ARRFSGYSGYDHYYYGMDV

SEQ ID NO: 381 - protein, 9 aa, Homo sapiens
  Light chain CDR3 for antibody 191 (IGKV1-17)
LQHNSYPWT

SEQ ID NO: 382 - protein, 17 aa, Homo sapiens
  Heavy chain CDR3 for antibody 191 (IGHV3-33)
ARDLIGPLSSSWYPFDY

SEQ ID NO: 383 - protein, 9 aa, Homo sapiens
  Light chain CDR3 for antibody 192 (IGKV3D-7)
QQDYNLPYT

SEQ ID NO: 384 - protein, 13 aa, Homo sapiens
  Heavy chain CDR3 for antibody 192 (IGHV1-46)
ARRQVGYYYGMDV

SEQ ID NO: 385 - protein, 9 aa, Homo sapiens
  Light chain CDR3 for antibody 193 (IGKV3-20)
QQYGSSPWT

SEQ ID NO: 386 - protein, 13 aa, Homo sapiens
  Heavy chain CDR3 for antibody 193 (IGHV4-59)
ANRDYYGYYGMDV

SEQ ID NO: 387 - protein, 9 aa, Homo sapiens
  Light chain CDR3 for antibody 194 (IGKV1-6)
LQDYNYPYT

SEQ ID NO: 388 - protein, 13 aa, Homo sapiens
  Heavy chain CDR3 for antibody 194 (IGHV3-33)
ASGYSGYDWYFDL

SEQ ID NO: 389 - protein, 9 aa, Homo sapiens
  Light chain CDR3 for antibody 195 (IGKV3-20)
QQYGSSPYT

SEQ ID NO: 390 - protein, 19 aa, Homo sapiens
  Heavy chain CDR3 for antibody 195 (IGHV3-33)
ARGPYYDILTGYGYYGMDV

SEQ ID NO: 391 - protein, 9 aa, Homo sapiens
  Light chain CDR3 for antibody 196 (IGKV1-9)
QQLNSYPYT

SEQ ID NO: 392 - protein, 12 aa, Homo sapiens
  Heavy chain CDR3 for antibody 196 (IGHV3-h)
AREDYYYYGMDV

SEQ ID NO: 393 - protein, 9 aa, Homo sapiens
  Light chain CDR3 for antibody 197 (IGKV1-16)
QHYNDYPFT

SEQ ID NO: 394 - protein, 14 aa, Homo sapiens
  Heavy chain CDR3 for antibody 197 (IGHV3-33)
VRDQGSMVRGGGDY

SEQ ID NO: 395 - protein, 9 aa, Homo sapiens
  Light chain CDR3 for antibody 198 (IGKV1-6)
LQDYNYPWT

SEQ ID NO: 396 - protein, 16 aa, Homo sapiens
  Heavy chain CDR3 for antibody 198 (IGHV3-33)
ARDNFGSGSYYSHFHY

SEQ ID NO: 397 - protein, 9 aa, Homo sapiens
  Light chain CDR3 for antibody 199 (IGKV1-17)
LQHNSYPYT

SEQ ID NO: 398 - protein, 21 aa, Homo sapiens
  Heavy chain CDR3 for antibody 199 (IGHV3-33)
ARDEYYEIVTGYGYYHYGMDV

SEQ ID NO: 399 - protein, 9 aa, Homo sapiens
  Light chain CDR3 for antibody 200 (IGKV1-5)
QQYNSYSYT

SEQ ID NO: 400 - protein, 26 aa, Homo sapiens
  Heavy chain CDR3 for antibody 200 (IGHV4-39)
ARQGLLWFGDLKAYDSSGYYYGYFHH

SEQ ID NO: 401 - protein, 9 aa, Homo sapiens
  Light chain CDR3 for antibody 201 (IGKV6-21)
HQSSSLPYT

SEQ ID NO: 402 - protein, 12 aa, Homo sapiens
  Heavy chain CDR3 for antibody 201 (IGHV3-13)
ARDRGYSGYFDY

SEQ ID NO: 403 - protein, 9 aa, Homo sapiens
  Light chain CDR3 for antibody 202 (IGKV1-17)
LQHNSYPYT

SEQ ID NO: 404 - protein, 15 aa, Homo sapiens
  Heavy chain CDR3 for antibody 202 (IGHV1-46)
ARGAVDDYYYYGMDV

SEQ ID NO: 405 - protein, 9 aa, Homo sapiens
  Light chain CDR3 for antibody 203 (IGKV1-17)
LQHNSYPLT

SEQ ID NO: 406 - protein, 14 aa, Homo sapiens
  Heavy chain CDR3 for antibody 203 (IGHV1-46)
ARKGIVGAFDAFDI

SEQ ID NO: 407 - protein, 9 aa, Homo sapiens
  Light chain CDR3 for antibody 204 (IGKV1D-13)
QHFNNYMYT

SEQ ID NO: 408 - protein, 17 aa, Homo sapiens
  Heavy chain CDR3 for antibody 204 (IGHV4-39)
ARQGWYYGSGSSLLFDY

SEQ ID NO: 409 - protein, 9 aa, Homo sapiens
  Light chain CDR3 for antibody 205 (IGKV1-9)
QQLNSYPLT

SEQ ID NO: 410 - protein, 12 aa, Homo sapiens
  Heavy chain CDR3 for antibody 205 (IGHV4-59)
ARDSGSYYYFDY

SEQ ID NO: 411 - protein, 9 aa, Homo sapiens
  Light chain CDR3 for antibody 206 (IGKV1D-16)
QQYSSYPYT

SEQ ID NO: 412 - protein, 17 aa, Homo sapiens
  Heavy chain CDR3 for antibody 206 (IGHV3-64)
ARERYYGSGSYYNWFDP

SEQ ID NO: 413 - protein, 9 aa, Homo sapiens
  Light chain CDR3 for antibody 207 (IGKV1-6)
LQDYNYPWT

SEQ ID NO: 414 - protein, 13 aa, Homo sapiens
  Heavy chain CDR3 for antibody 207 (IGHV4-39)
APFRVMVRGVLDY

SEQ ID NO: 415 - protein, 9 aa, Homo sapiens
  Light chain CDR3 for antibody 208 (IGKV1D-13)
QQFNNYPST

SEQ ID NO: 416 - protein, 18 aa, Homo sapiens
  Heavy chain CDR3 for antibody 208 (IGHV3-33)
ARREGITLIFYYYYGMDV

SEQ ID NO: 417 - protein, 10 aa, Homo sapiens
  Light chain CDR3 for antibody 209 (IGKV3-11)
QQRSNWPTWT

SEQ ID NO: 418 - protein, 8 aa, Homo sapiens
  Heavy chain CDR3 for antibody 209 (IGHV3-23)
AKESLLDY

SEQ ID NO: 419 - protein, 9 aa, Homo sapiens
  Light chain CDR3 for antibody 210 (IGKV6-21)
HQSSSLPLT

SEQ ID NO: 420 - protein, 14 aa, Homo sapiens
  Heavy chain CDR3 for antibody 210 (IGHV3-20)
ARDGGSTCYDWFDP

SEQ ID NO: 421 - protein, 9 aa, Homo sapiens
  Light chain CDR3 for antibody 211 (IGKV1-6)
LQDYNSPWT

SEQ ID NO: 422 - protein, 17 aa, Homo sapiens
  Heavy chain CDR3 for antibody 211 (IGHV3-33)
ARVRGVIEGYYYYGMDV

SEQ ID NO: 423 - protein, 9 aa, Homo sapiens
  Light chain CDR3 for antibody 212 (IGKV1-17)
LQHNSYPYT

SEQ ID NO: 424 - protein, 12 aa, Homo sapiens
  Heavy chain CDR3 for antibody 212 (IGHV3-33)
ASRDILTGYLGY

SEQ ID NO: 425 - protein, 9 aa, Homo sapiens
  Light chain CDR3 for antibody 213 (IGKV1-6)
LQDYNYPYT

SEQ ID NO: 426 - protein, 18 aa, Homo sapiens
  Heavy chain CDR3 for antibody 213 (IGHV3-33)
ARERGYYGSDIYPAAFDI

SEQ ID NO: 427 - protein, 9 aa, Homo sapiens
  Light chain CDR3 for antibody 214 (IGKV3D-20)
QQYGSSPLT

SEQ ID NO: 428 - protein, 13 aa, Homo sapiens
  Heavy chain CDR3 for antibody 214 (IGHV4-39)
ARRDGSYYGYFDY

SEQ ID NO: 429 - protein, 9 aa, Homo sapiens
  Light chain CDR3 for antibody 215 (IGKV1D-13)
QQFNNYPWT

SEQ ID NO: 430 - protein, 12 aa, Homo sapiens
  Heavy chain CDR3 for antibody 215 (IGHV4-39)
ARQMVREGWFDP

SEQ ID NO: 431 - protein, 10 aa, Homo sapiens
  Light chain CDR3 for antibody 216 (IGKV3-11)
QQRSNWPMYT

SEQ ID NO: 432 - protein, 9 aa, Homo sapiens
  Heavy chain CDR3 for antibody 216 (IGHV3-23)
AKEQQLFDY

SEQ ID NO: 433 - protein, 9 aa, Homo sapiens
  Light chain CDR3 for antibody 217 (IGKV1-6)
LQDYNYPYT

SEQ ID NO: 434 - protein, 13 aa, Homo sapiens
  Heavy chain CDR3 for antibody 217 (IGHV3-33)
AREYCSGGSCYDY

SEQ ID NO: 435 - protein, 9 aa, Homo sapiens
  Light chain CDR3 for antibody 218 (IGKV1D-16)
QQYNSYPYT

SEQ ID NO: 436 - protein, 13 aa, Homo sapiens
  Heavy chain CDR3 for antibody 218 (IGHV3-11)
ARDGGAAAGTWDS

SEQ ID NO: 437 - protein, 9 aa, Homo sapiens
  Light chain CDR3 for antibody 219 (IGKV1-6)
LQDYNYPRT

SEQ ID NO: 438 - protein, 18 aa, Homo sapiens
  Heavy chain CDR3 for antibody 219 (IGHV4-59)
ARERGNWNDVDYYYGMDV

SEQ ID NO: 439 - protein, 9 aa, Homo sapiens
  Light chain CDR3 for antibody 220 (IGKV3D-7)
QQDYNLPYT

SEQ ID NO: 440 - protein, 13 aa, Homo sapiens
  Heavy chain CDR3 for antibody 220 (IGHV4-39)
ARRDVLAPAAFDY

SEQ ID NO: 441 - protein, 9 aa, Homo sapiens
  Light chain CDR3 for antibody 221 (IGKV1-6)
LQDYNYPWT

SEQ ID NO: 442 - protein, 20 aa, Homo sapiens
  Heavy chain CDR3 for antibody 221 (IGHV3-33)
AREDYYGSGSYYPAYNWFDP

SEQ ID NO: 443 - protein, 9 aa, Homo sapiens
  Light chain CDR3 for antibody 222 (IGKV1-6)
LQDYNLPYT

SEQ ID NO: 444 - protein, 14 aa, Homo sapiens
  Heavy chain CDR3 for antibody 222 (IGHV1-46)
ARDGVGAKEGGFDY

SEQ ID NO: 445 - protein, 9 aa, Homo sapiens
  Light chain CDR3 for antibody 223 (IGKV3D-20)
QQYGRSPRT

SEQ ID NO: 446 - protein, 16 aa, Homo sapiens
  Heavy chain CDR3 for antibody 223 (IGHV1-24)
ATDWNDRGYYYYGMDV

SEQ ID NO: 447 - protein, 9 aa, Homo sapiens
  Light chain CDR3 for antibody 224 (IGKV1-6)
LQDNNYPWT

SEQ ID NO: 448 - protein, 14 aa, Homo sapiens
  Heavy chain CDR3 for antibody 224 (IGHV4-39)
ARQGTMIRGGYFDY

SEQ ID NO: 449 - protein, 9 aa, Homo sapiens
  Light chain CDR3 for antibody 225 (IGKV3-20)
QQYGSSPIT

SEQ ID NO: 450 - protein, 13 aa, Homo sapiens
  Heavy chain CDR3 for antibody 225 (IGHV3-33)
ARIDYYSYYGMDV

SEQ ID NO: 451 - protein, 9 aa, Homo sapiens
  Light chain CDR3 for antibody 226 (IGKV3D-7)
QQDYEFPIT

SEQ ID NO: 452 - protein, 12 aa, Homo sapiens
  Heavy chain CDR3 for antibody 226 (IGHV4-61)
ARVYSSGWLFDY

SEQ ID NO: 453 - protein, 9 aa, Homo sapiens
  Light chain CDR3 for antibody 227 (IGKV1-17)
LQHNSYPRT

SEQ ID NO: 454 - protein, 7 aa, Homo sapiens
  Heavy chain CDR3 for antibody 227 (IGHV3-33)
ARELVDY

SEQ ID NO: 455 - protein, 9 aa, Homo sapiens
  Light chain CDR3 for antibody 228 (IGKV6-21)
HQSYSLPHT

SEQ ID NO: 456 - protein, 9 aa, Homo sapiens
  Heavy chain CDR3 for antibody 228 (IGHV3-33)
AREYKEFDY

SEQ ID NO: 457 - protein, 9 aa, Homo sapiens
  Light chain CDR3 for antibody 229 (IGKV1-17)
LQHNTYPYT

SEQ ID NO: 458 - protein, 13 aa, Homo sapiens
  Heavy chain CDR3 for antibody 229 (IGHV3-33)
ARGVLWFGELFDY

SEQ ID NO: 459 - protein, 9 aa, Homo sapiens
  Light chain CDR3 for antibody 230 (IGKV1D-13)
QQFNNYPST

SEQ ID NO: 460 - protein, 17 aa, Homo sapiens
  Heavy chain CDR3 for antibody 230 (IGHV3-33)
ARGGAAAGPYLYYGLDV

SEQ ID NO: 461 - protein, 9 aa, Homo sapiens
  Light chain CDR3 for antibody 231 (IGKV3-15)
QQYNNWPFT

SEQ ID NO: 462 - protein, 18 aa, Homo sapiens
  Heavy chain CDR3 for antibody 231 (IGHV1-18)
ARDPNYYGSGSYYNYFDY

SEQ ID NO: 463 - protein, 9 aa, Homo sapiens
  Light chain CDR3 for antibody 232 (IGKV3-20)
QQYGRSPRT

SEQ ID NO: 464 - protein, 20 aa, Homo sapiens
  Heavy chain CDR3 for antibody 232 (IGHV1-f)
ATHYDILTGSPYYYYCALDV

SEQ ID NO: 465 - protein, 9 aa, Homo sapiens
  Light chain CDR3 for antibody 233 (IGKV2-30)
MQGTHWPLT

SEQ ID NO: 466 - protein, 13 aa, Homo sapiens
  Heavy chain CDR3 for antibody 233 (IGHV3-33)
ARVDTMVRGVMAY

SEQ ID NO: 467 - protein, 9 aa, Homo sapiens
  Light chain CDR3 for antibody 234 (IGKV1-6)
LQDYNYPWT

SEQ ID NO: 468 - protein, 18 aa, Homo sapiens
  Heavy chain CDR3 for antibody 234 (IGHV3-33)
VRDRERYGSGSYPDAFDI

SEQ ID NO: 469 - protein, 9 aa, Homo sapiens
  Light chain CDR3 for antibody 235 (IGKV5-2)
LQHDNFPWT

SEQ ID NO: 470 - protein, 18 aa, Homo sapiens
  Heavy chain CDR3 for antibody 235 (IGHV4-59)
AREGDYVWGSYRPNWFDP

SEQ ID NO: 471 - protein, 9 aa, Homo sapiens
  Light chain CDR3 for antibody 236 (IGKV6-21)
HQSSSLPYT

SEQ ID NO: 472 - protein, 16 aa, Homo sapiens
  Heavy chain CDR3 for antibody 236 (IGHV3-23)
AKEGEVLRYFDWLFNY

SEQ ID NO: 473 - protein, 9 aa, Homo sapiens
  Light chain CDR3 for antibody 237 (IGKV6-21)
HQSSSLPHT

SEQ ID NO: 474 - protein, 14 aa, Homo sapiens
  Heavy chain CDR3 for antibody 237 (IGHV3-20)
ARDGGSTSFDWFDP

SEQ ID NO: 475 - protein, 9 aa, Homo sapiens
  Light chain CDR3 for antibody 238 (IGKV1D-16)
QQYNSYPYT

SEQ ID NO: 476 - protein, 13 aa, Homo sapiens
  Heavy chain CDR3 for antibody 238 (IGHV3-33)
ARDYTMVRGVMNY

SEQ ID NO: 477 - protein, 9 aa, Homo sapiens
  Light chain CDR3 for antibody 239 (IGKV3D-7)
QQDYNLPWT

SEQ ID NO: 478 - protein, 12 aa, Homo sapiens
  Heavy chain CDR3 for antibody 239 (IGHV3-23)
AKEGLGSDYEPY

SEQ ID NO: 479 - protein, 9 aa, Homo sapiens
  Light chain CDR3 for antibody 240 (IGKV3D-20)
QQYGSSPVT

SEQ ID NO: 480 - protein, 9 aa, Homo sapiens
  Heavy chain CDR3 for antibody 240 (IGHV1-18)
ARGGWGFEY

SEQ ID NO: 481 - protein, 9 aa, Homo sapiens
  Light chain CDR3 for antibody 241 (IGKV3-20)
QQYGSSPLT

SEQ ID NO: 482 - protein, 12 aa, Homo sapiens
  Heavy chain CDR3 for antibody 241 (IGHV1-18)
AGVLFDGDYFDY

SEQ ID NO: 483 - protein, 9 aa, Homo sapiens
  Light chain CDR3 for antibody 242 (IGKV1-9)
QQLNSYPYT

SEQ ID NO: 484 - protein, 15 aa, Homo sapiens
  Heavy chain CDR3 for antibody 242 (IGHV3-74)
ARGSGSHYHYYGMDV

SEQ ID NO: 485 - protein, 9 aa, Homo sapiens
  Light chain CDR3 for antibody 243 (IGKV1D-16)
QQYNSYPLT

SEQ ID NO: 486 - protein, 11 aa, Homo sapiens
  Heavy chain CDR3 for antibody 243 (IGHV3-33)
ARDRSSGPFDY

SEQ ID NO: 487 - protein, 9 aa, Homo sapiens
  Light chain CDR3 for antibody 244 (IGKV3D-20)
QQYGSSPFT

SEQ ID NO: 488 - protein, 15 aa, Homo sapiens
  Heavy chain CDR3 for antibody 244 (IGHV1-46)
ARGRFFDWLLSPFDY

SEQ ID NO: 489 - protein, 9 aa, Homo sapiens
  Light chain CDR3 for antibody 245 (IGKV1-5)
QQYNTYSRT

SEQ ID NO: 490 - protein, 10 aa, Homo sapiens
  Heavy chain CDR3 for antibody 245 (IGHV3-74)
ARENWGGFDY

SEQ ID NO: 491 - protein, 9 aa, Homo sapiens
  Light chain CDR3 for antibody 246 (IGKV1D-13)
QRFNNYLYT

SEQ ID NO: 492 - protein, 20 aa, Homo sapiens
  Heavy chain CDR3 for antibody 246 (IGHV3-33)
ARDPAQLERRYYYFYYGMDV

SEQ ID NO: 493 - protein, 9 aa, Homo sapiens
  Light chain CDR3 for antibody 247 (IGKV1D-13)
QQFNNYPYT

SEQ ID NO: 494 - protein, 15 aa, Homo sapiens
  Heavy chain CDR3 for antibody 247 (IGHV3-23)
AKDGGWNYYYYGMDV

SEQ ID NO: 495 - protein, 9 aa, Homo sapiens
  Light chain CDR3 for antibody 248 (IGKV6-21)
HQSSSLPYT

SEQ ID NO: 496 - protein, 14 aa, Homo sapiens
  Heavy chain CDR3 for antibody 248 (IGHV4-39)
ARHGYYGSSNWFDP

SEQ ID NO: 497 - protein, 9 aa, Homo sapiens
  Light chain CDR3 for antibody 249 (IGKV1-17)
LQHNSYPYT

SEQ ID NO: 498 - protein, 10 aa, Homo sapiens
  Heavy chain CDR3 for antibody 249 (IGHV3-30)
AREWYGGMDV

SEQ ID NO: 499 - protein, 9 aa, Homo sapiens
  Light chain CDR3 for antibody 250 (IGKV1-6)
LQDYNYPFT

SEQ ID NO: 500 - protein, 14 aa, Homo sapiens
  Heavy chain CDR3 for antibody 250 (IGHV3-33)
ARRGYSGYDWYFDY

SEQ ID NO: 501 - protein, 9 aa, Homo sapiens
  Light chain CDR3 for antibody 251 (IGKV1-6)
LQDYNYPYT

SEQ ID NO: 502 - protein, 18 aa, Homo sapiens
  Heavy chain CDR3 for antibody 251 (IGHV3-33)
ARDQYSGYDFYYYYGMDV

SEQ ID NO: 503 - protein, 9 aa, Homo sapiens
  Light chain CDR3 for antibody 252 (IGKV1D-16)
QQYNSYPPT

SEQ ID NO: 504 - protein, 17 aa, Homo sapiens
  Heavy chain CDR3 for antibody 252 (IGHV3-33)
ARQGVLLWFGELYYFDY

SEQ ID NO: 505 - protein, 9 aa, Homo sapiens
  Light chain CDR3 for antibody 253 (IGKV1-6)
LQDFHYPWT

SEQ ID NO: 506 - protein, 23 aa, Homo sapiens
  Heavy chain CDR3 for antibody 253 (IGHV3-11)
ARDEGVTMVRGVISYYYYYGMDV

SEQ ID NO: 507 - protein, 9 aa, Homo sapiens
  Light chain CDR3 for antibody 254 (IGKV1-6)
LQDYNYPRT

SEQ ID NO: 508 - protein, 14 aa, Homo sapiens
  Heavy chain CDR3 for antibody 254 (IGHV3-33)
AREDYYGPLNWFDP

SEQ ID NO: 509 - protein, 9 aa, Homo sapiens
  Light chain CDR3 for antibody 255 (IGKV1-6)
LQDYNYPWT

SEQ ID NO: 510 - protein, 16 aa, Homo sapiens
  Heavy chain CDR3 for antibody 255 (IGHV3-30)
ARDIAVAGHVYYGMDV

SEQ ID NO: 511 - protein, 9 aa, Homo sapiens
  Light chain CDR3 for antibody 256 (IGKV5-2)
LQHDNFPWT

SEQ ID NO: 512 - protein, 13 aa, Homo sapiens
  Heavy chain CDR3 for antibody 256 (IGHV3-33)
ARDYCGGDCYLDY

SEQ ID NO: 513 - protein, 9 aa, Homo sapiens
  Light chain CDR3 for antibody 257 (IGKV1-6)
LQDYNYPYT

SEQ ID NO: 514 - protein, 16 aa, Homo sapiens
  Heavy chain CDR3 for antibody 257 (IGHV3-33)
ARGDDILTHQYYGVDV

SEQ ID NO: 515 - protein, 9 aa, Homo sapiens
  Light chain CDR3 for antibody 258 (IGKV1-33)
QQYDNLPFT

SEQ ID NO: 516 - protein, 18 aa, Homo sapiens
  Heavy chain CDR3 for antibody 258 (IGHV3-30)
ARDRHHDILTGYSDAFEI

SEQ ID NO: 517 - protein, 9 aa, Homo sapiens
  Light chain CDR3 for antibody 259 (IGKV1-6)
LQDYNYPYT

SEQ ID NO: 518 - protein, 16 aa, Homo sapiens
  Heavy chain CDR3 for antibody 259 (IGHV3-13)
ARDRSYESYYYYGMDV

SEQ ID NO: 519 - protein, 9 aa, Homo sapiens
  Light chain CDR3 for antibody 260 (IGKV1-6)
LQDYNYPFT

SEQ ID NO: 520 - protein, 16 aa, Homo sapiens
  Heavy chain CDR3 for antibody 260 (IGHV3-33)
ARDKNTDYDILTGFDY

SEQ ID NO: 521 - protein, 10 aa, Homo sapiens
  Light chain CDR3 for antibody 261 (IGKV1-17)
LQHNSYPMYT

SEQ ID NO: 522 - protein, 9 aa, Homo sapiens
  Heavy chain CDR3 for antibody 261 (IGHV3-23)
ARIWWLKDY

SEQ ID NO: 523 - protein, 9 aa, Homo sapiens
  Light chain CDR3 for antibody 262 (IGKV1D-16)
QQYNSYPYT

SEQ ID NO: 524 - protein, 13 aa, Homo sapiens
  Heavy chain CDR3 for antibody 262 (IGHV3-21)
ARDSTLVRGVFPY

SEQ ID NO: 525 - protein, 9 aa, Homo sapiens
  Light chain CDR3 for antibody 263 (IGKV3-20)
QQYGSSPLT

SEQ ID NO: 526 - protein, 14 aa, Homo sapiens
  Heavy chain CDR3 for antibody 263 (IGHV1-24)
ATWLPLYYYYGMDV

SEQ ID NO: 527 - protein, 9 aa, Homo sapiens
  Light chain CDR3 for antibody 264 (IGKV1-6)
LQDYNYPWT

SEQ ID NO: 528 - protein, 18 aa, Homo sapiens
  Heavy chain CDR3 for antibody 264 (IGHV3-33)
AREGDYYGSGGFPNWFDP

SEQ ID NO: 529 - protein, 9 aa, Homo sapiens
  Light chain CDR3 for antibody 265 (IGKV1-6)
LQDYNYPWT

SEQ ID NO: 530 - protein, 17 aa, Homo sapiens
  Heavy chain CDR3 for antibody 265 (IGHV3-33)
ARGDGDILTGYYEWFDP

SEQ ID NO: 531 - protein, 10 aa, Homo sapiens
  Light chain CDR3 for antibody 266 (IGKV3-11)
QQRSNWPPFT

SEQ ID NO: 532 - protein, 17 aa, Homo sapiens
  Heavy chain CDR3 for antibody 266 (IGHV3-23)
AKDYDILTGYSHNWFDP

SEQ ID NO: 533 - protein, 8 aa, Homo sapiens
  Light chain CDR3 for antibody 267 (IGKV3-11)
LQRGNWPT

SEQ ID NO: 534 - protein, 14 aa, Homo sapiens
  Heavy chain CDR3 for antibody 267 (IGHV3-15)
SIYYYGSGRDFFDY

SEQ ID NO: 535 - protein, 9 aa, Homo sapiens
  Light chain CDR3 for antibody 268 (IGKV1-9)
QQLNSYPLT

SEQ ID NO: 536 - protein, 13 aa, Homo sapiens
  Heavy chain CDR3 for antibody 268 (IGHV3-23)
AKDRGYSSTSTAY

SEQ ID NO: 537 - protein, 9 aa, Homo sapiens
  Light chain CDR3 for antibody 269 (IGKV1-6)
LQDYNYPYT

SEQ ID NO: 538 - protein, 19 aa, Homo sapiens
  Heavy chain CDR3 for antibody 269 (IGHV1-24)
ATAGLQWFGEKIGYYGMDV

SEQ ID NO: 539 - protein, 9 aa, Homo sapiens
  Light chain CDR3 for antibody 270 (IGKV1-6)
LQDYNYPYT

SEQ ID NO: 540 - protein, 17 aa, Homo sapiens
  Heavy chain CDR3 for antibody 270 (IGHV4-39)
AGRLTYYYGSGSPSFDY

SEQ ID NO: 541 - protein, 9 aa, Homo sapiens
  Light chain CDR3 for antibody 271 (IGKV1-6)
LQDYNYPRT

SEQ ID NO: 542 - protein, 14 aa, Homo sapiens
  Heavy chain CDR3 for antibody 271 (IGHV4-59)
AKGGSGSYYNWFDP

SEQ ID NO: 543 - protein, 9 aa, Homo sapiens
  Light chain CDR3 for antibody 272 (IGKV1D-16)
QQYNSYPLT

SEQ ID NO: 544 - protein, 19 aa, Homo sapiens
  Heavy chain CDR3 for antibody 272 (IGHV4-59)
ARDRVVGATTYYYYYGMDV

SEQ ID NO: 545 - protein, 9 aa, Homo sapiens
  Light chain CDR3 for antibody 273 (IGKV1-6)
LQDYNYPYT

SEQ ID NO: 546 - protein, 15 aa, Homo sapiens
  Heavy chain CDR3 for antibody 273 (IGHV4-39)
ARRDYDILTGYLFDY

SEQ ID NO: 547 - protein, 9 aa, Homo sapiens
  Light chain CDR3 for antibody 274 (IGKV1-6)
LQDYNYPYT

SEQ ID NO: 548 - protein, 18 aa, Homo sapiens
  Heavy chain CDR3 for antibody 274 (IGHV3-13)
ARDYYGSGSLYYYYGMDV

SEQ ID NO: 549 - protein, 9 aa, Homo sapiens
  Light chain CDR3 for antibody 275 (IGKV1-17)
LQHNSYPFT

SEQ ID NO: 550 - protein, 8 aa, Homo sapiens
  Heavy chain CDR3 for antibody 275 (IGHV3-33)
ARDRGFDY

SEQ ID NO: 551 - protein, 9 aa, Homo sapiens
  Light chain CDR3 for antibody 276 (IGKV1-39)
QQSYSTPFT

SEQ ID NO: 552 - protein, 16 aa, Homo sapiens
  Heavy chain CDR3 for antibody 276 (IGHV3-33)
ARDGSMVRRIHDAFDF

SEQ ID NO: 553 - protein, 9 aa, Homo sapiens
  Light chain CDR3 for antibody 277 (IGKV1-6)
LQDYNYPYT

SEQ ID NO: 554 - protein, 15 aa, Homo sapiens
  Heavy chain CDR3 for antibody 277 (IGHV3-33)
AREGLRYFHYYGMDV

SEQ ID NO: 555 - protein, 9 aa, Homo sapiens
  Light chain CDR3 for antibody 278 (IGKV1-6)
LQDYNYPFT

SEQ ID NO: 556 - protein, 13 aa, Homo sapiens
  Heavy chain CDR3 for antibody 278 (IGHV3-23)
AKDRGLRYYGMDV

SEQ ID NO: 557 - protein, 9 aa, Homo sapiens
  Light chain CDR3 for antibody 279 (IGKV1D-16)
QQYNSYPLT

SEQ ID NO: 558 - protein, 11 aa, Homo sapiens
  Heavy chain CDR3 for antibody 279 (IGHV4-59)
TRDRGLGSFDY

SEQ ID NO: 559 - protein, 9 aa, Homo sapiens
  Light chain CDR3 for antibody 280 (IGKV1-9)
QQLNSYPLT

SEQ ID NO: 560 - protein, 13 aa, Homo sapiens
  Heavy chain CDR3 for antibody 280 (IGHV3-30)
AAPFMVRGDGMDV

SEQ ID NO: 561 - protein, 9 aa, Homo sapiens
  Light chain CDR3 for antibody 281 (IGKV3-20)
QQYGSSPYT

SEQ ID NO: 562 - protein, 11 aa, Homo sapiens
  Heavy chain CDR3 for antibody 281 (IGHV3-33)
ARDRSSGPFDY

SEQ ID NO: 563 - protein, 7 aa, Homo sapiens
  Light chain CDR3 for antibody 282 (IGKV1-17)
LQHNSYP

SEQ ID NO: 564 - protein, 15 aa, Homo sapiens
  Heavy chain CDR3 for antibody 282 (IGHV1-18)
ARRSPNWGHYYGMDV

SEQ ID NO: 565 - protein, 9 aa, Homo sapiens
  Light chain CDR3 for antibody 283 (IGKV3-20)
QQYGSSPWT

SEQ ID NO: 566 - protein, 15 aa, Homo sapiens
  Heavy chain CDR3 for antibody 283 (IGHV4-39)
ARHSGYSSGWYPFDY

SEQ ID NO: 567 - protein, 9 aa, Homo sapiens
  Light chain CDR3 for antibody 284 (IGKV1D-16)
QQYNSYPYT

SEQ ID NO: 568 - protein, 13 aa, Homo sapiens
  Heavy chain CDR3 for antibody 284 (IGHV3-66)
ANTGDSYYYGFYV

SEQ ID NO: 569 - protein, 9 aa, Homo sapiens
  Light chain CDR3 for antibody 285 (IGKV3-20)
QQYGSSPYT

SEQ ID NO: 570 - protein, 13 aa, Homo sapiens
  Heavy chain CDR3 for antibody 285 (IGHV4-59)
ARDAGYSSSWFDY

SEQ ID NO: 571 - protein, 9 aa, Homo sapiens
  Light chain CDR3 for antibody 286 (IGKV1-9)
QQLNSYPYT

SEQ ID NO: 572 - protein, 24 aa, Homo sapiens
  Heavy chain CDR3 for antibody 286 (IGHV1-46)
ARDEARGLLTGYYNMREYYYGMDV

SEQ ID NO: 573 - protein, 9 aa, Homo sapiens
  Light chain CDR3 for antibody 287 (IGKV2-30)
MQGTHWPLT

SEQ ID NO: 574 - protein, 13 aa, Homo sapiens
  Heavy chain CDR3 for antibody 287 (IGHV3-11)
ARDEGYSGYNLDN

SEQ ID NO: 575 - protein, 9 aa, Homo sapiens
  Light chain CDR3 for antibody 288 (IGKV3-20)
QQYGISPYT

SEQ ID NO: 576 - protein, 17 aa, Homo sapiens
  Heavy chain CDR3 for antibody 288 (IGHV1-24)
ATHYGSGSHYKGYGMDV

SEQ ID NO: 577 - protein, 9 aa, Homo sapiens
  Light chain CDR3 for antibody 289 (IGKV1-6)
LQDYNYPYT

SEQ ID NO: 578 - protein, 19 aa, Homo sapiens
  Heavy chain CDR3 for antibody 289 (IGHV3-33)
ARDSGYSGYDYYYYYGMDV

SEQ ID NO: 579 - protein, 9 aa, Homo sapiens
  Light chain CDR3 for antibody 290 (IGKV1-9)
QQLNSYPLT

SEQ ID NO: 580 - protein, 12 aa, Homo sapiens
  Heavy chain CDR3 for antibody 290 (IGHV1-18)
ARRDGSGTSFDY

SEQ ID NO: 581 - protein, 9 aa, Homo sapiens
  Light chain CDR3 for antibody 291 (IGKV5-2)
LQHDAFPTT

SEQ ID NO: 582 - protein, 17 aa, Homo sapiens
  Heavy chain CDR3 for antibody 291 (IGHV4-61)
ARNTMVGTWQRQGNLDH

SEQ ID NO: 583 - protein, 9 aa, Homo sapiens
  Light chain CDR3 for antibody 292 (IGKV3D-20)
QQYGSSPFT

SEQ ID NO: 584 - protein, 15 aa, Homo sapiens
  Heavy chain CDR3 for antibody 292 (IGHV4-39)
ARQGLVATIKGYFQH

SEQ ID NO: 585 - protein, 9 aa, Homo sapiens
  Light chain CDR3 for antibody 293 (IGKV1-16)
QQYNSYPPT

SEQ ID NO: 586 - protein, 15 aa, Homo sapiens
  Heavy chain CDR3 for antibody 293 (IGHV3-23)
AKEFTMVRGVITPDY

SEQ ID NO: 587 - protein, 9 aa, Homo sapiens
  Light chain CDR3 for antibody 294 (IGKV1-6)
LQDYNYPRT

SEQ ID NO: 588 - protein, 12 aa, Homo sapiens
  Heavy chain CDR3 for antibody 294 (IGHV3-33)
ARDGYSSRNFDY

SEQ ID NO: 589 - protein, 9 aa, Homo sapiens
  Light chain CDR3 for antibody 295 (IGKV3D-20)
HQYGSSPLT

SEQ ID NO: 590 - protein, 19 aa, Homo sapiens
  Heavy chain CDR3 for antibody 295 (IGHV4-39)
ARQGDVLRYFDWLLGAFDI

SEQ ID NO: 591 - protein, 11 aa, Homo sapiens
  Light chain CDR3 for antibody 296 (IGKV3-11)
QQRSNWPPMYT

SEQ ID NO: 592 - protein, 17 aa, Homo sapiens
  Heavy chain CDR3 for antibody 296 (IGHV4-59)
AREGADSGIYYHWYFDL

SEQ ID NO: 593 - protein, 9 aa, Homo sapiens
  Light chain CDR3 for antibody 297 (IGKV2D-24)
TQATQFPHT

SEQ ID NO: 594 - protein, 18 aa, Homo sapiens
  Heavy chain CDR3 for antibody 297 (IGHV1-18)
ARDPTFYYVSGSYYKFDY

SEQ ID NO: 595 - protein, 9 aa, Homo sapiens
  Light chain CDR3 for antibody 298 (IGKV1D-13)
QQFNNYPYT

SEQ ID NO: 596 - protein, 16 aa, Homo sapiens
  Heavy chain CDR3 for antibody 298 (IGHV4-59)
ARFYFGSGSYYWYFDL

SEQ ID NO: 597 - protein, 9 aa, Homo sapiens
  Light chain CDR3 for antibody 299 (IGKV1D-16)
QQYNSYPYT

SEQ ID NO: 598 - protein, 9 aa, Homo sapiens
  Heavy chain CDR3 for antibody 299 (IGHV1-18)
ARGKDWFDP

SEQ ID NO: 599 - protein, 9 aa, Homo sapiens
  Light chain CDR3 for antibody 300 (IGKV1-6)
LQDYNYPWT

SEQ ID NO: 600 - protein, 11 aa, Homo sapiens
  Heavy chain CDR3 for antibody 300 (IGHV3-33)
ARGTTVTHFDY

SEQ ID NO: 601 - protein, 9 aa, Homo sapiens
  Light chain CDR3 for antibody 301 (IGKV1-9)
QQLNSYPLT

SEQ ID NO: 602 - protein, 18 aa, Homo sapiens
  Heavy chain CDR3 for antibody 301 (IGHV1-8)
AREGAAAGSYYYYNGMDV

SEQ ID NO: 603 - protein, 9 aa, Homo sapiens
  Light chain CDR3 for antibody 302 (IGKV3-20)
QQYGSSPWT

SEQ ID NO: 604 - protein, 17 aa, Homo sapiens
  Heavy chain CDR3 for antibody 302 (IGHV4-59)
ARDRELLWFGEFGGMDV

SEQ ID NO: 605 - protein, 9 aa, Homo sapiens
  Light chain CDR3 for antibody 303 (IGKV1-17)
LQHNSYPFT

SEQ ID NO: 606 - protein, 17 aa, Homo sapiens
  Heavy chain CDR3 for antibody 303 (IGHV3-33)
ARGGGYENDHYYYGMDV

SEQ ID NO: 607 - protein, 9 aa, Homo sapiens
  Light chain CDR3 for antibody 304 (IGKV1-6)
LQVYSYPWT

SEQ ID NO: 608 - protein, 17 aa, Homo sapiens
  Heavy chain CDR3 for antibody 304 (IGHV3-33)
ARSPYDILTGYSYYFDY

SEQ ID NO: 609 - protein, 9 aa, Homo sapiens
  Light chain CDR3 for antibody 305 (IGKV6-21)
HQSSSLPRT

SEQ ID NO: 610 - protein, 14 aa, Homo sapiens
  Heavy chain CDR3 for antibody 305 (IGHV3-20)
ARDEGSGGYDVFDI

SEQ ID NO: 611 - protein, 9 aa, Homo sapiens
  Light chain CDR3 for antibody 306 (IGKV1-6)
LQDYNYPWT

SEQ ID NO: 612 - protein, 15 aa, Homo sapiens
  Heavy chain CDR3 for antibody 306 (IGHV3-33)
ARDRVVRGVMGYFDY

SEQ ID NO: 613 - protein, 9 aa, Homo sapiens
  Light chain CDR3 for antibody 307 (IGKV2D-28)
MQVLQTPFT

SEQ ID NO: 614 - protein, 16 aa, Homo sapiens
  Heavy chain CDR3 for antibody 307 (IGHV4-59)
AGGSGSYRDYYYGMDV

SEQ ID NO: 615 - protein, 9 aa, Homo sapiens
  Light chain CDR3 for antibody 308 (IGKV1-9)
QQLNSYPRT

SEQ ID NO: 616 - protein, 12 aa, Homo sapiens
  Heavy chain CDR3 for antibody 308 (IGHV3-33)
AREGTGGNWFDP

SEQ ID NO: 617 - protein, 9 aa, Homo sapiens
  Light chain CDR3 for antibody 309 (IGKV1-6)
LQDYNYPYT

SEQ ID NO: 618 - protein, 14 aa, Homo sapiens
  Heavy chain CDR3 for antibody 309 (IGHV4-39)
ARRGVVVPPGGMDV

SEQ ID NO: 619 - protein, 9 aa, Homo sapiens
  Light chain CDR3 for antibody 310 (IGKV1-17)
LQHNSYPYT

SEQ ID NO: 620 - protein, 13 aa, Homo sapiens
  Heavy chain CDR3 for antibody 310 (IGHV3-33)
ARDYCGGDCYLDY

SEQ ID NO: 621 - protein, 9 aa, Homo sapiens
  Light chain CDR3 for antibody 311 (IGKV3D-20)
QQYGSSPWT

SEQ ID NO: 622 - protein, 9 aa, Homo sapiens
  Heavy chain CDR3 for antibody 311 (IGHV3-30)
ARPNWGFDY

SEQ ID NO: 623 - protein, 9 aa, Homo sapiens
  Light chain CDR3 for antibody 312 (IGKV3D-7)
QQDYNLPWT

SEQ ID NO: 624 - protein, 13 aa, Homo sapiens
  Heavy chain CDR3 for antibody 312 (IGHV4-39)
ARRGVVAPAAFDY

SEQ ID NO: 625 - protein, 9 aa, Homo sapiens
  Light chain CDR3 for antibody 313 (IGKV6-21)
HQSSSLPYT

SEQ ID NO: 626 - protein, 15 aa, Homo sapiens
  Heavy chain CDR3 for antibody 313 (IGHV3-33)
ARDHLTGYYYYGMDV

SEQ ID NO: 627 - protein, 8 aa, Homo sapiens
  Light chain CDR3 for antibody 314 (IGKV1-5)
QQYNSYYT

SEQ ID NO: 628 - protein, 16 aa, Homo sapiens
  Heavy chain CDR3 for antibody 314 (IGHV3-20)
AREGYSSSWFDRNFDY

SEQ ID NO: 629 - protein, 9 aa, Homo sapiens
  Light chain CDR3 for antibody 315 (IGKV1-17)
LQHNSYPYT

SEQ ID NO: 630 - protein, 10 aa, Homo sapiens
  Heavy chain CDR3 for antibody 315 (IGHV3-33)
AREWFGGFDI

SEQ ID NO: 631 - protein, 9 aa, Homo sapiens
  Light chain CDR3 for antibody 316 (IGKV6-21)
HQSSSLPYT

SEQ ID NO: 632 - protein, 11 aa, Homo sapiens
  Heavy chain CDR3 for antibody 316 (IGHV3-33)
ARDRATATVDY

SEQ ID NO: 633 - protein, 9 aa, Homo sapiens
  Light chain CDR3 for antibody 317 (IGKV1D-16)
QQYNSYPYT

SEQ ID NO: 634 - protein, 17 aa, Homo sapiens
  Heavy chain CDR3 for antibody 317 (IGHV1-18)
ARDEGYDILTGYPHFDY

SEQ ID NO: 635 - protein, 9 aa, Homo sapiens
  Light chain CDR3 for antibody 318 (IGKV3D-20)
QQYGTSPYT

SEQ ID NO: 636 - protein, 18 aa, Homo sapiens
  Heavy chain CDR3 for antibody 318 (IGHV3-33)
ARGGYDILTGYYRTGMDV

SEQ ID NO: 637 - protein, 9 aa, Homo sapiens
  Light chain CDR3 for antibody 319 (IGKV1-6)
LQDYNYPWT

SEQ ID NO: 638 - protein, 13 aa, Homo sapiens
  Heavy chain CDR3 for antibody 319 (IGHV3-33)
ARDSSSWYHWFDP

SEQ ID NO: 639 - protein, 9 aa, Homo sapiens
  Light chain CDR3 for antibody 320 (IGKV5-2)
LQHDNFPYT

SEQ ID NO: 640 - protein, 16 aa, Homo sapiens
  Heavy chain CDR3 for antibody 320 (IGHV3-23)
AKEGMVLRYFDWLWDY

SEQ ID NO: 641 - protein, 10 aa, Homo sapiens
  Light chain CDR3 for antibody 321 (IGKV1-17)
LQHNSYPMYT

SEQ ID NO: 642 - protein, 11 aa, Homo sapiens
  Heavy chain CDR3 for antibody 321 (IGHV3-23)
ARDPGSITGDY

SEQ ID NO: 643 - protein, 9 aa, Homo sapiens
  Light chain CDR3 for antibody 322 (IGKV6-21)
HQSRSLPYT

SEQ ID NO: 644 - protein, 14 aa, Homo sapiens
  Heavy chain CDR3 for antibody 322 (IGHV4-39)
ARQGGSGSYYNLDY

SEQ ID NO: 645 - protein, 9 aa, Homo sapiens
  Light chain CDR3 for antibody 323 (IGKV1-6)
LQDYNYPYT

SEQ ID NO: 646 - protein, 12 aa, Homo sapiens
  Heavy chain CDR3 for antibody 323 (IGHV1-46)
ARGLTGDHAVDI

SEQ ID NO: 647 - protein, 9 aa, Homo sapiens
  Light chain CDR3 for antibody 324 (IGKV2D-28)
MQALQTPPT

SEQ ID NO: 648 - protein, 17 aa, Homo sapiens
  Heavy chain CDR3 for antibody 324 (IGHV3-23)
AKDTITMVRGALFGMDV

SEQ ID NO: 649 - protein, 9 aa, Homo sapiens
  Light chain CDR3 for antibody 325 (IGKV4-1)
QQYYSTPLT

SEQ ID NO: 650 - protein, 15 aa, Homo sapiens
  Heavy chain CDR3 for antibody 325 (IGHV1-18)
ARIYYGSGSSYYFDY

SEQ ID NO: 651 - protein, 9 aa, Homo sapiens
  Light chain CDR3 for antibody 326 (IGKV1-6)
LQDYNYPYT

SEQ ID NO: 652 - protein, 17 aa, Homo sapiens
  Heavy chain CDR3 for antibody 326 (IGHV3-33)
AREDYDILTGYPFYFDY

SEQ ID NO: 653 - protein, 9 aa, Homo sapiens
  Light chain CDR3 for antibody 327 (IGKV1-17)
LQHNSYPYT

SEQ ID NO: 654 - protein, 15 aa, Homo sapiens
  Heavy chain CDR3 for antibody 327 (IGHV3-30)
ARGAMVRGVDYGMDV

SEQ ID NO: 655 - protein, 9 aa, Homo sapiens
  Light chain CDR3 for antibody 328 (IGKV1-16)
QQYDSYPPT

SEQ ID NO: 656 - protein, 15 aa, Homo sapiens
  Heavy chain CDR3 for antibody 328 (IGHV3-33)
ARAYDLPHYYYGMDV

SEQ ID NO: 657 - protein, 9 aa, Homo sapiens
  Light chain CDR3 for antibody 329 (IGKV3D-7)
QQDYNLPFT

SEQ ID NO: 658 - protein, 15 aa, Homo sapiens
  Heavy chain CDR3 for antibody 329 (IGHV3-23)
AKDRDYDFLSGPFDY

SEQ ID NO: 659 - protein, 10 aa, Homo sapiens
  Light chain CDR3 for antibody 330 (IGKV3-15)
QQYNNWPPYT

SEQ ID NO: 660 - protein, 11 aa, Homo sapiens
  Heavy chain CDR3 for antibody 330 (IGHV1-24)
ATYFGSGSLDY

SEQ ID NO: 661 - protein, 9 aa, Homo sapiens
  Light chain CDR3 for antibody 331 (IGKV1-17)
LQHNSYPRT

SEQ ID NO: 662 - protein, 17 aa, Homo sapiens
  Heavy chain CDR3 for antibody 331 (IGHV3-23)
AKEYCSGGSCYVYYFDY

SEQ ID NO: 663 - protein, 9 aa, Homo sapiens
  Light chain CDR3 for antibody 332 (IGKV1D-17)
LQHNSYPYT

SEQ ID NO: 664 - protein, 10 aa, Homo sapiens
  Heavy chain CDR3 for antibody 332 (IGHV3-33)
ARNILTPLDY

SEQ ID NO: 665 - protein, 9 aa, Homo sapiens
  Light chain CDR3 for antibody 333 (IGKV6-21)
HQSSSLPYT

SEQ ID NO: 666 - protein, 11 aa, Homo sapiens
  Heavy chain CDR3 for antibody 333 (IGHV3-33)
ARDRSSGPFDY

SEQ ID NO: 667 - protein, 9 aa, Homo sapiens
  Light chain CDR3 for antibody 334 (IGKV3D-7)
QQDYNLPYS

SEQ ID NO: 668 - protein, 13 aa, Homo sapiens
  Heavy chain CDR3 for antibody 334 (IGHV1-18)
ARGGGVRGAPLDY

SEQ ID NO: 669 - protein, 9 aa, Homo sapiens
  Light chain CDR3 for antibody 335 (IGKV1-6)
LQDYNYPYT

SEQ ID NO: 670 - protein, 18 aa, Homo sapiens
  Heavy chain CDR3 for antibody 335 (IGHV1-46)
ARDGDYVWGSYRSDWFDP

SEQ ID NO: 671 - protein, 9 aa, Homo sapiens
  Light chain CDR3 for antibody 336 (IGKV1-17)
LQHNSYPRT

SEQ ID NO: 672 - protein, 17 aa, Homo sapiens
  Heavy chain CDR3 for antibody 336 (IGHV3-33)
ARSGIVGATDYYYGLDV

SEQ ID NO: 673 - protein, 9 aa, Homo sapiens
  Light chain CDR3 for antibody 337 (IGKV3D-7)
QQDSNLPYT

SEQ ID NO: 674 - protein, 14 aa, Homo sapiens
  Heavy chain CDR3 for antibody 337 (IGHV4-39)
ARRGVVVPPGGMDV

SEQ ID NO: 675 - protein, 9 aa, Homo sapiens
  Light chain CDR3 for antibody 338 (IGKV1D-16)
QQYNSYPYT

SEQ ID NO: 676 - protein, 13 aa, Homo sapiens
  Heavy chain CDR3 for antibody 338 (IGHV3-33)
ARKAYGDYFYFDY

SEQ ID NO: 677 - protein, 9 aa, Homo sapiens
  Light chain CDR3 for antibody 339 (IGKV1-9)
QQLNSYPYT

SEQ ID NO: 678 - protein, 14 aa, Homo sapiens
  Heavy chain CDR3 for antibody 339 (IGHV1-46)
ARSYYDILTGAFDI

SEQ ID NO: 679 - protein, 9 aa, Homo sapiens
  Light chain CDR3 for antibody 340 (IGKV1-6)
LQDYNYPYT

SEQ ID NO: 680 - protein, 18 aa, Homo sapiens
  Heavy chain CDR3 for antibody 340 (IGHV3-33)
ARDYDSLTTYPEDYGMDV

SEQ ID NO: 681 - protein, 8 aa, Homo sapiens
  Light chain CDR3 for antibody 341 (IGKV3-15)
QQYNNWPT

SEQ ID NO: 682 - protein, 18 aa, Homo sapiens
  Heavy chain CDR3 for antibody 341 (IGHV3-33)
ARDQGIVVLPGAPWYFDP

SEQ ID NO: 683 - protein, 9 aa, Homo sapiens
  Light chain CDR3 for antibody 342 (IGKV1D-13)
QQFNNYPRT

SEQ ID NO: 684 - protein, 18 aa, Homo sapiens
  Heavy chain CDR3 for antibody 342 (IGHV3-33)
ARDEYYGSGIYYNYGMDV

SEQ ID NO: 685 - protein, 9 aa, Homo sapiens
  Light chain CDR3 for antibody 343 (IGKV5-2)
LQHDNFPYT

SEQ ID NO: 686 - protein, 11 aa, Homo sapiens
  Heavy chain CDR3 for antibody 343 (IGHV3-33)
ARDRSSGPFDY

SEQ ID NO: 687 - protein, 8 aa, Homo sapiens
  Light chain CDR3 for antibody 344 (IGKV1-5)
QQYNSYYT

SEQ ID NO: 688 - protein, 13 aa, Homo sapiens
  Heavy chain CDR3 for antibody 344 (IGHV3-23)
AKDRGGSYSYFDF

SEQ ID NO: 689 - protein, 9 aa, Homo sapiens
  Light chain CDR3 for antibody 345 (IGKV1D-16)
QQYSSYPYT

SEQ ID NO: 690 - protein, 13 aa, Homo sapiens
  Heavy chain CDR3 for antibody 345 (IGHV3-23)
ASTGDSYYYGMDV

SEQ ID NO: 691 - protein, 10 aa, Homo sapiens
  Light chain CDR3 for antibody 346 (IGKV1-27)
QKYNSAPMYT

SEQ ID NO: 692 - protein, 8 aa, Homo sapiens
  Heavy chain CDR3 for antibody 346 (IGHV4-39)
ARRGGLDY

SEQ ID NO: 693 - protein, 9 aa, Homo sapiens
  Light chain CDR3 for antibody 347 (IGKV3D-7)
QQDYNLPLT

SEQ ID NO: 694 - protein, 17 aa, Homo sapiens
  Heavy chain CDR3 for antibody 347 (IGHV3-15)
TTERYPRRYYYYFGMDV

SEQ ID NO: 695 - protein, 9 aa, Homo sapiens
  Light chain CDR3 for antibody 348 (IGKV1-9)
QQLNSYPRT

SEQ ID NO: 696 - protein, 13 aa, Homo sapiens
  Heavy chain CDR3 for antibody 348 (IGHV1-24)
ATGYSINWYEFDY

SEQ ID NO: 697 - protein, 9 aa, Homo sapiens
  Light chain CDR3 for antibody 349 (IGKV1D-16)
QQYNSYPYT

SEQ ID NO: 698 - protein, 13 aa, Homo sapiens
  Heavy chain CDR3 for antibody 349 (IGHV3-53)
ARSGSYWGYYFDY

SEQ ID NO: 699 - protein, 9 aa, Homo sapiens
  Light chain CDR3 for antibody 350 (IGKV1-17)
LQHNSYPYT

SEQ ID NO: 700 - protein, 11 aa, Homo sapiens
  Heavy chain CDR3 for antibody 350 (IGHV4-59)
VRERGYYGMDV

SEQ ID NO: 701 - protein, 9 aa, Homo sapiens
  Light chain CDR3 for antibody 351 (IGKV1-6)
LQDYNYPWT

SEQ ID NO: 702 - protein, 19 aa, Homo sapiens
  Heavy chain CDR3 for antibody 351 (IGHV3-33)
AREDYYGSGSYYNEDWFDP

SEQ ID NO: 703 - protein, 9 aa, Homo sapiens
  Light chain CDR3 for antibody 352 (IGKV1-6)
LQDYNYPWT

SEQ ID NO: 704 - protein, 17 aa, Homo sapiens
  Heavy chain CDR3 for antibody 352 (IGHV3-33)
ARDWFGELSDYYYGMDV

SEQ ID NO: 705 - protein, 9 aa, Homo sapiens
  Light chain CDR3 for antibody 353 (IGKV1D-16)
QQYNSYPYT

SEQ ID NO: 706 - protein, 15 aa, Homo sapiens
  Heavy chain CDR3 for antibody 353 (IGHV3-20)
ARDRGSSGWRDWFDP

SEQ ID NO: 707 - protein, 9 aa, Homo sapiens
  Light chain CDR3 for antibody 354 (IGKV3D-7)
QQDYNLPLT

SEQ ID NO: 708 - protein, 19 aa, Homo sapiens
  Heavy chain CDR3 for antibody 354 (IGHV1-18)
ARDTTLVRGLMNYYYGMDV

SEQ ID NO: 709 - protein, 9 aa, Homo sapiens
  Light chain CDR3 for antibody 355 (IGKV1-16)
QQYNSYPRT

SEQ ID NO: 710 - protein, 7 aa, Homo sapiens
  Heavy chain CDR3 for antibody 355 (IGHV3-33)
ARELFDY

SEQ ID NO: 711 - protein, 9 aa, Homo sapiens
  Light chain CDR3 for antibody 356 (IGKV3-15)
QQYNNWPFT

SEQ ID NO: 712 - protein, 9 aa, Homo sapiens
  Heavy chain CDR3 for antibody 356 (IGHV1-8)
ARGPRIMDV

SEQ ID NO: 713 - protein, 9 aa, Homo sapiens
  Light chain CDR3 for antibody 357 (IGKV1-6)
LQDYNYPYT

SEQ ID NO: 714 - protein, 16 aa, Homo sapiens
  Heavy chain CDR3 for antibody 357 (IGHV3-23)
ARNWNDVGDYYYGMDV

SEQ ID NO: 715 - protein, 9 aa, Homo sapiens
  Light chain CDR3 for antibody 358 (IGKV1-16)
QQYNSYPYT

SEQ ID NO: 716 - protein, 15 aa, Homo sapiens
  Heavy chain CDR3 for antibody 358 (IGHV3-33)
AKDRNSGYDWGGFDY

SEQ ID NO: 717 - protein, 9 aa, Homo sapiens
  Light chain CDR3 for antibody 359 (IGKV1-16)
QQYNSYPLT

SEQ ID NO: 718 - protein, 15 aa, Homo sapiens
  Heavy chain CDR3 for antibody 359 (IGHV3-23)
AKDLSSGWYAYFFDY

SEQ ID NO: 719 - protein, 9 aa, Homo sapiens
  Light chain CDR3 for antibody 360 (IGKV1-6)
LQDYNYPYT

SEQ ID NO: 720 - protein, 12 aa, Homo sapiens
  Heavy chain CDR3 for antibody 360 (IGHV3-33)
AKDPGWQQLAEY

SEQ ID NO: 721 - protein, 9 aa, Homo sapiens
  Light chain CDR3 for antibody 361 (IGKV1-6)
LQDYNYPYT

SEQ ID NO: 722 - protein, 19 aa, Homo sapiens
  Heavy chain CDR3 for antibody 361 (IGHV3-23)
AKDGRSGSYDYYYYYGMDV

SEQ ID NO: 723 - protein, 9 aa, Homo sapiens
  Light chain CDR3 for antibody 362 (IGKV5-2)
LQHDNFPWT

SEQ ID NO: 724 - protein, 13 aa, Homo sapiens
  Heavy chain CDR3 for antibody 362 (IGHV3-33)
ARDWGYSHGYFDY

SEQ ID NO: 725 - protein, 9 aa, Homo sapiens
  Light chain CDR3 for antibody 363 (IGKV1-6)
LQDYNYPYT

SEQ ID NO: 726 - protein, 16 aa, Homo sapiens
  Heavy chain CDR3 for antibody 363 (IGHV3-33)
AREVAGSYYYYYGMDV

SEQ ID NO: 727 - protein, 9 aa, Homo sapiens
  Light chain CDR3 for antibody 364 (IGKV3-20)
QQYGSSPFT

SEQ ID NO: 728 - protein, 18 aa, Homo sapiens
  Heavy chain CDR3 for antibody 364 (IGHV3-23)
AKVGDFFASGNYWDYFDY

SEQ ID NO: 729 - protein, 9 aa, Homo sapiens
  Light chain CDR3 for antibody 365 (IGKV3D-7)
QQDYTLPRT

SEQ ID NO: 730 - protein, 11 aa, Homo sapiens
  Heavy chain CDR3 for antibody 365 (IGHV4-59)
ARDGSWEPFDY

SEQ ID NO: 731 - protein, 8 aa, Homo sapiens
  Light chain CDR3 for antibody 366 (IGKV1-5)
QQYHSYYT

SEQ ID NO: 732 - protein, 13 aa, Homo sapiens
  Heavy chain CDR3 for antibody 366 (IGHV1-18)
ARSYYGSGSPFDY

SEQ ID NO: 733 - protein, 9 aa, Homo sapiens
  Light chain CDR3 for antibody 367 (IGKV1-17)
LHSNNYPWT

SEQ ID NO: 734 - protein, 14 aa, Homo sapiens
  Heavy chain CDR3 for antibody 367 (IGHV3-33)
ARDRRDFYYYGMDV

SEQ ID NO: 735 - protein, 9 aa, Homo sapiens
  Light chain CDR3 for antibody 368 (IGKV1D-16)
QQYNSYPYT

SEQ ID NO: 736 - protein, 11 aa, Homo sapiens
  Heavy chain CDR3 for antibody 368 (IGHV3-33)
ARDRVLTPFDY

SEQ ID NO: 737 - protein, 9 aa, Homo sapiens
  Light chain CDR3 for antibody 369 (IGKV1D-16)
QQYNSYPYT

SEQ ID NO: 738 - protein, 17 aa, Homo sapiens
  Heavy chain CDR3 for antibody 369 (IGHV1-18)
ARDRAFTMVRGVPPFDY

SEQ ID NO: 739 - protein, 9 aa, Homo sapiens
  Light chain CDR3 for antibody 370 (IGKV1-6)
LQDYNYPLT

SEQ ID NO: 740 - protein, 18 aa, Homo sapiens
  Heavy chain CDR3 for antibody 370 (IGHV3-33)
ARDRGDILTGYYKGWFDP

SEQ ID NO: 741 - protein, 6 aa, Homo sapiens
  Light chain CDR3 for antibody 371 (IGKV3-20)
QQYGST

SEQ ID NO: 742 - protein, 12 aa, Homo sapiens
  Heavy chain CDR3 for antibody 371 (IGHV3-33)
ARDYISTYGMDV

SEQ ID NO: 743 - protein, 9 aa, Homo sapiens
  Light chain CDR3 for antibody 372 (IGKV1D-16)
QQYNSYPYT

SEQ ID NO: 744 - protein, 12 aa, Homo sapiens
  Heavy chain CDR3 for antibody 372 (IGHV3-33)
ARESGGSYSFDY

SEQ ID NO: 745 - protein, 9 aa, Homo sapiens
  Light chain CDR3 for antibody 373 (IGKV6-21)
HQSSSLPLT

SEQ ID NO: 746 - protein, 10 aa, Homo sapiens
  Heavy chain CDR3 for antibody 373 (IGHV3-30)
ARDGLESFDY

SEQ ID NO: 747 - protein, 9 aa, Homo sapiens
  Light chain CDR3 for antibody 374 (IGKV1D-16)
QQYNSYPYT

SEQ ID NO: 748 - protein, 11 aa, Homo sapiens
  Heavy chain CDR3 for antibody 374 (IGHV3-23)
GEFSSGWSFDY

SEQ ID NO: 749 - protein, 8 aa, Homo sapiens
  Light chain CDR3 for antibody 375 (IGKV3-11)
QQRRNWLT

SEQ ID NO: 750 - protein, 20 aa, Homo sapiens
  Heavy chain CDR3 for antibody 375 (IGHV1-8)
ARGDGTMVRGIYYYYYGMDV

SEQ ID NO: 751 - protein, 9 aa, Homo sapiens
  Light chain CDR3 for antibody 376 (IGKV1D-16)
QQYNSFPYT

SEQ ID NO: 752 - protein, 13 aa, Homo sapiens
  Heavy chain CDR3 for antibody 376 (IGHV3-33)
ASAGNSYYNVMDV

SEQ ID NO: 753 - protein, 9 aa, Homo sapiens
  Light chain CDR3 for antibody 377 (IGKV5-2)
LQHDNFPWT

SEQ ID NO: 754 - protein, 11 aa, Homo sapiens
  Heavy chain CDR3 for antibody 377 (IGHV4-59)
AREMGHDTFDI

SEQ ID NO: 755 - protein, 9 aa, Homo sapiens
  Light chain CDR3 for antibody 378 (IGKV1-9)
QQLNSYPRT

SEQ ID NO: 756 - protein, 17 aa, Homo sapiens
  Heavy chain CDR3 for antibody 378 (IGHV1-8)
ARGDYYGSGSPYWYFDL

SEQ ID NO: 757 - protein, 9 aa, Homo sapiens
  Light chain CDR3 for antibody 379 (IGKV1-9)
QQLNSYPYT

SEQ ID NO: 758 - protein, 17 aa, Homo sapiens
  Heavy chain CDR3 for antibody 379 (IGHV3-33)
ARDPARGNVRSFYGLDV

SEQ ID NO: 759 - protein, 9 aa, Homo sapiens
  Light chain CDR3 for antibody 380 (IGKV6-21)
HQSSSLPHT

SEQ ID NO: 760 - protein, 10 aa, Homo sapiens
  Heavy chain CDR3 for antibody 380 (IGHV3-33)
ARDLGWSFDH

SEQ ID NO: 761 - protein, 9 aa, Homo sapiens
  Light chain CDR3 for antibody 381 (IGKV1-6)
LQDYNYPWT

SEQ ID NO: 762 - protein, 14 aa, Homo sapiens
  Heavy chain CDR3 for antibody 381 (IGHV3-33)
ARDAYDILTGYYDY

SEQ ID NO: 763 - protein, 9 aa, Homo sapiens
  Light chain CDR3 for antibody 382 (IGKV1-9)
QQLNSYPWT

SEQ ID NO: 764 - protein, 14 aa, Homo sapiens
  Heavy chain CDR3 for antibody 382 (IGHV3-20)
AREGWFGDYYGMDV

SEQ ID NO: 765 - protein, 9 aa, Homo sapiens
  Light chain CDR3 for antibody 383 (IGKV3-11)
QQRSNWPLT

SEQ ID NO: 766 - protein, 17 aa, Homo sapiens
  Heavy chain CDR3 for antibody 383 (IGHV4-34)
ARDGSGSYTHYYYGMDV

SEQ ID NO: 767 - protein, 9 aa, Homo sapiens
  Light chain CDR3 for antibody 384 (IGKV1D-13)
QQFNNYPRT

SEQ ID NO: 768 - protein, 18 aa, Homo sapiens
  Heavy chain CDR3 for antibody 384 (IGHV3-33)
ARDGRISLVRGIIDAFDI

SEQ ID NO: 769 - protein, 8 aa, Homo sapiens
  Light chain CDR3 for antibody 385 (IGKV6-21)
HQSSSLPT

SEQ ID NO: 770 - protein, 9 aa, Homo sapiens
  Heavy chain CDR3 for antibody 385 (IGHV3-33)
ARELAYFDY

SEQ ID NO: 771 - protein, 9 aa, Homo sapiens
  Light chain CDR3 for antibody 386 (IGKV1-6)
LQDYNYPYT

SEQ ID NO: 772 - protein, 17 aa, Homo sapiens
  Heavy chain CDR3 for antibody 386 (IGHV3-30)
AREGVRGLIYYYYGMDV

SEQ ID NO: 773 - protein, 9 aa, Homo sapiens
  Light chain CDR3 for antibody 387 (IGKV1-6)
LQDFNYPPT

SEQ ID NO: 774 - protein, 11 aa, Homo sapiens
  Heavy chain CDR3 for antibody 387 (IGHV3-23)
AKAGIVGCLDV

SEQ ID NO: 775 - protein, 9 aa, Homo sapiens
  Light chain CDR3 for antibody 388 (IGKV1-9)
QQLNTYPWT

SEQ ID NO: 776 - protein, 18 aa, Homo sapiens
  Heavy chain CDR3 for antibody 388 (IGHV3-33)
ARGGVLYDILTGFYGMDV

SEQ ID NO: 777 - protein, 9 aa, Homo sapiens
  Light chain CDR3 for antibody 389 (IGKV1-9)
QQLNSYPYT

SEQ ID NO: 778 - protein, 17 aa, Homo sapiens
  Heavy chain CDR3 for antibody 389 (IGHV3-33)
ARCGYSSSWYDPYYFDY

SEQ ID NO: 779 - protein, 9 aa, Homo sapiens
  Light chain CDR3 for antibody 390 (IGKV1-17)
LQHNSYPYT

SEQ ID NO: 780 - protein, 14 aa, Homo sapiens
  Heavy chain CDR3 for antibody 390 (IGHV3-33)
ARGAAAGNFYGLDV

SEQ ID NO: 781 - protein, 9 aa, Homo sapiens
  Light chain CDR3 for antibody 391 (IGKV1D-16)
QQYNSYPPT

SEQ ID NO: 782 - protein, 18 aa, Homo sapiens
  Heavy chain CDR3 for antibody 391 (IGHV3-33)
ARKGGYYSGSGSYRHFDF

SEQ ID NO: 783 - protein, 9 aa, Homo sapiens
  Light chain CDR3 for antibody 392 (IGKV3-20)
QQFGRSPRT

SEQ ID NO: 784 - protein, 18 aa, Homo sapiens
  Heavy chain CDR3 for antibody 392 (IGHV1-24)
ATGLRYFDWPIISNLFDY

SEQ ID NO: 785 - protein, 9 aa, Homo sapiens
  Light chain CDR3 for antibody 393 (IGKV1-9)
QQLNSYPYT

SEQ ID NO: 786 - protein, 15 aa, Homo sapiens
  Heavy chain CDR3 for antibody 393 (IGHV3-66)
ARDRDYYYYYYGMDV

SEQ ID NO: 787 - protein, 9 aa, Homo sapiens
  Light chain CDR3 for antibody 394 (IGKV5-2)
LQHDNFPYT

SEQ ID NO: 788 - protein, 15 aa, Homo sapiens
  Heavy chain CDR3 for antibody 394 (IGHV3-23)
AKDPRGYYYYYGMDV

SEQ ID NO: 789 - protein, 9 aa, Homo sapiens
  Light chain CDR3 for antibody 395 (IGKV1-17)
LQHNSYPYT

SEQ ID NO: 790 - protein, 13 aa, Homo sapiens
  Heavy chain CDR3 for antibody 395 (IGHV3-33)
ARDWGYSHGYFDY

SEQ ID NO: 791 - protein, 9 aa, Homo sapiens
  Light chain CDR3 for antibody 396 (IGKV2-30)
MQGTHWPYT

SEQ ID NO: 792 - protein, 12 aa, Homo sapiens
  Heavy chain CDR3 for antibody 396 (IGHV4-39)
ARHPRYLDAFDI

SEQ ID NO: 793 - protein, 9 aa, Homo sapiens
  Light chain CDR3 for antibody 397 (IGKV3-20)
QQYGSSIFT

SEQ ID NO: 794 - protein, 13 aa, Homo sapiens
  Heavy chain CDR3 for antibody 397 (IGHV3-33)
ARTDYYYYYGMDV

SEQ ID NO: 795 - protein, 9 aa, Homo sapiens
  Light chain CDR3 for antibody 398 (IGKV4-1)
QQYYSTPYT

SEQ ID NO: 796 - protein, 12 aa, Homo sapiens
  Heavy chain CDR3 for antibody 398 (IGHV3-23)
AKESLYTPTDDY

SEQ ID NO: 797 - protein, 9 aa, Homo sapiens
  Light chain CDR3 for antibody 399 (IGKV1D-13)
QQFNNYPST

SEQ ID NO: 798 - protein, 20 aa, Homo sapiens
  Heavy chain CDR3 for antibody 399 (IGHV3-33)
ARDWMVRGVIITDYYYGMDV

SEQ ID NO: 799 - protein, 9 aa, Homo sapiens
  Light chain CDR3 for antibody 400 (IGKV1-6)
LQDYNYPFT

SEQ ID NO: 800 - protein, 15 aa, Homo sapiens
  Heavy chain CDR3 for antibody 400 (IGHV3-33)
ARRSILTGSYWYFDL

SEQ ID NO: 801 - protein, 9 aa, Homo sapiens
  Light chain CDR3 for antibody 401 (IGKV3D-7)
QQDYNLPYT

SEQ ID NO: 802 - protein, 11 aa, Homo sapiens
  Heavy chain CDR3 for antibody 401 (IGHV4-59)
ARETGDDAFDI

SEQ ID NO: 803 - protein, 9 aa, Homo sapiens
  Light chain CDR3 for antibody 402 (IGKV1-39)
QQSYSSPFT

SEQ ID NO: 804 - protein, 21 aa, Homo sapiens
  Heavy chain CDR3 for antibody 402 (IGHV1-18)
ASGVLIWFGELLSEDYYDMDV

SEQ ID NO: 805 - protein, 9 aa, Homo sapiens
  Light chain CDR3 for antibody 403 (IGKV1-6)
LQDYNYPWT

SEQ ID NO: 806 - protein, 14 aa, Homo sapiens
  Heavy chain CDR3 for antibody 403 (IGHV3-33)
ARDLNYDILNGGGY

SEQ ID NO: 807 - protein, 9 aa, Homo sapiens
  Light chain CDR3 for antibody 404 (IGKV1-6)
LQDYNYPRT

SEQ ID NO: 808 - protein, 14 aa, Homo sapiens
  Heavy chain CDR3 for antibody 404 (IGHV3-64)
ARDHAAGGYSHSDY

SEQ ID NO: 809 - protein, 9 aa, Homo sapiens
  Light chain CDR3 for antibody 405 (IGKV3-11)
QQRSSWPPT

SEQ ID NO: 810 - protein, 15 aa, Homo sapiens
  Heavy chain CDR3 for antibody 405 (IGHV3-23)
AKDGFYYGSGSSFDH

SEQ ID NO: 811 - protein, 9 aa, Homo sapiens
  Light chain CDR3 for antibody 406 (IGKV1D-16)
QQYNSYPYT

SEQ ID NO: 812 - protein, 14 aa, Homo sapiens
  Heavy chain CDR3 for antibody 406 (IGHV3-33)
ARDRDIMATSYFDY

SEQ ID NO: 813 - protein, 9 aa, Homo sapiens
  Light chain CDR3 for antibody 407 (IGKV1-27)
QKYNSAPYT

SEQ ID NO: 814 - protein, 12 aa, Homo sapiens
  Heavy chain CDR3 for antibody 407 (IGHV3-33)
ARGYFTSGSAHY

SEQ ID NO: 815 - protein, 9 aa, Homo sapiens
  Light chain CDR3 for antibody 408 (IGKV1-6)
LQDYNYPRT

SEQ ID NO: 816 - protein, 13 aa, Homo sapiens
  Heavy chain CDR3 for antibody 408 (IGHV3-13)
ARAITMVRGVIDY

SEQ ID NO: 817 - protein, 9 aa, Homo sapiens
  Light chain CDR3 for antibody 409 (IGKV1-27)
QKYNSAPYT

SEQ ID NO: 818 - protein, 15 aa, Homo sapiens
  Heavy chain CDR3 for antibody 409 (IGHV3-11)
ARDRAVAGTIHAFDI

SEQ ID NO: 819 - protein, 8 aa, Homo sapiens
  Light chain CDR3 for antibody 410 (IGKV3-20)
QQYGSSLT

SEQ ID NO: 820 - protein, 16 aa, Homo sapiens
  Heavy chain CDR3 for antibody 410 (IGHV3-23)
AKDLRYFDWSLYAFDI

SEQ ID NO: 821 - protein, 9 aa, Homo sapiens
  Light chain CDR3 for antibody 411 (IGKV1-6)
LQDYNYPHT

SEQ ID NO: 822 - protein, 14 aa, Homo sapiens
  Heavy chain CDR3 for antibody 411 (IGHV3-33)
ARKGYSGRYYYFDY

SEQ ID NO: 823 - protein, 9 aa, Homo sapiens
  Light chain CDR3 for antibody 412 (IGKV1D-16)
QQYDSYPYT

SEQ ID NO: 824 - protein, 12 aa, Homo sapiens
  Heavy chain CDR3 for antibody 412 (IGHV3-33)
ARAGMGAPYFDY

SEQ ID NO: 825 - protein, 9 aa, Homo sapiens
  Light chain CDR3 for antibody 413 (IGKV1-17)
LQHNSYPYT

SEQ ID NO: 826 - protein, 14 aa, Homo sapiens
  Heavy chain CDR3 for antibody 413 (IGHV3-33)
ARDWNDVYYYGMDV

SEQ ID NO: 827 - protein, 9 aa, Homo sapiens
  Light chain CDR3 for antibody 414 (IGKV1-9)
QQLNSYPWT

SEQ ID NO: 828 - protein, 20 aa, Homo sapiens
  Heavy chain CDR3 for antibody 414 (IGHV3-20)
ARDLCSSTSCYGYYYYGMDV

SEQ ID NO: 829 - protein, 9 aa, Homo sapiens
  Light chain CDR3 for antibody 415 (IGKV1-17)
LQHNSYPYT

SEQ ID NO: 830 - protein, 14 aa, Homo sapiens
  Heavy chain CDR3 for antibody 415 (IGHV3-23)
AKSRIVGALYYFDY

SEQ ID NO: 831 - protein, 9 aa, Homo sapiens
  Light chain CDR3 for antibody 416 (IGKV1-9)
QQLNSYPYT

SEQ ID NO: 832 - protein, 17 aa, Homo sapiens
  Heavy chain CDR3 for antibody 416 (IGHV3-23)
AKDRPVTTLYYYFGMDV

SEQ ID NO: 833 - protein, 9 aa, Homo sapiens
  Light chain CDR3 for antibody 417 (IGKV1D-16)
QQYNSYPYT

SEQ ID NO: 834 - protein, 13 aa, Homo sapiens
  Heavy chain CDR3 for antibody 417 (IGHV3-23)
ASPFNWNDGFFDY

SEQ ID NO: 835 - protein, 9 aa, Homo sapiens
  Light chain CDR3 for antibody 418 (IGKV1-6)
LQDYNYPRT

SEQ ID NO: 836 - protein, 17 aa, Homo sapiens
  Heavy chain CDR3 for antibody 418 (IGHV3-23)
AKDRDWKDGYYYFGMDV

SEQ ID NO: 837 - protein, 9 aa, Homo sapiens
  Light chain CDR3 for antibody 419 (IGKV1-27)
QKYNSAPHT

SEQ ID NO: 838 - protein, 18 aa, Homo sapiens
  Heavy chain CDR3 for antibody 419 (IGHV3-33)
AREGYDILTGDYRLGFDY

SEQ ID NO: 839 - protein, 9 aa, Homo sapiens
  Light chain CDR3 for antibody 420 (IGKV1-17)
LQHNSYPWT

SEQ ID NO: 840 - protein, 22 aa, Homo sapiens
  Heavy chain CDR3 for antibody 420 (IGHV4-59)
AREINYGSGSYYNEDYYYGMDV

SEQ ID NO: 841 - protein, 9 aa, Homo sapiens
  Light chain CDR3 for antibody 421 (IGKV1-17)
LQHNDYPPT

SEQ ID NO: 842 - protein, 14 aa, Homo sapiens
  Heavy chain CDR3 for antibody 421 (IGHV1-18)
AREGGSYFYYGVDV

SEQ ID NO: 843 - protein, 9 aa, Homo sapiens
  Light chain CDR3 for antibody 422 (IGKV6-21)
HQSSSLPFT

SEQ ID NO: 844 - protein, 6 aa, Homo sapiens
  Heavy chain CDR3 for antibody 422 (IGHV1-8)
AREGTY

SEQ ID NO: 845 - protein, 9 aa, Homo sapiens
  Light chain CDR3 for antibody 423 (IGKV3-15)
QQYHNWPLT

SEQ ID NO: 846 - protein, 17 aa, Homo sapiens
  Heavy chain CDR3 for antibody 423 (IGHV3-33)
TRDSGMVRGIIIYGMDV

SEQ ID NO: 847 - protein, 9 aa, Homo sapiens
  Light chain CDR3 for antibody 424 (IGKV3-20)
QQYGSSPYT

SEQ ID NO: 848 - protein, 15 aa, Homo sapiens
  Heavy chain CDR3 for antibody 424 (IGHV3-33)
ARHSSGFYYYYGMDV

SEQ ID NO: 849 - protein, 9 aa, Homo sapiens
  Light chain CDR3 for antibody 425 (IGKV1-6)
LQDYNYPYT

SEQ ID NO: 850 - protein, 20 aa, Homo sapiens
  Heavy chain CDR3 for antibody 425 (IGHV3-33)
ARDNDSSGYYDYYYYYGMDV

SEQ ID NO: 851 - protein, 9 aa, Homo sapiens
  Light chain CDR3 for antibody 426 (IGKV1-6)
LQDYDYPYT

SEQ ID NO: 852 - protein, 19 aa, Homo sapiens
  Heavy chain CDR3 for antibody 426 (IGHV1-18)
ARGGHIGVVTAFHGYGMDV

SEQ ID NO: 853 - protein, 9 aa, Homo sapiens
  Light chain CDR3 for antibody 427 (IGKV1-17)
LQHNTYPWT

SEQ ID NO: 854 - protein, 12 aa, Homo sapiens
  Heavy chain CDR3 for antibody 427 (IGHV3-33)
AREGIAVAGVDP

SEQ ID NO: 855 - protein, 9 aa, Homo sapiens
  Light chain CDR3 for antibody 428 (IGKV3D-7)
QQDYNLPLT

SEQ ID NO: 856 - protein, 16 aa, Homo sapiens
  Heavy chain CDR3 for antibody 428 (IGHV3-33)
ARDRGGMTMVRGGFDY

SEQ ID NO: 857 - protein, 9 aa, Homo sapiens
  Light chain CDR3 for antibody 429 (IGKV6-21)
HQSSSLPFT

SEQ ID NO: 858 - protein, 14 aa, Homo sapiens
  Heavy chain CDR3 for antibody 429 (IGHV3-23)
AKGGDVLTGYYPDY

SEQ ID NO: 859 - protein, 9 aa, Homo sapiens
  Light chain CDR3 for antibody 430 (IGKV1-9)
QQLNNYLFT

SEQ ID NO: 860 - protein, 10 aa, Homo sapiens
  Heavy chain CDR3 for antibody 430 (IGHV4-39)
ARQLGNWFDP

SEQ ID NO: 861 - protein, 9 aa, Homo sapiens
  Light chain CDR3 for antibody 431 (IGKV1-9)
QQLNSYPYT

SEQ ID NO: 862 - protein, 14 aa, Homo sapiens
  Heavy chain CDR3 for antibody 431 (IGHV1-46)
ARAYYAFLTGAFDI

SEQ ID NO: 863 - protein, 9 aa, Homo sapiens
  Light chain CDR3 for antibody 432 (IGKV1-6)
LQDYNYPRT

SEQ ID NO: 864 - protein, 14 aa, Homo sapiens
  Heavy chain CDR3 for antibody 432 (IGHV3-33)
VSAISGSSYWYFAL

SEQ ID NO: 865 - protein, 9 aa, Homo sapiens
  Light chain CDR3 for antibody 433 (IGKV1D-16)
QQYNSYPYT

SEQ ID NO: 866 - protein, 15 aa, Homo sapiens
  Heavy chain CDR3 for antibody 433 (IGHV1-18)
ARGYCSSTSCYYFDY

SEQ ID NO: 867 - protein, 9 aa, Homo sapiens
  Light chain CDR3 for antibody 434 (IGKV1-6)
LQDYSYPFT

SEQ ID NO: 868 - protein, 12 aa, Homo sapiens
  Heavy chain CDR3 for antibody 434 (IGHV3-33)
ARKQWLVQAFDI

SEQ ID NO: 869 - protein, 9 aa, Homo sapiens
  Light chain CDR3 for antibody 435 (IGKV3D-7)
QQDYNLPYT

SEQ ID NO: 870 - protein, 12 aa, Homo sapiens
  Heavy chain CDR3 for antibody 435 (IGHV4-39)
ARREVILGAFDY

SEQ ID NO: 871 - protein, 9 aa, Homo sapiens
  Light chain CDR3 for antibody 436 (IGKV3-15)
QQYNNWPLT

SEQ ID NO: 872 - protein, 17 aa, Homo sapiens
  Heavy chain CDR3 for antibody 436 (IGHV3-23)
AKEGSSSSWYGGLYFDY

SEQ ID NO: 873 - protein, 9 aa, Homo sapiens
  Light chain CDR3 for antibody 437 (IGKV6-21)
HQSSSLPQT

SEQ ID NO: 874 - protein, 14 aa, Homo sapiens
  Heavy chain CDR3 for antibody 437 (IGHV3-33)
ARDTVAAGFNGMDV

SEQ ID NO: 875 - protein, 9 aa, Homo sapiens
  Light chain CDR3 for antibody 438 (IGKV1-16)
QQYNSYPYT

SEQ ID NO: 876 - protein, 13 aa, Homo sapiens
  Heavy chain CDR3 for antibody 438 (IGHV4-39)
ARQWPSGYWYFDL

SEQ ID NO: 877 - protein, 9 aa, Homo sapiens
  Light chain CDR3 for antibody 439 (IGKV1-17)
LQHNSYPYT

SEQ ID NO: 878 - protein, 15 aa, Homo sapiens
  Heavy chain CDR3 for antibody 439 (IGHV3-33)
ARDGSGSYSLYGMDV

SEQ ID NO: 879 - protein, 10 aa, Homo sapiens
  Light chain CDR3 for antibody 440 (IGKV1-6)
LQDYNYPMYT

SEQ ID NO: 880 - protein, 12 aa, Homo sapiens
  Heavy chain CDR3 for antibody 440 (IGHV3-23)
AKEGIVGVPFDY

SEQ ID NO: 881 - protein, 9 aa, Homo sapiens
  Light chain CDR3 for antibody 441 (IGKV1D-16)
QQYAGYPPT

SEQ ID NO: 882 - protein, 12 aa, Homo sapiens
  Heavy chain CDR3 for antibody 441 (IGHV4-34)
ARGYSSSWYFDY

SEQ ID NO: 883 - protein, 9 aa, Homo sapiens
  Light chain CDR3 for antibody 442 (IGKV1D-16)
QQYNSYPYT

SEQ ID NO: 884 - protein, 14 aa, Homo sapiens
  Heavy chain CDR3 for antibody 442 (IGHV3-33)
AREGYSSNWYDFDY

SEQ ID NO: 885 - protein, 9 aa, Homo sapiens
  Light chain CDR3 for antibody 443 (IGKV6-21)
HQSSSLPFT

SEQ ID NO: 886 - protein, 11 aa, Homo sapiens
  Heavy chain CDR3 for antibody 443 (IGHV4-59)
AREDYGVPFDY

SEQ ID NO: 887 - protein, 9 aa, Homo sapiens
  Light chain CDR3 for antibody 444 (IGKV3-15)
QQYNNWPRT

SEQ ID NO: 888 - protein, 15 aa, Homo sapiens
  Heavy chain CDR3 for antibody 444 (IGHV3-33)
ARDEHYDILTGYWGY

SEQ ID NO: 889 - protein, 9 aa, Homo sapiens
  Light chain CDR3 for antibody 445 (IGKV3D-20)
QQYGNSPRT

SEQ ID NO: 890 - protein, 19 aa, Homo sapiens
  Heavy chain CDR3 for antibody 445 (IGHV3-33)
ARRRDDILTGWDYYFGMDV

SEQ ID NO: 891 - protein, 9 aa, Homo sapiens
  Light chain CDR3 for antibody 446 (IGKV3-11)
QQRSNWPLT

SEQ ID NO: 892 - protein, 9 aa, Homo sapiens
  Heavy chain CDR3 for antibody 446 (IGHV4-59)
ARGGVHFDS

SEQ ID NO: 893 - protein, 9 aa, Homo sapiens
  Light chain CDR3 for antibody 447 (IGKV3D-7)
QQDYNLPLT

SEQ ID NO: 894 - protein, 17 aa, Homo sapiens
  Heavy chain CDR3 for antibody 447 (IGHV3-23)
AKGNYGSGSYYNGDFQH

SEQ ID NO: 895 - protein, 9 aa, Homo sapiens
  Light chain CDR3 for antibody 448 (IGKV3-20)
QQYGSSLYT

SEQ ID NO: 896 - protein, 11 aa, Homo sapiens
  Heavy chain CDR3 for antibody 448 (IGHV3-64)
ARERGSYAFDI

SEQ ID NO: 897 - protein, 9 aa, Homo sapiens
  Light chain CDR3 for antibody 449 (IGKV5-2)
LQHDNFPWT

SEQ ID NO: 898 - protein, 16 aa, Homo sapiens
  Heavy chain CDR3 for antibody 449 (IGHV4-59)
ARGRYFEWLLGDVFDI

SEQ ID NO: 899 - protein, 9 aa, Homo sapiens
  Light chain CDR3 for antibody 450 (IGKV3D-11)
QQRSNWQYT

SEQ ID NO: 900 - protein, 10 aa, Homo sapiens
  Heavy chain CDR3 for antibody 450 (IGHV3-23)
AKDHWGDFDY

SEQ ID NO: 901 - protein, 9 aa, Homo sapiens
  Light chain CDR3 for antibody 451 (IGKV1-9)
QQYNSYPLT

SEQ ID NO: 902 - protein, 9 aa, Homo sapiens
  Heavy chain CDR3 for antibody 451 (IGHV4-59)
AREGGSGSL

SEQ ID NO: 903 - protein, 9 aa, Homo sapiens
  Light chain CDR3 for antibody 452 (IGKV1-6)
LQDYNYPYT

SEQ ID NO: 904 - protein, 19 aa, Homo sapiens
  Heavy chain CDR3 for antibody 452 (IGHV3-33)
ARDRYYDILTGYSSYYFDY

SEQ ID NO: 905 - protein, 9 aa, Homo sapiens
  Light chain CDR3 for antibody 453 (IGKV6-21)
HQSSSLPYT

SEQ ID NO: 906 - protein, 18 aa, Homo sapiens
  Heavy chain CDR3 for antibody 453 (IGHV4-59)
AREGDYVWGSYRPNWFDP

SEQ ID NO: 907 - protein, 9 aa, Homo sapiens
  Light chain CDR3 for antibody 454 (IGKV3-20)
QQYGSSPRT

SEQ ID NO: 908 - protein, 12 aa, Homo sapiens
  Heavy chain CDR3 for antibody 454 (IGHV1-24)
ASDWAYYYGMDV

SEQ ID NO: 909 - protein, 9 aa, Homo sapiens
  Light chain CDR3 for antibody 455 (IGKV1-17)
LQHYSYPRT

SEQ ID NO: 910 - protein, 13 aa, Homo sapiens
  Heavy chain CDR3 for antibody 455 (IGHV3-11)
ARDEGYRGYVLDT

SEQ ID NO: 911 - protein, 9 aa, Homo sapiens
  Light chain CDR3 for antibody 456 (IGKV1-17)
LQHNTYPWT

SEQ ID NO: 912 - protein, 12 aa, Homo sapiens
  Heavy chain CDR3 for antibody 456 (IGHV3-33)
ARDPGYFFGLDV

SEQ ID NO: 913 - protein, 9 aa, Homo sapiens
  Light chain CDR3 for antibody 457 (IGKV3-15)
QQYNDWPLT

SEQ ID NO: 914 - protein, 12 aa, Homo sapiens
  Heavy chain CDR3 for antibody 457 (IGHV3-13)
AIGTMVRGIPDY

SEQ ID NO: 915 - protein, 9 aa, Homo sapiens
  Light chain CDR3 for antibody 458 (IGKV1-6)
LQDYNYPYT

SEQ ID NO: 916 - protein, 16 aa, Homo sapiens
  Heavy chain CDR3 for antibody 458 (IGHV3-20)
ARDSSSLDYYYYGMDV

SEQ ID NO: 917 - protein, 8 aa, Homo sapiens
  Light chain CDR3 for antibody 459 (IGKV1-5)
QQYNSYST

SEQ ID NO: 918 - protein, 23 aa, Homo sapiens
  Heavy chain CDR3 for antibody 459 (IGHV1-18)
ARNLHYDILTGYFPYYFYYGMDV

SEQ ID NO: 919 - protein, 9 aa, Homo sapiens
  Light chain CDR3 for antibody 460 (IGKV1-9)
QQLNRYPYT

SEQ ID NO: 920 - protein, 14 aa, Homo sapiens
  Heavy chain CDR3 for antibody 460 (IGHV3-33)
AREGYSSGWDYFDH

SEQ ID NO: 921 - protein, 9 aa, Homo sapiens
  Light chain CDR3 for antibody 461 (IGKV1D-13)
QQFNNYMYT

SEQ ID NO: 922 - protein, 17 aa, Homo sapiens
  Heavy chain CDR3 for antibody 461 (IGHV3-33)
ARDSYDILTGYYKPFDY

SEQ ID NO: 923 - protein, 9 aa, Homo sapiens
  Light chain CDR3 for antibody 462 (IGKV1D-16)
QQYNSYPYT

SEQ ID NO: 924 - protein, 17 aa, Homo sapiens
  Heavy chain CDR3 for antibody 462 (IGHV3-33)
ARGFSGYDGYYYYGMDV

SEQ ID NO: 925 - protein, 9 aa, Homo sapiens
  Light chain CDR3 for antibody 463 (IGKV1-6)
LQDYNYPWT

SEQ ID NO: 926 - protein, 18 aa, Homo sapiens
  Heavy chain CDR3 for antibody 463 (IGHV3-33)
AREGYDILTGYYNVKFDY

SEQ ID NO: 927 - protein, 9 aa, Homo sapiens
  Light chain CDR3 for antibody 464 (IGKV1-6)
LQDYNYPYT

SEQ ID NO: 928 - protein, 15 aa, Homo sapiens
  Heavy chain CDR3 for antibody 464 (IGHV1-18)
ARGYCSSTSCYYFDY

SEQ ID NO: 929 - protein, 9 aa, Homo sapiens
  Light chain CDR3 for antibody 465 (IGKV3-20)
QQYGSSPYT

SEQ ID NO: 930 - protein, 13 aa, Homo sapiens
  Heavy chain CDR3 for antibody 465 (IGHV3-33)
ARDYCGGDCYLDY

SEQ ID NO: 931 - protein, 9 aa, Homo sapiens
  Light chain CDR3 for antibody 466 (IGKV3-20)
QQYGSSPYT

SEQ ID NO: 932 - protein, 17 aa, Homo sapiens
  Heavy chain CDR3 for antibody 466 (IGHV4-59)
AREEDYFGSGSFGTFDI

SEQ ID NO: 933 - protein, 9 aa, Homo sapiens
  Light chain CDR3 for antibody 467 (IGKV1-6)
LQDYNYPYT

SEQ ID NO: 934 - protein, 15 aa, Homo sapiens
  Heavy chain CDR3 for antibody 467 (IGHV1-2)
ARDLGYYGSGSRMDV

SEQ ID NO: 935 - protein, 9 aa, Homo sapiens
  Light chain CDR3 for antibody 468 (IGKV1D-16)
QQYNSYPYT

SEQ ID NO: 936 - protein, 7 aa, Homo sapiens
  Heavy chain CDR3 for antibody 468 (IGHV1-46)
AREGGDY

SEQ ID NO: 937 - protein, 9 aa, Homo sapiens
  Light chain CDR3 for antibody 469 (IGKV1D-16)
QQYNSYPYT

SEQ ID NO: 938 - protein, 9 aa, Homo sapiens
  Heavy chain CDR3 for antibody 469 (IGHV3-33)
ARATVGVDY

SEQ ID NO: 939 - protein, 9 aa, Homo sapiens
  Light chain CDR3 for antibody 470 (IGKV1-17)
LQHNSYPYT

SEQ ID NO: 940 - protein, 15 aa, Homo sapiens
  Heavy chain CDR3 for antibody 470 (IGHV3-33)
ARDTGYSSSWNWFDP

SEQ ID NO: 941 - protein, 9 aa, Homo sapiens
  Light chain CDR3 for antibody 471 (IGKV1D-16)
QQYNSYPYT

SEQ ID NO: 942 - protein, 18 aa, Homo sapiens
  Heavy chain CDR3 for antibody 471 (IGHV3-33)
ARGYYGSGNFYKDSGMDV

SEQ ID NO: 943 - protein, 10 aa, Homo sapiens
  Light chain CDR3 for antibody 472 (IGKV3-11)
QQRSNWLMYT

SEQ ID NO: 944 - protein, 10 aa, Homo sapiens
  Heavy chain CDR3 for antibody 472 (IGHV3-23)
AKENWNDFDY

SEQ ID NO: 945 - protein, 9 aa, Homo sapiens
  Light chain CDR3 for antibody 473 (IGKV6-21)
HQSSSLPYT

SEQ ID NO: 946 - protein, 15 aa, Homo sapiens
  Heavy chain CDR3 for antibody 473 (IGHV3-64)
ARDGLRYFDWLFPWY

SEQ ID NO: 947 - protein, 9 aa, Homo sapiens
  Light chain CDR3 for antibody 474 (IGKV1-17)
LQHYSYPRT

SEQ ID NO: 948 - protein, 11 aa, Homo sapiens
  Heavy chain CDR3 for antibody 474 (IGHV3-33)
ARDQGGSSFDY

SEQ ID NO: 949 - protein, 9 aa, Homo sapiens
  Light chain CDR3 for antibody 475 (IGKV6-21)
QQSSSLPFT

SEQ ID NO: 950 - protein, 14 aa, Homo sapiens
  Heavy chain CDR3 for antibody 475 (IGHV3-20)
ARDRGSSFFDAFDI

SEQ ID NO: 951 - protein, 9 aa, Homo sapiens
  Light chain CDR3 for antibody 476 (IGKV1-17)
LHHHSYPYT

SEQ ID NO: 952 - protein, 11 aa, Homo sapiens
  Heavy chain CDR3 for antibody 476 (IGHV4-59)
ARDRGHYGMDV

SEQ ID NO: 953 - protein, 9 aa, Homo sapiens
  Light chain CDR3 for antibody 477 (IGKV5-2)
LQHDNFPWT

SEQ ID NO: 954 - protein, 18 aa, Homo sapiens
  Heavy chain CDR3 for antibody 477 (IGHV4-59)
AREGHYYTSGSYYKAFDY

SEQ ID NO: 955 - protein, 9 aa, Homo sapiens
  Light chain CDR3 for antibody 478 (IGKV1D-16)
QQYNSYPLT

SEQ ID NO: 956 - protein, 14 aa, Homo sapiens
  Heavy chain CDR3 for antibody 478 (IGHV3-33)
ARGAAAGNFYGLDV

SEQ ID NO: 957 - protein, 9 aa, Homo sapiens
  Light chain CDR3 for antibody 479 (IGKV1D-13)
QQFNNYMYT

SEQ ID NO: 958 - protein, 20 aa, Homo sapiens
  Heavy chain CDR3 for antibody 479 (IGHV3-33)
ARRMVRGVKKTYYYYYGLDV

SEQ ID NO: 959 - protein, 10 aa, Homo sapiens
  Light chain CDR3 for antibody 480 (IGKV3-15)
QKYNNWPPLT

SEQ ID NO: 960 - protein, 9 aa, Homo sapiens
  Heavy chain CDR3 for antibody 480 (IGHV1-18)
ARGNTWFDY

SEQ ID NO: 961 - protein, 9 aa, Homo sapiens
  Light chain CDR3 for antibody 481 (IGKV1-16)
QQYSSSPIT

SEQ ID NO: 962 - protein, 9 aa, Homo sapiens
  Heavy chain CDR3 for antibody 481 (IGHV4-59)
ARSGSGIYT

SEQ ID NO: 963 - protein, 9 aa, Homo sapiens
  Light chain CDR3 for antibody 482 (IGKV6-21)
HQSSSLLYT

SEQ ID NO: 964 - protein, 16 aa, Homo sapiens
  Heavy chain CDR3 for antibody 482 (IGHV3-33)
ARDQGILTGYYTALDY

SEQ ID NO: 965 - protein, 9 aa, Homo sapiens
  Light chain CDR3 for antibody 483 (IGKV1-6)
LQDYNYPWT

SEQ ID NO: 966 - protein, 14 aa, Homo sapiens
  Heavy chain CDR3 for antibody 483 (IGHV3-33)
ARDGYDILTGPMDV

SEQ ID NO: 967 - protein, 9 aa, Homo sapiens
  Light chain CDR3 for antibody 484 (IGKV1D-16)
QQYNSYPYT

SEQ ID NO: 968 - protein, 12 aa, Homo sapiens
  Heavy chain CDR3 for antibody 484 (IGHV1-18)
ARILFYGDYFDY

SEQ ID NO: 969 - protein, 9 aa, Homo sapiens
  Light chain CDR3 for antibody 485 (IGKV1D-16)
QQYNSYPYT

SEQ ID NO: 970 - protein, 14 aa, Homo sapiens
  Heavy chain CDR3 for antibody 485 (IGHV3-33)
ARAGSGYDRDWFDP

SEQ ID NO: 971 - protein, 10 aa, Homo sapiens
  Light chain CDR3 for antibody 486 (IGKV3-20)
QQYGRSPPVT

SEQ ID NO: 972 - protein, 18 aa, Homo sapiens
  Heavy chain CDR3 for antibody 486 (IGHV3-53)
AKAGDYYVSGSYWGYFDL

SEQ ID NO: 973 - protein, 9 aa, Homo sapiens
  Light chain CDR3 for antibody 487 (IGKV5-2)
LQHDNFPYT

SEQ ID NO: 974 - protein, 15 aa, Homo sapiens
  Heavy chain CDR3 for antibody 487 (IGHV3-30)
ARGAMVRGVDYGMDV

SEQ ID NO: 975 - protein, 9 aa, Homo sapiens
  Light chain CDR3 for antibody 488 (IGKV6-21)
HQSSSLPYT

SEQ ID NO: 976 - protein, 14 aa, Homo sapiens
  Heavy chain CDR3 for antibody 488 (IGHV3-23)
AKSRIVGALYYFDY

SEQ ID NO: 977 - protein, 9 aa, Homo sapiens
  Light chain CDR3 for antibody 489 (IGKV1-6)
LQDYIYPRT

SEQ ID NO: 978 - protein, 17 aa, Homo sapiens
  Heavy chain CDR3 for antibody 489 (IGHV3-33)
AREGYYYGSGSYHFFDY

SEQ ID NO: 979 - protein, 9 aa, Homo sapiens
  Light chain CDR3 for antibody 490 (IGKV1-17)
LQHNSYPYT

SEQ ID NO: 980 - protein, 12 aa, Homo sapiens
  Heavy chain CDR3 for antibody 490 (IGHV3-33)
TRGYSSKSYFDY

SEQ ID NO: 981 - protein, 9 aa, Homo sapiens
  Light chain CDR3 for antibody 491 (IGKV1-6)
LQDYNYPHT

SEQ ID NO: 982 - protein, 17 aa, Homo sapiens
  Heavy chain CDR3 for antibody 491 (IGHV3-30)
ARDGVGATSYYYYGMDV

SEQ ID NO: 983 - protein, 9 aa, Homo sapiens
  Light chain CDR3 for antibody 492 (IGKV1-6)
LQDYNYPYT

SEQ ID NO: 984 - protein, 14 aa, Homo sapiens
  Heavy chain CDR3 for antibody 492 (IGHV3-33)
ARSTLVRGANWFDP

SEQ ID NO: 985 - protein, 8 aa, Homo sapiens
  Light chain CDR3 for antibody 493 (IGKV1-5)
QQYNSYYT

SEQ ID NO: 986 - protein, 11 aa, Homo sapiens
  Heavy chain CDR3 for antibody 493 (IGHV4-39)
ARLLVGATTDY

SEQ ID NO: 987 - protein, 9 aa, Homo sapiens
  Light chain CDR3 for antibody 494 (IGKV1D-16)
QQYNSYPYT

SEQ ID NO: 988 - protein, 14 aa, Homo sapiens
  Heavy chain CDR3 for antibody 494 (IGHV3-33)
ARDKTYPLSYGMDV

SEQ ID NO: 989 - protein, 9 aa, Homo sapiens
  Light chain CDR3 for antibody 495 (IGKV6-21)
HQSSSLPYT

SEQ ID NO: 990 - protein, 13 aa, Homo sapiens
  Heavy chain CDR3 for antibody 495 (IGHV3-11)
ARDGGAAAGTWDS

SEQ ID NO: 991 - protein, 9 aa, Homo sapiens
  Light chain CDR3 for antibody 496 (IGKV1-6)
LQDYNYPYT

SEQ ID NO: 992 - protein, 13 aa, Homo sapiens
  Heavy chain CDR3 for antibody 496 (IGHV3-23)
ASTGDSYYYGMDV

SEQ ID NO: 993 - protein, 7 aa, Homo sapiens
  Light chain CDR3 for antibody 497 (IGKV3-11)
QQRSKFT

SEQ ID NO: 994 - protein, 16 aa, Homo sapiens
  Heavy chain CDR3 for antibody 497 (IGHV1-46)
ARGGGYSESYSNWFDP

SEQ ID NO: 995 - protein, 9 aa, Homo sapiens
  Light chain CDR3 for antibody 498 (IGKV6-21)
HQSSSLPLT

SEQ ID NO: 996 - protein, 14 aa, Homo sapiens
  Heavy chain CDR3 for antibody 498 (IGHV3-20)
ARDGGSGSYDGLDV

SEQ ID NO: 997 - protein, 8 aa, Homo sapiens
  Light chain CDR3 for antibody 499 (IGKV2D-28)
MQALQTPT

SEQ ID NO: 998 - protein, 9 aa, Homo sapiens
  Heavy chain CDR3 for antibody 499 (IGHV3-33)
AANSYGLDY

SEQ ID NO: 999 - protein, 9 aa, Homo sapiens
  Light chain CDR3 for antibody 500 (IGKV1D-16)
QQYDSYPYT

SEQ ID NO: 1000 - protein, 14 aa, Homo sapiens
  Heavy chain CDR3 for antibody 500 (IGHV3-33)
ARDLDIMATSPFAY

SEQ ID NO: 1001 - protein, 9 aa, Homo sapiens
  Light chain CDR3 for antibody 501 (IGKV1-16)
QQYNSYPYT

SEQ ID NO: 1002 - protein, 16 aa, Homo sapiens
  Heavy chain CDR3 for antibody 501 (IGHV4-59)
ARYSGSYYGDYYGMDV

SEQ ID NO: 1003 - protein, 9 aa, Homo sapiens
  Light chain CDR3 for antibody 502 (IGKV1-17)
LQHNSYPYT

SEQ ID NO: 1004 - protein, 18 aa, Homo sapiens
  Heavy chain CDR3 for antibody 502 (IGHV3-33)
ARREGIVGATTYYYGMDV

SEQ ID NO: 1005 - protein, 9 aa, Homo sapiens
  Light chain CDR3 for antibody 503 (IGKV3-20)
QQYGSSPLT

SEQ ID NO: 1006 - protein, 16 aa, Homo sapiens
  Heavy chain CDR3 for antibody 503 (IGHV3-33)
ARIAAPGSEYYYGMDV

SEQ ID NO: 1007 - protein, 9 aa, Homo sapiens
  Light chain CDR3 for antibody 504 (IGKV3-20)
QQYGRSPYT

SEQ ID NO: 1008 - protein, 13 aa, Homo sapiens
  Heavy chain CDR3 for antibody 504 (IGHV3-33)
ARTDYYSYYGLDV

SEQ ID NO: 1009 - protein, 9 aa, Homo sapiens
  Light chain CDR3 for antibody 505 (IGKV1-6)
LQDYNYPYT

SEQ ID NO: 1010 - protein, 9 aa, Homo sapiens
  Heavy chain CDR3 for antibody 505 (IGHV3-13)
ARDRWYFDL

SEQ ID NO: 1011 - protein, 9 aa, Homo sapiens
  Light chain CDR3 for antibody 506 (IGKV3-20)
QQYGSSPYT

SEQ ID NO: 1012 - protein, 18 aa, Homo sapiens
  Heavy chain CDR3 for antibody 506 (IGHV3-33)
ARGYNQGSGSYYNVCFDY

SEQ ID NO: 1013 - protein, 9 aa, Homo sapiens
  Light chain CDR3 for antibody 507 (IGKV1-17)
LQHNSYPYT

SEQ ID NO: 1014 - protein, 12 aa, Homo sapiens
  Heavy chain CDR3 for antibody 507 (IGHV3-33)
ARDLVGATPFDY

SEQ ID NO: 1015 - protein, 9 aa, Homo sapiens
  Light chain CDR3 for antibody 508 (IGKV2D-28)
MQTLQTPWT

SEQ ID NO: 1016 - protein, 12 aa, Homo sapiens
  Heavy chain CDR3 for antibody 508 (IGHV6-1)
ARLDWNYRAFDI

SEQ ID NO: 1017 - protein, 9 aa, Homo sapiens
  Light chain CDR3 for antibody 509 (IGKV3-20)
QQYGSSPYT

SEQ ID NO: 1018 - protein, 16 aa, Homo sapiens
  Heavy chain CDR3 for antibody 509 (IGHV4-59)
AREPLRYFDWPDAFDI

SEQ ID NO: 1019 - protein, 9 aa, Homo sapiens
  Light chain CDR3 for antibody 510 (IGKV5-2)
LQHDNFPWT

SEQ ID NO: 1020 - protein, 9 aa, Homo sapiens
  Heavy chain CDR3 for antibody 510 (IGHV4-59)
AREGGSGSL

SEQ ID NO: 1021 - protein, 9 aa, Homo sapiens
  Light chain CDR3 for antibody 511 (IGKV1D-16)
QQYNSYPYT

SEQ ID NO: 1022 - protein, 20 aa, Homo sapiens
  Heavy chain CDR3 for antibody 511 (IGHV3-11)
ARGGATLIRGLIDYYYGMDV

SEQ ID NO: 1023 - protein, 9 aa, Homo sapiens
  Light chain CDR3 for antibody 512 (IGKV6-21)
HQSSSLPYT

SEQ ID NO: 1024 - protein, 18 aa, Homo sapiens
  Heavy chain CDR3 for antibody 512 (IGHV1-18)
ARDRGYYYGSGSYSPFDY

SEQ ID NO: 1025 - protein, 9 aa, Homo sapiens
  Light chain CDR3 for antibody 513 (IGKV3-20)
QQYGSSPYT

SEQ ID NO: 1026 - protein, 15 aa, Homo sapiens
  Heavy chain CDR3 for antibody 513 (IGHV3-30)
ARGAMVRGVDYGMDV

SEQ ID NO: 1027 - protein, 10 aa, Homo sapiens
  Light chain CDR3 for antibody 514 (IGKV3-20)
QQYGSSPPYT

SEQ ID NO: 1028 - protein, 18 aa, Homo sapiens
  Heavy chain CDR3 for antibody 514 (IGHV3-11)
ARDGYSSGWNYYYFGLDV

SEQ ID NO: 1029 - protein, 9 aa, Homo sapiens
  Light chain CDR3 for antibody 515 (IGKV3-20)
QQYGSSPYT

SEQ ID NO: 1030 - protein, 16 aa, Homo sapiens
  Heavy chain CDR3 for antibody 515 (IGHV3-33)
ARGANYYGSGIPNFEY

SEQ ID NO: 1031 - protein, 9 aa, Homo sapiens
  Light chain CDR3 for antibody 516 (IGKV1-16)
QQYNSYPIT

SEQ ID NO: 1032 - protein, 15 aa, Homo sapiens
  Heavy chain CDR3 for antibody 516 (IGHV1-18)
ARLRWFGELSGWFDP

SEQ ID NO: 1033 - protein, 9 aa, Homo sapiens
  Light chain CDR3 for antibody 517 (IGKV1-17)
LQHNSYPYT

SEQ ID NO: 1034 - protein, 17 aa, Homo sapiens
  Heavy chain CDR3 for antibody 517 (IGHV3-33)
ARGYCSRTSCYLYYFDY

SEQ ID NO: 1035 - protein, 8 aa, Homo sapiens
  Light chain CDR3 for antibody 518 (IGKV6-21)
HQSSSLPT

SEQ ID NO: 1036 - protein, 12 aa, Homo sapiens
  Heavy chain CDR3 for antibody 518 (IGHV3-33)
ARDYGSGSFFDY

SEQ ID NO: 1037 - protein, 9 aa, Homo sapiens
  Light chain CDR3 for antibody 519 (IGKV1-17)
LQHNSYPYT

SEQ ID NO: 1038 - protein, 14 aa, Homo sapiens
  Heavy chain CDR3 for antibody 519 (IGHV3-33)
ARAISGSSYWYFDL

SEQ ID NO: 1039 - protein, 9 aa, Homo sapiens
  Light chain CDR3 for antibody 520 (IGKV5-2)
LQHDNFPYT

SEQ ID NO: 1040 - protein, 13 aa, Homo sapiens
  Heavy chain CDR3 for antibody 520 (IGHV3-11)
ARDGGAAAGTWDS

SEQ ID NO: 1041 - protein, 9 aa, Homo sapiens
  Light chain CDR3 for antibody 521 (IGKV1D-16)
QQYNSYPYT

SEQ ID NO: 1042 - protein, 17 aa, Homo sapiens
  Heavy chain CDR3 for antibody 521 (IGHV3-33)
ARGEQWLGYYYYYGMDV

SEQ ID NO: 1043 - protein, 10 aa, Homo sapiens
  Light chain CDR3 for antibody 522 (IGKV3-15)
QQYNNWPPYT

SEQ ID NO: 1044 - protein, 15 aa, Homo sapiens
  Heavy chain CDR3 for antibody 522 (IGHV3-33)
ARDALAVTGTGWFDP

SEQ ID NO: 1045 - protein, 9 aa, Homo sapiens
  Light chain CDR3 for antibody 523 (IGKV4-1)
QQYYTTPPT

SEQ ID NO: 1046 - protein, 12 aa, Homo sapiens
  Heavy chain CDR3 for antibody 523 (IGHV3-23)
AKGYTSFWYFDL

SEQ ID NO: 1047 - protein, 9 aa, Homo sapiens
  Light chain CDR3 for antibody 524 (IGKV3-20)
QQYGSSPYT

SEQ ID NO: 1048 - protein, 14 aa, Homo sapiens
  Heavy chain CDR3 for antibody 524 (IGHV3-33)
ARGAAAGNFYGLDV

SEQ ID NO: 1049 - protein, 9 aa, Homo sapiens
  Light chain CDR3 for antibody 525 (IGKV3D-7)
QQDYKLPLT

SEQ ID NO: 1050 - protein, 12 aa, Homo sapiens
  Heavy chain CDR3 for antibody 525 (IGHV4-61)
ARVGSSGWYFDY

SEQ ID NO: 1051 - protein, 9 aa, Homo sapiens
  Light chain CDR3 for antibody 526 (IGKV1-17)
LQHNSYPYT

SEQ ID NO: 1052 - protein, 15 aa, Homo sapiens
  Heavy chain CDR3 for antibody 526 (IGHV3-23)
AKDRYFDWLSDAFDI

SEQ ID NO: 1053 - protein, 9 aa, Homo sapiens
  Light chain CDR3 for antibody 527 (IGKV3-20)
QQYGGSPYT

SEQ ID NO: 1054 - protein, 13 aa, Homo sapiens
  Heavy chain CDR3 for antibody 527 (IGHV3-33)
ARVDYYNYYGLDV

SEQ ID NO: 1055 - protein, 9 aa, Homo sapiens
  Light chain CDR3 for antibody 528 (IGKV1D-16)
QQYNSYPYT

SEQ ID NO: 1056 - protein, 18 aa, Homo sapiens
  Heavy chain CDR3 for antibody 528 (IGHV3-33)
ARDRYYDILTGYYMGFDY

SEQ ID NO: 1057 - protein, 8 aa, Homo sapiens
  Light chain CDR3 for antibody 529 (IGKV3-15)
QQYNNWLT

SEQ ID NO: 1058 - protein, 16 aa, Homo sapiens
  Heavy chain CDR3 for antibody 529 (IGHV1-18)
TRGTFYYGSGSSFFDY

SEQ ID NO: 1059 - protein, 8 aa, Homo sapiens
  Light chain CDR3 for antibody 530 (IGKV3-20)
QQYGSSRT

SEQ ID NO: 1060 - protein, 14 aa, Homo sapiens
  Heavy chain CDR3 for antibody 530 (IGHV4-39)
ARQGGWYLYWYFDL

SEQ ID NO: 1061 - protein, 9 aa, Homo sapiens
  Light chain CDR3 for antibody 531 (IGKV1-9)
QQFNSYPYT

SEQ ID NO: 1062 - protein, 12 aa, Homo sapiens
  Heavy chain CDR3 for antibody 531 (IGHV3-33)
VRKWFGELYFDY

SEQ ID NO: 1063 - protein, 9 aa, Homo sapiens
  Light chain CDR3 for antibody 532 (IGKV1-17)
LQHNSFPWT

SEQ ID NO: 1064 - protein, 15 aa, Homo sapiens
  Heavy chain CDR3 for antibody 532 (IGHV3-20)
AREGPYYYGSGSLDY

SEQ ID NO: 1065 - protein, 8 aa, Homo sapiens
  Light chain CDR3 for antibody 533 (IGKV3-11)
QQRSNWWT

SEQ ID NO: 1066 - protein, 12 aa, Homo sapiens
  Heavy chain CDR3 for antibody 533 (IGHV3-33)
ARNYDILDYFDY

SEQ ID NO: 1067 - protein, 9 aa, Homo sapiens
  Light chain CDR3 for antibody 534 (IGKV3-20)
QQYGSSPLT

SEQ ID NO: 1068 - protein, 21 aa, Homo sapiens
  Heavy chain CDR3 for antibody 534 (IGHV1-18)
ASGVLIWFGELLSEDYYDMDV

SEQ ID NO: 1069 - protein, 9 aa, Homo sapiens
  Light chain CDR3 for antibody 535 (IGKV1-6)
LQDYNYPWT

SEQ ID NO: 1070 - protein, 18 aa, Homo sapiens
  Heavy chain CDR3 for antibody 535 (IGHV3-33)
ARRTAAGTGDYYYYGMDV

SEQ ID NO: 1071 - protein, 9 aa, Homo sapiens
  Light chain CDR3 for antibody 536 (IGKV5-2)
LQHDNFPWT

SEQ ID NO: 1072 - protein, 17 aa, Homo sapiens
  Heavy chain CDR3 for antibody 536 (IGHV4-59)
ARDFLVRGEGSYYGMDV

SEQ ID NO: 1073 - protein, 9 aa, Homo sapiens
  Light chain CDR3 for antibody 537 (IGKV1-17)
LQHNSYPYT

SEQ ID NO: 1074 - protein, 12 aa, Homo sapiens
  Heavy chain CDR3 for antibody 537 (IGHV3-33)
ARGYFGSGYAHF

SEQ ID NO: 1075 - protein, 9 aa, Homo sapiens
  Light chain CDR3 for antibody 538 (IGKV2-30)
MQGTHWPLT

SEQ ID NO: 1076 - protein, 16 aa, Homo sapiens
  Heavy chain CDR3 for antibody 538 (IGHV3-33)
AREGGLIAAAGTGFDY

SEQ ID NO: 1077 - protein, 9 aa, Homo sapiens
  Light chain CDR3 for antibody 539 (IGKV1-6)
LQDYNYPYT

SEQ ID NO: 1078 - protein, 12 aa, Homo sapiens
  Heavy chain CDR3 for antibody 539 (IGHV1-18)
ARILFYGDYFDY

SEQ ID NO: 1079 - protein, 9 aa, Homo sapiens
  Light chain CDR3 for antibody 540 (IGKV3D-7)
QQDYNLPYT

SEQ ID NO: 1080 - protein, 12 aa, Homo sapiens
  Heavy chain CDR3 for antibody 540 (IGHV3-21)
AREGFGESSFDY

SEQ ID NO: 1081 - protein, 9 aa, Homo sapiens
  Light chain CDR3 for antibody 541 (IGKV1D-16)
QQYNSYPYT

SEQ ID NO: 1082 - protein, 11 aa, Homo sapiens
  Heavy chain CDR3 for antibody 541 (IGHV3-33)
ARDILTGFLDH

SEQ ID NO: 1083 - protein, 9 aa, Homo sapiens
  Light chain CDR3 for antibody 542 (IGKV6-21)
HQSSSLPWT

SEQ ID NO: 1084 - protein, 15 aa, Homo sapiens
  Heavy chain CDR3 for antibody 542 (IGHV3-33)
ARDRGMVRGDGYLDY

SEQ ID NO: 1085 - protein, 9 aa, Homo sapiens
  Light chain CDR3 for antibody 543 (IGKV4-1)
QQYYSTPWT

SEQ ID NO: 1086 - protein, 20 aa, Homo sapiens
  Heavy chain CDR3 for antibody 543 (IGHV3-33)
ARDLGWATMVRGVIRAPFDY

SEQ ID NO: 1087 - protein, 9 aa, Homo sapiens
  Light chain CDR3 for antibody 544 (IGKV3D-20)
QQYGSSPPT

SEQ ID NO: 1088 - protein, 15 aa, Homo sapiens
  Heavy chain CDR3 for antibody 544 (IGHV3-23)
AKAGGRYFDWFPFDY

SEQ ID NO: 1089 - protein, 9 aa, Homo sapiens
  Light chain CDR3 for antibody 545 (IGKV1-6)
LQDYNYPYT

SEQ ID NO: 1090 - protein, 9 aa, Homo sapiens
  Heavy chain CDR3 for antibody 545 (IGHV3-30)
ARDYFHYDY

SEQ ID NO: 1091 - protein, 8 aa, Homo sapiens
  Light chain CDR3 for antibody 546 (IGKV3-20)
QQYGSSFT

SEQ ID NO: 1092 - protein, 13 aa, Homo sapiens
  Heavy chain CDR3 for antibody 546 (IGHV4-39)
ARPGIVAAGWFDP

SEQ ID NO: 1093 - protein, 9 aa, Homo sapiens
  Light chain CDR3 for antibody 547 (IGKV3-20)
QQYGSSPLT

SEQ ID NO: 1094 - protein, 16 aa, Homo sapiens
  Heavy chain CDR3 for antibody 547 (IGHV3-33)
ARAYYYGSGSYPHFQH

SEQ ID NO: 1095 - protein, 9 aa, Homo sapiens
  Light chain CDR3 for antibody 548 (IGKV3-15)
QQYNNWPLT

SEQ ID NO: 1096 - protein, 12 aa, Homo sapiens
  Heavy chain CDR3 for antibody 548 (IGHV4-28)
ARKDSGYDWFDY

SEQ ID NO: 1097 - protein, 9 aa, Homo sapiens
  Light chain CDR3 for antibody 549 (IGKV1-9)
QQLHIYPWT

SEQ ID NO: 1098 - protein, 12 aa, Homo sapiens
  Heavy chain CDR3 for antibody 549 (IGHV3-33)
ARKGYGLYVLDV

SEQ ID NO: 1099 - protein, 9 aa, Homo sapiens
  Light chain CDR3 for antibody 550 (IGKV1-16)
QQYTSYPFT

SEQ ID NO: 1100 - protein, 20 aa, Homo sapiens
  Heavy chain CDR3 for antibody 550 (IGHV4-59)
ARDRGYDILTGYYGYYGMDV

SEQ ID NO: 1101 - protein, 9 aa, Homo sapiens
  Light chain CDR3 for antibody 551 (IGKV1-27)
QKYNSAPFT

SEQ ID NO: 1102 - protein, 11 aa, Homo sapiens
  Heavy chain CDR3 for antibody 551 (IGHV3-23)
AKEGTYFDIPH

SEQ ID NO: 1103 - protein, 9 aa, Homo sapiens
  Light chain CDR3 for antibody 552 (IGKV3D-7)
QQDYNLPWT

SEQ ID NO: 1104 - protein, 17 aa, Homo sapiens
  Heavy chain CDR3 for antibody 552 (IGHV3-33)
ARENDILTGSYYYGMDV

SEQ ID NO: 1105 - protein, 9 aa, Homo sapiens
  Light chain CDR3 for antibody 553 (IGKV3-20)
QQYGSSPYT

SEQ ID NO: 1106 - protein, 13 aa, Homo sapiens
  Heavy chain CDR3 for antibody 553 (IGHV3-33)
ARDWGYSHGYFDY

SEQ ID NO: 1107 - protein, 9 aa, Homo sapiens
  Light chain CDR3 for antibody 554 (IGKV1-6)
LQDYNYPYT

SEQ ID NO: 1108 - protein, 13 aa, Homo sapiens
  Heavy chain CDR3 for antibody 554 (IGHV3-23)
ARAFFMVRGVIDF

SEQ ID NO: 1109 - protein, 9 aa, Homo sapiens
  Light chain CDR3 for antibody 555 (IGKV1-6)
LQDYNYPYT

SEQ ID NO: 1110 - protein, 17 aa, Homo sapiens
  Heavy chain CDR3 for antibody 555 (IGHV3-33)
ARDQDDILTGYYWYFDL

SEQ ID NO: 1111 - protein, 9 aa, Homo sapiens
  Light chain CDR3 for antibody 556 (IGKV6-21)
HQSGSLPHT

SEQ ID NO: 1112 - protein, 16 aa, Homo sapiens
  Heavy chain CDR3 for antibody 556 (IGHV3-33)
AKDAFYYGSGSHLFDY

SEQ ID NO: 1113 - protein, 9 aa, Homo sapiens
  Light chain CDR3 for antibody 557 (IGKV1D-16)
QQYNSYPLT

SEQ ID NO: 1114 - protein, 14 aa, Homo sapiens
  Heavy chain CDR3 for antibody 557 (IGHV3-23)
AKSRIVGALYYFDY

SEQ ID NO: 1115 - protein, 9 aa, Homo sapiens
  Light chain CDR3 for antibody 558 (IGKV3-11)
QQRSDWPLT

SEQ ID NO: 1116 - protein, 14 aa, Homo sapiens
  Heavy chain CDR3 for antibody 558 (IGHV3-33)
ARDGAAAALDAFDI

SEQ ID NO: 1117 - protein, 9 aa, Homo sapiens
  Light chain CDR3 for antibody 559 (IGKV3-20)
QQYGSSPYT

SEQ ID NO: 1118 - protein, 16 aa, Homo sapiens
  Heavy chain CDR3 for antibody 559 (IGHV3-33)
ARDAGYPNYDYYGMDV

SEQ ID NO: 1119 - protein, 9 aa, Homo sapiens
  Light chain CDR3 for antibody 560 (IGKV1-17)
LQHNSYPYT

SEQ ID NO: 1120 - protein, 14 aa, Homo sapiens
  Heavy chain CDR3 for antibody 560 (IGHV3-33)
ARGYGSGSYYSFDY

SEQ ID NO: 1121 - protein, 9 aa, Homo sapiens
  Light chain CDR3 for antibody 561 (IGKV3-15)
QQYNNWPRT

SEQ ID NO: 1122 - protein, 15 aa, Homo sapiens
  Heavy chain CDR3 for antibody 561 (IGHV3-11)
AREYSSGWYGDAFDI

SEQ ID NO: 1123 - protein, 9 aa, Homo sapiens
  Light chain CDR3 for antibody 562 (IGKV1D-16)
QQYNSYPLT

SEQ ID NO: 1124 - protein, 13 aa, Homo sapiens
  Heavy chain CDR3 for antibody 562 (IGHV3-33)
ARDWGYSHGYFDY

SEQ ID NO: 1125 - protein, 9 aa, Homo sapiens
  Light chain CDR3 for antibody 563 (IGKV6-21)
HQSSSLPHT

SEQ ID NO: 1126 - protein, 19 aa, Homo sapiens
  Heavy chain CDR3 for antibody 563 (IGHV4-39)
ARLDYDFLTDYYRPYFFAY

SEQ ID NO: 1127 - protein, 9 aa, Homo sapiens
  Light chain CDR3 for antibody 564 (IGKV1D-16)
QQYNSYPYT

SEQ ID NO: 1128 - protein, 11 aa, Homo sapiens
  Heavy chain CDR3 for antibody 564 (IGHV3-33)
ARDTWDDYFDY

SEQ ID NO: 1129 - protein, 9 aa, Homo sapiens
  Light chain CDR3 for antibody 565 (IGKV1-17)
LQHNSYPWT

SEQ ID NO: 1130 - protein, 14 aa, Homo sapiens
  Heavy chain CDR3 for antibody 565 (IGHV3-33)
ARDRGRHNYFGMDV

SEQ ID NO: 1131 - protein, 9 aa, Homo sapiens
  Light chain CDR3 for antibody 566 (IGKV1-6)
LQDHNYPRT

SEQ ID NO: 1132 - protein, 13 aa, Homo sapiens
  Heavy chain CDR3 for antibody 566 (IGHV3-33)
ARDGYSYGPYFDY

SEQ ID NO: 1133 - protein, 9 aa, Homo sapiens
  Light chain CDR3 for antibody 567 (IGKV3D-7)
QQDYNLPFT

SEQ ID NO: 1134 - protein, 15 aa, Homo sapiens
  Heavy chain CDR3 for antibody 567 (IGHV3-23)
AKDRNYDFLTGPFDP

SEQ ID NO: 1135 - protein, 9 aa, Homo sapiens
  Light chain CDR3 for antibody 568 (IGKV1D-16)
QQYNSYPYT

SEQ ID NO: 1136 - protein, 13 aa, Homo sapiens
  Heavy chain CDR3 for antibody 568 (IGHV4-59)
ARESPGPYDAFDI

SEQ ID NO: 1137 - protein, 9 aa, Homo sapiens
  Light chain CDR3 for antibody 569 (IGKV1-27)
QKYNSAPYT

SEQ ID NO: 1138 - protein, 11 aa, Homo sapiens
  Heavy chain CDR3 for antibody 569 (IGHV3-33)
ARDRSSGPFDY

SEQ ID NO: 1139 - protein, 9 aa, Homo sapiens
  Light chain CDR3 for antibody 570 (IGKV1-39)
QQSYSTPLT

SEQ ID NO: 1140 - protein, 16 aa, Homo sapiens
  Heavy chain CDR3 for antibody 570 (IGHV3-23)
AKEGMVLRYFDWLWDY

SEQ ID NO: 1141 - protein, 9 aa, Homo sapiens
  Light chain CDR3 for antibody 571 (IGKV1-9)
QQLNSYPLT

SEQ ID NO: 1142 - protein, 12 aa, Homo sapiens
  Heavy chain CDR3 for antibody 571 (IGHV4-61)
ARVYSSGWLFDY

SEQ ID NO: 1143 - protein, 9 aa, Homo sapiens
  Light chain CDR3 for antibody 572 (IGKV3-20)
QQYGSSPYT

SEQ ID NO: 1144 - protein, 14 aa, Homo sapiens
  Heavy chain CDR3 for antibody 572 (IGHV3-23)
AKSRIVGALYYFDY

SEQ ID NO: 1145 - protein, 9 aa, Homo sapiens
  Light chain CDR3 for antibody 573 (IGKV6-21)
HQSSSLPYT

SEQ ID NO: 1146 - protein, 10 aa, Homo sapiens
  Heavy chain CDR3 for antibody 573 (IGHV3-11)
ARGQWPPLDY

SEQ ID NO: 1147 - protein, 10 aa, Homo sapiens
  Light chain CDR3 for antibody 574 (IGKV1-9)
QQLNSFLMYT

SEQ ID NO: 1148 - protein, 18 aa, Homo sapiens
  Heavy chain CDR3 for antibody 574 (IGHV4-59)
ARDNHYYSSGTYSNWFDP

SEQ ID NO: 1149 - protein, 9 aa, Homo sapiens
  Light chain CDR3 for antibody 575 (IGKV3D-7)
QQDYKLPLT

SEQ ID NO: 1150 - protein, 12 aa, Homo sapiens
  Heavy chain CDR3 for antibody 575 (IGHV3-33)
ARDLVRGIRMDV

SEQ ID NO: 1151 - protein, 9 aa, Homo sapiens
  Light chain CDR3 for antibody 576 (IGKV1D-13)
QQFNNYPHT

SEQ ID NO: 1152 - protein, 19 aa, Homo sapiens
  Heavy chain CDR3 for antibody 576 (IGHV3-33)
ARRKNYYGSGSWHYYGMDV

SEQ ID NO: 1153 - protein, 10 aa, Homo sapiens
  Light chain CDR3 for antibody 577 (IGKV1-17)
LQHNSYPIFT

SEQ ID NO: 1154 - protein, 10 aa, Homo sapiens
  Heavy chain CDR3 for antibody 577 (IGHV3-23)
AKDQVGATDC

SEQ ID NO: 1155 - protein, 9 aa, Homo sapiens
  Light chain CDR3 for antibody 578 (IGKV1-6)
LQDYNYPWT

SEQ ID NO: 1156 - protein, 18 aa, Homo sapiens
  Heavy chain CDR3 for antibody 578 (IGHV3-33)
VREGGYYGSGSYPDAFDI

SEQ ID NO: 1157 - protein, 9 aa, Homo sapiens
  Light chain CDR3 for antibody 579 (IGKV5-2)
LQHDNFPWT

SEQ ID NO: 1158 - protein, 14 aa, Homo sapiens
  Heavy chain CDR3 for antibody 579 (IGHV4-39)
ARDSGYDYYYGMDV

SEQ ID NO: 1159 - protein, 9 aa, Homo sapiens
  Light chain CDR3 for antibody 580 (IGKV1D-16)
QQYNSYPLT

SEQ ID NO: 1160 - protein, 12 aa, Homo sapiens
  Heavy chain CDR3 for antibody 580 (IGHV3-33)
ARGYFGSGYAHF

SEQ ID NO: 1161 - protein, 9 aa, Homo sapiens
  Light chain CDR3 for antibody 581 (IGKV1D-16)
QQYDSYPYT

SEQ ID NO: 1162 - protein, 14 aa, Homo sapiens
  Heavy chain CDR3 for antibody 581 (IGHV3-23)
AKDDIVRATGAFDI

SEQ ID NO: 1163 - protein, 8 aa, Homo sapiens
  Light chain CDR3 for antibody 582 (IGKV6-21)
HQSSSLYT

SEQ ID NO: 1164 - protein, 10 aa, Homo sapiens
  Heavy chain CDR3 for antibody 582 (IGHV1-46)
AREWELLFDY

SEQ ID NO: 1165 - protein, 9 aa, Homo sapiens
  Light chain CDR3 for antibody 583 (IGKV1-17)
LQHNSYPYT

SEQ ID NO: 1166 - protein, 17 aa, Homo sapiens
  Heavy chain CDR3 for antibody 583 (IGHV3-33)
ARDWFGELSDYYYGMDV

SEQ ID NO: 1167 - protein, 9 aa, Homo sapiens
  Light chain CDR3 for antibody 584 (IGKV1-16)
QKYNSNPLT

SEQ ID NO: 1168 - protein, 12 aa, Homo sapiens
  Heavy chain CDR3 for antibody 584 (IGHV3-33)
ASRDILTGYLGY

SEQ ID NO: 1169 - protein, 9 aa, Homo sapiens
  Light chain CDR3 for antibody 585 (IGKV3-20)
QQYGSSPYT

SEQ ID NO: 1170 - protein, 17 aa, Homo sapiens
  Heavy chain CDR3 for antibody 585 (IGHV3-33)
ARKDYGILSGYYSPFDY

SEQ ID NO: 1171 - protein, 9 aa, Homo sapiens
  Light chain CDR3 for antibody 586 (IGKV1D-16)
QQYNSYPYT

SEQ ID NO: 1172 - protein, 10 aa, Homo sapiens
  Heavy chain CDR3 for antibody 586 (IGHV3-33)
ARENSTPLDY

SEQ ID NO: 1173 - protein, 9 aa, Homo sapiens
  Light chain CDR3 for antibody 587 (IGKV3-20)
QQYGSSPYT

SEQ ID NO: 1174 - protein, 13 aa, Homo sapiens
  Heavy chain CDR3 for antibody 587 (IGHV3-33)
ARVHFDWLDAFDI

SEQ ID NO: 1175 - protein, 9 aa, Homo sapiens
  Light chain CDR3 for antibody 588 (IGKV1-6)
LQDYNYPYT

SEQ ID NO: 1176 - protein, 9 aa, Homo sapiens
  Heavy chain CDR3 for antibody 588 (IGHV3-20)
ASIRGYFDY

SEQ ID NO: 1177 - protein, 9 aa, Homo sapiens
  Light chain CDR3 for antibody 589 (IGKV6-21)
HQSSSLPYT

SEQ ID NO: 1178 - protein, 12 aa, Homo sapiens
  Heavy chain CDR3 for antibody 589 (IGHV4-39)
ARHGSGSSFFDY

SEQ ID NO: 1179 - protein, 10 aa, Homo sapiens
  Light chain CDR3 for antibody 590 (IGKV4-1)
QQYYDISMYT

SEQ ID NO: 1180 - protein, 16 aa, Homo sapiens
  Heavy chain CDR3 for antibody 590 (IGHV2-70)
AHRAVVTSNLNCRFDF

SEQ ID NO: 1181 - protein, 9 aa, Homo sapiens
  Light chain CDR3 for antibody 591 (IGKV1-6)
LQDYNFPYT

SEQ ID NO: 1182 - protein, 17 aa, Homo sapiens
  Heavy chain CDR3 for antibody 591 (IGHV3-33)
ARDRDDILTGFYTYFDY

SEQ ID NO: 1183 - protein, 9 aa, Homo sapiens
  Light chain CDR3 for antibody 592 (IGKV6-21)
HQSSSLPIT

SEQ ID NO: 1184 - protein, 10 aa, Homo sapiens
  Heavy chain CDR3 for antibody 592 (IGHV3-30)
ARDNFEGMDV

SEQ ID NO: 1185 - protein, 9 aa, Homo sapiens
  Light chain CDR3 for antibody 593 (IGKV5-2)
LQHDNFPWT

SEQ ID NO: 1186 - protein, 12 aa, Homo sapiens
  Heavy chain CDR3 for antibody 593 (IGHV4-39)
ARHGSGSSYFDY

SEQ ID NO: 1187 - protein, 9 aa, Homo sapiens
  Light chain CDR3 for antibody 594 (IGKV1-17)
LQHNSYPYT

SEQ ID NO: 1188 - protein, 15 aa, Homo sapiens
  Heavy chain CDR3 for antibody 594 (IGHV3-33)
ARRICSGGSCSLFDY

SEQ ID NO: 1189 - protein, 9 aa, Homo sapiens
  Light chain CDR3 for antibody 595 (IGKV1-6)
LQDYNYPWT

SEQ ID NO: 1190 - protein, 17 aa, Homo sapiens
  Heavy chain CDR3 for antibody 595 (IGHV3-23)
SKERNWNDGYYYFGMDA

SEQ ID NO: 1191 - protein, 10 aa, Homo sapiens
  Light chain CDR3 for antibody 596 (IGKV3-20)
QQYGRSPPVT

SEQ ID NO: 1192 - protein, 18 aa, Homo sapiens
  Heavy chain CDR3 for antibody 596 (IGHV3-23)
AKDGDYFGSGSYWGYFDL

SEQ ID NO: 1193 - protein, 9 aa, Homo sapiens
  Light chain CDR3 for antibody 597 (IGKV1-39)
QQSYSTPLT

SEQ ID NO: 1194 - protein, 11 aa, Homo sapiens
  Heavy chain CDR3 for antibody 597 (IGHV3-33)
ARDRSSGPFDY

SEQ ID NO: 1195 - protein, 9 aa, Homo sapiens
  Light chain CDR3 for antibody 598 (IGKV1-39)
QQSYSTPLT

SEQ ID NO: 1196 - protein, 16 aa, Homo sapiens
  Heavy chain CDR3 for antibody 598 (IGHV3-64)
ARGRYFDWLLGDWFDP

SEQ ID NO: 1197 - protein, 9 aa, Homo sapiens
  Light chain CDR3 for antibody 599 (IGKV1-6)
LQDYNYPLT

SEQ ID NO: 1198 - protein, 12 aa, Homo sapiens
  Heavy chain CDR3 for antibody 599 (IGHV3-33)
ARESGGSFGMDV

SEQ ID NO: 1199 - protein, 9 aa, Homo sapiens
  Light chain CDR3 for antibody 600 (IGKV1-6)
LQDYNYPYT

SEQ ID NO: 1200 - protein, 10 aa, Homo sapiens
  Heavy chain CDR3 for antibody 600 (IGHV3-30)
ARGSWYGFDY

SEQ ID NO: 1201 - protein, 9 aa, Homo sapiens
  Light chain CDR3 for antibody 601 (IGKV6-21)
HQSSSLPYT

SEQ ID NO: 1202 - protein, 16 aa, Homo sapiens
  Heavy chain CDR3 for antibody 601 (IGHV3-11)
ARDSELRYFDWFGMDV

SEQ ID NO: 1203 - protein, 9 aa, Homo sapiens
  Light chain CDR3 for antibody 602 (IGKV5-2)
LQHDNFPYT

SEQ ID NO: 1204 - protein, 14 aa, Homo sapiens
  Heavy chain CDR3 for antibody 602 (IGHV3-33)
ARGAAAGNFYGLDV

SEQ ID NO: 1205 - protein, 9 aa, Homo sapiens
  Light chain CDR3 for antibody 603 (IGKV6-21)
HQSSSLPHT

SEQ ID NO: 1206 - protein, 13 aa, Homo sapiens
  Heavy chain CDR3 for antibody 603 (IGHV3-13)
ARAITMVRGVIDY

SEQ ID NO: 1207 - protein, 9 aa, Homo sapiens
  Light chain CDR3 for antibody 604 (IGKV5-2)
LQHDNFPYT

SEQ ID NO: 1208 - protein, 13 aa, Homo sapiens
  Heavy chain CDR3 for antibody 604 (IGHV3-23)
ASPFNWNDGFFDY

SEQ ID NO: 1209 - protein, 9 aa, Homo sapiens
  Light chain CDR3 for antibody 605 (IGKV3D-7)
QQDYNLPWT

SEQ ID NO: 1210 - protein, 14 aa, Homo sapiens
  Heavy chain CDR3 for antibody 605 (IGHV4-39)
ARRGVLVPPGGMDV

SEQ ID NO: 1211 - protein, 10 aa, Homo sapiens
  Light chain CDR3 for antibody 606 (IGKV3-15)
QQYNNWPPIT

SEQ ID NO: 1212 - protein, 14 aa, Homo sapiens
  Heavy chain CDR3 for antibody 606 (IGHV3-64)
ARGGGAVTGTNFDY

SEQ ID NO: 1213 - protein, 9 aa, Homo sapiens
  Light chain CDR3 for antibody 607 (IGKV1D-16)
QQYNSYPYT

SEQ ID NO: 1214 - protein, 10 aa, Homo sapiens
  Heavy chain CDR3 for antibody 607 (IGHV3-33)
ARDGSGSQPI

SEQ ID NO: 1215 - protein, 9 aa, Homo sapiens
  Light chain CDR3 for antibody 608 (IGKV6-21)
HQSSSLPYT

SEQ ID NO: 1216 - protein, 14 aa, Homo sapiens
  Heavy chain CDR3 for antibody 608 (IGHV3-33)
ARGAAAGNFYGLDV

SEQ ID NO: 1217 - protein, 9 aa, Homo sapiens
  Light chain CDR3 for antibody 609 (IGKV1-9)
QQLNSYPLT

SEQ ID NO: 1218 - protein, 13 aa, Homo sapiens
  Heavy chain CDR3 for antibody 609 (IGHV4-59)
ARTMVRGVAPFDY

SEQ ID NO: 1219 - protein, 9 aa, Homo sapiens
  Light chain CDR3 for antibody 610 (IGKV5-2)
LQHDNFPWT

SEQ ID NO: 1220 - protein, 15 aa, Homo sapiens
  Heavy chain CDR3 for antibody 610 (IGHV4-59)
ARDLGHYYGSVSIDY

SEQ ID NO: 1221 - protein, 8 aa, Homo sapiens
  Light chain CDR3 for antibody 611 (IGKV6-21)
HQSSSLPT

SEQ ID NO: 1222 - protein, 14 aa, Homo sapiens
  Heavy chain CDR3 for antibody 611 (IGHV3-20)
ARGGSSGWYDWFDP

SEQ ID NO: 1223 - protein, 9 aa, Homo sapiens
  Light chain CDR3 for antibody 612 (IGKV3-20)
QQYGSSPYT

SEQ ID NO: 1224 - protein, 13 aa, Homo sapiens
  Heavy chain CDR3 for antibody 612 (IGHV3-33)
AKRYSSGWYPFDF

SEQ ID NO: 1225 - protein, 9 aa, Homo sapiens
  Light chain CDR3 for antibody 613 (IGKV1D-16)
QQYNSYPYT

SEQ ID NO: 1226 - protein, 14 aa, Homo sapiens
  Heavy chain CDR3 for antibody 613 (IGHV1-46)
ARRGIVGALDAFDI

SEQ ID NO: 1227 - protein, 9 aa, Homo sapiens
  Light chain CDR3 for antibody 614 (IGKV1D-16)
QQYNSYPYT

SEQ ID NO: 1228 - protein, 14 aa, Homo sapiens
  Heavy chain CDR3 for antibody 614 (IGHV3-33)
ARDNILTVYYLFDY

SEQ ID NO: 1229 - protein, 10 aa, Homo sapiens
  Light chain CDR3 for antibody 615 (IGKV3-15)
QQYNNWPPLT

SEQ ID NO: 1230 - protein, 15 aa, Homo sapiens
  Heavy chain CDR3 for antibody 615 (IGHV3-33)
ARGGTGYYSYWYFDL

SEQ ID NO: 1231 - protein, 9 aa, Homo sapiens
  Light chain CDR3 for antibody 616 (IGKV1-27)
QKYNSAPWT

SEQ ID NO: 1232 - protein, 15 aa, Homo sapiens
  Heavy chain CDR3 for antibody 616 (IGHV3-23)
AKAGDYYGSGSPFDY

SEQ ID NO: 1233 - protein, 9 aa, Homo sapiens
  Light chain CDR3 for antibody 617 (IGKV1-9)
QQLNSYPLT

SEQ ID NO: 1234 - protein, 14 aa, Homo sapiens
  Heavy chain CDR3 for antibody 617 (IGHV4-39)
ARDSGYDYYYGMDV

SEQ ID NO: 1235 - protein, 9 aa, Homo sapiens
  Light chain CDR3 for antibody 618 (IGKV6-21)
HQSSSLPYT

SEQ ID NO: 1236 - protein, 13 aa, Homo sapiens
  Heavy chain CDR3 for antibody 618 (IGHV3-23)
ASPFNWNDGFFDY

SEQ ID NO: 1237 - protein, 9 aa, Homo sapiens
  Light chain CDR3 for antibody 619 (IGKV6-21)
HQSSSLPRT

SEQ ID NO: 1238 - protein, 13 aa, Homo sapiens
  Heavy chain CDR3 for antibody 619 (IGHV3-33)
ARDPLYSGSYFDY

SEQ ID NO: 1239 - protein, 9 aa, Homo sapiens
  Light chain CDR3 for antibody 620 (IGKV3D-7)
QQDDNLPPT

SEQ ID NO: 1240 - protein, 22 aa, Homo sapiens
  Heavy chain CDR3 for antibody 620 (IGHV1-18)
ARDRYNNQSKYRNRDYYYGLDV

SEQ ID NO: 1241 - protein, 9 aa, Homo sapiens
  Light chain CDR3 for antibody 621 (IGKV1-17)
LQHNSYPYT

SEQ ID NO: 1242 - protein, 10 aa, Homo sapiens
  Heavy chain CDR3 for antibody 621 (IGHV3-23)
AKGDRWRFDP

SEQ ID NO: 1243 - protein, 10 aa, Homo sapiens
  Light chain CDR3 for antibody 622 (IGKV3-11)
QQRSTWPTLT

SEQ ID NO: 1244 - protein, 8 aa, Homo sapiens
  Heavy chain CDR3 for antibody 622 (IGHV3-23)
AKETGNNY

SEQ ID NO: 1245 - protein, 9 aa, Homo sapiens
  Light chain CDR3 for antibody 623 (IGKV1-17)
LQHNSYPYT

SEQ ID NO: 1246 - protein, 13 aa, Homo sapiens
  Heavy chain CDR3 for antibody 623 (IGHV3-33)
ARAFTMVRGVIDY

SEQ ID NO: 1247 - protein, 9 aa, Homo sapiens
  Light chain CDR3 for antibody 624 (IGKV1D-16)
QQYNSYPYT

SEQ ID NO: 1248 - protein, 12 aa, Homo sapiens
  Heavy chain CDR3 for antibody 624 (IGHV1-24)
ASDWAYYYGMDV

SEQ ID NO: 1249 - protein, 9 aa, Homo sapiens
  Light chain CDR3 for antibody 625 (IGKV3D-20)
QQYGSSPYT

SEQ ID NO: 1250 - protein, 12 aa, Homo sapiens
  Heavy chain CDR3 for antibody 625 (IGHV3-33)
ARGYFGSGYAHF

SEQ ID NO: 1251 - protein, 9 aa, Homo sapiens
  Light chain CDR3 for antibody 626 (IGKV3-20)
QQYGSSPRT

SEQ ID NO: 1252 - protein, 16 aa, Homo sapiens
  Heavy chain CDR3 for antibody 626 (IGHV1-24)
ATEDSSSYYYYYGMDV

SEQ ID NO: 1253 - protein, 9 aa, Homo sapiens
  Light chain CDR3 for antibody 627 (IGKV1-17)
LQHNSYPYT

SEQ ID NO: 1254 - protein, 13 aa, Homo sapiens
  Heavy chain CDR3 for antibody 627 (IGHV4-4)
ARERGIAAAGPDY

SEQ ID NO: 1255 - protein, 9 aa, Homo sapiens
  Light chain CDR3 for antibody 628 (IGKV1-6)
LQDYMYPFT

SEQ ID NO: 1256 - protein, 20 aa, Homo sapiens
  Heavy chain CDR3 for antibody 628 (IGHV3-23)
AKDRETGTTSYHYYYYGMDV

SEQ ID NO: 1257 - protein, 9 aa, Homo sapiens
  Light chain CDR3 for antibody 629 (IGKV1-17)
LQHNSYPWT

SEQ ID NO: 1258 - protein, 16 aa, Homo sapiens
  Heavy chain CDR3 for antibody 629 (IGHV3-23)
ARNDILTASGYYGMDV

SEQ ID NO: 1259 - protein, 9 aa, Homo sapiens
  Light chain CDR3 for antibody 630 (IGKV1D-16)
QQYNSYPYT

SEQ ID NO: 1260 - protein, 17 aa, Homo sapiens
  Heavy chain CDR3 for antibody 630 (IGHV3-23)
AKDGIGELSYYYYGMDV

SEQ ID NO: 1261 - protein, 9 aa, Homo sapiens
  Light chain CDR3 for antibody 631 (IGKV1D-16)
QQYNSYPYT

SEQ ID NO: 1262 - protein, 13 aa, Homo sapiens
  Heavy chain CDR3 for antibody 631 (IGHV3-33)
ASGYSGYDWYFDL

SEQ ID NO: 1263 - protein, 9 aa, Homo sapiens
  Light chain CDR3 for antibody 632 (IGKV1D-16)
QQYNSYPLT

SEQ ID NO: 1264 - protein, 14 aa, Homo sapiens
  Heavy chain CDR3 for antibody 632 (IGHV3-33)
ARDWNDVYYYGMDV

SEQ ID NO: 1265 - protein, 9 aa, Homo sapiens
  Light chain CDR3 for antibody 633 (IGKV1D-16)
QQYNSYPYT

SEQ ID NO: 1266 - protein, 14 aa, Homo sapiens
  Heavy chain CDR3 for antibody 633 (IGHV3-33)
ARDREQQLVRYFDY

SEQ ID NO: 1267 - protein, 9 aa, Homo sapiens
  Light chain CDR3 for antibody 634 (IGKV5-2)
LQHDNFPWT

SEQ ID NO: 1268 - protein, 11 aa, Homo sapiens
  Heavy chain CDR3 for antibody 634 (IGHV4-59)
ARSLRYSVFDY

SEQ ID NO: 1269 - protein, 9 aa, Homo sapiens
  Light chain CDR3 for antibody 635 (IGKV1-9)
QQLNSYPLT

SEQ ID NO: 1270 - protein, 12 aa, Homo sapiens
  Heavy chain CDR3 for antibody 635 (IGHV3-23)
AKGAVVTAIFDY

SEQ ID NO: 1271 - protein, 9 aa, Homo sapiens
  Light chain CDR3 for antibody 636 (IGKV1-6)
LQDYNYPFT

SEQ ID NO: 1272 - protein, 16 aa, Homo sapiens
  Heavy chain CDR3 for antibody 636 (IGHV3-30)
ARDSSYYGSGYYGMDV

SEQ ID NO: 1273 - protein, 9 aa, Homo sapiens
  Light chain CDR3 for antibody 637 (IGKV1-17)
LQHNSYPYT

SEQ ID NO: 1274 - protein, 14 aa, Homo sapiens
  Heavy chain CDR3 for antibody 637 (IGHV3-33)
ARQYSYGYPYYFDY

SEQ ID NO: 1275 - protein, 9 aa, Homo sapiens
  Light chain CDR3 for antibody 638 (IGKV1-17)
LQHNGYPFT

SEQ ID NO: 1276 - protein, 12 aa, Homo sapiens
  Heavy chain CDR3 for antibody 638 (IGHV3-33)
AREEAVAEAFDI

SEQ ID NO: 1277 - protein, 9 aa, Homo sapiens
  Light chain CDR3 for antibody 639 (IGKV1-6)
LQDYNYPYT

SEQ ID NO: 1278 - protein, 8 aa, Homo sapiens
  Heavy chain CDR3 for antibody 639 (IGHV3-23)
AETFLFDY

SEQ ID NO: 1279 - protein, 9 aa, Homo sapiens
  Light chain CDR3 for antibody 640 (IGKV3-20)
QQYGSSPYT

SEQ ID NO: 1280 - protein, 14 aa, Homo sapiens
  Heavy chain CDR3 for antibody 640 (IGHV3-33)
ARGLEWGGDNWFDP

SEQ ID NO: 1281 - protein, 9 aa, Homo sapiens
  Light chain CDR3 for antibody 641 (IGKV1D-16)
QQYNSYPLT

SEQ ID NO: 1282 - protein, 12 aa, Homo sapiens
  Heavy chain CDR3 for antibody 641 (IGHV3-33)
ARGGIAVDVCDI

SEQ ID NO: 1283 - protein, 9 aa, Homo sapiens
  Light chain CDR3 for antibody 642 (IGKV3-20)
QQYGSSPRT

SEQ ID NO: 1284 - protein, 24 aa, Homo sapiens
  Heavy chain CDR3 for antibody 642 (IGHV1-24)
ATEAHYDILTGYYNPHYYYYGMDV

SEQ ID NO: 1285 - protein, 9 aa, Homo sapiens
  Light chain CDR3 for antibody 643 (IGKV5-2)
LQHDNFPWT

SEQ ID NO: 1286 - protein, 12 aa, Homo sapiens
  Heavy chain CDR3 for antibody 643 (IGHV1-24)
ASDWAYYYGMDV

SEQ ID NO: 1287 - protein, 9 aa, Homo sapiens
  Light chain CDR3 for antibody 644 (IGKV1-6)
LQDYNYPWT

SEQ ID NO: 1288 - protein, 14 aa, Homo sapiens
  Heavy chain CDR3 for antibody 644 (IGHV3-23)
AKCDYDILTGILDY

SEQ ID NO: 1289 - protein, 9 aa, Homo sapiens
  Light chain CDR3 for antibody 645 (IGKV1D-16)
QQYNSYPYT

SEQ ID NO: 1290 - protein, 13 aa, Homo sapiens
  Heavy chain CDR3 for antibody 645 (IGHV3-11)
ARDEGYRGYVLDT

SEQ ID NO: 1291 - protein, 9 aa, Homo sapiens
  Light chain CDR3 for antibody 646 (IGKV1-6)
LQDYNYPYT

SEQ ID NO: 1292 - protein, 13 aa, Homo sapiens
  Heavy chain CDR3 for antibody 646 (IGHV3-11)
ARDEGYRGYVLDT

SEQ ID NO: 1293 - protein, 9 aa, Homo sapiens
  Light chain CDR3 for antibody 647 (IGKV1-17)
LQHNSYPYT

SEQ ID NO: 1294 - protein, 16 aa, Homo sapiens
  Heavy chain CDR3 for antibody 647 (IGHV3-33)
ARAVYYGSGSSLIMDV

SEQ ID NO: 1295 - protein, 9 aa, Homo sapiens
  Light chain CDR3 for antibody 648 (IGKV6-21)
HQSSSLPFT

SEQ ID NO: 1296 - protein, 11 aa, Homo sapiens
  Heavy chain CDR3 for antibody 648 (IGHV3-33)
ARDRATAGLDY

SEQ ID NO: 1297 - protein, 9 aa, Homo sapiens
  Light chain CDR3 for antibody 649 (IGKV1-27)
QKYNSAPWT

SEQ ID NO: 1298 - protein, 14 aa, Homo sapiens
  Heavy chain CDR3 for antibody 649 (IGHV1-18)
ARDQPTVPSGYFDY

SEQ ID NO: 1299 - protein, 9 aa, Homo sapiens
  Light chain CDR3 for antibody 650 (IGKV6-21)
HQSSSLPYT

SEQ ID NO: 1300 - protein, 12 aa, Homo sapiens
  Heavy chain CDR3 for antibody 650 (IGHV3-13)
AREAGIPDAFDI

SEQ ID NO: 1301 - protein, 9 aa, Homo sapiens
  Light chain CDR3 for antibody 651 (IGKV3D-7)
QQDYNLPLT

SEQ ID NO: 1302 - protein, 14 aa, Homo sapiens
  Heavy chain CDR3 for antibody 651 (IGHV1-2)
AREGGSGSSPGMDV

SEQ ID NO: 1303 - protein, 9 aa, Homo sapiens
  Light chain CDR3 for antibody 652 (IGKV1-17)
LQHNSYPYT

SEQ ID NO: 1304 - protein, 15 aa, Homo sapiens
  Heavy chain CDR3 for antibody 652 (IGHV3-23)
AKDGSYYDYYYGMDV

SEQ ID NO: 1305 - protein, 9 aa, Homo sapiens
  Light chain CDR3 for antibody 653 (IGKV1-6)
LQDYNYPYT

SEQ ID NO: 1306 - protein, 13 aa, Homo sapiens
  Heavy chain CDR3 for antibody 653 (IGHV3-33)
ARRYRSGWYPFDY

SEQ ID NO: 1307 - protein, 9 aa, Homo sapiens
  Light chain CDR3 for antibody 654 (IGKV3-15)
QQYNNWPRT

SEQ ID NO: 1308 - protein, 17 aa, Homo sapiens
  Heavy chain CDR3 for antibody 654 (IGHV3-13)
AREGWFGELWGYYGMDV

SEQ ID NO: 1309 - protein, 9 aa, Homo sapiens
  Light chain CDR3 for antibody 655 (IGKV1-9)
QQLNSYPLT

SEQ ID NO: 1310 - protein, 13 aa, Homo sapiens
  Heavy chain CDR3 for antibody 655 (IGHV3-33)
ARDYCGGDCYLDY

SEQ ID NO: 1311 - protein, 9 aa, Homo sapiens
  Light chain CDR3 for antibody 656 (IGKV5-2)
LQHDNFPWT

SEQ ID NO: 1312 - protein, 12 aa, Homo sapiens
  Heavy chain CDR3 for antibody 656 (IGHV4-61)
ARVYSSGWLFDY

SEQ ID NO: 1313 - protein, 9 aa, Homo sapiens
  Light chain CDR3 for antibody 657 (IGKV3-15)
QQYNNWPLT

SEQ ID NO: 1314 - protein, 13 aa, Homo sapiens
  Heavy chain CDR3 for antibody 657 (IGHV4-59)
ARDAGYSSSWFDY

SEQ ID NO: 1315 - protein, 9 aa, Homo sapiens
  Light chain CDR3 for antibody 658 (IGKV3-20)
QQYGSSPYT

SEQ ID NO: 1316 - protein, 18 aa, Homo sapiens
  Heavy chain CDR3 for antibody 658 (IGHV3-33)
ARREGIVGATTYYYGMDV

SEQ ID NO: 1317 - protein, 9 aa, Homo sapiens
  Light chain CDR3 for antibody 659 (IGKV6-21)
HQSSSLPYT

SEQ ID NO: 1318 - protein, 13 aa, Homo sapiens
  Heavy chain CDR3 for antibody 659 (IGHV3-33)
ARALYSSSWPGDY

SEQ ID NO: 1319 - protein, 9 aa, Homo sapiens
  Light chain CDR3 for antibody 660 (IGKV1D-16)
QQYNSYPYT

SEQ ID NO: 1320 - protein, 17 aa, Homo sapiens
  Heavy chain CDR3 for antibody 660 (IGHV3-33)
VREGGLLWVGELSLFDY

SEQ ID NO: 1321 - protein, 9 aa, Homo sapiens
  Light chain CDR3 for antibody 661 (IGKV1D-16)
QQYNSYPYT

SEQ ID NO: 1322 - protein, 20 aa, Homo sapiens
  Heavy chain CDR3 for antibody 661 (IGHV1-f)
ATGLITFVRGVILTYRSFDY

SEQ ID NO: 1323 - protein, 9 aa, Homo sapiens
  Light chain CDR3 for antibody 662 (IGKV6-21)
HQSSSLPQT

SEQ ID NO: 1324 - protein, 11 aa, Homo sapiens
  Heavy chain CDR3 for antibody 662 (IGHV3-33)
ARDRSTGWLDY

SEQ ID NO: 1325 - protein, 9 aa, Homo sapiens
  Light chain CDR3 for antibody 663 (IGKV3D-7)
QQDYDLPYP

SEQ ID NO: 1326 - protein, 10 aa, Homo sapiens
  Heavy chain CDR3 for antibody 663 (IGHV4-59)
VSSGTSLLAY

SEQ ID NO: 1327 - protein, 9 aa, Homo sapiens
  Light chain CDR3 for antibody 664 (IGKV3-20)
QQYGSSPYT

SEQ ID NO: 1328 - protein, 12 aa, Homo sapiens
  Heavy chain CDR3 for antibody 664 (IGHV3-13)
AREAGIPDAFDI

SEQ ID NO: 1329 - protein, 9 aa, Homo sapiens
  Light chain CDR3 for antibody 665 (IGKV3-20)
QQYGSSPYT

SEQ ID NO: 1330 - protein, 8 aa, Homo sapiens
  Heavy chain CDR3 for antibody 665 (IGHV3-23)
AKETGNNY

SEQ ID NO: 1331 - protein, 10 aa, Homo sapiens
  Light chain CDR3 for antibody 666 (IGKV3-11)
QQRSNWPMYT

SEQ ID NO: 1332 - protein, 10 aa, Homo sapiens
  Heavy chain CDR3 for antibody 666 (IGHV3-23)
ATIVGPFLDV

SEQ ID NO: 1333 - protein, 8 aa, Homo sapiens
  Light chain CDR3 for antibody 667 (IGKV1-5)
QQYNTYSS

SEQ ID NO: 1334 - protein, 11 aa, Homo sapiens
  Heavy chain CDR3 for antibody 667 (IGHV1-18)
SRGGFSVGYDS

SEQ ID NO: 1335 - protein, 9 aa, Homo sapiens
  Light chain CDR3 for antibody 668 (IGKV6-21)
HQSSSLPYT

SEQ ID NO: 1336 - protein, 15 aa, Homo sapiens
  Heavy chain CDR3 for antibody 668 (IGHV3-20)
ARDRGSSGWRDWFDP

SEQ ID NO: 1337 - protein, 9 aa, Homo sapiens
  Light chain CDR3 for antibody 669 (IGKV6-21)
HQSSSLPYT

SEQ ID NO: 1338 - protein, 9 aa, Homo sapiens
  Heavy chain CDR3 for antibody 669 (IGHV4-34)
ARDLYYFDY

SEQ ID NO: 1339 - protein, 9 aa, Homo sapiens
  Light chain CDR3 for antibody 670 (IGKV1D-13)
QQFNNYPYT

SEQ ID NO: 1340 - protein, 13 aa, Homo sapiens
  Heavy chain CDR3 for antibody 670 (IGHV3-33)
ARDYCGGDCYLDY

SEQ ID NO: 1341 - protein, 9 aa, Homo sapiens
  Light chain CDR3 for antibody 671 (IGKV1D-16)
QQYNSYPYT

SEQ ID NO: 1342 - protein, 11 aa, Homo sapiens
  Heavy chain CDR3 for antibody 671 (IGHV3-33)
AREGAVARFDY

SEQ ID NO: 1343 - protein, 9 aa, Homo sapiens
  Light chain CDR3 for antibody 672 (IGKV3-20)
QQYGSSPYT

SEQ ID NO: 1344 - protein, 16 aa, Homo sapiens
  Heavy chain CDR3 for antibody 672 (IGHV4-59)
ARGRYFEWLLGDVFDI

SEQ ID NO: 1345 - protein, 9 aa, Homo sapiens
  Light chain CDR3 for antibody 673 (IGKV3D-20)
QQYGRSPRT

SEQ ID NO: 1346 - protein, 15 aa, Homo sapiens
  Heavy chain CDR3 for antibody 673 (IGHV3-20)
AREGSSSWYLYYFDY

SEQ ID NO: 1347 - protein, 9 aa, Homo sapiens
  Light chain CDR3 for antibody 674 (IGKV1D-16)
QQYNSYPYT

SEQ ID NO: 1348 - protein, 20 aa, Homo sapiens
  Heavy chain CDR3 for antibody 674 (IGHV3-23)
AKDREMAATSHYYYYYGMDV

SEQ ID NO: 1349 - protein, 9 aa, Homo sapiens
  Light chain CDR3 for antibody 675 (IGKV5-2)
LQHDNFPWT

SEQ ID NO: 1350 - protein, 12 aa, Homo sapiens
  Heavy chain CDR3 for antibody 675 (IGHV4-59)
ARDRSGWAYFDY

SEQ ID NO: 1351 - protein, 9 aa, Homo sapiens
  Light chain CDR3 for antibody 676 (IGKV3D-7)
QQDYNFPLT

SEQ ID NO: 1352 - protein, 15 aa, Homo sapiens
  Heavy chain CDR3 for antibody 676 (IGHV4-59)
ARDLGYYGSGSPLAY

SEQ ID NO: 1353 - protein, 9 aa, Homo sapiens
  Light chain CDR3 for antibody 677 (IGKV6-21)
HQSSSLPLT

SEQ ID NO: 1354 - protein, 9 aa, Homo sapiens
  Heavy chain CDR3 for antibody 677 (IGHV3-30)
VRDDYGVDV

SEQ ID NO: 1355 - protein, 10 aa, Homo sapiens
  Light chain CDR3 for antibody 678 (IGKV3-11)
QQRSNWPPFT

SEQ ID NO: 1356 - protein, 23 aa, Homo sapiens
  Heavy chain CDR3 for antibody 678 (IGHV1-18)
ARNLHYDILTGYFPYYFYYGMDV

SEQ ID NO: 1357 - protein, 9 aa, Homo sapiens
  Light chain CDR3 for antibody 679 (IGKV1D-16)
QQYNSYPYT

SEQ ID NO: 1358 - protein, 9 aa, Homo sapiens
  Heavy chain CDR3 for antibody 679 (IGHV1-8)
ARGRLDFDY

SEQ ID NO: 1359 - protein, 9 aa, Homo sapiens
  Light chain CDR3 for antibody 680 (IGKV1D-16)
QQYNSYPYT

SEQ ID NO: 1360 - protein, 14 aa, Homo sapiens
  Heavy chain CDR3 for antibody 680 (IGHV3-33)
ARGGYSGYRYYFDY

SEQ ID NO: 1361 - protein, 9 aa, Homo sapiens
  Light chain CDR3 for antibody 681 (IGKV6-21)
HQSSSLPYT

SEQ ID NO: 1362 - protein, 11 aa, Homo sapiens
  Heavy chain CDR3 for antibody 681 (IGHV3-23)
AKKVYDYGSDY

SEQ ID NO: 1363 - protein, 9 aa, Homo sapiens
  Light chain CDR3 for antibody 682 (IGKV3-20)
QQYGSSPYT

SEQ ID NO: 1364 - protein, 12 aa, Homo sapiens
  Heavy chain CDR3 for antibody 682 (IGHV3-33)
TRGYSSKSYFDY

SEQ ID NO: 1365 - protein, 9 aa, Homo sapiens
  Light chain CDR3 for antibody 683 (IGKV1D-16)
QQYNSYPLT

SEQ ID NO: 1366 - protein, 12 aa, Homo sapiens
  Heavy chain CDR3 for antibody 683 (IGHV3-33)
TRGYSSKSYFDY

SEQ ID NO: 1367 - protein, 9 aa, Homo sapiens
  Light chain CDR3 for antibody 684 (IGKV5-2)
LQHDNFPWT

SEQ ID NO: 1368 - protein, 13 aa, Homo sapiens
  Heavy chain CDR3 for antibody 684 (IGHV4-39)
ARHVLLWFGEFDP

SEQ ID NO: 1369 - protein, 9 aa, Homo sapiens
  Light chain CDR3 for antibody 685 (IGKV1-6)
LQDYNYPPT

SEQ ID NO: 1370 - protein, 18 aa, Homo sapiens
  Heavy chain CDR3 for antibody 685 (IGHV3-33)
ARDHYDILTGYYKGWFDP

SEQ ID NO: 1371 - protein, 9 aa, Homo sapiens
  Light chain CDR3 for antibody 686 (IGKV5-2)
LQHDNFPWT

SEQ ID NO: 1372 - protein, 18 aa, Homo sapiens
  Heavy chain CDR3 for antibody 686 (IGHV1-46)
ARDGDYVWGSYRSDWFDP

SEQ ID NO: 1373 - protein, 9 aa, Homo sapiens
  Light chain CDR3 for antibody 687 (IGKV6-21)
HQSSSLPWT

SEQ ID NO: 1374 - protein, 14 aa, Homo sapiens
  Heavy chain CDR3 for antibody 687 (IGHV3-33)
ARWELPFYYSGMDV

SEQ ID NO: 1375 - protein, 9 aa, Homo sapiens
  Light chain CDR3 for antibody 688 (IGKV6-21)
HQSSSLPYT

SEQ ID NO: 1376 - protein, 12 aa, Homo sapiens
  Heavy chain CDR3 for antibody 688 (IGHV1-46)
ARGLTGDHAVDI

SEQ ID NO: 1377 - protein, 10 aa, Homo sapiens [sequence omitted]

SEQ ID NO: 1378 - protein, 12 aa, Homo sapiens
  Heavy chain CDR3 for antibody 689 (IGHV4-39)
ARQGAYSRFFDY

SEQ ID NO: 1379 - protein, 9 aa, Homo sapiens
  Light chain CDR3 for antibody 690 (IGKV6-21)
HQTSSLPYT

SEQ ID NO: 1380 - protein, 13 aa, Homo sapiens
  Heavy chain CDR3 for antibody 690 (IGHV3-15)
TTDRLLLFGAFDY

SEQ ID NO: 1381 - protein, 9 aa, Homo sapiens
  Light chain CDR3 for antibody 691 (IGKV1D-16)
QQYNSYPYT

SEQ ID NO: 1382 - protein, 10 aa, Homo sapiens
  Heavy chain CDR3 for antibody 691 (IGHV4-31)
ARHGVAGTNY

SEQ ID NO: 1383 - protein, 9 aa, Homo sapiens
  Light chain CDR3 for antibody 692 (IGKV3-20)
QQYGTSPFP

SEQ ID NO: 1384 - protein, 13 aa, Homo sapiens
  Heavy chain CDR3 for antibody 692 (IGHV3-33)
ARIDYYSYYGMDV

SEQ ID NO: 1385 - protein, 9 aa, Homo sapiens
  Light chain CDR3 for antibody 693 (IGKV1-9)
QQLNSYPLT

SEQ ID NO: 1386 - protein, 11 aa, Homo sapiens
  Heavy chain CDR3 for antibody 693 (IGHV4-59)
ARSIRYSVFDY

SEQ ID NO: 1387 - protein, 9 aa, Homo sapiens
  Light chain CDR3 for antibody 694 (IGKV3D-7)
HQDYNLPWT

SEQ ID NO: 1388 - protein, 19 aa, Homo sapiens
  Heavy chain CDR3 for antibody 694 (IGHV3-33)
ARGRGSYYYGPGSHNGMDV

SEQ ID NO: 1389 - protein, 9 aa, Homo sapiens
  Light chain CDR3 for antibody 695 (IGKV1-17)
LQHNSSPWT

SEQ ID NO: 1390 - protein, 11 aa, Homo sapiens
  Heavy chain CDR3 for antibody 695 (IGHV4-59)
ARESFYGSGNL

SEQ ID NO: 1391 - protein, 9 aa, Homo sapiens
  Light chain CDR3 for antibody 696 (IGKV1-17)
LQHNSYPYT

SEQ ID NO: 1392 - protein, 18 aa, Homo sapiens
  Heavy chain CDR3 for antibody 696 (IGHV3-33)
ARDGYSGYDYYYYYGMDV

SEQ ID NO: 1393 - protein, 8 aa, Homo sapiens
  Light chain CDR3 for antibody 697 (IGKV6-21)
HQSSSLPT

SEQ ID NO: 1394 - protein, 10 aa, Homo sapiens
  Heavy chain CDR3 for antibody 697 (IGHV1-18)
ARGPTSDVDY

SEQ ID NO: 1395 - protein, 9 aa, Homo sapiens
  Light chain CDR3 for antibody 698 (IGKV6-21)
HQSSSLPYT

SEQ ID NO: 1396 - protein, 16 aa, Homo sapiens
  Heavy chain CDR3 for antibody 698 (IGHV3-11)
ARYHYGSGSYYNVGDY

SEQ ID NO: 1397 - protein, 9 aa, Homo sapiens
  Light chain CDR3 for antibody 699 (IGKV1-17)
LQHNSYPWT

SEQ ID NO: 1398 - protein, 22 aa, Homo sapiens
  Heavy chain CDR3 for antibody 699 (IGHV3-23)
AKDDLPYYDILTHSTTTGGMDV

SEQ ID NO: 1399 - protein, 9 aa, Homo sapiens
  Light chain CDR3 for antibody 700 (IGKV1D-16)
QQYNSYPLT

SEQ ID NO: 1400 - protein, 17 aa, Homo sapiens
  Heavy chain CDR3 for antibody 700 (IGHV3-33)
ARGYCSRTSCYLYYFDY

SEQ ID NO: 1401 - protein, 9 aa, Homo sapiens
  Light chain CDR3 for antibody 701 (IGKV1-6)
LQDYNYPYT

SEQ ID NO: 1402 - protein, 12 aa, Homo sapiens
  Heavy chain CDR3 for antibody 701 (IGHV3-33)
ARVDAAAPYFDY

SEQ ID NO: 1403 - protein, 9 aa, Homo sapiens
  Light chain CDR3 for antibody 702 (IGKV5-2)
LQHDNFPYT

SEQ ID NO: 1404 - protein, 12 aa, Homo sapiens
  Heavy chain CDR3 for antibody 702 (IGHV3-13)
AREAGIPDAFDI

SEQ ID NO: 1405 - protein, 9 aa, Homo sapiens
  Light chain CDR3 for antibody 703 (IGKV1-17)
LQHNSYPYT

SEQ ID NO: 1406 - protein, 8 aa, Homo sapiens
  Heavy chain CDR3 for antibody 703 (IGHV3-23)
AETFLFDY

SEQ ID NO: 1407 - protein, 9 aa, Homo sapiens
  Light chain CDR3 for antibody 704 (IGKV1-6)
LQDYNYPRT

SEQ ID NO: 1408 - protein, 16 aa, Homo sapiens
  Heavy chain CDR3 for antibody 704 (IGHV4-59)
ARDTPYYSGSGRPFDS

SEQ ID NO: 1409 - protein, 9 aa, Homo sapiens
  Light chain CDR3 for antibody 705 (IGKV1D-16)
QQYNSYPYT

SEQ ID NO: 1410 - protein, 11 aa, Homo sapiens
  Heavy chain CDR3 for antibody 705 (IGHV3-13)
AREAIIGPFDY

SEQ ID NO: 1411 - protein, 9 aa, Homo sapiens
  Light chain CDR3 for antibody 706 (IGKV3-20)
QQYGSSPYT

SEQ ID NO: 1412 - protein, 13 aa, Homo sapiens
  Heavy chain CDR3 for antibody 706 (IGHV3-33)
ARAFTMVRGVIDY

SEQ ID NO: 1413 - protein, 9 aa, Homo sapiens
  Light chain CDR3 for antibody 707 (IGKV1-6)
LQDYNYPYT

SEQ ID NO: 1414 - protein, 19 aa, Homo sapiens
  Heavy chain CDR3 for antibody 707 (IGHV1-18)
ARDDILTGYSLYYYYGMDV

SEQ ID NO: 1415 - protein, 9 aa, Homo sapiens
  Light chain CDR3 for antibody 708 (IGKV6-21)
HQSSSLPHT

SEQ ID NO: 1416 - protein, 13 aa, Homo sapiens
  Heavy chain CDR3 for antibody 708 (IGHV3-33)
ARGGYYGSGSLDY

SEQ ID NO: 1417 - protein, 9 aa, Homo sapiens
  Light chain CDR3 for antibody 709 (IGKV1-17)
LQLNSFPWT

SEQ ID NO: 1418 - protein, 14 aa, Homo sapiens
  Heavy chain CDR3 for antibody 709 (IGHV3-23)
ARGRRDFYYYGMDV

SEQ ID NO: 1419 - protein, 9 aa, Homo sapiens
  Light chain CDR3 for antibody 710 (IGKV1D-16)
QQYNSFPLT

SEQ ID NO: 1420 - protein, 13 aa, Homo sapiens
  Heavy chain CDR3 for antibody 710 (IGHV3-33)
ARGDNWNDGGFDY

SEQ ID NO: 1421 - protein, 9 aa, Homo sapiens
  Light chain CDR3 for antibody 711 (IGKV1-17)
LQHNSYPYT

SEQ ID NO: 1422 - protein, 12 aa, Homo sapiens
  Heavy chain CDR3 for antibody 711 (IGHV3-33)
AREGDILTGYSL

SEQ ID NO: 1423 - protein, 9 aa, Homo sapiens
  Light chain CDR3 for antibody 712 (IGKV1-17)
LQHNSYPYT

SEQ ID NO: 1424 - protein, 17 aa, Homo sapiens
  Heavy chain CDR3 for antibody 712 (IGHV3-33)
ARESLKLGIYYYYGMDV

SEQ ID NO: 1425 - protein, 9 aa, Homo sapiens
  Light chain CDR3 for antibody 713 (IGKV1-16)
QQYNNYPLT

SEQ ID NO: 1426 - protein, 18 aa, Homo sapiens
  Heavy chain CDR3 for antibody 713 (IGHV4-39)
ARGALTYYDILTGYFFDY

SEQ ID NO: 1427 - protein, 9 aa, Homo sapiens
  Light chain CDR3 for antibody 714 (IGKV3D-20)
QQHGNSPLT

SEQ ID NO: 1428 - protein, 13 aa, Homo sapiens
  Heavy chain CDR3 for antibody 714 (IGHV4-39)
ARRDGSYYGYFDY

SEQ ID NO: 1429 - protein, 9 aa, Homo sapiens
  Light chain CDR3 for antibody 715 (IGKV1-17)
LQHNSYPYT

SEQ ID NO: 1430 - protein, 18 aa, Homo sapiens
  Heavy chain CDR3 for antibody 715 (IGHV3-33)
ARDRDRYGSGTYPDAIDI

SEQ ID NO: 1431 - protein, 9 aa, Homo sapiens
  Light chain CDR3 for antibody 716 (IGKV5-2)
LQHDNFPYT

SEQ ID NO: 1432 - protein, 15 aa, Homo sapiens
  Heavy chain CDR3 for antibody 716 (IGHV3-20)
ARDRGSSGWRDWFDP

SEQ ID NO: 1433 - protein, 9 aa, Homo sapiens
  Light chain CDR3 for antibody 717 (IGKV6-21)
HQSSSLPWT

SEQ ID NO: 1434 - protein, 10 aa, Homo sapiens
  Heavy chain CDR3 for antibody 717 (IGHV3-33)
ARVVDTAMAY

SEQ ID NO: 1435 - protein, 9 aa, Homo sapiens
  Light chain CDR3 for antibody 718 (IGKV1-17)
LQHNSYPYT

SEQ ID NO: 1436 - protein, 17 aa, Homo sapiens
  Heavy chain CDR3 for antibody 718 (IGHV3-33)
ARVYYDILTGYSPAFDI

SEQ ID NO: 1437 - protein, 9 aa, Homo sapiens
  Light chain CDR3 for antibody 719 (IGKV6-21)
HQSSTLPHT

SEQ ID NO: 1438 - protein, 16 aa, Homo sapiens
  Heavy chain CDR3 for antibody 719 (IGHV4-39)
ARHPLILTGYPNWFDP

SEQ ID NO: 1439 - protein, 8 aa, Homo sapiens
  Light chain CDR3 for antibody 720 (IGKV3-20)
QQYGSSLT

SEQ ID NO: 1440 - protein, 13 aa, Homo sapiens
  Heavy chain CDR3 for antibody 720 (IGHV3-21)
ATGAWASSWWGDY

SEQ ID NO: 1441 - protein, 9 aa, Homo sapiens
  Light chain CDR3 for antibody 721 (IGKV3-20)
QQYGSSPYT

SEQ ID NO: 1442 - protein, 14 aa, Homo sapiens
  Heavy chain CDR3 for antibody 721 (IGHV3-33)
ARDWNDVYYYGMDV

SEQ ID NO: 1443 - protein, 9 aa, Homo sapiens
  Light chain CDR3 for antibody 722 (IGKV3-20)
QHYGSSPYT

SEQ ID NO: 1444 - protein, 13 aa, Homo sapiens
  Heavy chain CDR3 for antibody 722 (IGHV3-33)
GRTDYYSYYGVDV

SEQ ID NO: 1445 - protein, 9 aa, Homo sapiens
  Light chain CDR3 for antibody 723 (IGKV1-17)
LQHNSYPYT

SEQ ID NO: 1446 - protein, 9 aa, Homo sapiens
  Heavy chain CDR3 for antibody 723 (IGHV3-13)
ARDRWYFDL

SEQ ID NO: 1447 - protein, 9 aa, Homo sapiens
  Light chain CDR3 for antibody 724 (IGKV1-16)
QQYNRYPYT

SEQ ID NO: 1448 - protein, 13 aa, Homo sapiens
  Heavy chain CDR3 for antibody 724 (IGHV4-59)
ARDAGYSSSWFDY

SEQ ID NO: 1449 - protein, 9 aa, Homo sapiens
  Light chain CDR3 for antibody 725 (IGKV3-20)
QQYGSSPYT

SEQ ID NO: 1450 - protein, 15 aa, Homo sapiens
  Heavy chain CDR3 for antibody 725 (IGHV3-33)
ARDTGYSSSWNWFDP

SEQ ID NO: 1451 - protein, 9 aa, Homo sapiens
  Light chain CDR3 for antibody 726 (IGKV1D-16)
QQYNSYPYT

SEQ ID NO: 1452 - protein, 15 aa, Homo sapiens
  Heavy chain CDR3 for antibody 726 (IGHV3-33)
ARRGYNDYDPYGMDV

SEQ ID NO: 1453 - protein, 9 aa, Homo sapiens
  Light chain CDR3 for antibody 727 (IGKV1-16)
QQYNSYPYT

SEQ ID NO: 1454 - protein, 18 aa, Homo sapiens
  Heavy chain CDR3 for antibody 727 (IGHV1-46)
ARDLTGRTENYYYYGMDV

SEQ ID NO: 1455 - protein, 9 aa, Homo sapiens
  Light chain CDR3 for antibody 728 (IGKV1-17)
LQHNSYPYT

SEQ ID NO: 1456 - protein, 14 aa, Homo sapiens
  Heavy chain CDR3 for antibody 728 (IGHV3-33)
ARDGYDFLTGPFDY

SEQ ID NO: 1457 - protein, 9 aa, Homo sapiens
  Light chain CDR3 for antibody 729 (IGKV1D-16)
QQYNSYPYT

SEQ ID NO: 1458 - protein, 18 aa, Homo sapiens
  Heavy chain CDR3 for antibody 729 (IGHV3-33)
ARREGITLIFYYYYGMDV

SEQ ID NO: 1459 - protein, 9 aa, Homo sapiens
  Light chain CDR3 for antibody 730 (IGKV6-21)
HQSSTLPST

SEQ ID NO: 1460 - protein, 11 aa, Homo sapiens
  Heavy chain CDR3 for antibody 730 (IGHV3-33)
ARDRGYSYFDY

SEQ ID NO: 1461 - protein, 9 aa, Homo sapiens
  Light chain CDR3 for antibody 731 (IGKV1-6)
LQDYNYPYT

SEQ ID NO: 1462 - protein, 18 aa, Homo sapiens
  Heavy chain CDR3 for antibody 731 (IGHV3-33)
ARREGITLIFYYYYGMDV

SEQ ID NO: 1463 - protein, 9 aa, Homo sapiens
  Light chain CDR3 for antibody 732 (IGKV1-17)
LQHNSYPYT

SEQ ID NO: 1464 - protein, 15 aa, Homo sapiens
  Heavy chain CDR3 for antibody 732 (IGHV3-33)
VCVLYDYGDYVGFDY

SEQ ID NO: 1465 - protein, 9 aa, Homo sapiens
  Light chain CDR3 for antibody 733 (IGKV1-9)
QQLNSYPLT

SEQ ID NO: 1466 - protein, 12 aa, Homo sapiens
  Heavy chain CDR3 for antibody 733 (IGHV1-46)
ARGLTGDHAVDI

SEQ ID NO: 1467 - protein, 9 aa, Homo sapiens
  Light chain CDR3 for antibody 734 (IGKV1-39)
QQSYSTPYT

SEQ ID NO: 1468 - protein, 22 aa, Homo sapiens
  Heavy chain CDR3 for antibody 734 (IGHV3-11)
AREAYYDILTGYYTGYYYGMDV

SEQ ID NO: 1469 - protein, 9 aa, Homo sapiens
  Light chain CDR3 for antibody 735 (IGKV6-21)
HQSSSLPYT

SEQ ID NO: 1470 - protein, 18 aa, Homo sapiens
  Heavy chain CDR3 for antibody 735 (IGHV3-33)
AREGYFGSGSYYRNWFDP

SEQ ID NO: 1471 - protein, 9 aa, Homo sapiens
  Light chain CDR3 for antibody 736 (IGKV1-37)
QRTSNAPYT

SEQ ID NO: 1472 - protein, 19 aa, Homo sapiens
  Heavy chain CDR3 for antibody 736 (IGHV3-33)
ARIPGIAVAGGYYYYGMDV

SEQ ID NO: 1473 - protein, 8 aa, Homo sapiens
  Light chain CDR3 for antibody 737 (IGKV1D-13)
QQFNNYLT

SEQ ID NO: 1474 - protein, 18 aa, Homo sapiens
  Heavy chain CDR3 for antibody 737 (IGHV3-23)
AKPDYYGSGSYYNVPFDY

SEQ ID NO: 1475 - protein, 9 aa, Homo sapiens
  Light chain CDR3 for antibody 738 (IGKV1D-16)
QQYNSYPYT

SEQ ID NO: 1476 - protein, 12 aa, Homo sapiens
  Heavy chain CDR3 for antibody 738 (IGHV3-33)
ARDSSGWSHFDY

SEQ ID NO: 1477 - protein, 9 aa, Homo sapiens
  Light chain CDR3 for antibody 739 (IGKV1D-16)
QQYNSYPYT

SEQ ID NO: 1478 - protein, 17 aa, Homo sapiens
  Heavy chain CDR3 for antibody 739 (IGHV3-23)
AKDGSFYSSGWYDAFDI

SEQ ID NO: 1479 - protein, 9 aa, Homo sapiens
  Light chain CDR3 for antibody 740 (IGKV5-2)
LQHDNFPWT

SEQ ID NO: 1480 - protein, 13 aa, Homo sapiens
  Heavy chain CDR3 for antibody 740 (IGHV4-59)
ARTMVRGVAPFDY

SEQ ID NO: 1481 - protein, 9 aa, Homo sapiens
  Light chain CDR3 for antibody 741 (IGKV1D-16)
QQYNSYPYT

SEQ ID NO: 1482 - protein, 17 aa, Homo sapiens
  Heavy chain CDR3 for antibody 741 (IGHV3-66)
ARVQYDILTGYSPYFDN

SEQ ID NO: 1483 - protein, 9 aa, Homo sapiens
  Light chain CDR3 for antibody 742 (IGKV5-2)
LQHDNFPWT

SEQ ID NO: 1484 - protein, 12 aa, Homo sapiens
  Heavy chain CDR3 for antibody 742 (IGHV4-39)
ARQMVREGWFDP

SEQ ID NO: 1485 - protein, 9 aa, Homo sapiens
  Light chain CDR3 for antibody 743 (IGKV1D-16)
QQYNSYPYT

SEQ ID NO: 1486 - protein, 13 aa, Homo sapiens
  Heavy chain CDR3 for antibody 743 (IGHV3-23)
ARGELLWFGEFAC

SEQ ID NO: 1487 - protein, 9 aa, Homo sapiens
  Light chain CDR3 for antibody 744 (IGKV1D-16)
QQYNSYPLT

SEQ ID NO: 1488 - protein, 15 aa, Homo sapiens
  Heavy chain CDR3 for antibody 744 (IGHV3-33)
ARDTGYSSSWNWFDP

SEQ ID NO: 1489 - protein, 9 aa, Homo sapiens
  Light chain CDR3 for antibody 745 (IGKV3-20)
QQYGSSPWT

SEQ ID NO: 1490 - protein, 21 aa, Homo sapiens
  Heavy chain CDR3 for antibody 745 (IGHV4-59)
AAGVLLWFGEPNYYYYYGMDV

SEQ ID NO: 1491 - protein, 9 aa, Homo sapiens
  Light chain CDR3 for antibody 746 (IGKV5-2)
LQHDNFPWT

SEQ ID NO: 1492 - protein, 14 aa, Homo sapiens
  Heavy chain CDR3 for antibody 746 (IGHV4-39)
ARQDYDILTGLFDY

SEQ ID NO: 1493 - protein, 9 aa, Homo sapiens
  Light chain CDR3 for antibody 747 (IGKV1D-16)
QQYNSYPYT

SEQ ID NO: 1494 - protein, 15 aa, Homo sapiens
  Heavy chain CDR3 for antibody 747 (IGHV3-23)
AKEALRYFDWSGMDV

SEQ ID NO: 1495 - protein, 9 aa, Homo sapiens
  Light chain CDR3 for antibody 748 (IGKV5-2)
LQHDNFPYT

SEQ ID NO: 1496 - protein, 17 aa, Homo sapiens
  Heavy chain CDR3 for antibody 748 (IGHV3-33)
ARGYCSRTSCYLYYFDY

SEQ ID NO: 1497 - protein, 9 aa, Homo sapiens
  Light chain CDR3 for antibody 749 (IGKV1D-16)
QQYNSYPYT

SEQ ID NO: 1498 - protein, 17 aa, Homo sapiens
  Heavy chain CDR3 for antibody 749 (IGHV3-23)
AKEYCSGGSCYVYYFDY

SEQ ID NO: 1499 - protein, 9 aa, Homo sapiens
  Light chain CDR3 for antibody 750 (IGKV6-21)
HQSSSLPYT

SEQ ID NO: 1500 - protein, 12 aa, Homo sapiens
  Heavy chain CDR3 for antibody 750 (IGHV3-33)
ARGYFGSGYAHF

SEQ ID NO: 1501 - protein, 9 aa, Homo sapiens
  Light chain CDR3 for antibody 751 (IGKV3D-7)
QQDYNLPRT

SEQ ID NO: 1502 - protein, 17 aa, Homo sapiens
  Heavy chain CDR3 for antibody 751 (IGHV3-33)
AREGTMVRGYYYYGMDV

SEQ ID NO: 1503 - protein, 9 aa, Homo sapiens
  Light chain CDR3 for antibody 752 (IGKV3-20)
QQYGSSPYT

SEQ ID NO: 1504 - protein, 10 aa, Homo sapiens
  Heavy chain CDR3 for antibody 752 (IGHV3-23)
AKEQWLVLDY

SEQ ID NO: 1505 - protein, 9 aa, Homo sapiens
  Light chain CDR3 for antibody 753 (IGKV1-6)
LQDYNYPYT

SEQ ID NO: 1506 - protein, 17 aa, Homo sapiens
  Heavy chain CDR3 for antibody 753 (IGHV1-18)
ARERYYGSGIYKYAMDV

SEQ ID NO: 1507 - protein, 9 aa, Homo sapiens
  Light chain CDR3 for antibody 754 (IGKV6-21)
HQSSSLPYT

SEQ ID NO: 1508 - protein, 9 aa, Homo sapiens
  Heavy chain CDR3 for antibody 754 (IGHV3-30)
ARGRVSLDV

SEQ ID NO: 1509 - protein, 9 aa, Homo sapiens
  Light chain CDR3 for antibody 755 (IGKV5-2)
LQHDNFPWT

SEQ ID NO: 1510 - protein, 9 aa, Homo sapiens
  Heavy chain CDR3 for antibody 755 (IGHV1-18)
ARGKDWFDP

SEQ ID NO: 1511 - protein, 9 aa, Homo sapiens
  Light chain CDR3 for antibody 756 (IGKV6-21)
HQSSSLPYT

SEQ ID NO: 1512 - protein, 17 aa, Homo sapiens
  Heavy chain CDR3 for antibody 756 (IGHV3-33)
ARGYCSRTSCYLYYFDY

SEQ ID NO: 1513 - protein, 9 aa, Homo sapiens
  Light chain CDR3 for antibody 757 (IGKV1-6)
LQDYNYPYT

SEQ ID NO: 1514 - protein, 20 aa, Homo sapiens
  Heavy chain CDR3 for antibody 757 (IGHV1-f)
ATGLITFVRGVILTYRSFDY

SEQ ID NO: 1515 - protein, 9 aa, Homo sapiens
  Light chain CDR3 for antibody 758 (IGKV5-2)
LQHDNFPWT

SEQ ID NO: 1516 - protein, 13 aa, Homo sapiens
  Heavy chain CDR3 for antibody 758 (IGHV4-39)
ARHEVMVRGVFDY

SEQ ID NO: 1517 - protein, 9 aa, Homo sapiens
  Light chain CDR3 for antibody 759 (IGKV6-21)
HQSSSLPYT

SEQ ID NO: 1518 - protein, 9 aa, Homo sapiens
  Heavy chain CDR3 for antibody 759 (IGHV1-18)
ARGKDWFDP

SEQ ID NO: 1519 - protein, 9 aa, Homo sapiens
  Light chain CDR3 for antibody 760 (IGKV1D-16)
QQYNSYPLT

SEQ ID NO: 1520 - protein, 18 aa, Homo sapiens
  Heavy chain CDR3 for antibody 760 (IGHV3-33)
ARREGIVGATTYYYGMDV

SEQ ID NO: 1521 - protein, 9 aa, Homo sapiens
  Light chain CDR3 for antibody 761 (IGKV1D-13)
QQFNNYPST

SEQ ID NO: 1522 - protein, 16 aa, Homo sapiens
  Heavy chain CDR3 for antibody 761 (IGHV4-39)
ARRVPYYDILTGYLDY

SEQ ID NO: 1523 - protein, 9 aa, Homo sapiens
  Light chain CDR3 for antibody 762 (IGKV1D-16)
QQYNSYPYT

SEQ ID NO: 1524 - protein, 18 aa, Homo sapiens
  Heavy chain CDR3 for antibody 762 (IGHV3-33)
ARERGYYGSDIYPAAFDI

SEQ ID NO: 1525 - protein, 9 aa, Homo sapiens
  Light chain CDR3 for antibody 763 (IGKV1D-16)
QQYNSYPYT

SEQ ID NO: 1526 - protein, 17 aa, Homo sapiens
  Heavy chain CDR3 for antibody 763 (IGHV1-18)
ARERYYGSGNYKYNMDV

SEQ ID NO: 1527 - protein, 9 aa, Homo sapiens
  Light chain CDR3 for antibody 764 (IGKV1-9)
QQLNSYPHT

SEQ ID NO: 1528 - protein, 11 aa, Homo sapiens
  Heavy chain CDR3 for antibody 764 (IGHV3-33)
ARDILTGYFDY

SEQ ID NO: 1529 - protein, 9 aa, Homo sapiens
  Light chain CDR3 for antibody 765 (IGKV1D-16)
QQYNSYPYT

SEQ ID NO: 1530 - protein, 13 aa, Homo sapiens
  Heavy chain CDR3 for antibody 765 (IGHV1-18)
ARSITMVRGVIGY

SEQ ID NO: 1531 - protein, 9 aa, Homo sapiens
  Light chain CDR3 for antibody 766 (IGKV1-39)
QQSYSTPFT

SEQ ID NO: 1532 - protein, 11 aa, Homo sapiens
  Heavy chain CDR3 for antibody 766 (IGHV4-59)
AREMGHDTFDI

SEQ ID NO: 1533 - protein, 9 aa, Homo sapiens
  Light chain CDR3 for antibody 767 (IGKV6-21)
HQSSYSPYT

SEQ ID NO: 1534 - protein, 13 aa, Homo sapiens
  Heavy chain CDR3 for antibody 767 (IGHV3-33)
TRRIAVAGAEGDY

SEQ ID NO: 1535 - protein, 9 aa, Homo sapiens
  Light chain CDR3 for antibody 768 (IGKV3-20)
QQYGSSPLT

SEQ ID NO: 1536 - protein, 13 aa, Homo sapiens
  Heavy chain CDR3 for antibody 768 (IGHV1-18)
ARKWEWDLLNFDY

SEQ ID NO: 1537 - protein, 9 aa, Homo sapiens
  Light chain CDR3 for antibody 769 (IGKV1D-16)
QQYNSYPYT

SEQ ID NO: 1538 - protein, 20 aa, Homo sapiens
  Heavy chain CDR3 for antibody 769 (IGHV3-33)
AREDYYGSGSYYPAYNWFDP

SEQ ID NO: 1539 - protein, 9 aa, Homo sapiens
  Light chain CDR3 for antibody 770 (IGKV5-2)
LQHDNFPYT

SEQ ID NO: 1540 - protein, 14 aa, Homo sapiens
  Heavy chain CDR3 for antibody 770 (IGHV3-33)
ARDWNDVYYYGMDV

SEQ ID NO: 1541 - protein, 9 aa, Homo sapiens
  Light chain CDR3 for antibody 771 (IGKV1-9)
QQLNSYPWP

SEQ ID NO: 1542 - protein, 17 aa, Homo sapiens
  Heavy chain CDR3 for antibody 771 (IGHV3-33)
ARSMVTTYGYYYYGMDV

SEQ ID NO: 1543 - protein, 9 aa, Homo sapiens
  Light chain CDR3 for antibody 772 (IGKV6-21)
HQSSSLPHT

SEQ ID NO: 1544 - protein, 13 aa, Homo sapiens
  Heavy chain CDR3 for antibody 772 (IGHV3-33)
ARGRGYNYGYGDY

SEQ ID NO: 1545 - protein, 9 aa, Homo sapiens
  Light chain CDR3 for antibody 773 (IGKV6-21)
HQSSSLPWT

SEQ ID NO: 1546 - protein, 17 aa, Homo sapiens
  Heavy chain CDR3 for antibody 773 (IGHV3-23)
AKGDYYGSGSYSTFFDY

SEQ ID NO: 1547 - protein, 9 aa, Homo sapiens
  Light chain CDR3 for antibody 774 (IGKV1-17)
LQHNSYPYT

SEQ ID NO: 1548 - protein, 14 aa, Homo sapiens
  Heavy chain CDR3 for antibody 774 (IGHV3-33)
ARRGSPLRPSHLDV

SEQ ID NO: 1549 - protein, 9 aa, Homo sapiens
  Light chain CDR3 for antibody 775 (IGKV5-2)
LQHDNFPWT

SEQ ID NO: 1550 - protein, 17 aa, Homo sapiens
  Heavy chain CDR3 for antibody 775 (IGHV1-18)
ARDEGYDILTGYPHFDY

SEQ ID NO: 1551 - protein, 9 aa, Homo sapiens
  Light chain CDR3 for antibody 776 (IGKV6-21)
HQSSSLPYT

SEQ ID NO: 1552 - protein, 18 aa, Homo sapiens
  Heavy chain CDR3 for antibody 776 (IGHV1-46)
ARDGDYVWGSYRSDWFDP

SEQ ID NO: 1553 - protein, 9 aa, Homo sapiens
  Light chain CDR3 for antibody 777 (IGKV6-21)
HQSSSLPYT

SEQ ID NO: 1554 - protein, 13 aa, Homo sapiens
  Heavy chain CDR3 for antibody 777 (IGHV1-18)
ARKWEWDLLNFDY

SEQ ID NO: 1555 - protein, 9 aa, Homo sapiens
  Light chain CDR3 for antibody 778 (IGKV3D-20)
QQYGSSPRT

SEQ ID NO: 1556 - protein, 19 aa, Homo sapiens
  Heavy chain CDR3 for antibody 778 (IGHV1-24)
ATEGGIVGGTRYYYYGMDV

SEQ ID NO: 1557 - protein, 9 aa, Homo sapiens
  Light chain CDR3 for antibody 779 (IGKV1-9)
QQLNSYPLT

SEQ ID NO: 1558 - protein, 18 aa, Homo sapiens
  Heavy chain CDR3 for antibody 779 (IGHV4-59)
AREGDYVWGSYRSNWFDP

SEQ ID NO: 1559 - protein, 9 aa, Homo sapiens
  Light chain CDR3 for antibody 780 (IGKV1-9)
QQLNSYPLT

SEQ ID NO: 1560 - protein, 13 aa, Homo sapiens
  Heavy chain CDR3 for antibody 780 (IGHV4-39)
ARHEVMVRGVFDY

SEQ ID NO: 1561 - protein, 9 aa, Homo sapiens
  Light chain CDR3 for antibody 781 (IGKV3-20)
QQYGSSPYT

SEQ ID NO: 1562 - protein, 13 aa, Homo sapiens
  Heavy chain CDR3 for antibody 781 (IGHV4-61)
ASRYSSGRYPFDY

SEQ ID NO: 1563 - protein, 9 aa, Homo sapiens
  Light chain CDR3 for antibody 782 (IGKV3-20)
QQFGTSPLT

SEQ ID NO: 1564 - protein, 13 aa, Homo sapiens
  Heavy chain CDR3 for antibody 782 (IGHV1-24)
ATLHTYFYGEFAY

SEQ ID NO: 1565 - protein, 9 aa, Homo sapiens
  Light chain CDR3 for antibody 783 (IGKV1-6)
LQDYNYPFT

SEQ ID NO: 1566 - protein, 15 aa, Homo sapiens
  Heavy chain CDR3 for antibody 783 (IGHV3-33)
ARDRVQLGYYYGMDV

SEQ ID NO: 1567 - protein, 8 aa, Homo sapiens
  Light chain CDR3 for antibody 784 (IGKV3D-7)
QQDYHLLT

SEQ ID NO: 1568 - protein, 8 aa, Homo sapiens
  Heavy chain CDR3 for antibody 784 (IGHV4-4)
ARGARFDP

SEQ ID NO: 1569 - protein, 9 aa, Homo sapiens
  Light chain CDR3 for antibody 785 (IGKV6-21)
HQSSSLPYT

SEQ ID NO: 1570 - protein, 13 aa, Homo sapiens
  Heavy chain CDR3 for antibody 785 (IGHV3-11)
AREGIAVAGDFDF

SEQ ID NO: 1571 - protein, 9 aa, Homo sapiens
  Light chain CDR3 for antibody 786 (IGKV3-15)
QQYNNWPRT

SEQ ID NO: 1572 - protein, 16 aa, Homo sapiens
  Heavy chain CDR3 for antibody 786 (IGHV3-33)
ARPTYYDILTGYPFDY

SEQ ID NO: 1573 - protein, 9 aa, Homo sapiens
  Light chain CDR3 for antibody 787 (IGKV1D-16)
QQYNSYPYT

SEQ ID NO: 1574 - protein, 8 aa, Homo sapiens
  Heavy chain CDR3 for antibody 787 (IGHV3-23)
EKSAGEDV

SEQ ID NO: 1575 - protein, 9 aa, Homo sapiens
  Light chain CDR3 for antibody 788 (IGKV1-39)
QQSYSTPLT

SEQ ID NO: 1576 - protein, 13 aa, Homo sapiens
  Heavy chain CDR3 for antibody 788 (IGHV3-33)
ARDYCGGDCYLDY

SEQ ID NO: 1577 - protein, 9 aa, Homo sapiens
  Light chain CDR3 for antibody 789 (IGKV5-2)
LQHDNFPYT

SEQ ID NO: 1578 - protein, 12 aa, Homo sapiens
  Heavy chain CDR3 for antibody 789 (IGHV3-33)
ARESGGSYSFDY

SEQ ID NO: 1579 - protein, 9 aa, Homo sapiens
  Light chain CDR3 for antibody 790 (IGKV1D-16)
QQYNSYPYT

SEQ ID NO: 1580 - protein, 13 aa, Homo sapiens
  Heavy chain CDR3 for antibody 790 (IGHV1-46)
ARVKLGSLGAFDI

SEQ ID NO: 1581 - protein, 9 aa, Homo sapiens
  Light chain CDR3 for antibody 791 (IGKV1D-16)
QQYNSYPYT

SEQ ID NO: 1582 - protein, 13 aa, Homo sapiens
  Heavy chain CDR3 for antibody 791 (IGHV3-33)
ARGVLWFGELFDY

SEQ ID NO: 1583 - protein, 9 aa, Homo sapiens
  Light chain CDR3 for antibody 792 (IGKV5-2)
LQHDNFPWT

SEQ ID NO: 1584 - protein, 16 aa, Homo sapiens
  Heavy chain CDR3 for antibody 792 (IGHV4-59)
ARDTPYYSGSGRPFDS

SEQ ID NO: 1585 - protein, 9 aa, Homo sapiens
  Light chain CDR3 for antibody 793 (IGKV1D-16)
QQYNSYPLT

SEQ ID NO: 1586 - protein, 12 aa, Homo sapiens
  Heavy chain CDR3 for antibody 793 (IGHV3-33)
ARDLVGATPFDY

SEQ ID NO: 1587 - protein, 9 aa, Homo sapiens
  Light chain CDR3 for antibody 794 (IGKV1D-16)
QQYNSYPYT

SEQ ID NO: 1588 - protein, 17 aa, Homo sapiens
  Heavy chain CDR3 for antibody 794 (IGHV4-39)
ARVLRYFDWLSHDAFDI

SEQ ID NO: 1589 - protein, 9 aa, Homo sapiens
  Light chain CDR3 for antibody 795 (IGKV1-6)
LQDYNYPYT

SEQ ID NO: 1590 - protein, 12 aa, Homo sapiens
  Heavy chain CDR3 for antibody 795 (IGHV1-46)
AREDYDIDGMDV

SEQ ID NO: 1591 - protein, 9 aa, Homo sapiens
  Light chain CDR3 for antibody 796 (IGKV6-21)
HQSSSLPRT

SEQ ID NO: 1592 - protein, 14 aa, Homo sapiens
  Heavy chain CDR3 for antibody 796 (IGHV3-33)
AREEDYYYYYDMDV

SEQ ID NO: 1593 - protein, 9 aa, Homo sapiens
  Light chain CDR3 for antibody 797 (IGKV1D-16)
QQYDSYPYT

SEQ ID NO: 1594 - protein, 14 aa, Homo sapiens
  Heavy chain CDR3 for antibody 797 (IGHV3-33)
ARDAMGTSTAWFDP

SEQ ID NO: 1595 - protein, 9 aa, Homo sapiens
  Light chain CDR3 for antibody 798 (IGKV1D-16)
QQYNSYPYT

SEQ ID NO: 1596 - protein, 24 aa, Homo sapiens
  Heavy chain CDR3 for antibody 798 (IGHV3-20)
ARGRITMVRGVIINPLDYYNGMDV

SEQ ID NO: 1597 - protein, 9 aa, Homo sapiens
  Light chain CDR3 for antibody 799 (IGKV5-2)
LQHDNFPYT

SEQ ID NO: 1598 - protein, 12 aa, Homo sapiens
  Heavy chain CDR3 for antibody 799 (IGHV3-33)
ARGYFGSGYAHF

SEQ ID NO: 1599 - protein, 9 aa, Homo sapiens
  Light chain CDR3 for antibody 800 (IGKV1-17)
LQHNSYPYT

SEQ ID NO: 1600 - protein, 20 aa, Homo sapiens
  Heavy chain CDR3 for antibody 800 (IGHV3-20)
ARDLCSSTSCYGYYYYGMDV

SEQ ID NO: 1601 - protein, 9 aa, Homo sapiens
  Light chain CDR3 for antibody 801 (IGKV1D-16)
QQYNSYPYT

SEQ ID NO: 1602 - protein, 20 aa, Homo sapiens
  Heavy chain CDR3 for antibody 801 (IGHV1-18)
AREVGIAVAGTLYYYYGMDV

SEQ ID NO: 1603 - protein, 9 aa, Homo sapiens
  Light chain CDR3 for antibody 802 (IGKV6-21)
HQSSSLPHT

SEQ ID NO: 1604 - protein, 10 aa, Homo sapiens
  Heavy chain CDR3 for antibody 802 (IGHV4-39)
ASSNWNDGPL

SEQ ID NO: 1605 - protein, 9 aa, Homo sapiens
  Light chain CDR3 for antibody 803 (IGKV1-17)
LQHNSYPYT

SEQ ID NO: 1606 - protein, 16 aa, Homo sapiens
  Heavy chain CDR3 for antibody 803 (IGHV3-33)
ARGGRSDWLYYYGMDV

SEQ ID NO: 1607 - protein, 9 aa, Homo sapiens
  Light chain CDR3 for antibody 804 (IGKV1D-16)
QQYNSYPYT

SEQ ID NO: 1608 - protein, 13 aa, Homo sapiens
  Heavy chain CDR3 for antibody 804 (IGHV4-28)
ARKGATGYYGMDV

SEQ ID NO: 1609 - protein, 9 aa, Homo sapiens
  Light chain CDR3 for antibody 805 (IGKV1D-16)
QQYNSYPYT

SEQ ID NO: 1610 - protein, 17 aa, Homo sapiens
  Heavy chain CDR3 for antibody 805 (IGHV1-18)
ARERYYGSGSYKYNMDV

SEQ ID NO: 1611 - protein, 9 aa, Homo sapiens
  Light chain CDR3 for antibody 806 (IGKV1D-16)
QQYNSYPYT

SEQ ID NO: 1612 - protein, 13 aa, Homo sapiens
  Heavy chain CDR3 for antibody 806 (IGHV3-33)
AREYFDWLLPLDY

SEQ ID NO: 1613 - protein, 9 aa, Homo sapiens
  Light chain CDR3 for antibody 807 (IGKV1D-16)
QQYNSYPYT

SEQ ID NO: 1614 - protein, 15 aa, Homo sapiens
  Heavy chain CDR3 for antibody 807 (IGHV3-33)
ARDSRPEIIGPPFDY

SEQ ID NO: 1615 - protein, 9 aa, Homo sapiens
  Light chain CDR3 for antibody 808 (IGKV5-2)
LQHDNFPYT

SEQ ID NO: 1616 - protein, 13 aa, Homo sapiens
  Heavy chain CDR3 for antibody 808 (IGHV3-33)
ARKAYGDYFYFDY

SEQ ID NO: 1617 - protein, 9 aa, Homo sapiens
  Light chain CDR3 for antibody 809 (IGKV6-21)
HQSSSLPYT

SEQ ID NO: 1618 - protein, 13 aa, Homo sapiens
  Heavy chain CDR3 for antibody 809 (IGHV3-33)
ARDQRYSSGWYDY

SEQ ID NO: 1619 - protein, 9 aa, Homo sapiens
  Light chain CDR3 for antibody 810 (IGKV1-6)
LQDYNYPRT

SEQ ID NO: 1620 - protein, 15 aa, Homo sapiens
  Heavy chain CDR3 for antibody 810 (IGHV3-64)
ARDSHHDLLTGHYEY

SEQ ID NO: 1621 - protein, 9 aa, Homo sapiens
  Light chain CDR3 for antibody 811 (IGKV1-6)
LQDYNYPYT

SEQ ID NO: 1622 - protein, 14 aa, Homo sapiens
  Heavy chain CDR3 for antibody 811 (IGHV1-46)
ARRGIVGALDAFDI

SEQ ID NO: 1623 - protein, 9 aa, Homo sapiens
  Light chain CDR3 for antibody 812 (IGKV3-15)
QQYNNWPYT

SEQ ID NO: 1624 - protein, 12 aa, Homo sapiens
  Heavy chain CDR3 for antibody 812 (IGHV3-33)
ARDGPVAGLFDY

SEQ ID NO: 1625 - protein, 9 aa, Homo sapiens
  Light chain CDR3 for antibody 813 (IGKV1-17)
LQHNSYPYT

SEQ ID NO: 1626 - protein, 15 aa, Homo sapiens
  Heavy chain CDR3 for antibody 813 (IGHV3-33)
ARDRGWKAPGYGMDV

SEQ ID NO: 1627 - protein, 9 aa, Homo sapiens
  Light chain CDR3 for antibody 814 (IGKV1-6)
LQDYNYPYT

SEQ ID NO: 1628 - protein, 20 aa, Homo sapiens
  Heavy chain CDR3 for antibody 814 (IGHV3-23)
AKDREMAATSHYYYYYGMDV

SEQ ID NO: 1629 - protein, 9 aa, Homo sapiens
  Light chain CDR3 for antibody 815 (IGKV3D-20)
QQYGSSPPT

SEQ ID NO: 1630 - protein, 18 aa, Homo sapiens
  Heavy chain CDR3 for antibody 815 (IGHV3-33)
ARRGVGARGYYYYYGMDV

SEQ ID NO: 1631 - protein, 9 aa, Homo sapiens
  Light chain CDR3 for antibody 816 (IGKV1-17)
LQHNSYPYT

SEQ ID NO: 1632 - protein, 11 aa, Homo sapiens
  Heavy chain CDR3 for antibody 816 (IGHV3-33)
AREAANWGFDY

SEQ ID NO: 1633 - protein, 9 aa, Homo sapiens
  Light chain CDR3 for antibody 817 (IGKV1-6)
LQDYNYPFT

SEQ ID NO: 1634 - protein, 20 aa, Homo sapiens
  Heavy chain CDR3 for antibody 817 (IGHV3-23)
AKDRMTTVTSYYYYSYGMDV

SEQ ID NO: 1635 - protein, 9 aa, Homo sapiens
  Light chain CDR3 for antibody 818 (IGKV3D-7)
QQDYNLPHT

SEQ ID NO: 1636 - protein, 15 aa, Homo sapiens
  Heavy chain CDR3 for antibody 818 (IGHV4-39)
ARRVRGLIITRYFDY

SEQ ID NO: 1637 - protein, 9 aa, Homo sapiens
  Light chain CDR3 for antibody 819 (IGKV1D-16)
QQYHSYPYT

SEQ ID NO: 1638 - protein, 12 aa, Homo sapiens
  Heavy chain CDR3 for antibody 819 (IGHV3-66)
VRDRAAAPYFDL

SEQ ID NO: 1639 - protein, 9 aa, Homo sapiens
  Light chain CDR3 for antibody 820 (IGKV1-6)
LQDYNYPWT

SEQ ID NO: 1640 - protein, 18 aa, Homo sapiens
  Heavy chain CDR3 for antibody 820 (IGHV3-33)
VRERGHYGSGSFPDAFDI

SEQ ID NO: 1641 - protein, 9 aa, Homo sapiens
  Light chain CDR3 for antibody 821 (IGKV1D-16)
QQYNSYPYT

SEQ ID NO: 1642 - protein, 12 aa, Homo sapiens
  Heavy chain CDR3 for antibody 821 (IGHV3-23)
AKDGWFGESLDY

SEQ ID NO: 1643 - protein, 9 aa, Homo sapiens
  Light chain CDR3 for antibody 822 (IGKV1-9)
QQLNSYPYT

SEQ ID NO: 1644 - protein, 17 aa, Homo sapiens
  Heavy chain CDR3 for antibody 822 (IGHV4-39)
AGRLTYYFGSGSPSFDY

SEQ ID NO: 1645 - protein, 9 aa, Homo sapiens
  Light chain CDR3 for antibody 823 (IGKV1D-13)
QQFNNYPHT

SEQ ID NO: 1646 - protein, 16 aa, Homo sapiens
  Heavy chain CDR3 for antibody 823 (IGHV3-23)
AKEGMVLRYFDWLWDY

SEQ ID NO: 1647 - protein, 9 aa, Homo sapiens
  Light chain CDR3 for antibody 824 (IGKV1D-16)
QQYNSYPYT

SEQ ID NO: 1648 - protein, 13 aa, Homo sapiens
  Heavy chain CDR3 for antibody 824 (IGHV3-33)
ARIDYYSYYGMDV

SEQ ID NO: 1649 - protein, 9 aa, Homo sapiens
  Light chain CDR3 for antibody 825 (IGKV1-27)
QKYNSAPYT

SEQ ID NO: 1650 - protein, 13 aa, Homo sapiens
  Heavy chain CDR3 for antibody 825 (IGHV3-33)
ARDYCGGDCYLDY

SEQ ID NO: 1651 - protein, 9 aa, Homo sapiens
  Light chain CDR3 for antibody 826 (IGKV3-15)
QQYNNWPWT

SEQ ID NO: 1652 - protein, 11 aa, Homo sapiens
  Heavy chain CDR3 for antibody 826 (IGHV3-11)
ARASRGSYYDY

SEQ ID NO: 1653 - protein, 9 aa, Homo sapiens
  Light chain CDR3 for antibody 827 (IGKV5-2)
LQHDNFPWT

SEQ ID NO: 1654 - protein, 17 aa, Homo sapiens
  Heavy chain CDR3 for antibody 827 (IGHV1-18)
ARDRAFTMVRGVPPFDY

SEQ ID NO: 1655 - protein, 9 aa, Homo sapiens
  Light chain CDR3 for antibody 828 (IGKV3-11)
QQRSNWPWT

SEQ ID NO: 1656 - protein, 13 aa, Homo sapiens
  Heavy chain CDR3 for antibody 828 (IGHV4-59)
ARDAGYSSSWFDY

SEQ ID NO: 1657 - protein, 9 aa, Homo sapiens
  Light chain CDR3 for antibody 829 (IGKV1-6)
LQDYNYPYT

SEQ ID NO: 1658 - protein, 15 aa, Homo sapiens
  Heavy chain CDR3 for antibody 829 (IGHV3-33)
ARGYYYGSGSFPVDY

SEQ ID NO: 1659 - protein, 9 aa, Homo sapiens
  Light chain CDR3 for antibody 830 (IGKV1-17)
LQHNSYPYT

SEQ ID NO: 1660 - protein, 20 aa, Homo sapiens
  Heavy chain CDR3 for antibody 830 (IGHV3-33)
SRGGATLVRGVIDYYYGMDV

SEQ ID NO: 1661 - protein, 9 aa, Homo sapiens
  Light chain CDR3 for antibody 831 (IGKV5-2)
LQHDNFPWT

SEQ ID NO: 1662 - protein, 16 aa, Homo sapiens
  Heavy chain CDR3 for antibody 831 (IGHV4-59)
ARYSGSYYGDYYGMDV

SEQ ID NO: 1663 - protein, 9 aa, Homo sapiens
  Light chain CDR3 for antibody 832 (IGKV1-17)
LQHNSYPYT

SEQ ID NO: 1664 - protein, 17 aa, Homo sapiens
  Heavy chain CDR3 for antibody 832 (IGHV3-33)
ARAYYDILTGYSYYFDY

SEQ ID NO: 1665 - protein, 9 aa, Homo sapiens
  Light chain CDR3 for antibody 833 (IGKV1-17)
LQHNSYPYT

SEQ ID NO: 1666 - protein, 18 aa, Homo sapiens
  Heavy chain CDR3 for antibody 833 (IGHV3-23)
AKEGNYYGSGSYWGYFDP

SEQ ID NO: 1667 - protein, 8 aa, Homo sapiens
  Light chain CDR3 for antibody 834 (IGKV3D-7)
LQDYNLPT

SEQ ID NO: 1668 - protein, 12 aa, Homo sapiens
  Heavy chain CDR3 for antibody 834 (IGHV1-18)
ARKGIEVGGFDY

SEQ ID NO: 1669 - protein, 9 aa, Homo sapiens
  Light chain CDR3 for antibody 835 (IGKV1D-16)
QQYNSYPYT

SEQ ID NO: 1670 - protein, 9 aa, Homo sapiens
  Heavy chain CDR3 for antibody 835 (IGHV3-33)
AREYKEFDY

SEQ ID NO: 1671 - protein, 9 aa, Homo sapiens
  Light chain CDR3 for antibody 836 (IGKV1D-16)
QQYNSYPYT

SEQ ID NO: 1672 - protein, 11 aa, Homo sapiens
  Heavy chain CDR3 for antibody 836 (IGHV1-24)
ATREYSSSCDY

SEQ ID NO: 1673 - protein, 9 aa, Homo sapiens
  Light chain CDR3 for antibody 837 (IGKV1D-16)
QQYNSYPYT

SEQ ID NO: 1674 - protein, 18 aa, Homo sapiens
  Heavy chain CDR3 for antibody 837 (IGHV1-18)
ARDRYYYDSGSYYYGMDV

SEQ ID NO: 1675 - protein, 8 aa, Homo sapiens
  Light chain CDR3 for antibody 838 (IGKV3D-7)
QQDYNLLT

SEQ ID NO: 1676 - protein, 18 aa, Homo sapiens
  Heavy chain CDR3 for antibody 838 (IGHV3-33)
ARGAYSSGWDYYYYGLDV

SEQ ID NO: 1677 - protein, 9 aa, Homo sapiens
  Light chain CDR3 for antibody 839 (IGKV6-21)
HQSSSLPYT

SEQ ID NO: 1678 - protein, 8 aa, Homo sapiens
  Heavy chain CDR3 for antibody 839 (IGHV3-23)
AKETGNNY

SEQ ID NO: 1679 - protein, 9 aa, Homo sapiens
  Light chain CDR3 for antibody 840 (IGKV1-8)
QQYYSYPPT

SEQ ID NO: 1680 - protein, 15 aa, Homo sapiens
  Heavy chain CDR3 for antibody 840 (IGHV3-23)
AKDRSGSGSYNLFDY

SEQ ID NO: 1681 - protein, 9 aa, Homo sapiens
  Light chain CDR3 for antibody 841 (IGKV1-17)
LQHNSYPYT

SEQ ID NO: 1682 - protein, 16 aa, Homo sapiens
  Heavy chain CDR3 for antibody 841 (IGHV3-33)
ARGYDMLTGDYYGMDV

SEQ ID NO: 1683 - protein, 9 aa, Homo sapiens
  Light chain CDR3 for antibody 842 (IGKV1-16)
QQYNSYPYT

SEQ ID NO: 1684 - protein, 23 aa, Homo sapiens
  Heavy chain CDR3 for antibody 842 (IGHV4-59)
ARERTYSDILPGYYEDYYYGMDV

SEQ ID NO: 1685 - protein, 9 aa, Homo sapiens
  Light chain CDR3 for antibody 843 (IGKV1-16)
QQYNSYPYT

SEQ ID NO: 1686 - protein, 16 aa, Homo sapiens
  Heavy chain CDR3 for antibody 843 (IGHV1-18)
ARYFDWLLRDYYGMDV

SEQ ID NO: 1687 - protein, 9 aa, Homo sapiens
  Light chain CDR3 for antibody 844 (IGKV1-16)
QQYKSYPYT

SEQ ID NO: 1688 - protein, 18 aa, Homo sapiens
  Heavy chain CDR3 for antibody 844 (IGHV1-46)
ARDGDYVWGSYRSNWFDP

SEQ ID NO: 1689 - protein, 9 aa, Homo sapiens
  Light chain CDR3 for antibody 845 (IGKV1D-16)
QQYNSYPYT

SEQ ID NO: 1690 - protein, 16 aa, Homo sapiens
  Heavy chain CDR3 for antibody 845 (IGHV3-33)
ARDNFGSGSYYSHFHY

SEQ ID NO: 1691 - protein, 9 aa, Homo sapiens
  Light chain CDR3 for antibody 846 (IGKV6-21)
HQSSSLPHT

SEQ ID NO: 1692 - protein, 10 aa, Homo sapiens
  Heavy chain CDR3 for antibody 846 (IGHV3-33)
ARDHGYYFDY

SEQ ID NO: 1693 - protein, 9 aa, Homo sapiens
  Light chain CDR3 for antibody 847 (IGKV1-17)
LQHNSYPYT

SEQ ID NO: 1694 - protein, 21 aa, Homo sapiens
  Heavy chain CDR3 for antibody 847 (IGHV3-23)
AKDIDYYGSGSYPLYYYGMDV

SEQ ID NO: 1695 - protein, 9 aa, Homo sapiens
  Light chain CDR3 for antibody 848 (IGKV1-17)
LQHNSYPYT

SEQ ID NO: 1696 - protein, 10 aa, Homo sapiens
  Heavy chain CDR3 for antibody 848 (IGHV3-33)
ARDVVVYFDY

SEQ ID NO: 1697 - protein, 9 aa, Homo sapiens
  Light chain CDR3 for antibody 849 (IGKV1D-16)
QQYNSYPLT

SEQ ID NO: 1698 - protein, 12 aa, Homo sapiens
  Heavy chain CDR3 for antibody 849 (IGHV3-33)
ARDRAYRGSLDY

SEQ ID NO: 1699 - protein, 9 aa, Homo sapiens
  Light chain CDR3 for antibody 850 (IGKV1-6)
LHDYNYPYT

SEQ ID NO: 1700 - protein, 14 aa, Homo sapiens
  Heavy chain CDR3 for antibody 850 (IGHV4-39)
ARQGDILTGYSFDN

SEQ ID NO: 1701 - protein, 9 aa, Homo sapiens
  Light chain CDR3 for antibody 851 (IGKV6-21)
HQSSSLPYT

SEQ ID NO: 1702 - protein, 18 aa, Homo sapiens
  Heavy chain CDR3 for antibody 851 (IGHV3-33)
ARREGIVGATTYYYGMDV

SEQ ID NO: 1703 - protein, 9 aa, Homo sapiens
  Light chain CDR3 for antibody 852 (IGKV1-6)
LQAYNYPFT

SEQ ID NO: 1704 - protein, 17 aa, Homo sapiens
  Heavy chain CDR3 for antibody 852 (IGHV3-23)
AKERNWNDGYYYYGMDV

SEQ ID NO: 1705 - protein, 9 aa, Homo sapiens
  Light chain CDR3 for antibody 853 (IGKV1-39)
QQSYSTPLT

SEQ ID NO: 1706 - protein, 15 aa, Homo sapiens
  Heavy chain CDR3 for antibody 853 (IGHV3-30)
ARGAMVRGVDYGMDV

SEQ ID NO: 1707 - protein, 9 aa, Homo sapiens
  Light chain CDR3 for antibody 854 (IGKV6-21)
HQSSSLPHT

SEQ ID NO: 1708 - protein, 18 aa, Homo sapiens
  Heavy chain CDR3 for antibody 854 (IGHV4-39)
VKYITMVRGDIITGPFAY

SEQ ID NO: 1709 - protein, 9 aa, Homo sapiens
  Light chain CDR3 for antibody 855 (IGKV3D-7)
QQDYNLPLT

SEQ ID NO: 1710 - protein, 17 aa, Homo sapiens
  Heavy chain CDR3 for antibody 855 (IGHV3-23)
ANGGFGESHYNYYGMDV

SEQ ID NO: 1711 - protein, 9 aa, Homo sapiens
  Light chain CDR3 for antibody 856 (IGKV1-17)
LQHNSYPYT

SEQ ID NO: 1712 - protein, 12 aa, Homo sapiens
  Heavy chain CDR3 for antibody 856 (IGHV1-46)
ARALTVGASFDY

SEQ ID NO: 1713 - protein, 9 aa, Homo sapiens
  Light chain CDR3 for antibody 857 (IGKV1D-16)
QQYNSYPLT

SEQ ID NO: 1714 - protein, 17 aa, Homo sapiens
  Heavy chain CDR3 for antibody 857 (IGHV3-33)
ARESLKLGIYYYYGMDV

SEQ ID NO: 1715 - protein, 9 aa, Homo sapiens
  Light chain CDR3 for antibody 858 (IGKV5-2)
LQHDNFPYT

SEQ ID NO: 1716 - protein, 13 aa, Homo sapiens
  Heavy chain CDR3 for antibody 858 (IGHV3-33)
ARDQRYSSGWYDY

SEQ ID NO: 1717 - protein, 9 aa, Homo sapiens
  Light chain CDR3 for antibody 859 (IGKV3D-20)
QQFGSLPLT

SEQ ID NO: 1718 - protein, 19 aa, Homo sapiens
  Heavy chain CDR3 for antibody 859 (IGHV4-39)
ARQGDVLRYFDWLLGAFDI

SEQ ID NO: 1719 - protein, 9 aa, Homo sapiens
  Light chain CDR3 for antibody 860 (IGKV1D-13)
QQFNNYLFT

SEQ ID NO: 1720 - protein, 18 aa, Homo sapiens
  Heavy chain CDR3 for antibody 860 (IGHV3-11)
ARDGYYGSGSFYYYGMDV

SEQ ID NO: 1721 - protein, 9 aa, Homo sapiens
  Light chain CDR3 for antibody 861 (IGKV1-6)
LQDYNYPYT

SEQ ID NO: 1722 - protein, 18 aa, Homo sapiens
  Heavy chain CDR3 for antibody 861 (IGHV1-46)
ARDLTGRTENYYYYGMDV

SEQ ID NO: 1723 - protein, 9 aa, Homo sapiens
  Light chain CDR3 for antibody 862 (IGKV3D-7)
QQDYNLPYT

SEQ ID NO: 1724 - protein, 16 aa, Homo sapiens
  Heavy chain CDR3 for antibody 862 (IGHV1-8)
ARGHYYGSGSYYNFDY

SEQ ID NO: 1725 - protein, 8 aa, Homo sapiens
  Light chain CDR3 for antibody 863 (IGKV3-11)
QQRGNWPS

SEQ ID NO: 1726 - protein, 14 aa, Homo sapiens
  Heavy chain CDR3 for antibody 863 (IGHV3-15)
SIYFYGSGRDYFDY

SEQ ID NO: 1727 - protein, 9 aa, Homo sapiens
  Light chain CDR3 for antibody 864 (IGKV3-20)
QQFGSSPYT

SEQ ID NO: 1728 - protein, 16 aa, Homo sapiens
  Heavy chain CDR3 for antibody 864 (IGHV3-33)
ARGGLTGGGDYDAFDI

SEQ ID NO: 1729 - protein, 9 aa, Homo sapiens
  Light chain CDR3 for antibody 865 (IGKV1-17)
LQHNSYPYT

SEQ ID NO: 1730 - protein, 14 aa, Homo sapiens
  Heavy chain CDR3 for antibody 865 (IGHV3-33)
ARTTAAAGPRDFQH

SEQ ID NO: 1731 - protein, 9 aa, Homo sapiens
  Light chain CDR3 for antibody 866 (IGKV3-20)
QQYGSSPYT

SEQ ID NO: 1732 - protein, 12 aa, Homo sapiens
  Heavy chain CDR3 for antibody 866 (IGHV3-33)
ARDLVGATPFDY

SEQ ID NO: 1733 - protein, 9 aa, Homo sapiens
  Light chain CDR3 for antibody 867 (IGKV1-6)
LQDYNYPWT

SEQ ID NO: 1734 - protein, 15 aa, Homo sapiens
  Heavy chain CDR3 for antibody 867 (IGHV3-23)
AKDRGWYDYYYGMDV

SEQ ID NO: 1735 - protein, 9 aa, Homo sapiens
  Light chain CDR3 for antibody 868 (IGKV1-9)
QQLNSYPYT

SEQ ID NO: 1736 - protein, 16 aa, Homo sapiens
  Heavy chain CDR3 for antibody 868 (IGHV4-59)
ARQLLWFGELKGVFDY

SEQ ID NO: 1737 - protein, 9 aa, Homo sapiens
  Light chain CDR3 for antibody 869 (IGKV1D-13)
QQFNNYPYT

SEQ ID NO: 1738 - protein, 18 aa, Homo sapiens
  Heavy chain CDR3 for antibody 869 (IGHV3-23)
AKERGYYGSGSYSNWFDP

SEQ ID NO: 1739 - protein, 9 aa, Homo sapiens
  Light chain CDR3 for antibody 870 (IGKV5-2)
LQHDNFPWT

SEQ ID NO: 1740 - protein, 17 aa, Homo sapiens
  Heavy chain CDR3 for antibody 870 (IGHV4-34)
AGLRFFDWLFDYYGMDV

SEQ ID NO: 1741 - protein, 9 aa, Homo sapiens
  Light chain CDR3 for antibody 871 (IGKV5-2)
LQHDNFPYT

SEQ ID NO: 1742 - protein, 8 aa, Homo sapiens
  Heavy chain CDR3 for antibody 871 (IGHV3-23)
AKETGNNY

SEQ ID NO: 1743 - protein, 9 aa, Homo sapiens
  Light chain CDR3 for antibody 872 (IGKV2D-28)
MQALQTPWT

SEQ ID NO: 1744 - protein, 19 aa, Homo sapiens
  Heavy chain CDR3 for antibody 872 (IGHV3-20)
ARDSAVAGRYYYYYYGMDV

SEQ ID NO: 1745 - protein, 9 aa, Homo sapiens
  Light chain CDR3 for antibody 873 (IGKV1-17)
LQHNSYPYT

SEQ ID NO: 1746 - protein, 13 aa, Homo sapiens
  Heavy chain CDR3 for antibody 873 (IGHV3-33)
ARRYRSGWYPFDY

SEQ ID NO: 1747 - protein, 8 aa, Homo sapiens
  Light chain CDR3 for antibody 874 (IGKV6-21)
HQSGSLPT

SEQ ID NO: 1748 - protein, 18 aa, Homo sapiens
  Heavy chain CDR3 for antibody 874 (IGHV3-64)
ARDEYYYGSGSYYNYFDW

SEQ ID NO: 1749 - protein, 9 aa, Homo sapiens
  Light chain CDR3 for antibody 875 (IGKV1-16)
QQYNSYPYT

SEQ ID NO: 1750 - protein, 16 aa, Homo sapiens
  Heavy chain CDR3 for antibody 875 (IGHV1-24)
ATEDSSSTYYYYGLDV

SEQ ID NO: 1751 - protein, 9 aa, Homo sapiens
  Light chain CDR3 for antibody 876 (IGKV3-20)
QQYGSSPYT

SEQ ID NO: 1752 - protein, 12 aa, Homo sapiens
  Heavy chain CDR3 for antibody 876 (IGHV4-61)
ARVYSSGWLFDY

SEQ ID NO: 1753 - protein, 9 aa, Homo sapiens
  Light chain CDR3 for antibody 877 (IGKV5-2)
LQHDNFPYT

SEQ ID NO: 1754 - protein, 9 aa, Homo sapiens
  Heavy chain CDR3 for antibody 877 (IGHV3-13)
ARDRWYFDL

SEQ ID NO: 1755 - protein, 9 aa, Homo sapiens
  Light chain CDR3 for antibody 878 (IGKV1D-16)
QQYNSYPLT

SEQ ID NO: 1756 - protein, 16 aa, Homo sapiens
  Heavy chain CDR3 for antibody 878 (IGHV3-33)
ARAVYYGSGSSLIMDV

SEQ ID NO: 1757 - protein, 9 aa, Homo sapiens
  Light chain CDR3 for antibody 879 (IGKV1-27)
QKYNSAPYT

SEQ ID NO: 1758 - protein, 15 aa, Homo sapiens
  Heavy chain CDR3 for antibody 879 (IGHV3-30)
ARGAMVRGVDYGMDV

SEQ ID NO: 1759 - protein, 9 aa, Homo sapiens
  Light chain CDR3 for antibody 880 (IGKV6-21)
QQSSNLPHT

SEQ ID NO: 1760 - protein, 14 aa, Homo sapiens
  Heavy chain CDR3 for antibody 880 (IGHV3-33)
AREEDYYYHYDMDV

SEQ ID NO: 1761 - protein, 9 aa, Homo sapiens
  Light chain CDR3 for antibody 881 (IGKV1-6)
LQDYNYPYT

SEQ ID NO: 1762 - protein, 16 aa, Homo sapiens
  Heavy chain CDR3 for antibody 881 (IGHV4-59)
AREGYNWNDGVNWFDP

SEQ ID NO: 1763 - protein, 9 aa, Homo sapiens
  Light chain CDR3 for antibody 882 (IGKV1-17)
LQHNSYPYT

SEQ ID NO: 1764 - protein, 14 aa, Homo sapiens
  Heavy chain CDR3 for antibody 882 (IGHV3-23)
ANWAYDILTGYLDY

SEQ ID NO: 1765 - protein, 9 aa, Homo sapiens
  Light chain CDR3 for antibody 883 (IGKV1-9)
QQVNSYPNT

SEQ ID NO: 1766 - protein, 17 aa, Homo sapiens
  Heavy chain CDR3 for antibody 883 (IGHV1-24)
TTVVLYYDILPGYSFDY

SEQ ID NO: 1767 - protein, 9 aa, Homo sapiens
  Light chain CDR3 for antibody 884 (IGKV3-20)
QQYGSSPYT

SEQ ID NO: 1768 - protein, 14 aa, Homo sapiens
  Heavy chain CDR3 for antibody 884 (IGHV3-33)
ARAISGSSYWYFDL

SEQ ID NO: 1769 - protein, 9 aa, Homo sapiens
  Light chain CDR3 for antibody 885 (IGKV1-17)
LQHNSYPYT

SEQ ID NO: 1770 - protein, 13 aa, Homo sapiens
  Heavy chain CDR3 for antibody 885 (IGHV3-33)
ARTDYYFYYGLDV

SEQ ID NO: 1771 - protein, 9 aa, Homo sapiens
  Light chain CDR3 for antibody 886 (IGKV1D-16)
QQYNSYPYT

SEQ ID NO: 1772 - protein, 11 aa, Homo sapiens
  Heavy chain CDR3 for antibody 886 (IGHV3-33)
ARGSGSYAFDS

SEQ ID NO: 1773 - protein, 9 aa, Homo sapiens
  Light chain CDR3 for antibody 887 (IGKV1D-16)
QQYNSYPLT

SEQ ID NO: 1774 - protein, 18 aa, Homo sapiens
  Heavy chain CDR3 for antibody 887 (IGHV3-33)
ARDRDRYGSGTYPDAIDI

SEQ ID NO: 1775 - protein, 9 aa, Homo sapiens
  Light chain CDR3 for antibody 888 (IGKV1-6)
LQDYNYPWT

SEQ ID NO: 1776 - protein, 16 aa, Homo sapiens
  Heavy chain CDR3 for antibody 888 (IGHV3-23)
ARDLGIAAAGTGWFDP

SEQ ID NO: 1777 - protein, 9 aa, Homo sapiens
  Light chain CDR3 for antibody 889 (IGKV6-21)
HQSSSLPYT

SEQ ID NO: 1778 - protein, 13 aa, Homo sapiens
  Heavy chain CDR3 for antibody 889 (IGHV3-53)
ARSGSYWGYYFDY

SEQ ID NO: 1779 - protein, 9 aa, Homo sapiens
  Light chain CDR3 for antibody 890 (IGKV6-21)
HQSRSLPFT

SEQ ID NO: 1780 - protein, 13 aa, Homo sapiens
  Heavy chain CDR3 for antibody 890 (IGHV3-53)
ARDRDSSGSYFDY

SEQ ID NO: 1781 - protein, 9 aa, Homo sapiens
  Light chain CDR3 for antibody 891 (IGKV1D-16)
QQYNSYPYT

SEQ ID NO: 1782 - protein, 18 aa, Homo sapiens
  Heavy chain CDR3 for antibody 891 (IGHV3-23)
ARYHLYFGSGFGSDGMDV

SEQ ID NO: 1783 - protein, 8 aa, Homo sapiens
  Light chain CDR3 for antibody 892 (IGKV3D-7)
QQDYNLVT

SEQ ID NO: 1784 - protein, 13 aa, Homo sapiens
  Heavy chain CDR3 for antibody 892 (IGHV4-59)
ARDAGYSSSWFDY

SEQ ID NO: 1785 - protein, 9 aa, Homo sapiens
  Light chain CDR3 for antibody 893 (IGKV1-9)
QQLNSYPWT

SEQ ID NO: 1786 - protein, 18 aa, Homo sapiens
  Heavy chain CDR3 for antibody 893 (IGHV3-33)
AGGGSGSYSSYYYYGMDV

SEQ ID NO: 1787 - protein, 9 aa, Homo sapiens
  Light chain CDR3 for antibody 894 (IGKV1D-16)
QQYNSYPYT

SEQ ID NO: 1788 - protein, 14 aa, Homo sapiens
  Heavy chain CDR3 for antibody 894 (IGHV3-33)
ARRGYSGYDWYFDY

SEQ ID NO: 1789 - protein, 9 aa, Homo sapiens
  Light chain CDR3 for antibody 895 (IGKV6-21)
HQSSSLPYT

SEQ ID NO: 1790 - protein, 12 aa, Homo sapiens
  Heavy chain CDR3 for antibody 895 (IGHV3-33)
ARESGGSYSFDY

SEQ ID NO: 1791 - protein, 9 aa, Homo sapiens
  Light chain CDR3 for antibody 896 (IGKV3-20)
QQYGSSPYT

SEQ ID NO: 1792 - protein, 15 aa, Homo sapiens
  Heavy chain CDR3 for antibody 896 (IGHV3-33)
ARDRGWKAPGYGMDV

SEQ ID NO: 1793 - protein, 9 aa, Homo sapiens
  Light chain CDR3 for antibody 897 (IGKV6-21)
HQSSSLPYT

SEQ ID NO: 1794 - protein, 13 aa, Homo sapiens
  Heavy chain CDR3 for antibody 897 (IGHV3-33)
ARKAYGDYFYFDY

SEQ ID NO: 1795 - protein, 9 aa, Homo sapiens
  Light chain CDR3 for antibody 898 (IGKV1-6)
LQDYNYPRT

SEQ ID NO: 1796 - protein, 15 aa, Homo sapiens
  Heavy chain CDR3 for antibody 898 (IGHV3-33)
AKGGTMVRGVIAFDY

SEQ ID NO: 1797 - protein, 9 aa, Homo sapiens
  Light chain CDR3 for antibody 899 (IGKV5-2)
LQHDNFPWT

SEQ ID NO: 1798 - protein, 9 aa, Homo sapiens
  Heavy chain CDR3 for antibody 899 (IGHV4-59)
AGGSWDFDY

SEQ ID NO: 1799 - protein, 9 aa, Homo sapiens
  Light chain CDR3 for antibody 900 (IGKV1D-16)
QQYNSYPYT

SEQ ID NO: 1800 - protein, 20 aa, Homo sapiens
  Heavy chain CDR3 for antibody 900 (IGHV3-23)
AKGMGGLRYFDWPHYYGMDV

SEQ ID NO: 1801 - protein, 9 aa, Homo sapiens
  Light chain CDR3 for antibody 901 (IGKV6-21)
HQSSSLPYT

SEQ ID NO: 1802 - protein, 9 aa, Homo sapiens
  Heavy chain CDR3 for antibody 901 (IGHV3-13)
ARDRWYFDL

SEQ ID NO: 1803 - protein, 9 aa, Homo sapiens
  Light chain CDR3 for antibody 902 (IGKV1D-16)
QQYNSYPYT

SEQ ID NO: 1804 - protein, 17 aa, Homo sapiens
  Heavy chain CDR3 for antibody 902 (IGHV3-33)
ARDLIGPLSSSWYPFDY

SEQ ID NO: 1805 - protein, 9 aa, Homo sapiens
  Light chain CDR3 for antibody 903 (IGKV1-6)
LQDYNYPYT

SEQ ID NO: 1806 - protein, 11 aa, Homo sapiens
  Heavy chain CDR3 for antibody 903 (IGHV3-13)
AREAIIGPFDY

SEQ ID NO: 1807 - protein, 9 aa, Homo sapiens
  Light chain CDR3 for antibody 904 (IGKV1-17)
LQHNSYPYT

SEQ ID NO: 1808 - protein, 10 aa, Homo sapiens
  Heavy chain CDR3 for antibody 904 (IGHV3-23)
AKDHYGDYPY

SEQ ID NO: 1809 - protein, 9 aa, Homo sapiens
  Light chain CDR3 for antibody 905 (IGKV3D-20)
QQYGSSPYT

SEQ ID NO: 1810 - protein, 18 aa, Homo sapiens
  Heavy chain CDR3 for antibody 905 (IGHV1-18)
ARDRYSSGWSDYYFGMDV

SEQ ID NO: 1811 - protein, 9 aa, Homo sapiens
  Light chain CDR3 for antibody 906 (IGKV1-6)
LQDYNYPYT

SEQ ID NO: 1812 - protein, 16 aa, Homo sapiens
  Heavy chain CDR3 for antibody 906 (IGHV1-24)
ATEDSSSTYYYYGLDV

SEQ ID NO: 1813 - protein, 9 aa, Homo sapiens
  Light chain CDR3 for antibody 907 (IGKV6-21)
HQSSSLPQT

SEQ ID NO: 1814 - protein, 13 aa, Homo sapiens
  Heavy chain CDR3 for antibody 907 (IGHV3-33)
ARCIVAAMGGFDY

SEQ ID NO: 1815 - protein, 9 aa, Homo sapiens
  Light chain CDR3 for antibody 908 (IGKV1D-16)
QQYNSYPYT

SEQ ID NO: 1816 - protein, 10 aa, Homo sapiens
  Heavy chain CDR3 for antibody 908 (IGHV3-74)
ARENWGGFDY

SEQ ID NO: 1817 - protein, 9 aa, Homo sapiens
  Light chain CDR3 for antibody 909 (IGKV6-21)
HQSSSLPYT

SEQ ID NO: 1818 - protein, 17 aa, Homo sapiens
  Heavy chain CDR3 for antibody 909 (IGHV1-18)
ARDEGYDILTGYPHFDY

SEQ ID NO: 1819 - protein, 9 aa, Homo sapiens
  Light chain CDR3 for antibody 910 (IGKV1-6)
LQGYNYPRS

SEQ ID NO: 1820 - protein, 12 aa, Homo sapiens
  Heavy chain CDR3 for antibody 910 (IGHV3-33)
ARKGYDMHAFDI

SEQ ID NO: 1821 - protein, 9 aa, Homo sapiens
  Light chain CDR3 for antibody 911 (IGKV5-2)
LQHDNFPWT

SEQ ID NO: 1822 - protein, 15 aa, Homo sapiens
  Heavy chain CDR3 for antibody 911 (IGHV1-18)
ARGYCSSTSCYYFDY

SEQ ID NO: 1823 - protein, 9 aa, Homo sapiens
  Light chain CDR3 for antibody 912 (IGKV5-2)
LQHDNFPYT

SEQ ID NO: 1824 - protein, 18 aa, Homo sapiens
  Heavy chain CDR3 for antibody 912 (IGHV3-33)
ARREGIVGATTYYYGMDV

SEQ ID NO: 1825 - protein, 11 aa, Homo sapiens
  Light chain CDR3 for antibody 913 (IGKV3-11)
QQRSNWPPTWT

SEQ ID NO: 1826 - protein, 13 aa, Homo sapiens
  Heavy chain CDR3 for antibody 913 (IGHV4-59)
ARDAGYSSSWFDY

SEQ ID NO: 1827 - protein, 9 aa, Homo sapiens
  Light chain CDR3 for antibody 914 (IGKV1D-13)
QQFNNYPHT

SEQ ID NO: 1828 - protein, 18 aa, Homo sapiens
  Heavy chain CDR3 for antibody 914 (IGHV4-59)
AREGDYVWGSYRPNWFDP

SEQ ID NO: 1829 - protein, 9 aa, Homo sapiens
  Light chain CDR3 for antibody 915 (IGKV6-21)
HQSSSLPNT

SEQ ID NO: 1830 - protein, 15 aa, Homo sapiens
  Heavy chain CDR3 for antibody 915 (IGHV3-33)
ARDRGSSGYDRYFDY

SEQ ID NO: 1831 - protein, 9 aa, Homo sapiens
  Light chain CDR3 for antibody 916 (IGKV5-2)
LQHDNFPYT

SEQ ID NO: 1832 - protein, 20 aa, Homo sapiens
  Heavy chain CDR3 for antibody 916 (IGHV3-20)
ARDLCSSTSCYGYYYYGMDV

SEQ ID NO: 1833 - protein, 9 aa, Homo sapiens
  Light chain CDR3 for antibody 917 (IGKV6-21)
HQSSSLPHT

SEQ ID NO: 1834 - protein, 10 aa, Homo sapiens
  Heavy chain CDR3 for antibody 917 (IGHV3-33)
ARKGMNAFDI

SEQ ID NO: 1835 - protein, 9 aa, Homo sapiens
  Light chain CDR3 for antibody 918 (IGKV3-20)
QQYGSSPYT

SEQ ID NO: 1836 - protein, 11 aa, Homo sapiens
  Heavy chain CDR3 for antibody 918 (IGHV3-33)
ARDKSSGWSDY

SEQ ID NO: 1837 - protein, 9 aa, Homo sapiens
  Light chain CDR3 for antibody 919 (IGKV5-2)
LQHDNFPWT

SEQ ID NO: 1838 - protein, 13 aa, Homo sapiens
  Heavy chain CDR3 for antibody 919 (IGHV4-28)
ARKGATGYYGMDV

SEQ ID NO: 1839 - protein, 9 aa, Homo sapiens
  Light chain CDR3 for antibody 920 (IGKV5-2)
LQHDNFPYT

SEQ ID NO: 1840 - protein, 12 aa, Homo sapiens
  Heavy chain CDR3 for antibody 920 (IGHV3-33)
TRGYSSKSYFDY

SEQ ID NO: 1841 - protein, 9 aa, Homo sapiens
  Light chain CDR3 for antibody 921 (IGKV6-21)
HQSSSLPYT

SEQ ID NO: 1842 - protein, 14 aa, Homo sapiens
  Heavy chain CDR3 for antibody 921 (IGHV3-33)
AREGYSSNWYDFDY

SEQ ID NO: 1843 - protein, 9 aa, Homo sapiens
  Light chain CDR3 for antibody 922 (IGKV1-6)
LQDYNYPYT

SEQ ID NO: 1844 - protein, 20 aa, Homo sapiens
  Heavy chain CDR3 for antibody 922 (IGHV3-33)
ARDPAQLERRYYYFYYGMDV

SEQ ID NO: 1845 - protein, 9 aa, Homo sapiens
  Light chain CDR3 for antibody 923 (IGKV3D-7)
QQDYNLPLT

SEQ ID NO: 1846 - protein, 14 aa, Homo sapiens
  Heavy chain CDR3 for antibody 923 (IGHV1-18)
ARERGVRGVMYFDY

SEQ ID NO: 1847 - protein, 9 aa, Homo sapiens
  Light chain CDR3 for antibody 924 (IGKV1-17)
LQHNSYPYT

SEQ ID NO: 1848 - protein, 13 aa, Homo sapiens
  Heavy chain CDR3 for antibody 924 (IGHV3-23)
ASTGDSYYYGMDV

SEQ ID NO: 1849 - protein, 9 aa, Homo sapiens
  Light chain CDR3 for antibody 925 (IGKV1-9)
QQLNSYPWT

SEQ ID NO: 1850 - protein, 12 aa, Homo sapiens
  Heavy chain CDR3 for antibody 925 (IGHV3-33)
ARKAYALYVLDV

SEQ ID NO: 1851 - protein, 9 aa, Homo sapiens
  Light chain CDR3 for antibody 926 (IGKV1D-16)
QQYNSYPYT

SEQ ID NO: 1852 - protein, 18 aa, Homo sapiens
  Heavy chain CDR3 for antibody 926 (IGHV3-30)
ARDRHHDILTGYSDAFEI

SEQ ID NO: 1853 - protein, 9 aa, Homo sapiens
  Light chain CDR3 for antibody 927 (IGKV1-16)
QQYNSYPYT

SEQ ID NO: 1854 - protein, 17 aa, Homo sapiens
  Heavy chain CDR3 for antibody 927 (IGHV4-39)
ARQGWYYGSGSSLLFDY

SEQ ID NO: 1855 - protein, 9 aa, Homo sapiens
  Light chain CDR3 for antibody 928 (IGKV6-21)
HQSSSLPWT

SEQ ID NO: 1856 - protein, 13 aa, Homo sapiens
  Heavy chain CDR3 for antibody 928 (IGHV3-33)
ARDYGDYLNWFDP

SEQ ID NO: 1857 - protein, 9 aa, Homo sapiens
  Light chain CDR3 for antibody 929 (IGKV1-17)
LQHNSYPYT

SEQ ID NO: 1858 - protein, 13 aa, Homo sapiens
  Heavy chain CDR3 for antibody 929 (IGHV3-33)
AREYCSGGSCYDY

SEQ ID NO: 1859 - protein, 9 aa, Homo sapiens
  Light chain CDR3 for antibody 930 (IGKV1-6)
LQDYNYPYT

SEQ ID NO: 1860 - protein, 20 aa, Homo sapiens
  Heavy chain CDR3 for antibody 930 (IGHV3-23)
AKGMGGLRYFDWPHYYGMDV

SEQ ID NO: 1861 - protein, 9 aa, Homo sapiens
  Light chain CDR3 for antibody 931 (IGKV3-11)
QHRGNWPLT

SEQ ID NO: 1862 - protein, 17 aa, Homo sapiens
  Heavy chain CDR3 for antibody 931 (IGHV4-34)
ARDGSGSYTSYYYGMDV

SEQ ID NO: 1863 - protein, 9 aa, Homo sapiens
  Light chain CDR3 for antibody 932 (IGKV6-21)
HQSISLPHT

SEQ ID NO: 1864 - protein, 14 aa, Homo sapiens
  Heavy chain CDR3 for antibody 932 (IGHV3-20)
ARDRGSSGHDAFDI

SEQ ID NO: 1865 - protein, 9 aa, Homo sapiens
  Light chain CDR3 for antibody 933 (IGKV1-17)
LQHNSYPYT

SEQ ID NO: 1866 - protein, 13 aa, Homo sapiens
  Heavy chain CDR3 for antibody 933 (IGHV3-33)
ARVDTMVRGVMAY

SEQ ID NO: 1867 - protein, 9 aa, Homo sapiens
  Light chain CDR3 for antibody 934 (IGKV6-21)
HQSSSLPYT

SEQ ID NO: 1868 - protein, 18 aa, Homo sapiens
  Heavy chain CDR3 for antibody 934 (IGHV3-23)
AKDRITGTTYGYYSGLDV

SEQ ID NO: 1869 - protein, 9 aa, Homo sapiens
  Light chain CDR3 for antibody 935 (IGKV5-2)
LQHDNFPYT

SEQ ID NO: 1870 - protein, 18 aa, Homo sapiens
  Heavy chain CDR3 for antibody 935 (IGHV3-23)
AKEGNYYGSGSYWGYFDP

SEQ ID NO: 1871 - protein, 9 aa, Homo sapiens
  Light chain CDR3 for antibody 936 (IGKV1-17)
LQHNSYPYT

SEQ ID NO: 1872 - protein, 12 aa, Homo sapiens
  Heavy chain CDR3 for antibody 936 (IGHV3-33)
ARKGYDMHEFDI

SEQ ID NO: 1873 - protein, 9 aa, Homo sapiens
  Light chain CDR3 for antibody 937 (IGKV1-17)
LQHNSYPYT

SEQ ID NO: 1874 - protein, 16 aa, Homo sapiens
  Heavy chain CDR3 for antibody 937 (IGHV3-33)
ARGDDILTHQYYGVDV

SEQ ID NO: 1875 - protein, 9 aa, Homo sapiens
  Light chain CDR3 for antibody 938 (IGKV6-21)
HQSSSLPYT

SEQ ID NO: 1876 - protein, 18 aa, Homo sapiens
  Heavy chain CDR3 for antibody 938 (IGHV3-33)
ARGYYGSGNFYKDSGMDV

SEQ ID NO: 1877 - protein, 9 aa, Homo sapiens
  Light chain CDR3 for antibody 939 (IGKV5-2)
LQHDNFPYT

SEQ ID NO: 1878 - protein, 13 aa, Homo sapiens
  Heavy chain CDR3 for antibody 939 (IGHV3-23)
ARAFFMVRGVIDF

SEQ ID NO: 1879 - protein, 9 aa, Homo sapiens
  Light chain CDR3 for antibody 940 (IGKV1D-16)
QQYNSYPLT

SEQ ID NO: 1880 - protein, 18 aa, Homo sapiens
  Heavy chain CDR3 for antibody 940 (IGHV3-23)
AKDRITGTTYGYYSGLDV

SEQ ID NO: 1881 - protein, 9 aa, Homo sapiens
  Light chain CDR3 for antibody 941 (IGKV6-21)
HQSSSLPYT

SEQ ID NO: 1882 - protein, 12 aa, Homo sapiens
  Heavy chain CDR3 for antibody 941 (IGHV1-18)
ARILFYGDYFDY

SEQ ID NO: 1883 - protein, 9 aa, Homo sapiens
  Light chain CDR3 for antibody 942 (IGKV5-2)
LQHDNFPYT

SEQ ID NO: 1884 - protein, 15 aa, Homo sapiens
  Heavy chain CDR3 for antibody 942 (IGHV3-33)
ARRICSGGSCSLFDY

SEQ ID NO: 1885 - protein, 9 aa, Homo sapiens
  Light chain CDR3 for antibody 943 (IGKV6-21)
HQSSSLPQT

SEQ ID NO: 1886 - protein, 14 aa, Homo sapiens
  Heavy chain CDR3 for antibody 943 (IGHV3-33)
ARKPDYYGSGYFDY

SEQ ID NO: 1887 - protein, 9 aa, Homo sapiens
  Light chain CDR3 for antibody 944 (IGKV5-2)
LQHDNFPYT

SEQ ID NO: 1888 - protein, 9 aa, Homo sapiens
  Heavy chain CDR3 for antibody 944 (IGHV3-30)
ARDNWGFDY

SEQ ID NO: 1889 - protein, 9 aa, Homo sapiens
  Light chain CDR3 for antibody 945 (IGKV1D-16)
QQCNSYPRT

SEQ ID NO: 1890 - protein, 17 aa, Homo sapiens
  Heavy chain CDR3 for antibody 945 (IGHV3-64)
ARERYYGSGSYYNWFDP

SEQ ID NO: 1891 - protein, 9 aa, Homo sapiens
  Light chain CDR3 for antibody 946 (IGKV1-39)
QQSYSTPFT

SEQ ID NO: 1892 - protein, 16 aa, Homo sapiens
  Heavy chain CDR3 for antibody 946 (IGHV4-59)
ARGRYFEWLLGDVFDI

SEQ ID NO: 1893 - protein, 9 aa, Homo sapiens
  Light chain CDR3 for antibody 947 (IGKV3-20)
QQYGSSPYT

SEQ ID NO: 1894 - protein, 11 aa, Homo sapiens
  Heavy chain CDR3 for antibody 947 (IGHV3-74)
ARDRGNWGFDY

SEQ ID NO: 1895 - protein, 9 aa, Homo sapiens
  Light chain CDR3 for antibody 948 (IGKV1D-16)
QQYNSYPYT

SEQ ID NO: 1896 - protein, 13 aa, Homo sapiens
  Heavy chain CDR3 for antibody 948 (IGHV4-39)
APFRVMVRGVLDY

SEQ ID NO: 1897 - protein, 9 aa, Homo sapiens
  Light chain CDR3 for antibody 949 (IGKV1-16)
QQYNSYPYT

SEQ ID NO: 1898 - protein, 16 aa, Homo sapiens
  Heavy chain CDR3 for antibody 949 (IGHV1-8)
AREGTMVRGVTYAFDI

SEQ ID NO: 1899 - protein, 9 aa, Homo sapiens
  Light chain CDR3 for antibody 950 (IGKV5-2)
LQHDNFPWT

SEQ ID NO: 1900 - protein, 13 aa, Homo sapiens
  Heavy chain CDR3 for antibody 950 (IGHV4-39)
ARHPPSRDYGMDV

SEQ ID NO: 1901 - protein, 9 aa, Homo sapiens
  Light chain CDR3 for antibody 951 (IGKV6-21)
HQSSSLPYT

SEQ ID NO: 1902 - protein, 11 aa, Homo sapiens
  Heavy chain CDR3 for antibody 951 (IGHV3-33)
ARDRVLTPFDY

SEQ ID NO: 1903 - protein, 9 aa, Homo sapiens
  Light chain CDR3 for antibody 952 (IGKV6-21)
HQSSSLPHT

SEQ ID NO: 1904 - protein, 15 aa, Homo sapiens
  Heavy chain CDR3 for antibody 952 (IGHV3-33)
ARPPIAVAGPEYFQH

SEQ ID NO: 1905 - protein, 9 aa, Homo sapiens
  Light chain CDR3 for antibody 953 (IGKV1D-16)
QQYNSYPLT

SEQ ID NO: 1906 - protein, 8 aa, Homo sapiens
  Heavy chain CDR3 for antibody 953 (IGHV3-23)
AETFLFDY

SEQ ID NO: 1907 - protein, 9 aa, Homo sapiens
  Light chain CDR3 for antibody 954 (IGKV1D-16)
QQYNSYPLT

SEQ ID NO: 1908 - protein, 10 aa, Homo sapiens
  Heavy chain CDR3 for antibody 954 (IGHV3-23)
AKGDRWRFDP

SEQ ID NO: 1909 - protein, 9 aa, Homo sapiens
  Light chain CDR3 for antibody 955 (IGKV1-17)
LRHNCYPYT

SEQ ID NO: 1910 - protein, 11 aa, Homo sapiens
  Heavy chain CDR3 for antibody 955 (IGHV4-39)
ARLSGEGHFDS

SEQ ID NO: 1911 - protein, 9 aa, Homo sapiens
  Light chain CDR3 for antibody 956 (IGKV1-6)
LQDYNYPYT

SEQ ID NO: 1912 - protein, 17 aa, Homo sapiens
  Heavy chain CDR3 for antibody 956 (IGHV3-33)
ARGGAAAGPYLYYGLDV

SEQ ID NO: 1913 - protein, 9 aa, Homo sapiens
  Light chain CDR3 for antibody 957 (IGKV1-27)
QKYNSAPYT

SEQ ID NO: 1914 - protein, 13 aa, Homo sapiens
  Heavy chain CDR3 for antibody 957 (IGHV4-59)
ARDAGYSSSWFDY

SEQ ID NO: 1915 - protein, 9 aa, Homo sapiens
  Light chain CDR3 for antibody 958 (IGKV5-2)
LQHDNFPWT

SEQ ID NO: 1916 - protein, 13 aa, Homo sapiens
  Heavy chain CDR3 for antibody 958 (IGHV4-61)
ASRYSSGWYPFDY

SEQ ID NO: 1917 - protein, 9 aa, Homo sapiens
  Light chain CDR3 for antibody 959 (IGKV1-39)
QQSYSTPLT

SEQ ID NO: 1918 - protein, 14 aa, Homo sapiens
  Heavy chain CDR3 for antibody 959 (IGHV3-23)
AKSRIVGALYYFDY

SEQ ID NO: 1919 - protein, 9 aa, Homo sapiens
  Light chain CDR3 for antibody 960 (IGKV3-20)
QQYGSSPYT

SEQ ID NO: 1920 - protein, 15 aa, Homo sapiens
  Heavy chain CDR3 for antibody 960 (IGHV3-33)
ARDHLTGYYYYGMDV

SEQ ID NO: 1921 - protein, 9 aa, Homo sapiens
  Light chain CDR3 for antibody 961 (IGKV1-27)
QKYNSAPYT

SEQ ID NO: 1922 - protein, 10 aa, Homo sapiens
  Heavy chain CDR3 for antibody 961 (IGHV3-33)
ARDGLRYFDW

SEQ ID NO: 1923 - protein, 9 aa, Homo sapiens
  Light chain CDR3 for antibody 962 (IGKV1-17)
LQHNSYPYT

SEQ ID NO: 1924 - protein, 11 aa, Homo sapiens
  Heavy chain CDR3 for antibody 962 (IGHV3-33)
ARAGIAALFDY

SEQ ID NO: 1925 - protein, 9 aa, Homo sapiens
  Light chain CDR3 for antibody 963 (IGKV5-2)
LQHDNFPWT

SEQ ID NO: 1926 - protein, 26 aa, Homo sapiens
  Heavy chain CDR3 for antibody 963 (IGHV4-39)
ARQGLLWFGDLKAYDSSGYYYGYFHH

SEQ ID NO: 1927 - protein, 9 aa, Homo sapiens
  Light chain CDR3 for antibody 964 (IGKV6-21)
HQSSSLPHT

SEQ ID NO: 1928 - protein, 17 aa, Homo sapiens
  Heavy chain CDR3 for antibody 964 (IGHV3-33)
ARDPWIYSGYGGGWFDP

SEQ ID NO: 1929 - protein, 9 aa, Homo sapiens
  Light chain CDR3 for antibody 965 (IGKV6-21)
HQSSSLPYT

SEQ ID NO: 1930 - protein, 12 aa, Homo sapiens
  Heavy chain CDR3 for antibody 965 (IGHV3-11)
ARVLLWFGETDY

SEQ ID NO: 1931 - protein, 9 aa, Homo sapiens
  Light chain CDR3 for antibody 966 (IGKV1-17)
LQHNSYPYT

SEQ ID NO: 1932 - protein, 13 aa, Homo sapiens
  Heavy chain CDR3 for antibody 966 (IGHV3-33)
AKEDGDYHHYFDY

SEQ ID NO: 1933 - protein, 9 aa, Homo sapiens
  Light chain CDR3 for antibody 967 (IGKV5-2)
LQHDNFPYT

SEQ ID NO: 1934 - protein, 10 aa, Homo sapiens
  Heavy chain CDR3 for antibody 967 (IGHV3-23)
AKGDRWRFDP

SEQ ID NO: 1935 - protein, 9 aa, Homo sapiens
  Light chain CDR3 for antibody 968 (IGKV6-21)
HQSSSLPYT

SEQ ID NO: 1936 - protein, 14 aa, Homo sapiens
  Heavy chain CDR3 for antibody 968 (IGHV3-33)
ARDRIAAASSDFDC

SEQ ID NO: 1937 - protein, 9 aa, Homo sapiens
  Light chain CDR3 for antibody 969 (IGKV6-21)
HQSSSLPYT

SEQ ID NO: 1938 - protein, 15 aa, Homo sapiens
  Heavy chain CDR3 for antibody 969 (IGHV3-33)
ARDTGYSSSWNWFDP

SEQ ID NO: 1939 - protein, 9 aa, Homo sapiens
  Light chain CDR3 for antibody 970 (IGKV3-15)
QQYNNWPLT

SEQ ID NO: 1940 - protein, 13 aa, Homo sapiens
  Heavy chain CDR3 for antibody 970 (IGHV4-34)
ASNFYYYYYGMDV

SEQ ID NO: 1941 - protein, 9 aa, Homo sapiens
  Light chain CDR3 for antibody 971 (IGKV5-2)
LQHDNFPYT

SEQ ID NO: 1942 - protein, 15 aa, Homo sapiens
  Heavy chain CDR3 for antibody 971 (IGHV3-33)
ARDTGYSSSWNWFDP

SEQ ID NO: 1943 - protein, 9 aa, Homo sapiens
  Light chain CDR3 for antibody 972 (IGKV1D-16)
QQYNSYPYT

SEQ ID NO: 1944 - protein, 12 aa, Homo sapiens
  Heavy chain CDR3 for antibody 972 (IGHV3-13)
ARDRGYSGYFDY

SEQ ID NO: 1945 - protein, 9 aa, Homo sapiens
  Light chain CDR3 for antibody 973 (IGKV6-21)
HQSSSLPYT

SEQ ID NO: 1946 - protein, 12 aa, Homo sapiens
  Heavy chain CDR3 for antibody 973 (IGHV3-33)
ARDLVGATPFDY

SEQ ID NO: 1947 - protein, 9 aa, Homo sapiens
  Light chain CDR3 for antibody 974 (IGKV1-9)
QQLNSYPLT

SEQ ID NO: 1948 - protein, 13 aa, Homo sapiens
  Heavy chain CDR3 for antibody 974 (IGHV4-61)
ASRYSSGWYPFDY

SEQ ID NO: 1949 - protein, 9 aa, Homo sapiens
  Light chain CDR3 for antibody 975 (IGKV5-2)
LQHDNFPYT

SEQ ID NO: 1950 - protein, 14 aa, Homo sapiens
  Heavy chain CDR3 for antibody 975 (IGHV3-33)
AREGYSSNWYDFDY

SEQ ID NO: 1951 - protein, 9 aa, Homo sapiens
  Light chain CDR3 for antibody 976 (IGKV1D-16)
QQYNSYPYT

SEQ ID NO: 1952 - protein, 11 aa, Homo sapiens
  Heavy chain CDR3 for antibody 976 (IGHV3-33)
ARDRATATVDY

SEQ ID NO: 1953 - protein, 9 aa, Homo sapiens
  Light chain CDR3 for antibody 977 (IGKV5-2)
LQHDNFPYT

SEQ ID NO: 1954 - protein, 13 aa, Homo sapiens
  Heavy chain CDR3 for antibody 977 (IGHV3-11)
ARDEGYRGYVLDT

SEQ ID NO: 1955 - protein, 9 aa, Homo sapiens
  Light chain CDR3 for antibody 978 (IGKV2-30)
MQGTHWPWT

SEQ ID NO: 1956 - protein, 11 aa, Homo sapiens
  Heavy chain CDR3 for antibody 978 (IGHV3-33)
ATERDMVRGDY

SEQ ID NO: 1957 - protein, 9 aa, Homo sapiens
  Light chain CDR3 for antibody 979 (IGKV1-39)
QQSYSTPLT

SEQ ID NO: 1958 - protein, 13 aa, Homo sapiens
  Heavy chain CDR3 for antibody 979 (IGHV3-23)
ASPFNWNDGFFDY

SEQ ID NO: 1959 - protein, 8 aa, Homo sapiens
  Light chain CDR3 for antibody 980 (IGKV1-39)
QQSYTTPT

SEQ ID NO: 1960 - protein, 17 aa, Homo sapiens
  Heavy chain CDR3 for antibody 980 (IGHV4-61)
ARNTMVGTWQRQGNLDH

SEQ ID NO: 1961 - protein, 9 aa, Homo sapiens
  Light chain CDR3 for antibody 981 (IGKV3-20)
QQYGSSPYT

SEQ ID NO: 1962 - protein, 20 aa, Homo sapiens
  Heavy chain CDR3 for antibody 981 (IGHV3-20)
ARDLCSSTSCYGYYYYGMDV

SEQ ID NO: 1963 - protein, 9 aa, Homo sapiens
  Light chain CDR3 for antibody 982 (IGKV1D-16)
QQYDSYPYT

SEQ ID NO: 1964 - protein, 14 aa, Homo sapiens
  Heavy chain CDR3 for antibody 982 (IGHV3-33)
ARDGIVRATDAFAI

SEQ ID NO: 1965 - protein, 9 aa, Homo sapiens
  Light chain CDR3 for antibody 983 (IGKV3-20)
QQYGSSPYT

SEQ ID NO: 1966 - protein, 10 aa, Homo sapiens
  Heavy chain CDR3 for antibody 983 (IGHV3-23)
AKGDRWRFDP

SEQ ID NO: 1967 - protein, 9 aa, Homo sapiens
  Light chain CDR3 for antibody 984 (IGKV6-21)
HQRSSLPHT

SEQ ID NO: 1968 - protein, 15 aa, Homo sapiens
  Heavy chain CDR3 for antibody 984 (IGHV3-33)
ARERYSSAWSSGMDV

SEQ ID NO: 1969 - protein, 9 aa, Homo sapiens
  Light chain CDR3 for antibody 985 (IGKV5-2)
LQHDNFPWT

SEQ ID NO: 1970 - protein, 14 aa, Homo sapiens
  Heavy chain CDR3 for antibody 985 (IGHV4-39)
ARRGVVVPPGGMDV

SEQ ID NO: 1971 - protein, 9 aa, Homo sapiens
  Light chain CDR3 for antibody 986 (IGKV3-20)
QQYGSSPYT

SEQ ID NO: 1972 - protein, 12 aa, Homo sapiens
  Heavy chain CDR3 for antibody 986 (IGHV3-33)
ARDRAYRGSLDY

SEQ ID NO: 1973 - protein, 9 aa, Homo sapiens
  Light chain CDR3 for antibody 987 (IGKV3D-7)
QQDYNLPLT

SEQ ID NO: 1974 - protein, 15 aa, Homo sapiens
  Heavy chain CDR3 for antibody 987 (IGHV4-59)
ARDGHGNWGSGTFDY

SEQ ID NO: 1975 - protein, 9 aa, Homo sapiens
  Light chain CDR3 for antibody 988 (IGKV2-30)
MQGTHWPLT

SEQ ID NO: 1976 - protein, 16 aa, Homo sapiens
  Heavy chain CDR3 for antibody 988 (IGHV3-23)
AKEGMVLRYFDWLWDY

SEQ ID NO: 1977 - protein, 9 aa, Homo sapiens
  Light chain CDR3 for antibody 989 (IGKV1D-13)
QQFNNYPYT

SEQ ID NO: 1978 - protein, 14 aa, Homo sapiens
  Heavy chain CDR3 for antibody 989 (IGHV3-33)
ARDWNDVYYYGMDV

SEQ ID NO: 1979 - protein, 9 aa, Homo sapiens
  Light chain CDR3 for antibody 990 (IGKV5-2)
LQHDNFPWT

SEQ ID NO: 1980 - protein, 18 aa, Homo sapiens
  Heavy chain CDR3 for antibody 990 (IGHV4-39)
ARQYYFGSGNYYRGWFDP

SEQ ID NO: 1981 - protein, 9 aa, Homo sapiens
  Light chain CDR3 for antibody 991 (IGKV1D-16)
QQYNSYPYT

SEQ ID NO: 1982 - protein, 14 aa, Homo sapiens
  Heavy chain CDR3 for antibody 991 (IGHV3-33)
ARDGLVGASSWFDP

SEQ ID NO: 1983 - protein, 9 aa, Homo sapiens
  Light chain CDR3 for antibody 992 (IGKV6-21)
HQSSSLPYT

SEQ ID NO: 1984 - protein, 15 aa, Homo sapiens
  Heavy chain CDR3 for antibody 992 (IGHV3-33)
ARRICSGGSCSLFDY

SEQ ID NO: 1985 - protein, 9 aa, Homo sapiens
  Light chain CDR3 for antibody 993 (IGKV5-2)
LQHDNFPYT

SEQ ID NO: 1986 - protein, 15 aa, Homo sapiens
  Heavy chain CDR3 for antibody 993 (IGHV3-23)
AKDGSYYDYYYGMDV

SEQ ID NO: 1987 - protein, 9 aa, Homo sapiens
  Light chain CDR3 for antibody 994 (IGKV3D-7)
QQDYEFPLT

SEQ ID NO: 1988 - protein, 18 aa, Homo sapiens
  Heavy chain CDR3 for antibody 994 (IGHV4-59)
AREGDYVWGSYRPNWFDP

SEQ ID NO: 1989 - protein, 9 aa, Homo sapiens
  Light chain CDR3 for antibody 995 (IGKV6-21)
HQSSSLPYT

SEQ ID NO: 1990 - protein, 17 aa, Homo sapiens
  Heavy chain CDR3 for antibody 995 (IGHV1-18)
ARDRAFTMVRGVPPFDY

SEQ ID NO: 1991 - protein, 9 aa, Homo sapiens
  Light chain CDR3 for antibody 996 (IGKV1D-16)
QQYNSYPYT

SEQ ID NO: 1992 - protein, 17 aa, Homo sapiens
  Heavy chain CDR3 for antibody 996 (IGHV3-33)
ARSPYDILTGYSYYFDY

SEQ ID NO: 1993 - protein, 9 aa, Homo sapiens
  Light chain CDR3 for antibody 997 (IGKV5-2)
LQHDNFPYT

SEQ ID NO: 1994 - protein, 18 aa, Homo sapiens
  Heavy chain CDR3 for antibody 997 (IGHV3-23)
AKDRITGTTYGYYSGLDV

SEQ ID NO: 1995 - protein, 9 aa, Homo sapiens
  Light chain CDR3 for antibody 998 (IGKV6-21)
HQSSSLPYT

SEQ ID NO: 1996 - protein, 9 aa, Homo sapiens
  Heavy chain CDR3 for antibody 998 (IGHV3-33)
ARATVGVDY

SEQ ID NO: 1997 - protein, 9 aa, Homo sapiens
  Light chain CDR3 for antibody 999 (IGKV1D-13)
QQFNNYPHT

SEQ ID NO: 1998 - protein, 18 aa, Homo sapiens
  Heavy chain CDR3 for antibody 999 (IGHV3-33)
ARAGYYGSGSYYYYGMDV

SEQ ID NO: 1999 - protein, 9 aa, Homo sapiens
  Light chain CDR3 for antibody 1000 (IGKV1-6)
LQDYNYPWT

SEQ ID NO: 2000 - protein, 17 aa, Homo sapiens
  Heavy chain CDR3 for antibody 1000 (IGHV3-11)
ARAGPRYDSSGHDAFDI

SEQ ID NO: 2001 - protein, 9 aa, Homo sapiens
  Light chain CDR3 for antibody 1001 (IGKV1-17)
LQHNSYPST

SEQ ID NO: 2002 - protein, 17 aa, Homo sapiens
  Heavy chain CDR3 for antibody 1001 (IGHV3-23)
AREGYYDILTDYYGMDV

SEQ ID NO: 2003 - protein, 9 aa, Homo sapiens
  Light chain CDR3 for antibody 1002 (IGKV3-20)
QQYGSSPYT

SEQ ID NO: 2004 - protein, 18 aa, Homo sapiens
  Heavy chain CDR3 for antibody 1002 (IGHV3-33)
ARGLLWFGVSYYYYGMDV

SEQ ID NO: 2005 - protein, 9 aa, Homo sapiens
  Light chain CDR3 for antibody 1003 (IGKV6-21)
HQSSSLPYT

SEQ ID NO: 2006 - protein, 15 aa, Homo sapiens
  Heavy chain CDR3 for antibody 1003 (IGHV3-23)
AKDGSYYDYYYGMDV

SEQ ID NO: 2007 - protein, 9 aa, Homo sapiens
  Light chain CDR3 for antibody 1004 (IGKV6-21)
HQSSSLPHT

SEQ ID NO: 2008 - protein, 12 aa, Homo sapiens
  Heavy chain CDR3 for antibody 1004 (IGHV3-9)
AEDPFLGTSFDY

SEQ ID NO: 2009 - protein, 9 aa, Homo sapiens
  Light chain CDR3 for antibody 1005 (IGKV1-39)
QQSYSTPFT

SEQ ID NO: 2010 - protein, 18 aa, Homo sapiens
  Heavy chain CDR3 for antibody 1005 (IGHV4-59)
AREGHYYTSGSYYKAFDY

SEQ ID NO: 2011 - protein, 9 aa, Homo sapiens
  Light chain CDR3 for antibody 1006 (IGKV1-16)
QQYNSYPYT

SEQ ID NO: 2012 - protein, 16 aa, Homo sapiens
  Heavy chain CDR3 for antibody 1006 (IGHV4-59)
ARDTPYYSGSGRPFDH

SEQ ID NO: 2013 - protein, 9 aa, Homo sapiens
  Light chain CDR3 for antibody 1007 (IGKV1-39)
QQSYSTPLT

SEQ ID NO: 2014 - protein, 20 aa, Homo sapiens
  Heavy chain CDR3 for antibody 1007 (IGHV3-23)
TKDRYSDSSGYYLYYNDMDV

SEQ ID NO: 2015 - protein, 9 aa, Homo sapiens
  Light chain CDR3 for antibody 1008 (IGKV6-21)
HQSSSLPYT

SEQ ID NO: 2016 - protein, 14 aa, Homo sapiens
  Heavy chain CDR3 for antibody 1008 (IGHV3-33)
ARAISGSSYWYFDL

SEQ ID NO: 2017 - protein, 9 aa, Homo sapiens
  Light chain CDR3 for antibody 1009 (IGKV5-2)
LQHDNFPYT

SEQ ID NO: 2018 - protein, 13 aa, Homo sapiens
  Heavy chain CDR3 for antibody 1009 (IGHV3-53)
ARSGSYWGYYFDY

SEQ ID NO: 2019 - protein, 9 aa, Homo sapiens
  Light chain CDR3 for antibody 1010 (IGKV3D-7)
QQDYILPWT

SEQ ID NO: 2020 - protein, 14 aa, Homo sapiens
  Heavy chain CDR3 for antibody 1010 (IGHV3-23)
AKDRNIPAAGPFDY

SEQ ID NO: 2021 - protein, 9 aa, Homo sapiens
  Light chain CDR3 for antibody 1011 (IGKV1-39)
QQSYSTPLT

SEQ ID NO: 2022 - protein, 14 aa, Homo sapiens
  Heavy chain CDR3 for antibody 1011 (IGHV3-33)
ARGAAAGNFYGLDV

SEQ ID NO: 2023 - protein, 9 aa, Homo sapiens
  Light chain CDR3 for antibody 1012 (IGKV1-17)
LQHNSYPYT

SEQ ID NO: 2024 - protein, 9 aa, Homo sapiens
  Heavy chain CDR3 for antibody 1012 (IGHV3-23)
ARIWWLKDY

SEQ ID NO: 2025 - protein, 9 aa, Homo sapiens
  Light chain CDR3 for antibody 1013 (IGKV1-17)
LQHNSYPYT

SEQ ID NO: 2026 - protein, 20 aa, Homo sapiens
  Heavy chain CDR3 for antibody 1013 (IGHV3-33)
ARDPAQLERRYYYFYYGMDV

SEQ ID NO: 2027 - protein, 9 aa, Homo sapiens
  Light chain CDR3 for antibody 1014 (IGKV1-17)
LQHNSYPYT

SEQ ID NO: 2028 - protein, 17 aa, Homo sapiens
  Heavy chain CDR3 for antibody 1014 (IGHV3-33)
ARGGAAAGPYLYYGLDV

SEQ ID NO: 2029 - protein, 9 aa, Homo sapiens
  Light chain CDR3 for antibody 1015 (IGKV5-2)
LQHDNFPYT

SEQ ID NO: 2030 - protein, 11 aa, Homo sapiens
  Heavy chain CDR3 for antibody 1015 (IGHV3-33)
ARDKSSGWSDY

SEQ ID NO: 2031 - protein, 9 aa, Homo sapiens
  Light chain CDR3 for antibody 1016 (IGKV3-20)
QQYGSSPYT

SEQ ID NO: 2032 - protein, 18 aa, Homo sapiens
  Heavy chain CDR3 for antibody 1016 (IGHV3-23)
AKDRITGTTYGYYSGLDV

SEQ ID NO: 2033 - protein, 9 aa, Homo sapiens
  Light chain CDR3 for antibody 1017 (IGKV1-6)
LQDYNYPYT

SEQ ID NO: 2034 - protein, 18 aa, Homo sapiens
  Heavy chain CDR3 for antibody 1017 (IGHV1-18)
ARDRYYYDSGSYYYGMDV

SEQ ID NO: 2035 - protein, 9 aa, Homo sapiens
  Light chain CDR3 for antibody 1018 (IGKV1-16)
QQYNSYPYT

SEQ ID NO: 2036 - protein, 13 aa, Homo sapiens
  Heavy chain CDR3 for antibody 1018 (IGHV1-2)
ARDGVRGSFGMDV

SEQ ID NO: 2037 - protein, 9 aa, Homo sapiens
  Light chain CDR3 for antibody 1019 (IGKV6-21)
HQSSSLPLT

SEQ ID NO: 2038 - protein, 14 aa, Homo sapiens
  Heavy chain CDR3 for antibody 1019 (IGHV3-20)
ARDEGSTWSDIFDI

SEQ ID NO: 2039 - protein, 9 aa, Homo sapiens
  Light chain CDR3 for antibody 1020 (IGKV1D-16)
QQYNSYPLT

SEQ ID NO: 2040 - protein, 18 aa, Homo sapiens
  Heavy chain CDR3 for antibody 1020 (IGHV3-33)
ARERDYYGSGSYPDAFDI

SEQ ID NO: 2041 - protein, 9 aa, Homo sapiens
  Light chain CDR3 for antibody 1021 (IGKV2-30)
MQGTHWPLT

SEQ ID NO: 2042 - protein, 13 aa, Homo sapiens
  Heavy chain CDR3 for antibody 1021 (IGHV3-11)
ARDGGAAAGTWDS

SEQ ID NO: 2043 - protein, 9 aa, Homo sapiens
  Light chain CDR3 for antibody 1022 (IGKV5-2)
LQHDNFPWT

SEQ ID NO: 2044 - protein, 12 aa, Homo sapiens
  Heavy chain CDR3 for antibody 1022 (IGHV1-18)
ARILFYGDYFDY

SEQ ID NO: 2045 - protein, 9 aa, Homo sapiens
  Light chain CDR3 for antibody 1023 (IGKV1-17)
LQHNSYPYT

SEQ ID NO: 2046 - protein, 16 aa, Homo sapiens
  Heavy chain CDR3 for antibody 1023 (IGHV3-13)
ARDRSYESYYYYGMDV

SEQ ID NO: 2047 - protein, 9 aa, Homo sapiens
  Light chain CDR3 for antibody 1024 (IGKV6-21)
HQSSSLPYT

SEQ ID NO: 2048 - protein, 15 aa, Homo sapiens
  Heavy chain CDR3 for antibody 1024 (IGHV1-18)
ARGYCSSTSCYYFDY

SEQ ID NO: 2049 - protein, 9 aa, Homo sapiens
  Light chain CDR3 for antibody 1025 (IGKV1-16)
QQYNSYPYT

SEQ ID NO: 2050 - protein, 14 aa, Homo sapiens
  Heavy chain CDR3 for antibody 1025 (IGHV1-46)
ARDGVGAKEGGFDY

SEQ ID NO: 2051 - protein, 9 aa, Homo sapiens
  Light chain CDR3 for antibody 1026 (IGKV3D-7)
QQDYNLPYT

SEQ ID NO: 2052 - protein, 22 aa, Homo sapiens
  Heavy chain CDR3 for antibody 1026 (IGHV3-33)
ARMYYDILTGYYKDYYYYGMDV

SEQ ID NO: 2053 - protein, 9 aa, Homo sapiens
  Light chain CDR3 for antibody 1027 (IGKV1D-16)
QQYNSYPLT

SEQ ID NO: 2054 - protein, 12 aa, Homo sapiens
  Heavy chain CDR3 for antibody 1027 (IGHV1-46)
AREDYDIDGMDV

SEQ ID NO: 2055 - protein, 9 aa, Homo sapiens
  Light chain CDR3 for antibody 1028 (IGKV1D-16)
QQYNSYPYT

SEQ ID NO: 2056 - protein, 11 aa, Homo sapiens
  Heavy chain CDR3 for antibody 1028 (IGHV3-23)
ARDPGSITGDY

SEQ ID NO: 2057 - protein, 9 aa, Homo sapiens
  Light chain CDR3 for antibody 1029 (IGKV1-17)
LQHNSYPYT

SEQ ID NO: 2058 - protein, 17 aa, Homo sapiens
  Heavy chain CDR3 for antibody 1029 (IGHV1-18)
ARERYYGSGSYKYNMDV

SEQ ID NO: 2059 - protein, 9 aa, Homo sapiens
  Light chain CDR3 for antibody 1030 (IGKV6-21)
HQSNSLPFT

SEQ ID NO: 2060 - protein, 10 aa, Homo sapiens
  Heavy chain CDR3 for antibody 1030 (IGHV3-13)
ARDRGSYYDY

SEQ ID NO: 2061 - protein, 9 aa, Homo sapiens
  Light chain CDR3 for antibody 1031 (IGKV3-15)
QQYNNWPLT

SEQ ID NO: 2062 - protein, 18 aa, Homo sapiens
  Heavy chain CDR3 for antibody 1031 (IGHV4-59)
AREGDYVWGSYRPNWFDP

SEQ ID NO: 2063 - protein, 9 aa, Homo sapiens
  Light chain CDR3 for antibody 1032 (IGKV1D-16)
QQYNSYPYT

SEQ ID NO: 2064 - protein, 18 aa, Homo sapiens
  Heavy chain CDR3 for antibody 1032 (IGHV3-33)
ARDEYYGSGIYYNYGMDV

SEQ ID NO: 2065 - protein, 9 aa, Homo sapiens
  Light chain CDR3 for antibody 1033 (IGKV1D-16)
QQYNSYPYT

SEQ ID NO: 2066 - protein, 17 aa, Homo sapiens
  Heavy chain CDR3 for antibody 1033 (IGHV3-33)
ARSGIVGATDYYYGLDV

SEQ ID NO: 2067 - protein, 9 aa, Homo sapiens
  Light chain CDR3 for antibody 1034 (IGKV1-9)
QQFNSYTRT

SEQ ID NO: 2068 - protein, 11 aa, Homo sapiens
  Heavy chain CDR3 for antibody 1034 (IGHV3-33)
AREGAVASFDY

SEQ ID NO: 2069 - protein, 9 aa, Homo sapiens
  Light chain CDR3 for antibody 1035 (IGKV6-21)
HQSSSLPYT

SEQ ID NO: 2070 - protein, 10 aa, Homo sapiens
  Heavy chain CDR3 for antibody 1035 (IGHV3-23)
AKGDRWRFDP

SEQ ID NO: 2071 - protein, 9 aa, Homo sapiens
  Light chain CDR3 for antibody 1036 (IGKV5-2)
LQHDNFPWT

SEQ ID NO: 2072 - protein, 11 aa, Homo sapiens
  Heavy chain CDR3 for antibody 1036 (IGHV4-4)
AREAYYYGLDV

SEQ ID NO: 2073 - protein, 9 aa, Homo sapiens
  Light chain CDR3 for antibody 1037 (IGKV1D-16)
QQYNSYPLT

SEQ ID NO: 2074 - protein, 12 aa, Homo sapiens
  Heavy chain CDR3 for antibody 1037 (IGHV3-13)
AREAGIPDAFDI

SEQ ID NO: 2075 - protein, 9 aa, Homo sapiens
  Light chain CDR3 for antibody 1038 (IGKV1-6)
LQDYNYPYT

SEQ ID NO: 2076 - protein, 11 aa, Homo sapiens
  Heavy chain CDR3 for antibody 1038 (IGHV1-24)
ATELGLYYFDY

SEQ ID NO: 2077 - protein, 9 aa, Homo sapiens
  Light chain CDR3 for antibody 1039 (IGKV3D-20)
QQYGSSPYT

SEQ ID NO: 2078 - protein, 18 aa, Homo sapiens
  Heavy chain CDR3 for antibody 1039 (IGHV3-33)
ARDGYSGYDYYYYYGMDV

SEQ ID NO: 2079 - protein, 9 aa, Homo sapiens
  Light chain CDR3 for antibody 1040 (IGKV1D-16)
QQYNSYPLT

SEQ ID NO: 2080 - protein, 18 aa, Homo sapiens
  Heavy chain CDR3 for antibody 1040 (IGHV3-33)
ARDGYSGYDYYYYYGMDV

SEQ ID NO: 2081 - protein, 9 aa, Homo sapiens
  Light chain CDR3 for antibody 1041 (IGKV3-20)
QQYGSSPYT

SEQ ID NO: 2082 - protein, 15 aa, Homo sapiens
  Heavy chain CDR3 for antibody 1041 (IGHV3-23)
AKDGSYYDYYYGMDV

SEQ ID NO: 2083 - protein, 9 aa, Homo sapiens
  Light chain CDR3 for antibody 1042 (IGKV1-6)
LQDYNYPYT

SEQ ID NO: 2084 - protein, 14 aa, Homo sapiens
  Heavy chain CDR3 for antibody 1042 (IGHV1-2)
ARDYYGSGNYYMGY

SEQ ID NO: 2085 - protein, 9 aa, Homo sapiens
  Light chain CDR3 for antibody 1043 (IGKV5-2)
LQHDNFPYT

SEQ ID NO: 2086 - protein, 14 aa, Homo sapiens
  Heavy chain CDR3 for antibody 1043 (IGHV3-33)
ARDRIAAASSDFDC

SEQ ID NO: 2087 - protein, 9 aa, Homo sapiens
  Light chain CDR3 for antibody 1044 (IGKV1-17)
LQHNSYPYT

SEQ ID NO: 2088 - protein, 11 aa, Homo sapiens
  Heavy chain CDR3 for antibody 1044 (IGHV3-23)
AKGLWSYYFDY

SEQ ID NO: 2089 - protein, 9 aa, Homo sapiens
  Light chain CDR3 for antibody 1045 (IGKV6-21)
HQSSSLPYT

SEQ ID NO: 2090 - protein, 20 aa, Homo sapiens
  Heavy chain CDR3 for antibody 1045 (IGHV3-20)
ARDLCSSTSCYGYYYYGMDV

SEQ ID NO: 2091 - protein, 9 aa, Homo sapiens
  Light chain CDR3 for antibody 1046 (IGKV3-15)
QQYNNWPRT

SEQ ID NO: 2092 - protein, 18 aa, Homo sapiens
  Heavy chain CDR3 for antibody 1046 (IGHV3-33)
ARDPYSSGWYDYYFGMDV

SEQ ID NO: 2093 - protein, 9 aa, Homo sapiens
  Light chain CDR3 for antibody 1047 (IGKV1-12)
QQADTIPVT

SEQ ID NO: 2094 - protein, 9 aa, Homo sapiens
  Heavy chain CDR3 for antibody 1047 (IGHV4-59)
ARGRSNFRI

SEQ ID NO: 2095 - protein, 9 aa, Homo sapiens
  Light chain CDR3 for antibody 1048 (IGKV3-11)
QQRSNWPYT

SEQ ID NO: 2096 - protein, 16 aa, Homo sapiens
  Heavy chain CDR3 for antibody 1048 (IGHV3-23)
AKEGMVLRYFDWLWDY

SEQ ID NO: 2097 - protein, 9 aa, Homo sapiens
  Light chain CDR3 for antibody 1049 (IGKV1D-16)
QQYNSYPYT

SEQ ID NO: 2098 - protein, 8 aa, Homo sapiens
  Heavy chain CDR3 for antibody 1049 (IGHV3-33)
ARDRGFDY

SEQ ID NO: 2099 - protein, 9 aa, Homo sapiens
  Light chain CDR3 for antibody 1050 (IGKV5-2)
LQHDNFPWT

SEQ ID NO: 2100 - protein, 13 aa, Homo sapiens
  Heavy chain CDR3 for antibody 1050 (IGHV4-39)
ARRDVLAPAAFDY

SEQ ID NO: 2101 - protein, 9 aa, Homo sapiens
  Light chain CDR3 for antibody 1051 (IGKV1-6)
LQDYNYPYT

SEQ ID NO: 2102 - protein, 11 aa, Homo sapiens
  Heavy chain CDR3 for antibody 1051 (IGHV3-33)
ARDRATATVDY

SEQ ID NO: 2103 - protein, 9 aa, Homo sapiens
  Light chain CDR3 for antibody 1052 (IGKV1-17)
LQHNSYPYT

SEQ ID NO: 2104 - protein, 18 aa, Homo sapiens
  Heavy chain CDR3 for antibody 1052 (IGHV3-33)
ARERDYYGSGSYPDAFDI

SEQ ID NO: 2105 - protein, 9 aa, Homo sapiens
  Light chain CDR3 for antibody 1053 (IGKV1-9)
QQYNSYPLT

SEQ ID NO: 2106 - protein, 18 aa, Homo sapiens
  Heavy chain CDR3 for antibody 1053 (IGHV4-59)
ARERGNWNDVDYYYGMDV

SEQ ID NO: 2107 - protein, 9 aa, Homo sapiens
  Light chain CDR3 for antibody 1054 (IGKV1-17)
LQHNSYPYT

SEQ ID NO: 2108 - protein, 14 aa, Homo sapiens
  Heavy chain CDR3 for antibody 1054 (IGHV3-33)
VRDQGSMVRGGGDY

SEQ ID NO: 2109 - protein, 9 aa, Homo sapiens
  Light chain CDR3 for antibody 1055 (IGKV5-2)
LQHDNFPYT

SEQ ID NO: 2110 - protein, 11 aa, Homo sapiens
  Heavy chain CDR3 for antibody 1055 (IGHV3-33)
ARDRVLTPFDY

SEQ ID NO: 2111 - protein, 9 aa, Homo sapiens
  Light chain CDR3 for antibody 1056 (IGKV1D-16)
QQYNSYPLT

SEQ ID NO: 2112 - protein, 17 aa, Homo sapiens
  Heavy chain CDR3 for antibody 1056 (IGHV3-33)
ARVYYDILTGYSPAFDI

SEQ ID NO: 2113 - protein, 9 aa, Homo sapiens
  Light chain CDR3 for antibody 1057 (IGKV6-21)
HQSSSLPYT

SEQ ID NO: 2114 - protein, 10 aa, Homo sapiens
  Heavy chain CDR3 for antibody 1057 (IGHV3-23)
AKEQWLVLDY

SEQ ID NO: 2115 - protein, 9 aa, Homo sapiens
  Light chain CDR3 for antibody 1058 (IGKV1-17)
LQHNSYPWT

SEQ ID NO: 2116 - protein, 13 aa, Homo sapiens
  Heavy chain CDR3 for antibody 1058 (IGHV1-18)
ARKWEWDLLNFDY

SEQ ID NO: 2117 - protein, 9 aa, Homo sapiens
  Light chain CDR3 for antibody 1059 (IGKV3-20)
QQYGSSPYT

SEQ ID NO: 2118 - protein, 12 aa, Homo sapiens
  Heavy chain CDR3 for antibody 1059 (IGHV3-33)
AREKGGSYSFDY

SEQ ID NO: 2119 - protein, 8 aa, Homo sapiens
  Light chain CDR3 for antibody 1060 (IGKV1D-13)
QQFNNYHT

SEQ ID NO: 2120 - protein, 15 aa, Homo sapiens
  Heavy chain CDR3 for antibody 1060 (IGHV3-23)
AKDGSYSYYYYGMDV

SEQ ID NO: 2121 - protein, 9 aa, Homo sapiens
  Light chain CDR3 for antibody 1061 (IGKV5-2)
LQHDNFPYT

SEQ ID NO: 2122 - protein, 13 aa, Homo sapiens
  Heavy chain CDR3 for antibody 1061 (IGHV3-33)
ARRATLVRGVFDP

SEQ ID NO: 2123 - protein, 9 aa, Homo sapiens
  Light chain CDR3 for antibody 1062 (IGKV1-16)
QQYNSYPYT

SEQ ID NO: 2124 - protein, 17 aa, Homo sapiens
  Heavy chain CDR3 for antibody 1062 (IGHV1-24)
ATEGYDILPGYYNVLDY

SEQ ID NO: 2125 - protein, 9 aa, Homo sapiens
  Light chain CDR3 for antibody 1063 (IGKV1-17)
LQHNSYPYT

SEQ ID NO: 2126 - protein, 14 aa, Homo sapiens
  Heavy chain CDR3 for antibody 1063 (IGHV3-33)
AREDYYGPLNWFDP

SEQ ID NO: 2127 - protein, 9 aa, Homo sapiens
  Light chain CDR3 for antibody 1064 (IGKV1D-16)
QQYNSYPYT

SEQ ID NO: 2128 - protein, 18 aa, Homo sapiens
  Heavy chain CDR3 for antibody 1064 (IGHV3-33)
ARDYDSLTTYPEDYGMDV

SEQ ID NO: 2129 - protein, 9 aa, Homo sapiens
  Light chain CDR3 for antibody 1065 (IGKV6-21)
HQSSSLPLT

SEQ ID NO: 2130 - protein, 13 aa, Homo sapiens
  Heavy chain CDR3 for antibody 1065 (IGHV3-33)
ARDDDYGDYPFDY

SEQ ID NO: 2131 - protein, 9 aa, Homo sapiens
  Light chain CDR3 for antibody 1066 (IGKV5-2)
LQHDNFPYT

SEQ ID NO: 2132 - protein, 12 aa, Homo sapiens
  Heavy chain CDR3 for antibody 1066 (IGHV3-33)
ARDLVGATPFDY

SEQ ID NO: 2133 - protein, 9 aa, Homo sapiens
  Light chain CDR3 for antibody 1067 (IGKV2-30)
MQGTHWPLT

SEQ ID NO: 2134 - protein, 11 aa, Homo sapiens
  Heavy chain CDR3 for antibody 1067 (IGHV3-33)
ARDRSSGPFDY

SEQ ID NO: 2135 - protein, 9 aa, Homo sapiens
  Light chain CDR3 for antibody 1068 (IGKV1-6)
LQDYNYPYT

SEQ ID NO: 2136 - protein, 9 aa, Homo sapiens
  Heavy chain CDR3 for antibody 1068 (IGHV3-33)
ARGSGWSDY

SEQ ID NO: 2137 - protein, 9 aa, Homo sapiens
  Light chain CDR3 for antibody 1069 (IGKV1-6)
LQDYNYPYT

SEQ ID NO: 2138 - protein, 14 aa, Homo sapiens
  Heavy chain CDR3 for antibody 1069 (IGHV1-18)
ARCFGSGSYGWFDP

SEQ ID NO: 2139 - protein, 9 aa, Homo sapiens
  Light chain CDR3 for antibody 1070 (IGKV1-6)
LQDYNYPYT

SEQ ID NO: 2140 - protein, 11 aa, Homo sapiens
  Heavy chain CDR3 for antibody 1070 (IGHV3-23)
ARDPGSITGDY

SEQ ID NO: 2141 - protein, 9 aa, Homo sapiens
  Light chain CDR3 for antibody 1071 (IGKV5-2)
LQHDNFPWT

SEQ ID NO: 2142 - protein, 23 aa, Homo sapiens
  Heavy chain CDR3 for antibody 1071 (IGHV4-59)
ARERTYSDILPGYYEDYYYGMDV

SEQ ID NO: 2143 - protein, 9 aa, Homo sapiens
  Light chain CDR3 for antibody 1072 (IGKV1-17)
LQHNSYPYT

SEQ ID NO: 2144 - protein, 19 aa, Homo sapiens
  Heavy chain CDR3 for antibody 1072 (IGHV3-33)
ARDSGYSGYDYYYYYGMDV

SEQ ID NO: 2145 - protein, 9 aa, Homo sapiens
  Light chain CDR3 for antibody 1073 (IGKV3D-7)
QQDYNLPLT

SEQ ID NO: 2146 - protein, 11 aa, Homo sapiens
  Heavy chain CDR3 for antibody 1073 (IGHV4-59)
AREMGHDTFDI

SEQ ID NO: 2147 - protein, 9 aa, Homo sapiens
  Light chain CDR3 for antibody 1074 (IGKV1D-16)
QQYNSYPLT

SEQ ID NO: 2148 - protein, 13 aa, Homo sapiens
  Heavy chain CDR3 for antibody 1074 (IGHV3-33)
ARTDYYFYYGLDV

SEQ ID NO: 2149 - protein, 9 aa, Homo sapiens
  Light chain CDR3 for antibody 1075 (IGKV1-6)
LQDYNYPYT

SEQ ID NO: 2150 - protein, 23 aa, Homo sapiens
  Heavy chain CDR3 for antibody 1075 (IGHV3-11)
ARDEGVTMVRGVISYYYYYGMDV

SEQ ID NO: 2151 - protein, 9 aa, Homo sapiens
  Light chain CDR3 for antibody 1076 (IGKV1D-16)
QQYNSYPLT

SEQ ID NO: 2152 - protein, 11 aa, Homo sapiens
  Heavy chain CDR3 for antibody 1076 (IGHV3-33)
ARARYTTGLDY

SEQ ID NO: 2153 - protein, 9 aa, Homo sapiens
  Light chain CDR3 for antibody 1077 (IGKV1-27)
QKYNSAPYT

SEQ ID NO: 2154 - protein, 14 aa, Homo sapiens
  Heavy chain CDR3 for antibody 1077 (IGHV3-33)
ARDWNDVYYYGMDV

SEQ ID NO: 2155 - protein, 9 aa, Homo sapiens
  Light chain CDR3 for antibody 1078 (IGKV1-6)
LQDYHYPWT

SEQ ID NO: 2156 - protein, 23 aa, Homo sapiens
  Heavy chain CDR3 for antibody 1078 (IGHV3-11)
ARDRGITMVRGVITYYYFYGMDV

SEQ ID NO: 2157 - protein, 9 aa, Homo sapiens
  Light chain CDR3 for antibody 1079 (IGKV1-17)
LQHNSYPYT

SEQ ID NO: 2158 - protein, 17 aa, Homo sapiens
  Heavy chain CDR3 for antibody 1079 (IGHV3-33)
ARVRGVIEGYYYYGMDV

SEQ ID NO: 2159 - protein, 9 aa, Homo sapiens
  Light chain CDR3 for antibody 1080 (IGKV1-17)
LQHNSYPYT

SEQ ID NO: 2160 - protein, 18 aa, Homo sapiens
  Heavy chain CDR3 for antibody 1080 (IGHV3-33)
VRDRERYGSGSYPDAFDI

SEQ ID NO: 2161 - protein, 9 aa, Homo sapiens
  Light chain CDR3 for antibody 1081 (IGKV1-12)
QQANSFPFT

SEQ ID NO: 2162 - protein, 15 aa, Homo sapiens
  Heavy chain CDR3 for antibody 1081 (IGHV3-33)
ATERAYGSGSSYCDY

SEQ ID NO: 2163 - protein, 9 aa, Homo sapiens
  Light chain CDR3 for antibody 1082 (IGKV1D-13)
QQFNNYPHT

SEQ ID NO: 2164 - protein, 13 aa, Homo sapiens
  Heavy chain CDR3 for antibody 1082 (IGHV3-11)
ARDGGAAAGTWDS

SEQ ID NO: 2165 - protein, 9 aa, Homo sapiens
  Light chain CDR3 for antibody 1083 (IGKV1-6)
LQDYNYPWT

SEQ ID NO: 2166 - protein, 13 aa, Homo sapiens
  Heavy chain CDR3 for antibody 1083 (IGHV3-33)
ARAFIMVRGVIDY

SEQ ID NO: 2167 - protein, 9 aa, Homo sapiens
  Light chain CDR3 for antibody 1084 (IGKV3-20)
QQYGSSPYT

SEQ ID NO: 2168 - protein, 12 aa, Homo sapiens
  Heavy chain CDR3 for antibody 1084 (IGHV4-59)
ARDRSGWAYFDY

SEQ ID NO: 2169 - protein, 9 aa, Homo sapiens
  Light chain CDR3 for antibody 1085 (IGKV1-9)
QQLNSYPLT

SEQ ID NO: 2170 - protein, 12 aa, Homo sapiens
  Heavy chain CDR3 for antibody 1085 (IGHV4-39)
ARQMVREGWFDP

SEQ ID NO: 2171 - protein, 9 aa, Homo sapiens
  Light chain CDR3 for antibody 1086 (IGKV6-21)
HQSSSLPYT

SEQ ID NO: 2172 - protein, 11 aa, Homo sapiens
  Heavy chain CDR3 for antibody 1086 (IGHV3-33)
ARARYTTGLDY

SEQ ID NO: 2173 - protein, 9 aa, Homo sapiens
  Light chain CDR3 for antibody 1087 (IGKV3-20)
QQYGSSPYT

SEQ ID NO: 2174 - protein, 17 aa, Homo sapiens
  Heavy chain CDR3 for antibody 1087 (IGHV3-33)
ARVYYDILTGYSPAFDI

SEQ ID NO: 2175 - protein, 9 aa, Homo sapiens
  Light chain CDR3 for antibody 1088 (IGKV1D-16)
QQYNSYPYT

SEQ ID NO: 2176 - protein, 14 aa, Homo sapiens
  Heavy chain CDR3 for antibody 1088 (IGHV3-33)
ARDAYDILTGYYDY

SEQ ID NO: 2177 - protein, 9 aa, Homo sapiens
  Light chain CDR3 for antibody 1089 (IGKV5-2)
LQHDNFPYT

SEQ ID NO: 2178 - protein, 15 aa, Homo sapiens
  Heavy chain CDR3 for antibody 1089 (IGHV3-33)
ARDHLTGYYYYGMDV

SEQ ID NO: 2179 - protein, 10 aa, Homo sapiens
  Light chain CDR3 for antibody 1090 (IGKV3-15)
QQYNKWPPLT

SEQ ID NO: 2180 - protein, 18 aa, Homo sapiens
  Heavy chain CDR3 for antibody 1090 (IGHV1-8)
ARGRYNSGWNYYYFGMDV

SEQ ID NO: 2181 - protein, 9 aa, Homo sapiens
  Light chain CDR3 for antibody 1091 (IGKV1-17)
LQHNSYPYT

SEQ ID NO: 2182 - protein, 18 aa, Homo sapiens
  Heavy chain CDR3 for antibody 1091 (IGHV3-33)
ARGGYSSGWDYYYYGMDV

SEQ ID NO: 2183 - protein, 9 aa, Homo sapiens
  Light chain CDR3 for antibody 1092 (IGKV1-17)
LQHNSYPYT

SEQ ID NO: 2184 - protein, 19 aa, Homo sapiens
  Heavy chain CDR3 for antibody 1092 (IGHV3-30)
ARRFSGYSGYDHYYYGMDV

SEQ ID NO: 2185 - protein, 9 aa, Homo sapiens
  Light chain CDR3 for antibody 1093 (IGKV1-39)
QQSYSTPLT

SEQ ID NO: 2186 - protein, 12 aa, Homo sapiens
  Heavy chain CDR3 for antibody 1093 (IGHV1-46)
ARGLTGDHAVDI

SEQ ID NO: 2187 - protein, 9 aa, Homo sapiens
  Light chain CDR3 for antibody 1094 (IGKV6-21)
LQSSSFPYT

SEQ ID NO: 2188 - protein, 11 aa, Homo sapiens
  Heavy chain CDR3 for antibody 1094 (IGHV3-33)
ASWDILTGSGY

SEQ ID NO: 2189 - protein, 9 aa, Homo sapiens
  Light chain CDR3 for antibody 1095 (IGKV3-20)
QQYGSSPRT

SEQ ID NO: 2190 - protein, 20 aa, Homo sapiens
  Heavy chain CDR3 for antibody 1095 (IGHV1-f)
ATGLITFVRGVILTYRSFDY

SEQ ID NO: 2191 - protein, 9 aa, Homo sapiens
  Light chain CDR3 for antibody 1096 (IGKV1D-16)
QQYNSYPYT

SEQ ID NO: 2192 - protein, 16 aa, Homo sapiens
  Heavy chain CDR3 for antibody 1096 (IGHV3-20)
AREGYSSSWFDRNFDY

SEQ ID NO: 2193 - protein, 9 aa, Homo sapiens
  Light chain CDR3 for antibody 1097 (IGKV3-20)
QQYGSSPLT

SEQ ID NO: 2194 - protein, 16 aa, Homo sapiens
  Heavy chain CDR3 for antibody 1097 (IGHV1-24)
TTEGGTVDYYYYGMDV

SEQ ID NO: 2195 - protein, 9 aa, Homo sapiens
  Light chain CDR3 for antibody 1098 (IGKV1D-16)
QQYNSYPLT

SEQ ID NO: 2196 - protein, 21 aa, Homo sapiens
  Heavy chain CDR3 for antibody 1098 (IGHV3-33)
ARDEYYEIVTGYGYYHYGMDV

SEQ ID NO: 2197 - protein, 9 aa, Homo sapiens
  Light chain CDR3 for antibody 1099 (IGKV6-21)
HQSSSLPHT

SEQ ID NO: 2198 - protein, 12 aa, Homo sapiens
  Heavy chain CDR3 for antibody 1099 (IGHV3-33)
ARDIVGTSYFDY

SEQ ID NO: 2199 - protein, 9 aa, Homo sapiens
  Light chain CDR3 for antibody 1100 (IGKV1-17)
LQHNSYPYT

SEQ ID NO: 2200 - protein, 12 aa, Homo sapiens
  Heavy chain CDR3 for antibody 1100 (IGHV3-33)
ARDGYSSRNFDY

SEQ ID NO: 2201 - protein, 9 aa, Homo sapiens
  Light chain CDR3 for antibody 1101 (IGKV1-37)
QRTYNAPFT

SEQ ID NO: 2202 - protein, 17 aa, Homo sapiens
  Heavy chain CDR3 for antibody 1101 (IGHV3-33)
ARAYYDILTGYYIHCDY

SEQ ID NO: 2203 - protein, 9 aa, Homo sapiens
  Light chain CDR3 for antibody 1102 (IGKV6-21)
HQSDSLPHT

SEQ ID NO: 2204 - protein, 18 aa, Homo sapiens
  Heavy chain CDR3 for antibody 1102 (IGHV4-39)
ARYITMVRGAIITGPFDY

SEQ ID NO: 2205 - protein, 9 aa, Homo sapiens
  Light chain CDR3 for antibody 1103 (IGKV1-6)
LQDYNYPYT

SEQ ID NO: 2206 - protein, 13 aa, Homo sapiens
  Heavy chain CDR3 for antibody 1103 (IGHV1-18)
ARSITMVRGVIGY

SEQ ID NO: 2207 - protein, 9 aa, Homo sapiens
  Light chain CDR3 for antibody 1104 (IGKV3-20)
QQYGSSPYT

SEQ ID NO: 2208 - protein, 11 aa, Homo sapiens
  Heavy chain CDR3 for antibody 1104 (IGHV4-59)
ARSIRYSVFDY

SEQ ID NO: 2209 - protein, 9 aa, Homo sapiens
  Light chain CDR3 for antibody 1105 (IGKV3-20)
QQYGSSPYT

SEQ ID NO: 2210 - protein, 15 aa, Homo sapiens
  Heavy chain CDR3 for antibody 1105 (IGHV3-33)
ARRICSGGSCSLFDY

SEQ ID NO: 2211 - protein, 9 aa, Homo sapiens
  Light chain CDR3 for antibody 1106 (IGKV5-2)
LQHDNFPYT

SEQ ID NO: 2212 - protein, 17 aa, Homo sapiens
  Heavy chain CDR3 for antibody 1106 (IGHV3-33)
ARESLKLGIYYYYGMDV

SEQ ID NO: 2213 - protein, 9 aa, Homo sapiens
  Light chain CDR3 for antibody 1107 (IGKV1D-16)
QQYNSYPYT

SEQ ID NO: 2214 - protein, 13 aa, Homo sapiens
  Heavy chain CDR3 for antibody 1107 (IGHV4-39)
ARHEVMIRGVFDY

SEQ ID NO: 2215 - protein, 9 aa, Homo sapiens
  Light chain CDR3 for antibody 1108 (IGKV5-2)
LQHDNFPWT

SEQ ID NO: 2216 - protein, 7 aa, Homo sapiens
  Heavy chain CDR3 for antibody 1108 (IGHV1-46)
AREGGDY

SEQ ID NO: 2217 - protein, 9 aa, Homo sapiens
  Light chain CDR3 for antibody 1109 (IGKV5-2)
LQHDNFPYT

SEQ ID NO: 2218 - protein, 15 aa, Homo sapiens
  Heavy chain CDR3 for antibody 1109 (IGHV3-33)
ARDRGWKAPGYGMDV

SEQ ID NO: 2219 - protein, 9 aa, Homo sapiens
  Light chain CDR3 for antibody 1110 (IGKV5-2)
LQHDNFPYT

SEQ ID NO: 2220 - protein, 18 aa, Homo sapiens
  Heavy chain CDR3 for antibody 1110 (IGHV3-33)
ARGLLWFGVSYYYYGMDV

SEQ ID NO: 2221 - protein, 9 aa, Homo sapiens
  Light chain CDR3 for antibody 1111 (IGKV1-17)
LQHNSYPYT

SEQ ID NO: 2222 - protein, 16 aa, Homo sapiens
  Heavy chain CDR3 for antibody 1111 (IGHV3-33)
ARDKNTDYDILTGFDY

SEQ ID NO: 2223 - protein, 9 aa, Homo sapiens
  Light chain CDR3 for antibody 1112 (IGKV3-20)
QQYGSSPYT

SEQ ID NO: 2224 - protein, 10 aa, Homo sapiens
  Heavy chain CDR3 for antibody 1112 (IGHV3-33)
ARDVVVYFDY

SEQ ID NO: 2225 - protein, 9 aa, Homo sapiens
  Light chain CDR3 for antibody 1113 (IGKV1D-16)
QQYNSYPLT

SEQ ID NO: 2226 - protein, 15 aa, Homo sapiens
  Heavy chain CDR3 for antibody 1113 (IGHV3-33)
VRGYYYGSGSYPLNY

SEQ ID NO: 2227 - protein, 9 aa, Homo sapiens
  Light chain CDR3 for antibody 1114 (IGKV6-21)
HQSSSLPYT

SEQ ID NO: 2228 - protein, 18 aa, Homo sapiens
  Heavy chain CDR3 for antibody 1114 (IGHV3-23)
AKEGNYYGSGSYWGYFDP

SEQ ID NO: 2229 - protein, 9 aa, Homo sapiens
  Light chain CDR3 for antibody 1115 (IGKV5-2)
LQHDNFPYT

SEQ ID NO: 2230 - protein, 10 aa, Homo sapiens
  Heavy chain CDR3 for antibody 1115 (IGHV3-23)
AKEQWLVLDY

SEQ ID NO: 2231 - protein, 9 aa, Homo sapiens
  Light chain CDR3 for antibody 1116 (IGKV6-21)
HQSSSLPYT

SEQ ID NO: 2232 - protein, 13 aa, Homo sapiens
  Heavy chain CDR3 for antibody 1116 (IGHV3-23)
ASTGDSYYYGMDV

SEQ ID NO: 2233 - protein, 9 aa, Homo sapiens
  Light chain CDR3 for antibody 1117 (IGKV1-6)
LQDYNYPYT

SEQ ID NO: 2234 - protein, 15 aa, Homo sapiens
  Heavy chain CDR3 for antibody 1117 (IGHV3-74)
SRGSGSHYFYYGMDV

SEQ ID NO: 2235 - protein, 9 aa, Homo sapiens
  Light chain CDR3 for antibody 1118 (IGKV5-2)
LQHDNFPWT

SEQ ID NO: 2236 - protein, 16 aa, Homo sapiens
  Heavy chain CDR3 for antibody 1118 (IGHV1-24)
ATEDSSSTYYYYGLDV

SEQ ID NO: 2237 - protein, 9 aa, Homo sapiens
  Light chain CDR3 for antibody 1119 (IGKV6-21)
HQSSSLPHT

SEQ ID NO: 2238 - protein, 9 aa, Homo sapiens
  Heavy chain CDR3 for antibody 1119 (IGHV3-30)
ARELGYFDY

SEQ ID NO: 2239 - protein, 9 aa, Homo sapiens
  Light chain CDR3 for antibody 1120 (IGKV1-17)
LQHNSYPYT

SEQ ID NO: 2240 - protein, 13 aa, Homo sapiens
  Heavy chain CDR3 for antibody 1120 (IGHV3-33)
ARGDNWNDGGFDY

SEQ ID NO: 2241 - protein, 9 aa, Homo sapiens
  Light chain CDR3 for antibody 1121 (IGKV5-2)
LQHDNFPYT

SEQ ID NO: 2242 - protein, 14 aa, Homo sapiens
  Heavy chain CDR3 for antibody 1121 (IGHV3-33)
ARTTAAAGPRDFQH

SEQ ID NO: 2243 - protein, 9 aa, Homo sapiens
  Light chain CDR3 for antibody 1122 (IGKV6-21)
HQSSSLPYT

SEQ ID NO: 2244 - protein, 13 aa, Homo sapiens
  Heavy chain CDR3 for antibody 1122 (IGHV3-33)
ARRATLVRGVFDP

SEQ ID NO: 2245 - protein, 9 aa, Homo sapiens
  Light chain CDR3 for antibody 1123 (IGKV6-21)
HQSSSLPYT

SEQ ID NO: 2246 - protein, 8 aa, Homo sapiens
  Heavy chain CDR3 for antibody 1123 (IGHV3-23)
AETFLFDY

SEQ ID NO: 2247 - protein, 9 aa, Homo sapiens
  Light chain CDR3 for antibody 1124 (IGKV6-21)
HQSSSLPYT

SEQ ID NO: 2248 - protein, 13 aa, Homo sapiens
  Heavy chain CDR3 for antibody 1124 (IGHV3-11)
ARDEGYRGYVLDT

SEQ ID NO: 2249 - protein, 9 aa, Homo sapiens
  Light chain CDR3 for antibody 1125 (IGKV3-20)
QQYGSSPYT

SEQ ID NO: 2250 - protein, 14 aa, Homo sapiens
  Heavy chain CDR3 for antibody 1125 (IGHV3-33)
ARQYSYGYPYYFDY

SEQ ID NO: 2251 - protein, 9 aa, Homo sapiens
  Light chain CDR3 for antibody 1126 (IGKV3-20)
QLSGSSLLT

SEQ ID NO: 2252 - protein, 12 aa, Homo sapiens
  Heavy chain CDR3 for antibody 1126 (IGHV4-39)
ALDEWHPSWYKY

SEQ ID NO: 2253 - protein, 9 aa, Homo sapiens
  Light chain CDR3 for antibody 1127 (IGKV6-21)
HQSGSFPRT

SEQ ID NO: 2254 - protein, 12 aa, Homo sapiens
  Heavy chain CDR3 for antibody 1127 (IGHV3-11)
VRVLLWFGESDY

SEQ ID NO: 2255 - protein, 9 aa, Homo sapiens
  Light chain CDR3 for antibody 1128 (IGKV6-21)
HQSSSLPYT

SEQ ID NO: 2256 - protein, 18 aa, Homo sapiens
  Heavy chain CDR3 for antibody 1128 (IGHV3-33)
ARDGYSGYDYYYYYGMDV

SEQ ID NO: 2257 - protein, 9 aa, Homo sapiens
  Light chain CDR3 for antibody 1129 (IGKV6-21)
HQSSSLPYT

SEQ ID NO: 2258 - protein, 13 aa, Homo sapiens
  Heavy chain CDR3 for antibody 1129 (IGHV3-33)
ARRYRSGWYPFDY

SEQ ID NO: 2259 - protein, 9 aa, Homo sapiens
  Light chain CDR3 for antibody 1130 (IGKV1D-16)
QQYNSYPYT

SEQ ID NO: 2260 - protein, 18 aa, Homo sapiens
  Heavy chain CDR3 for antibody 1130 (IGHV3-33)
ARDQYSGYDFYYYYGMDV

SEQ ID NO: 2261 - protein, 9 aa, Homo sapiens
  Light chain CDR3 for antibody 1131 (IGKV1-16)
QQYNSYPIT

SEQ ID NO: 2262 - protein, 12 aa, Homo sapiens
  Heavy chain CDR3 for antibody 1131 (IGHV3-33)
ARGGFDWGSIDY

SEQ ID NO: 2263 - protein, 9 aa, Homo sapiens
  Light chain CDR3 for antibody 1132 (IGKV3-20)
QQYGSSPYT

SEQ ID NO: 2264 - protein, 14 aa, Homo sapiens
  Heavy chain CDR3 for antibody 1132 (IGHV3-33)
ARRGSPLRPSHLDV

SEQ ID NO: 2265 - protein, 9 aa, Homo sapiens
  Light chain CDR3 for antibody 1133 (IGKV1D-16)
QQYNSYPLT

SEQ ID NO: 2266 - protein, 14 aa, Homo sapiens
  Heavy chain CDR3 for antibody 1133 (IGHV3-33)
ARRGSPLRPSHLDV

SEQ ID NO: 2267 - protein, 9 aa, Homo sapiens
  Light chain CDR3 for antibody 1134 (IGKV5-2)
LQHDNFPYT

SEQ ID NO: 2268 - protein, 8 aa, Homo sapiens
  Heavy chain CDR3 for antibody 1134 (IGHV3-23)
AETFLFDY

SEQ ID NO: 2269 - protein, 9 aa, Homo sapiens
  Light chain CDR3 for antibody 1135 (IGKV1-17)
LQHNSYPYT

SEQ ID NO: 2270 - protein, 23 aa, Homo sapiens
  Heavy chain CDR3 for antibody 1135 (IGHV3-11)
ARDEGVTMVRGVISYYYYYGMDV

SEQ ID NO: 2271 - protein, 9 aa, Homo sapiens
  Light chain CDR3 for antibody 1136 (IGKV6-21)
HQSSSLPYT

SEQ ID NO: 2272 - protein, 20 aa, Homo sapiens
  Heavy chain CDR3 for antibody 1136 (IGHV3-11)
ARGGATLIRGLIDYYYGMDV

SEQ ID NO: 2273 - protein, 9 aa, Homo sapiens
  Light chain CDR3 for antibody 1137 (IGKV1-39)
QQSYSTPWT

SEQ ID NO: 2274 - protein, 19 aa, Homo sapiens
  Heavy chain CDR3 for antibody 1137 (IGHV3-33)
ARGSDYDILTGYSSDAFDI

SEQ ID NO: 2275 - protein, 9 aa, Homo sapiens
  Light chain CDR3 for antibody 1138 (IGKV1-9)
QQLTSFPRT

SEQ ID NO: 2276 - protein, 10 aa, Homo sapiens
  Heavy chain CDR3 for antibody 1138 (IGHV3-33)
ARDLRADFDY

SEQ ID NO: 2277 - protein, 9 aa, Homo sapiens
  Light chain CDR3 for antibody 1139 (IGKV1-9)
QQLNSYPLT

SEQ ID NO: 2278 - protein, 17 aa, Homo sapiens
  Heavy chain CDR3 for antibody 1139 (IGHV4-59)
ARRITMVREIIITAFDY

SEQ ID NO: 2279 - protein, 9 aa, Homo sapiens
  Light chain CDR3 for antibody 1140 (IGKV1-17)
LQHNSYPYT

SEQ ID NO: 2280 - protein, 8 aa, Homo sapiens
  Heavy chain CDR3 for antibody 1140 (IGHV3-33)
ARDDPPRY

SEQ ID NO: 2281 - protein, 9 aa, Homo sapiens
  Light chain CDR3 for antibody 1141 (IGKV6-21)
HQSSSLPYT

SEQ ID NO: 2282 - protein, 12 aa, Homo sapiens
  Heavy chain CDR3 for antibody 1141 (IGHV3-33)
ARDRAYRGSLDY

SEQ ID NO: 2283 - protein, 9 aa, Homo sapiens
  Light chain CDR3 for antibody 1142 (IGKV5-2)
LQHDNFPYT

SEQ ID NO: 2284 - protein, 11 aa, Homo sapiens
  Heavy chain CDR3 for antibody 1142 (IGHV3-33)
AREAANWGFDY

SEQ ID NO: 2285 - protein, 9 aa, Homo sapiens
  Light chain CDR3 for antibody 1143 (IGKV6-21)
HQSSSLPYT

SEQ ID NO: 2286 - protein, 7 aa, Homo sapiens
  Heavy chain CDR3 for antibody 1143 (IGHV1-46)
AREGGDY

SEQ ID NO: 2287 - protein, 9 aa, Homo sapiens
  Light chain CDR3 for antibody 1144 (IGKV1-17)
LQHNSYPYT

SEQ ID NO: 2288 - protein, 15 aa, Homo sapiens
  Heavy chain CDR3 for antibody 1144 (IGHV3-33)
AREGLRYFHYYGMDV

SEQ ID NO: 2289 - protein, 9 aa, Homo sapiens
  Light chain CDR3 for antibody 1145 (IGKV1-17)
LQHNSYPYT

SEQ ID NO: 2290 - protein, 14 aa, Homo sapiens
  Heavy chain CDR3 for antibody 1145 (IGHV3-33)
VRDAMGATTAWFDP

SEQ ID NO: 2291 - protein, 9 aa, Homo sapiens
  Light chain CDR3 for antibody 1146 (IGKV3-20)
QQYGSSPYT

SEQ ID NO: 2292 - protein, 21 aa, Homo sapiens
  Heavy chain CDR3 for antibody 1146 (IGHV3-33)
ARDGGITMGRGVYYYYYGMDV

SEQ ID NO: 2293 - protein, 9 aa, Homo sapiens
  Light chain CDR3 for antibody 1147 (IGKV5-2)
LQHDNFPYT

SEQ ID NO: 2294 - protein, 12 aa, Homo sapiens
  Heavy chain CDR3 for antibody 1147 (IGHV3-33)
ARDRAYRGSLDY

SEQ ID NO: 2295 - protein, 9 aa, Homo sapiens
  Light chain CDR3 for antibody 1148 (IGKV3-20)
QQYGSSPYT

SEQ ID NO: 2296 - protein, 13 aa, Homo sapiens
  Heavy chain CDR3 for antibody 1148 (IGHV3-33)
AKEDGDYHHYFDY

SEQ ID NO: 2297 - protein, 9 aa, Homo sapiens
  Light chain CDR3 for antibody 1149 (IGKV6-21)
HQSSSLPYT

SEQ ID NO: 2298 - protein, 12 aa, Homo sapiens
  Heavy chain CDR3 for antibody 1149 (IGHV3-64)
ARVNSGSPYFDY

SEQ ID NO: 2299 - protein, 9 aa, Homo sapiens
  Light chain CDR3 for antibody 1150 (IGKV1D-16)
QQYNSYPYT

SEQ ID NO: 2300 - protein, 14 aa, Homo sapiens
  Heavy chain CDR3 for antibody 1150 (IGHV1-18)
ARCFGSGSYGWFDP

SEQ ID NO: 2301 - protein, 9 aa, Homo sapiens
  Light chain CDR3 for antibody 1151 (IGKV5-2)
LQHDNFPWT

SEQ ID NO: 2302 - protein, 17 aa, Homo sapiens
  Heavy chain CDR3 for antibody 1151 (IGHV1-18)
ARERYYGSGIYKYAMDV

SEQ ID NO: 2303 - protein, 9 aa, Homo sapiens
  Light chain CDR3 for antibody 1152 (IGKV6-21)
HQSSSLPQT

SEQ ID NO: 2304 - protein, 19 aa, Homo sapiens
  Heavy chain CDR3 for antibody 1152 (IGHV3-33)
ARDKYYDILTGYPWNGMDV

SEQ ID NO: 2305 - protein, 9 aa, Homo sapiens
  Light chain CDR3 for antibody 1153 (IGKV1-6)
LQDYNYPYT

SEQ ID NO: 2306 - protein, 14 aa, Homo sapiens
  Heavy chain CDR3 for antibody 1153 (IGHV3-20)
ARDGGSTCYDWFDP

SEQ ID NO: 2307 - protein, 9 aa, Homo sapiens
  Light chain CDR3 for antibody 1154 (IGKV1-6)
LQDYSYPWT

SEQ ID NO: 2308 - protein, 18 aa, Homo sapiens
  Heavy chain CDR3 for antibody 1154 (IGHV3-23)
AREYYDFLTGYYKGAFDI

SEQ ID NO: 2309 - protein, 9 aa, Homo sapiens
  Light chain CDR3 for antibody 1155 (IGKV1D-16)
QQYNSYPYT

SEQ ID NO: 2310 - protein, 13 aa, Homo sapiens
  Heavy chain CDR3 for antibody 1155 (IGHV3-23)
AKDRGLRYYGMDV

SEQ ID NO: 2311 - protein, 9 aa, Homo sapiens
  Light chain CDR3 for antibody 1156 (IGKV1-6)
LQDYNYPRT

SEQ ID NO: 2312 - protein, 17 aa, Homo sapiens
  Heavy chain CDR3 for antibody 1156 (IGHV1-18)
ARERYYGSGSYKYNMDV

SEQ ID NO: 2313 - protein, 9 aa, Homo sapiens
  Light chain CDR3 for antibody 1157 (IGKV1D-13)
QQFNNYPYT

SEQ ID NO: 2314 - protein, 12 aa, Homo sapiens
  Heavy chain CDR3 for antibody 1157 (IGHV3-33)
TRGYSSKSYFDY

SEQ ID NO: 2315 - protein, 9 aa, Homo sapiens
  Light chain CDR3 for antibody 1158 (IGKV6-21)
HQSSSLPYT

SEQ ID NO: 2316 - protein, 11 aa, Homo sapiens
  Heavy chain CDR3 for antibody 1158 (IGHV3-33)
ARDKSSGWSDY

SEQ ID NO: 2317 - protein, 9 aa, Homo sapiens
  Light chain CDR3 for antibody 1159 (IGKV6-21)
HQSSSLPYT

SEQ ID NO: 2318 - protein, 12 aa, Homo sapiens
  Heavy chain CDR3 for antibody 1159 (IGHV3-33)
ARVDAAAPYFDY

SEQ ID NO: 2319 - protein, 9 aa, Homo sapiens
  Light chain CDR3 for antibody 1160 (IGKV1D-16)
QQYNSYPLT

SEQ ID NO: 2320 - protein, 15 aa, Homo sapiens
  Heavy chain CDR3 for antibody 1160 (IGHV3-33)
VCVLYDYGDYVGFDY

SEQ ID NO: 2321 - protein, 9 aa, Homo sapiens
  Light chain CDR3 for antibody 1161 (IGKV5-2)
LQHDNFPWT

SEQ ID NO: 2322 - protein, 9 aa, Homo sapiens
  Heavy chain CDR3 for antibody 1161 (IGHV4-59)
ARGGASFDY

SEQ ID NO: 2323 - protein, 9 aa, Homo sapiens
  Light chain CDR3 for antibody 1162 (IGKV3D-7)
QQDYNFPLT

SEQ ID NO: 2324 - protein, 12 aa, Homo sapiens
  Heavy chain CDR3 for antibody 1162 (IGHV4-61)
ARVVSSGWYFDY

SEQ ID NO: 2325 - protein, 9 aa, Homo sapiens
  Light chain CDR3 for antibody 1163 (IGKV2-30)
MQGTHWPLT

SEQ ID NO: 2326 - protein, 13 aa, Homo sapiens
  Heavy chain CDR3 for antibody 1163 (IGHV4-59)
ARDAGYSSSWFDY

SEQ ID NO: 2327 - protein, 9 aa, Homo sapiens
  Light chain CDR3 for antibody 1164 (IGKV1-9)
QQLNSYPLT

SEQ ID NO: 2328 - protein, 11 aa, Homo sapiens
  Heavy chain CDR3 for antibody 1164 (IGHV4-59)
AREMGHDIFDI

SEQ ID NO: 2329 - protein, 9 aa, Homo sapiens
  Light chain CDR3 for antibody 1165 (IGKV6-21)
HQSSSLPYT

SEQ ID NO: 2330 - protein, 12 aa, Homo sapiens
  Heavy chain CDR3 for antibody 1165 (IGHV3-23)
AKDGWFGESLDY

SEQ ID NO: 2331 - protein, 9 aa, Homo sapiens
  Light chain CDR3 for antibody 1166 (IGKV1D-13)
QQFNNYPYT

SEQ ID NO: 2332 - protein, 15 aa, Homo sapiens
  Heavy chain CDR3 for antibody 1166 (IGHV3-33)
ARDTGYSSSWNWFDP

SEQ ID NO: 2333 - protein, 9 aa, Homo sapiens
  Light chain CDR3 for antibody 1167 (IGKV6-21)
HQSSSLPYT

SEQ ID NO: 2334 - protein, 14 aa, Homo sapiens
  Heavy chain CDR3 for antibody 1167 (IGHV3-33)
ARQYSYGYPYYFDY

SEQ ID NO: 2335 - protein, 9 aa, Homo sapiens
  Light chain CDR3 for antibody 1168 (IGKV1D-13)
QQFNNYPRT

SEQ ID NO: 2336 - protein, 20 aa, Homo sapiens
  Heavy chain CDR3 for antibody 1168 (IGHV3-33)
ARDNDSSGYYDYYYYYGMDV

SEQ ID NO: 2337 - protein, 9 aa, Homo sapiens
  Light chain CDR3 for antibody 1169 (IGKV1-6)
LQDYNYPYT

SEQ ID NO: 2338 - protein, 13 aa, Homo sapiens
  Heavy chain CDR3 for antibody 1169 (IGHV3-33)
AREYFDWLLPLDY

SEQ ID NO: 2339 - protein, 9 aa, Homo sapiens
  Light chain CDR3 for antibody 1170 (IGKV1D-16)
QQYNSYPYT

SEQ ID NO: 2340 - protein, 14 aa, Homo sapiens
  Heavy chain CDR3 for antibody 1170 (IGHV3-20)
ARDGGSTCYDWFDP

SEQ ID NO: 2341 - protein, 11 aa, Homo sapiens
  Light chain CDR3 for antibody 1171 (IGKV3-11)
QQRSNWPPTWT

SEQ ID NO: 2342 - protein, 18 aa, Homo sapiens
  Heavy chain CDR3 for antibody 1171 (IGHV4-59)
AREGDYVWGSYRPNWFDP

SEQ ID NO: 2343 - protein, 9 aa, Homo sapiens
  Light chain CDR3 for antibody 1172 (IGKV5-2)
LQHDNFPYT

SEQ ID NO: 2344 - protein, 20 aa, Homo sapiens
  Heavy chain CDR3 for antibody 1172 (IGHV3-23)
AKDREMAATSHYYYYYGMDV

SEQ ID NO: 2345 - protein, 9 aa, Homo sapiens
  Light chain CDR3 for antibody 1173 (IGKV6-21)
HQSSSLPYT

SEQ ID NO: 2346 - protein, 12 aa, Homo sapiens
  Heavy chain CDR3 for antibody 1173 (IGHV4-61)
ARVYSSGWLFDY

SEQ ID NO: 2347 - protein, 9 aa, Homo sapiens
  Light chain CDR3 for antibody 1174 (IGKV1D-16)
QQYNSYPYT

SEQ ID NO: 2348 - protein, 12 aa, Homo sapiens
  Heavy chain CDR3 for antibody 1174 (IGHV4-61)
ARVDSSGWFFDY

SEQ ID NO: 2349 - protein, 9 aa, Homo sapiens
  Light chain CDR3 for antibody 1175 (IGKV1-39)
QQSYSTPYT

SEQ ID NO: 2350 - protein, 16 aa, Homo sapiens
  Heavy chain CDR3 for antibody 1175 (IGHV1-24)
ATDGYYYGSGSYLFDY

SEQ ID NO: 2351 - protein, 9 aa, Homo sapiens
  Light chain CDR3 for antibody 1176 (IGKV5-2)
LQHDNFPWT

SEQ ID NO: 2352 - protein, 17 aa, Homo sapiens
  Heavy chain CDR3 for antibody 1176 (IGHV4-39)
ARVLRYFDWLSHDAFDI

SEQ ID NO: 2353 - protein, 9 aa, Homo sapiens
  Light chain CDR3 for antibody 1177 (IGKV5-2)
LQHDNFPYT

SEQ ID NO: 2354 - protein, 11 aa, Homo sapiens
  Heavy chain CDR3 for antibody 1177 (IGHV3-33)
ARDTWDDYFDY

SEQ ID NO: 2355 - protein, 10 aa, Homo sapiens
  Light chain CDR3 for antibody 1178 (IGKV3-11)
QQRSNWPPWT

SEQ ID NO: 2356 - protein, 15 aa, Homo sapiens
  Heavy chain CDR3 for antibody 1178 (IGHV5-51)
AIRYYSSGRYDAFDI

SEQ ID NO: 2357 - protein, 9 aa, Homo sapiens
  Light chain CDR3 for antibody 1179 (IGKV5-2)
LQHDNFPYT

SEQ ID NO: 2358 - protein, 13 aa, Homo sapiens
  Heavy chain CDR3 for antibody 1179 (IGHV3-33)
VSTGDSYYYVMDV

SEQ ID NO: 2359 - protein, 9 aa, Homo sapiens
  Light chain CDR3 for antibody 1180 (IGKV6-21)
HQSSSLPYT

SEQ ID NO: 2360 - protein, 13 aa, Homo sapiens
  Heavy chain CDR3 for antibody 1180 (IGHV3-23)
ARAFFMVRGVIDF

SEQ ID NO: 2361 - protein, 9 aa, Homo sapiens
  Light chain CDR3 for antibody 1181 (IGKV5-2)
LQHDNFPYT

SEQ ID NO: 2362 - protein, 17 aa, Homo sapiens
  Heavy chain CDR3 for antibody 1181 (IGHV3-33)
ARVYYDILTGYSPAFDI

SEQ ID NO: 2363 - protein, 9 aa, Homo sapiens
  Light chain CDR3 for antibody 1182 (IGKV1-17)
LQHNSYPYT

SEQ ID NO: 2364 - protein, 11 aa, Homo sapiens
  Heavy chain CDR3 for antibody 1182 (IGHV4-59)
ARSLRYSFFDY

SEQ ID NO: 2365 - protein, 9 aa, Homo sapiens
  Light chain CDR3 for antibody 1183 (IGKV1-9)
QQLNSYPLT

SEQ ID NO: 2366 - protein, 9 aa, Homo sapiens
  Heavy chain CDR3 for antibody 1183 (IGHV3-13)
ARDRWYFDL

SEQ ID NO: 2367 - protein, 9 aa, Homo sapiens
  Light chain CDR3 for antibody 1184 (IGKV5-2)
LQHDNFPWT

SEQ ID NO: 2368 - protein, 9 aa, Homo sapiens
  Heavy chain CDR3 for antibody 1184 (IGHV1-8)
ARGRLDFDY

SEQ ID NO: 2369 - protein, 9 aa, Homo sapiens
  Light chain CDR3 for antibody 1185 (IGKV1-9)
QQLNSYPRT

SEQ ID NO: 2370 - protein, 16 aa, Homo sapiens
  Heavy chain CDR3 for antibody 1185 (IGHV3-33)
ARAPGGDYYFYFGMDV

SEQ ID NO: 2371 - protein, 9 aa, Homo sapiens
  Light chain CDR3 for antibody 1186 (IGKV5-2)
LQHDNFPYT

SEQ ID NO: 2372 - protein, 15 aa, Homo sapiens
  Heavy chain CDR3 for antibody 1186 (IGHV3-33)
ARDSRPEIIGPPFDY

SEQ ID NO: 2373 - protein, 9 aa, Homo sapiens
  Light chain CDR3 for antibody 1187 (IGKV1-17)
LQHNSYPYT

SEQ ID NO: 2374 - protein, 16 aa, Homo sapiens
  Heavy chain CDR3 for antibody 1187 (IGHV3-33)
ARDGSMVRRIHDAFDF

SEQ ID NO: 2375 - protein, 9 aa, Homo sapiens
  Light chain CDR3 for antibody 1188 (IGKV1-39)
QQSYSTPLT

SEQ ID NO: 2376 - protein, 17 aa, Homo sapiens
  Heavy chain CDR3 for antibody 1188 (IGHV1-18)
ARDEGYDILTGYPHFDY

SEQ ID NO: 2377 - protein, 9 aa, Homo sapiens
  Light chain CDR3 for antibody 1189 (IGKV6-21)
HQSSSLPFT

SEQ ID NO: 2378 - protein, 10 aa, Homo sapiens
  Heavy chain CDR3 for antibody 1189 (IGHV3-33)
ARDYGDYFDY

SEQ ID NO: 2379 - protein, 9 aa, Homo sapiens
  Light chain CDR3 for antibody 1190 (IGKV6-21)
HQSSSLPYT

SEQ ID NO: 2380 - protein, 11 aa, Homo sapiens
  Heavy chain CDR3 for antibody 1190 (IGHV3-33)
ARDTWDDYFDY

SEQ ID NO: 2381 - protein, 9 aa, Homo sapiens
  Light chain CDR3 for antibody 1191 (IGKV5-2)
LQHDNFPYT

SEQ ID NO: 2382 - protein, 18 aa, Homo sapiens
  Heavy chain CDR3 for antibody 1191 (IGHV3-33)
ARDGYSGYDYYYYYGMDV

SEQ ID NO: 2383 - protein, 9 aa, Homo sapiens
  Light chain CDR3 for antibody 1192 (IGKV1D-16)
QQYNSYPYT

SEQ ID NO: 2384 - protein, 15 aa, Homo sapiens
  Heavy chain CDR3 for antibody 1192 (IGHV4-39)
ARRDYDILTGYLFDY

SEQ ID NO: 2385 - protein, 9 aa, Homo sapiens
  Light chain CDR3 for antibody 1193 (IGKV5-2)
LQHDNFPYT

SEQ ID NO: 2386 - protein, 11 aa, Homo sapiens
  Heavy chain CDR3 for antibody 1193 (IGHV3-33)
ARARYTTGLDY

SEQ ID NO: 2387 - protein, 9 aa, Homo sapiens
  Light chain CDR3 for antibody 1194 (IGKV1-9)
QQVNSYPFT

SEQ ID NO: 2388 - protein, 14 aa, Homo sapiens
  Heavy chain CDR3 for antibody 1194 (IGHV3-23)
AKGGGVGAYNWFDP

SEQ ID NO: 2389 - protein, 9 aa, Homo sapiens
  Light chain CDR3 for antibody 1195 (IGKV3D-7)
QQDYNFALT

SEQ ID NO: 2390 - protein, 9 aa, Homo sapiens
  Heavy chain CDR3 for antibody 1195 (IGHV3-33)
ASHSSGEDY

SEQ ID NO: 2391 - protein, 9 aa, Homo sapiens
  Light chain CDR3 for antibody 1196 (IGKV3-20)
QQYGSSPYT

SEQ ID NO: 2392 - protein, 18 aa, Homo sapiens
  Heavy chain CDR3 for antibody 1196 (IGHV3-33)
ARGGYSSGWDYYYYGMDV

SEQ ID NO: 2393 - protein, 9 aa, Homo sapiens
  Light chain CDR3 for antibody 1197 (IGKV1-6)
LQDYNYPYT

SEQ ID NO: 2394 - protein, 18 aa, Homo sapiens
  Heavy chain CDR3 for antibody 1197 (IGHV6-1)
ARDQYSYGPYYYYYGMDV

SEQ ID NO: 2395 - protein, 9 aa, Homo sapiens
  Light chain CDR3 for antibody 1198 (IGKV1-17)
LQHNSYPWT

SEQ ID NO: 2396 - protein, 14 aa, Homo sapiens
  Heavy chain CDR3 for antibody 1198 (IGHV3-33)
ARDYYDSGSYYFDY

SEQ ID NO: 2397 - protein, 9 aa, Homo sapiens
  Light chain CDR3 for antibody 1199 (IGKV5-2)
LQHDNFPYT

SEQ ID NO: 2398 - protein, 21 aa, Homo sapiens
  Heavy chain CDR3 for antibody 1199 (IGHV3-23)
AKDIDYYGSGSYPLYYYGMDV

SEQ ID NO: 2399 - protein, 9 aa, Homo sapiens
  Light chain CDR3 for antibody 1200 (IGKV3-20)
QQYGSSPYT

SEQ ID NO: 2400 - protein, 16 aa, Homo sapiens
  Heavy chain CDR3 for antibody 1200 (IGHV3-33)
ARGYDMLTGDYYGMDV

SEQ ID NO: 2401 - protein, 9 aa, Homo sapiens
  Light chain CDR3 for antibody 1201 (IGKV1-39)
QQSYSTPLT

SEQ ID NO: 2402 - protein, 11 aa, Homo sapiens
  Heavy chain CDR3 for antibody 1201 (IGHV3-33)
ARDRVLTPFDY

SEQ ID NO: 2403 - protein, 9 aa, Homo sapiens
  Light chain CDR3 for antibody 1202 (IGKV1-17)
LQHNSYPYT

SEQ ID NO: 2404 - protein, 12 aa, Homo sapiens
  Heavy chain CDR3 for antibody 1202 (IGHV3-23)
AKEYDILTGYFH

SEQ ID NO: 2405 - protein, 9 aa, Homo sapiens
  Light chain CDR3 for antibody 1203 (IGKV1D-16)
QQYNSYPYT

SEQ ID NO: 2406 - protein, 14 aa, Homo sapiens
  Heavy chain CDR3 for antibody 1203 (IGHV1-46)
ARKGIVGGFDAFDV

SEQ ID NO: 2407 - protein, 9 aa, Homo sapiens
  Light chain CDR3 for antibody 1204 (IGKV1-39)
QQSYSTPLT

SEQ ID NO: 2408 - protein, 12 aa, Homo sapiens
  Heavy chain CDR3 for antibody 1204 (IGHV3-13)
VREAGIPDAFDI

SEQ ID NO: 2409 - protein, 9 aa, Homo sapiens
  Light chain CDR3 for antibody 1205 (IGKV5-2)
LQHDNFPWT

SEQ ID NO: 2410 - protein, 16 aa, Homo sapiens
  Heavy chain CDR3 for antibody 1205 (IGHV3-33)
ARAVYYGSGSSLIMDV

SEQ ID NO: 2411 - protein, 9 aa, Homo sapiens
  Light chain CDR3 for antibody 1206 (IGKV1D-16)
QQYNSYPYT

SEQ ID NO: 2412 - protein, 12 aa, Homo sapiens
  Heavy chain CDR3 for antibody 1206 (IGHV3-33)
AREGIAVAGVDP

SEQ ID NO: 2413 - protein, 9 aa, Homo sapiens
  Light chain CDR3 for antibody 1207 (IGKV3-20)
QQYGSSPYT

SEQ ID NO: 2414 - protein, 21 aa, Homo sapiens
  Heavy chain CDR3 for antibody 1207 (IGHV3-33)
ARKRLYDILTGYYKAYYGMDV

SEQ ID NO: 2415 - protein, 9 aa, Homo sapiens
  Light chain CDR3 for antibody 1208 (IGKV1-17)
LQHNSYPYT

SEQ ID NO: 2416 - protein, 17 aa, Homo sapiens
  Heavy chain CDR3 for antibody 1208 (IGHV3-33)
AREDYDILTGYPFYFDY

SEQ ID NO: 2417 - protein, 9 aa, Homo sapiens
  Light chain CDR3 for antibody 1209 (IGKV1-17)
LQHNSYPYT

SEQ ID NO: 2418 - protein, 18 aa, Homo sapiens
  Heavy chain CDR3 for antibody 1209 (IGHV3-33)
AREGDYYGSGGFPNWFDP

SEQ ID NO: 2419 - protein, 9 aa, Homo sapiens
  Light chain CDR3 for antibody 1210 (IGKV5-2)
LQHDNFPWT

SEQ ID NO: 2420 - protein, 12 aa, Homo sapiens
  Heavy chain CDR3 for antibody 1210 (IGHV4-34)
ASNFYYYYGMDV

SEQ ID NO: 2421 - protein, 9 aa, Homo sapiens
  Light chain CDR3 for antibody 1211 (IGKV6-21)
HQSSSLPYT

SEQ ID NO: 2422 - protein, 16 aa, Homo sapiens
  Heavy chain CDR3 for antibody 1211 (IGHV3-33)
ARGGRSDWLYYYGMDV

SEQ ID NO: 2423 - protein, 9 aa, Homo sapiens
  Light chain CDR3 for antibody 1212 (IGKV5-2)
LQHDNFPYT

SEQ ID NO: 2424 - protein, 10 aa, Homo sapiens
  Heavy chain CDR3 for antibody 1212 (IGHV3-33)
ARDGSGSQPI

SEQ ID NO: 2425 - protein, 9 aa, Homo sapiens
  Light chain CDR3 for antibody 1213 (IGKV3-20)
QQYGSSPYT

SEQ ID NO: 2426 - protein, 12 aa, Homo sapiens
  Heavy chain CDR3 for antibody 1213 (IGHV3-33)
AREGTRWVYFDY

SEQ ID NO: 2427 - protein, 9 aa, Homo sapiens
  Light chain CDR3 for antibody 1214 (IGKV5-2)
LQHDNFPWT

SEQ ID NO: 2428 - protein, 13 aa, Homo sapiens
  Heavy chain CDR3 for antibody 1214 (IGHV3-33)
ARAFTMVRGVIDY

SEQ ID NO: 2429 - protein, 9 aa, Homo sapiens
  Light chain CDR3 for antibody 1215 (IGKV3-20)
QQYGSSPYT

SEQ ID NO: 2430 - protein, 15 aa, Homo sapiens
  Heavy chain CDR3 for antibody 1215 (IGHV3-33)
VCVLYDYGDYVGFDY

SEQ ID NO: 2431 - protein, 9 aa, Homo sapiens
  Light chain CDR3 for antibody 1216 (IGKV2-30)
MQGTHWPLT

SEQ ID NO: 2432 - protein, 13 aa, Homo sapiens
  Heavy chain CDR3 for antibody 1216 (IGHV3-33)
ARDYCGGDCYLDY

SEQ ID NO: 2433 - protein, 8 aa, Homo sapiens
  Light chain CDR3 for antibody 1217 (IGKV1D-13)
QQFNNYPT

SEQ ID NO: 2434 - protein, 11 aa, Homo sapiens
  Heavy chain CDR3 for antibody 1217 (IGHV3-33)
ARDRSSGPFDY

SEQ ID NO: 2435 - protein, 9 aa, Homo sapiens
  Light chain CDR3 for antibody 1218 (IGKV3-20)
QQYGSSPYT

SEQ ID NO: 2436 - protein, 11 aa, Homo sapiens
  Heavy chain CDR3 for antibody 1218 (IGHV3-33)
ARARYTTGLDY

SEQ ID NO: 2437 - protein, 9 aa, Homo sapiens
  Light chain CDR3 for antibody 1219 (IGKV3-20)
QHYGSSPYT

SEQ ID NO: 2438 - protein, 13 aa, Homo sapiens
  Heavy chain CDR3 for antibody 1219 (IGHV4-59)
ARGYYDIFGWFDP

SEQ ID NO: 2439 - protein, 9 aa, Homo sapiens
  Light chain CDR3 for antibody 1220 (IGKV1-16)
QQYNSYPYT

SEQ ID NO: 2440 - protein, 14 aa, Homo sapiens
  Heavy chain CDR3 for antibody 1220 (IGHV4-39)
ARHGYYGSSNWFDP

SEQ ID NO: 2441 - protein, 9 aa, Homo sapiens
  Light chain CDR3 for antibody 1221 (IGKV5-2)
LQHDNFPYT

SEQ ID NO: 2442 - protein, 17 aa, Homo sapiens
  Heavy chain CDR3 for antibody 1221 (IGHV3-33)
ARGEQWLGYYYYYGMDV

SEQ ID NO: 2443 - protein, 9 aa, Homo sapiens
  Light chain CDR3 for antibody 1222 (IGKV5-2)
LQHDNFPYT

SEQ ID NO: 2444 - protein, 13 aa, Homo sapiens
  Heavy chain CDR3 for antibody 1222 (IGHV3-33)
ARTDYYFYYGLDV

SEQ ID NO: 2445 - protein, 9 aa, Homo sapiens
  Light chain CDR3 for antibody 1223 (IGKV5-2)
LQHDNFPWT

SEQ ID NO: 2446 - protein, 13 aa, Homo sapiens
  Heavy chain CDR3 for antibody 1223 (IGHV4-39)
ARHHYGSGSLRDY

SEQ ID NO: 2447 - protein, 9 aa, Homo sapiens
  Light chain CDR3 for antibody 1224 (IGKV1-6)
LQDYNYPYT

SEQ ID NO: 2448 - protein, 16 aa, Homo sapiens
  Heavy chain CDR3 for antibody 1224 (IGHV1-8)
AREGTMVRGVTYAFDI

SEQ ID NO: 2449 - protein, 9 aa, Homo sapiens
  Light chain CDR3 for antibody 1225 (IGKV1D-16)
QQYNSYPYT

SEQ ID NO: 2450 - protein, 14 aa, Homo sapiens
  Heavy chain CDR3 for antibody 1225 (IGHV3-33)
ARSTLVRGANWFDP

SEQ ID NO: 2451 - protein, 9 aa, Homo sapiens
  Light chain CDR3 for antibody 1226 (IGKV1D-16)
QQYNSYPLT

SEQ ID NO: 2452 - protein, 14 aa, Homo sapiens
  Heavy chain CDR3 for antibody 1226 (IGHV3-33)
VRDQGSMVRGGGDY

SEQ ID NO: 2453 - protein, 9 aa, Homo sapiens
  Light chain CDR3 for antibody 1227 (IGKV1D-13)
QQFNNYPYT

SEQ ID NO: 2454 - protein, 17 aa, Homo sapiens
  Heavy chain CDR3 for antibody 1227 (IGHV3-33)
ARGYCSRTSCYLYYFDY

SEQ ID NO: 2455 - protein, 9 aa, Homo sapiens
  Light chain CDR3 for antibody 1228 (IGKV1-39)
QQSHTLPCT

SEQ ID NO: 2456 - protein, 12 aa, Homo sapiens
  Heavy chain CDR3 for antibody 1228 (IGHV3-21)
ARDGGRYGDFDY

SEQ ID NO: 2457 - protein, 9 aa, Homo sapiens
  Light chain CDR3 for antibody 1229 (IGKV5-2)
LQHDNFPWT

SEQ ID NO: 2458 - protein, 13 aa, Homo sapiens
  Heavy chain CDR3 for antibody 1229 (IGHV4-39)
APFRVMVRGVLDY

SEQ ID NO: 2459 - protein, 9 aa, Homo sapiens
  Light chain CDR3 for antibody 1230 (IGKV3D-7)
QQDYNLPLT

SEQ ID NO: 2460 - protein, 11 aa, Homo sapiens
  Heavy chain CDR3 for antibody 1230 (IGHV3-33)
ARDRSSGPFDY

SEQ ID NO: 2461 - protein, 9 aa, Homo sapiens
  Light chain CDR3 for antibody 1231 (IGKV2D-28)
MQALQTPFT

SEQ ID NO: 2462 - protein, 14 aa, Homo sapiens
  Heavy chain CDR3 for antibody 1231 (IGHV3-33)
AKSYDILTGEAFDI

SEQ ID NO: 2463 - protein, 9 aa, Homo sapiens
  Light chain CDR3 for antibody 1232 (IGKV1-16)
QQYNRYPYT

SEQ ID NO: 2464 - protein, 16 aa, Homo sapiens
  Heavy chain CDR3 for antibody 1232 (IGHV4-59)
ARGRYFEWLLGDVFDI

SEQ ID NO: 2465 - protein, 9 aa, Homo sapiens
  Light chain CDR3 for antibody 1233 (IGKV1-17)
LQHNSYPYT

SEQ ID NO: 2466 - protein, 13 aa, Homo sapiens
  Heavy chain CDR3 for antibody 1233 (IGHV3-33)
ARQSSGWFDAFDI

SEQ ID NO: 2467 - protein, 9 aa, Homo sapiens
  Light chain CDR3 for antibody 1234 (IGKV5-2)
LQHDNFPYT

SEQ ID NO: 2468 - protein, 20 aa, Homo sapiens
  Heavy chain CDR3 for antibody 1234 (IGHV3-11)
ARGGATLIRGLIDYYYGMDV

SEQ ID NO: 2469 - protein, 9 aa, Homo sapiens
  Light chain CDR3 for antibody 1235 (IGKV5-2)
LQHDNFPYT

SEQ ID NO: 2470 - protein, 13 aa, Homo sapiens
  Heavy chain CDR3 for antibody 1235 (IGHV3-33)
AKEDGDYHHYFDY

SEQ ID NO: 2471 - protein, 9 aa, Homo sapiens
  Light chain CDR3 for antibody 1236 (IGKV6-21)
HQSSSLPYT

SEQ ID NO: 2472 - protein, 11 aa, Homo sapiens
  Heavy chain CDR3 for antibody 1236 (IGHV3-33)
AREAANWGFDY

SEQ ID NO: 2473 - protein, 9 aa, Homo sapiens
  Light chain CDR3 for antibody 1237 (IGKV6-21)
HQSSSLPYT

SEQ ID NO: 2474 - protein, 10 aa, Homo sapiens
  Heavy chain CDR3 for antibody 1237 (IGHV3-33)
ARENSTPLDY

SEQ ID NO: 2475 - protein, 9 aa, Homo sapiens
  Light chain CDR3 for antibody 1238 (IGKV1-16)
QQYNSYPYT

SEQ ID NO: 2476 - protein, 15 aa, Homo sapiens
  Heavy chain CDR3 for antibody 1238 (IGHV1-24)
ATHWDLRYYYYGMDV

SEQ ID NO: 2477 - protein, 9 aa, Homo sapiens
  Light chain CDR3 for antibody 1239 (IGKV1D-16)
QQYNSYPYT

SEQ ID NO: 2478 - protein, 18 aa, Homo sapiens
  Heavy chain CDR3 for antibody 1239 (IGHV1-8)
ARSRIAAAGIYYYYGMDV

SEQ ID NO: 2479 - protein, 9 aa, Homo sapiens
  Light chain CDR3 for antibody 1240 (IGKV1D-16)
QQYNSYPYT

SEQ ID NO: 2480 - protein, 9 aa, Homo sapiens
  Heavy chain CDR3 for antibody 1240 (IGHV3-33)
ARELAYFDY

SEQ ID NO: 2481 - protein, 9 aa, Homo sapiens
  Light chain CDR3 for antibody 1241 (IGKV1-16)
QQYNRYPYT

SEQ ID NO: 2482 - protein, 13 aa, Homo sapiens
  Heavy chain CDR3 for antibody 1241 (IGHV4-34)
ASNFYYYYYGMDV

SEQ ID NO: 2483 - protein, 9 aa, Homo sapiens
  Light chain CDR3 for antibody 1242 (IGKV1-17)
LQHNSYPYT

SEQ ID NO: 2484 - protein, 11 aa, Homo sapiens
  Heavy chain CDR3 for antibody 1242 (IGHV3-33)
ARGTTVTHFDY

SEQ ID NO: 2485 - protein, 9 aa, Homo sapiens
  Light chain CDR3 for antibody 1243 (IGKV5-2)
LQHDNFPYT

SEQ ID NO: 2486 - protein, 11 aa, Homo sapiens
  Heavy chain CDR3 for antibody 1243 (IGHV3-33)
ARDILTGFLDH

SEQ ID NO: 2487 - protein, 9 aa, Homo sapiens
  Light chain CDR3 for antibody 1244 (IGKV5-2)
LQHDNFPYT

SEQ ID NO: 2488 - protein, 14 aa, Homo sapiens
  Heavy chain CDR3 for antibody 1244 (IGHV3-33)
ARQYSYGYPYYFDY

SEQ ID NO: 2489 - protein, 9 aa, Homo sapiens
  Light chain CDR3 for antibody 1245 (IGKV1-27)
QKYNSAPYT

SEQ ID NO: 2490 - protein, 13 aa, Homo sapiens
  Heavy chain CDR3 for antibody 1245 (IGHV3-33)
ARDWGYSHGYFDY

SEQ ID NO: 2491 - protein, 9 aa, Homo sapiens
  Light chain CDR3 for antibody 1246 (IGKV1-17)
LQHNSYPFT

SEQ ID NO: 2492 - protein, 12 aa, Homo sapiens
  Heavy chain CDR3 for antibody 1246 (IGHV1-18)
ARAPYNWNDPDY

SEQ ID NO: 2493 - protein, 9 aa, Homo sapiens
  Light chain CDR3 for antibody 1247 (IGKV1-9)
QQYNSYPLT

SEQ ID NO: 2494 - protein, 14 aa, Homo sapiens
  Heavy chain CDR3 for antibody 1247 (IGHV4-59)
AKGGSGSYYNWFDP

SEQ ID NO: 2495 - protein, 9 aa, Homo sapiens
  Light chain CDR3 for antibody 1248 (IGKV6-21)
HQSSSLPYT

SEQ ID NO: 2496 - protein, 13 aa, Homo sapiens
  Heavy chain CDR3 for antibody 1248 (IGHV3-33)
ARVDTMVRGVMAY

SEQ ID NO: 2497 - protein, 9 aa, Homo sapiens
  Light chain CDR3 for antibody 1249 (IGKV1-17)
LQHNSYPYT

SEQ ID NO: 2498 - protein, 17 aa, Homo sapiens
  Heavy chain CDR3 for antibody 1249 (IGHV3-33)
ARGDGDILTGYYEWFDP

SEQ ID NO: 2499 - protein, 8 aa, Homo sapiens
  Light chain CDR3 for antibody 1250 (IGKV3D-7)
QQDYNLLT

SEQ ID NO: 2500 - protein, 11 aa, Homo sapiens
  Heavy chain CDR3 for antibody 1250 (IGHV3-33)
ARDRSSGPFDY

SEQ ID NO: 2501 - protein, 9 aa, Homo sapiens
  Light chain CDR3 for antibody 1251 (IGKV3-20)
QQYGSSPYT

SEQ ID NO: 2502 - protein, 13 aa, Homo sapiens
  Heavy chain CDR3 for antibody 1251 (IGHV4-59)
ARTMVRGVAPFDY

SEQ ID NO: 2503 - protein, 9 aa, Homo sapiens
  Light chain CDR3 for antibody 1252 (IGKV1-6)
LQDYNYPYT

SEQ ID NO: 2504 - protein, 11 aa, Homo sapiens
  Heavy chain CDR3 for antibody 1252 (IGHV3-23)
AKDRPYYGSGV

SEQ ID NO: 2505 - protein, 9 aa, Homo sapiens
  Light chain CDR3 for antibody 1253 (IGKV1D-16)
QQYNSYPYT

SEQ ID NO: 2506 - protein, 17 aa, Homo sapiens
  Heavy chain CDR3 for antibody 1253 (IGHV3-33)
ARGGGYENDHYYYGMDV

SEQ ID NO: 2507 - protein, 9 aa, Homo sapiens
  Light chain CDR3 for antibody 1254 (IGKV1-17)
LQHNSFPLT

SEQ ID NO: 2508 - protein, 16 aa, Homo sapiens
  Heavy chain CDR3 for antibody 1254 (IGHV3-33)
ARGEQWLGYYYYGMDV

SEQ ID NO: 2509 - protein, 9 aa, Homo sapiens
  Light chain CDR3 for antibody 1255 (IGKV3D-20)
QQYGSSPYT

SEQ ID NO: 2510 - protein, 16 aa, Homo sapiens
  Heavy chain CDR3 for antibody 1255 (IGHV3-23)
AKEGEVLRYFDWLFNY

SEQ ID NO: 2511 - protein, 9 aa, Homo sapiens
  Light chain CDR3 for antibody 1256 (IGKV1D-16)
QQYNSYPLT

SEQ ID NO: 2512 - protein, 13 aa, Homo sapiens
  Heavy chain CDR3 for antibody 1256 (IGHV3-33)
AREYCSGGSCYDY

SEQ ID NO: 2513 - protein, 9 aa, Homo sapiens
  Light chain CDR3 for antibody 1257 (IGKV6-21)
HQSSSLPYT

SEQ ID NO: 2514 - protein, 13 aa, Homo sapiens
  Heavy chain CDR3 for antibody 1257 (IGHV4-39)
ARHPPSRDYGMDV

SEQ ID NO: 2515 - protein, 9 aa, Homo sapiens
  Light chain CDR3 for antibody 1258 (IGKV2-30)
MQGTHWPLT

SEQ ID NO: 2516 - protein, 18 aa, Homo sapiens
  Heavy chain CDR3 for antibody 1258 (IGHV4-59)
AREGDYVWGSYRPNWFDP

SEQ ID NO: 2517 - protein, 9 aa, Homo sapiens
  Light chain CDR3 for antibody 1259 (IGKV5-2)
LQHDNFPYT

SEQ ID NO: 2518 - protein, 13 aa, Homo sapiens
  Heavy chain CDR3 for antibody 1259 (IGHV3-33)
ARVDTMVRGVMAY

SEQ ID NO: 2519 - protein, 9 aa, Homo sapiens
  Light chain CDR3 for antibody 1260 (IGKV1-17)
LQHNSYPYT

SEQ ID NO: 2520 - protein, 16 aa, Homo sapiens
  Heavy chain CDR3 for antibody 1260 (IGHV3-30)
ARDIAVAGHVYYGMDV

SEQ ID NO: 2521 - protein, 9 aa, Homo sapiens
  Light chain CDR3 for antibody 1261 (IGKV1-17)
LQHNSYPYT

SEQ ID NO: 2522 - protein, 14 aa, Homo sapiens
  Heavy chain CDR3 for antibody 1261 (IGHV3-33)
ARDRRDFYYYGMDV

SEQ ID NO: 2523 - protein, 9 aa, Homo sapiens
  Light chain CDR3 for antibody 1262 (IGKV6-21)
HQSSSLPYT

SEQ ID NO: 2524 - protein, 16 aa, Homo sapiens
  Heavy chain CDR3 for antibody 1262 (IGHV3-33)
ARAVYYGSGSSLIMDV

SEQ ID NO: 2525 - protein, 9 aa, Homo sapiens
  Light chain CDR3 for antibody 1263 (IGKV6-21)
HQSSTLPFT

SEQ ID NO: 2526 - protein, 14 aa, Homo sapiens
  Heavy chain CDR3 for antibody 1263 (IGHV3-20)
ARDRGSSFFDGFDI

SEQ ID NO: 2527 - protein, 9 aa, Homo sapiens
  Light chain CDR3 for antibody 1264 (IGKV3-20)
QQYGSSPYT

SEQ ID NO: 2528 - protein, 14 aa, Homo sapiens
  Heavy chain CDR3 for antibody 1264 (IGHV3-33)
ARTTAAAGPRDFQH

SEQ ID NO: 2529 - protein, 9 aa, Homo sapiens
  Light chain CDR3 for antibody 1265 (IGKV6-21)
HQSSSLPWT

SEQ ID NO: 2530 - protein, 14 aa, Homo sapiens
  Heavy chain CDR3 for antibody 1265 (IGHV3-33)
ARDDILTGYSYFQH

SEQ ID NO: 2531 - protein, 9 aa, Homo sapiens
  Light chain CDR3 for antibody 1266 (IGKV1-6)
LQDYNYPYT

SEQ ID NO: 2532 - protein, 13 aa, Homo sapiens
  Heavy chain CDR3 for antibody 1266 (IGHV3-33)
ASAGNSYYNVMDV

SEQ ID NO: 2533 - protein, 9 aa, Homo sapiens
  Light chain CDR3 for antibody 1267 (IGKV5-2)
LQHDNFPWT

SEQ ID NO: 2534 - protein, 17 aa, Homo sapiens
  Heavy chain CDR3 for antibody 1267 (IGHV4-39)
ARQGWYYGSGSSLLFDY

SEQ ID NO: 2535 - protein, 9 aa, Homo sapiens
  Light chain CDR3 for antibody 1268 (IGKV1-16)
QQYYSYPYT

SEQ ID NO: 2536 - protein, 18 aa, Homo sapiens
  Heavy chain CDR3 for antibody 1268 (IGHV1-46)
ARDGDYVWGSYRSNWFDP

SEQ ID NO: 2537 - protein, 9 aa, Homo sapiens
  Light chain CDR3 for antibody 1269 (IGKV6-21)
HQSSSLPYT

SEQ ID NO: 2538 - protein, 21 aa, Homo sapiens
  Heavy chain CDR3 for antibody 1269 (IGHV3-33)
ARKRLYDILTGYYKAYYGMDV

SEQ ID NO: 2539 - protein, 9 aa, Homo sapiens
  Light chain CDR3 for antibody 1270 (IGKV3D-7)
QQDYNLPYT

SEQ ID NO: 2540 - protein, 16 aa, Homo sapiens
  Heavy chain CDR3 for antibody 1270 (IGHV3-33)
AREVGAKDYYYYGMDV

SEQ ID NO: 2541 - protein, 9 aa, Homo sapiens
  Light chain CDR3 for antibody 1271 (IGKV5-2)
LQHDNFPYT

SEQ ID NO: 2542 - protein, 12 aa, Homo sapiens
  Heavy chain CDR3 for antibody 1271 (IGHV3-33)
ARKGYDMHEFDI

SEQ ID NO: 2543 - protein, 9 aa, Homo sapiens
  Light chain CDR3 for antibody 1272 (IGKV1D-16)
QQYNSYPLT

SEQ ID NO: 2544 - protein, 10 aa, Homo sapiens
  Heavy chain CDR3 for antibody 1272 (IGHV3-23)
AKDHYGDYPY

SEQ ID NO: 2545 - protein, 9 aa, Homo sapiens
  Light chain CDR3 for antibody 1273 (IGKV5-2)
LQHDNFPYT

SEQ ID NO: 2546 - protein, 14 aa, Homo sapiens
  Heavy chain CDR3 for antibody 1273 (IGHV3-33)
ARAGSGYDRDWFDP

SEQ ID NO: 2547 - protein, 9 aa, Homo sapiens
  Light chain CDR3 for antibody 1274 (IGKV1D-16)
QQYNSYPYT

SEQ ID NO: 2548 - protein, 10 aa, Homo sapiens
  Heavy chain CDR3 for antibody 1274 (IGHV1-18)
AREQRLGFDY

SEQ ID NO: 2549 - protein, 9 aa, Homo sapiens
  Light chain CDR3 for antibody 1275 (IGKV6-21)
HQSSSLPYT

SEQ ID NO: 2550 - protein, 17 aa, Homo sapiens
  Heavy chain CDR3 for antibody 1275 (IGHV3-23)
AKDGSFYSSGWYDAFDI

SEQ ID NO: 2551 - protein, 9 aa, Homo sapiens
  Light chain CDR3 for antibody 1276 (IGKV1D-13)
QQFNNYPHT

SEQ ID NO: 2552 - protein, 12 aa, Homo sapiens
  Heavy chain CDR3 for antibody 1276 (IGHV3-13)
AREAGIPDAFDI

SEQ ID NO: 2553 - protein, 9 aa, Homo sapiens
  Light chain CDR3 for antibody 1277 (IGKV3-20)
QQYGSSPYT

SEQ ID NO: 2554 - protein, 14 aa, Homo sapiens
  Heavy chain CDR3 for antibody 1277 (IGHV3-33)
ARDKTYPLSYGMDV

SEQ ID NO: 2555 - protein, 9 aa, Homo sapiens
  Light chain CDR3 for antibody 1278 (IGKV5-2)
LQHDNFPWT

SEQ ID NO: 2556 - protein, 17 aa, Homo sapiens
  Heavy chain CDR3 for antibody 1278 (IGHV3-33)
ARGFSGYDGYYYYGMDV

SEQ ID NO: 2557 - protein, 9 aa, Homo sapiens
  Light chain CDR3 for antibody 1279 (IGKV1D-16)
QQYNSYPYT

SEQ ID NO: 2558 - protein, 16 aa, Homo sapiens
  Heavy chain CDR3 for antibody 1279 (IGHV3-33)
ARDRGGMTMVRGGFDY

SEQ ID NO: 2559 - protein, 9 aa, Homo sapiens
  Light chain CDR3 for antibody 1280 (IGKV1-27)
QKYNSAPYT

SEQ ID NO: 2560 - protein, 12 aa, Homo sapiens
  Heavy chain CDR3 for antibody 1280 (IGHV1-46)
ARGLTGDHAVDI

SEQ ID NO: 2561 - protein, 9 aa, Homo sapiens
  Light chain CDR3 for antibody 1281 (IGKV1-17)
LQHNSYPWT

SEQ ID NO: 2562 - protein, 19 aa, Homo sapiens
  Heavy chain CDR3 for antibody 1281 (IGHV3-33)
ARVLDGLSPPYYYYDGLDV

SEQ ID NO: 2563 - protein, 9 aa, Homo sapiens
  Light chain CDR3 for antibody 1282 (IGKV1D-16)
QQYNSYPYT

SEQ ID NO: 2564 - protein, 20 aa, Homo sapiens
  Heavy chain CDR3 for antibody 1282 (IGHV3-33)
ARRMVRGVKKTYYYYYGLDV

SEQ ID NO: 2565 - protein, 9 aa, Homo sapiens
  Light chain CDR3 for antibody 1283 (IGKV3D-7)
QQDYNLPLT

SEQ ID NO: 2566 - protein, 12 aa, Homo sapiens
  Heavy chain CDR3 for antibody 1283 (IGHV1-18)
ARILFYGDYFDY

SEQ ID NO: 2567 - protein, 9 aa, Homo sapiens
  Light chain CDR3 for antibody 1284 (IGKV3-20)
QQYGSSPYT

SEQ ID NO: 2568 - protein, 20 aa, Homo sapiens
  Heavy chain CDR3 for antibody 1284 (IGHV3-33)
ARAGDIAVAGTHYYYYGMDV

SEQ ID NO: 2569 - protein, 9 aa, Homo sapiens
  Light chain CDR3 for antibody 1285 (IGKV5-2)
LQHDNFPYT

SEQ ID NO: 2570 - protein, 10 aa, Homo sapiens
  Heavy chain CDR3 for antibody 1285 (IGHV3-33)
ARENSTPLDY

SEQ ID NO: 2571 - protein, 9 aa, Homo sapiens
  Light chain CDR3 for antibody 1286 (IGKV6-21)
HQSSSLPYT

SEQ ID NO: 2572 - protein, 15 aa, Homo sapiens
  Heavy chain CDR3 for antibody 1286 (IGHV3-23)
AKEALRYFDWSGMDV

SEQ ID NO: 2573 - protein, 9 aa, Homo sapiens
  Light chain CDR3 for antibody 1287 (IGKV6-21)
HQSSSLPYT

SEQ ID NO: 2574 - protein, 17 aa, Homo sapiens
  Heavy chain CDR3 for antibody 1287 (IGHV3-23)
AKDGIGELSYYYYGMDV

SEQ ID NO: 2575 - protein, 9 aa, Homo sapiens
  Light chain CDR3 for antibody 1288 (IGKV1D-16)
QQYNSYPYT

SEQ ID NO: 2576 - protein, 15 aa, Homo sapiens
  Heavy chain CDR3 for antibody 1288 (IGHV1-18)
ARRSPNWGHYYGMDV

SEQ ID NO: 2577 - protein, 9 aa, Homo sapiens
  Light chain CDR3 for antibody 1289 (IGKV3-20)
QQYATSPIT

SEQ ID NO: 2578 - protein, 9 aa, Homo sapiens
  Heavy chain CDR3 for antibody 1289 (IGHV3-74)
ARSEYQPTY

SEQ ID NO: 2579 - protein, 9 aa, Homo sapiens
  Light chain CDR3 for antibody 1290 (IGKV6-21)
HQSSSLPYT

SEQ ID NO: 2580 - protein, 15 aa, Homo sapiens
  Heavy chain CDR3 for antibody 1290 (IGHV3-33)
ARDRGWKAPGYGMDV

SEQ ID NO: 2581 - protein, 9 aa, Homo sapiens
  Light chain CDR3 for antibody 1291 (IGKV1-6)
LQDYNYPYT

SEQ ID NO: 2582 - protein, 15 aa, Homo sapiens
  Heavy chain CDR3 for antibody 1291 (IGHV3-23)
AKEFTMVRGVITPDY

SEQ ID NO: 2583 - protein, 9 aa, Homo sapiens
  Light chain CDR3 for antibody 1292 (IGKV3-15)
QQYNNWPLT

SEQ ID NO: 2584 - protein, 11 aa, Homo sapiens
  Heavy chain CDR3 for antibody 1292 (IGHV4-59)
AREMGHDTFDI

SEQ ID NO: 2585 - protein, 9 aa, Homo sapiens
  Light chain CDR3 for antibody 1293 (IGKV3D-7)
QQDYNLPPT

SEQ ID NO: 2586 - protein, 12 aa, Homo sapiens
  Heavy chain CDR3 for antibody 1293 (IGHV3-33)
ARERGIGRYFDL

SEQ ID NO: 2587 - protein, 9 aa, Homo sapiens
  Light chain CDR3 for antibody 1294 (IGKV5-2)
LQHDNFPWT

SEQ ID NO: 2588 - protein, 14 aa, Homo sapiens
  Heavy chain CDR3 for antibody 1294 (IGHV4-39)
ARQGTMIRGGYFDY

SEQ ID NO: 2589 - protein, 9 aa, Homo sapiens
  Light chain CDR3 for antibody 1295 (IGKV1D-16)
QQYNSYPYT

SEQ ID NO: 2590 - protein, 18 aa, Homo sapiens
  Heavy chain CDR3 for antibody 1295 (IGHV3-33)
ARGGYDILTGYYRTGMDV

SEQ ID NO: 2591 - protein, 9 aa, Homo sapiens
  Light chain CDR3 for antibody 1296 (IGKV1D-16)
QQYNSYPLT

SEQ ID NO: 2592 - protein, 19 aa, Homo sapiens
  Heavy chain CDR3 for antibody 1296 (IGHV3-33)
ARDSGYSGYDYYYYYGMDV

SEQ ID NO: 2593 - protein, 9 aa, Homo sapiens
  Light chain CDR3 for antibody 1297 (IGKV1D-16)
QQYNSYPLT

SEQ ID NO: 2594 - protein, 12 aa, Homo sapiens
  Heavy chain CDR3 for antibody 1297 (IGHV3-33)
AREGTRWVYFDY

SEQ ID NO: 2595 - protein, 9 aa, Homo sapiens
  Light chain CDR3 for antibody 1298 (IGKV1-17)
LQHNSYPYT

SEQ ID NO: 2596 - protein, 12 aa, Homo sapiens
  Heavy chain CDR3 for antibody 1298 (IGHV4-61)
ARVYSSGWLFDY

SEQ ID NO: 2597 - protein, 9 aa, Homo sapiens
  Light chain CDR3 for antibody 1299 (IGKV1-17)
LQHNSYPYT

SEQ ID NO: 2598 - protein, 15 aa, Homo sapiens
  Heavy chain CDR3 for antibody 1299 (IGHV3-33)
ARDRVVRGVMGYFDY

SEQ ID NO: 2599 - protein, 9 aa, Homo sapiens
  Light chain CDR3 for antibody 1300 (IGKV6-21)
HQSSSLPYT

SEQ ID NO: 2600 - protein, 15 aa, Homo sapiens
  Heavy chain CDR3 for antibody 1300 (IGHV3-33)
ARDSRPEIIGPPFDY

SEQ ID NO: 2601 - protein, 9 aa, Homo sapiens
  Light chain CDR3 for antibody 1301 (IGKV6-21)
HQSSSLPYT

SEQ ID NO: 2602 - protein, 14 aa, Homo sapiens
  Heavy chain CDR3 for antibody 1301 (IGHV3-33)
ARDGYDFLTGPFDY

SEQ ID NO: 2603 - protein, 9 aa, Homo sapiens
  Light chain CDR3 for antibody 1302 (IGKV1-16)
QQYNSYPYT

SEQ ID NO: 2604 - protein, 16 aa, Homo sapiens
  Heavy chain CDR3 for antibody 1302 (IGHV3-23)
ARNWNDVGDYYYGMDV

SEQ ID NO: 2605 - protein, 9 aa, Homo sapiens
  Light chain CDR3 for antibody 1303 (IGKV3D-7)
QQDYNLPLT

SEQ ID NO: 2606 - protein, 13 aa, Homo sapiens
  Heavy chain CDR3 for antibody 1303 (IGHV3-33)
ARDYCGGDCYLDY

SEQ ID NO: 2607 - protein, 10 aa, Homo sapiens
  Light chain CDR3 for antibody 1304 (IGKV3-11)
QQRSNWPPYT

SEQ ID NO: 2608 - protein, 14 aa, Homo sapiens
  Heavy chain CDR3 for antibody 1304 (IGHV3-33)
AREMVRGVPNWFDP

SEQ ID NO: 2609 - protein, 9 aa, Homo sapiens
  Light chain CDR3 for antibody 1305 (IGKV1-17)
LQHNSYPYT

SEQ ID NO: 2610 - protein, 13 aa, Homo sapiens
  Heavy chain CDR3 for antibody 1305 (IGHV3-33)
ARDSSSWYHWFDP

SEQ ID NO: 2611 - protein, 9 aa, Homo sapiens
  Light chain CDR3 for antibody 1306 (IGKV3D-20)
QQYGISPYT

SEQ ID NO: 2612 - protein, 16 aa, Homo sapiens
  Heavy chain CDR3 for antibody 1306 (IGHV3-33)
ARGAWYSNGWYGTFDI

SEQ ID NO: 2613 - protein, 9 aa, Homo sapiens
  Light chain CDR3 for antibody 1307 (IGKV6-21)
HQSSSLPYT

SEQ ID NO: 2614 - protein, 12 aa, Homo sapiens
  Heavy chain CDR3 for antibody 1307 (IGHV3-33)
ARDPGYYYGLDV

SEQ ID NO: 2615 - protein, 9 aa, Homo sapiens
  Light chain CDR3 for antibody 1308 (IGKV1-39)
QQSYSTPLT

SEQ ID NO: 2616 - protein, 17 aa, Homo sapiens
  Heavy chain CDR3 for antibody 1308 (IGHV1-18)
ARDRAFTMVRGVPPFDY

SEQ ID NO: 2617 - protein, 9 aa, Homo sapiens
  Light chain CDR3 for antibody 1309 (IGKV6-21)
HQSSSLPYT

SEQ ID NO: 2618 - protein, 13 aa, Homo sapiens
  Heavy chain CDR3 for antibody 1309 (IGHV3-33)
ARTDYYFYYGLDV

SEQ ID NO: 2619 - protein, 9 aa, Homo sapiens
  Light chain CDR3 for antibody 1310 (IGKV3D-7)
QQDYNLPIT

SEQ ID NO: 2620 - protein, 16 aa, Homo sapiens
  Heavy chain CDR3 for antibody 1310 (IGHV3-33)
ARGSVSDILTGAYFDY

SEQ ID NO: 2621 - protein, 9 aa, Homo sapiens
  Light chain CDR3 for antibody 1311 (IGKV1-6)
LQDYNYPYT

SEQ ID NO: 2622 - protein, 18 aa, Homo sapiens
  Heavy chain CDR3 for antibody 1311 (IGHV3-33)
ARGGYDILTGYYRTGMDV

SEQ ID NO: 2623 - protein, 9 aa, Homo sapiens
  Light chain CDR3 for antibody 1312 (IGKV1-17)
LQHNSYPYT

SEQ ID NO: 2624 - protein, 12 aa, Homo sapiens
  Heavy chain CDR3 for antibody 1312 (IGHV3-33)
AKDPGWQQLAEY

SEQ ID NO: 2625 - protein, 9 aa, Homo sapiens
  Light chain CDR3 for antibody 1313 (IGKV1-17)
LQHNSYPYT

SEQ ID NO: 2626 - protein, 14 aa, Homo sapiens
  Heavy chain CDR3 for antibody 1313 (IGHV3-23)
AKDRYRGYEGLFDY

SEQ ID NO: 2627 - protein, 9 aa, Homo sapiens
  Light chain CDR3 for antibody 1314 (IGKV1-6)
LQDYNYPYT

SEQ ID NO: 2628 - protein, 15 aa, Homo sapiens
  Heavy chain CDR3 for antibody 1314 (IGHV1-18)
ARRSPNWGHYYGMDV

SEQ ID NO: 2629 - protein, 9 aa, Homo sapiens
  Light chain CDR3 for antibody 1315 (IGKV5-2)
LQHDNFPYT

SEQ ID NO: 2630 - protein, 16 aa, Homo sapiens
  Heavy chain CDR3 for antibody 1315 (IGHV3-33)
ARGGRSDWLYYYGMDV

SEQ ID NO: 2631 - protein, 9 aa, Homo sapiens
  Light chain CDR3 for antibody 1316 (IGKV5-2)
LQHDNFPYT

SEQ ID NO: 2632 - protein, 14 aa, Homo sapiens
  Heavy chain CDR3 for antibody 1316 (IGHV3-23)
ANWAYDILTGYLDY

SEQ ID NO: 2633 - protein, 9 aa, Homo sapiens
  Light chain CDR3 for antibody 1317 (IGKV6-21)
HQSSSLPYT

SEQ ID NO: 2634 - protein, 14 aa, Homo sapiens
  Heavy chain CDR3 for antibody 1317 (IGHV3-33)
ARDKTYPLSYGMDV

SEQ ID NO: 2635 - protein, 9 aa, Homo sapiens
  Light chain CDR3 for antibody 1318 (IGKV3D-7)
QQDYNLPYT

SEQ ID NO: 2636 - protein, 18 aa, Homo sapiens
  Heavy chain CDR3 for antibody 1318 (IGHV4-59)
AREGHYYTSGSYYKAFDY

SEQ ID NO: 2637 - protein, 9 aa, Homo sapiens
  Light chain CDR3 for antibody 1319 (IGKV1-17)
LQHNSYPYT

SEQ ID NO: 2638 - protein, 9 aa, Homo sapiens
  Heavy chain CDR3 for antibody 1319 (IGHV3-23)
AKEQQLFDY

SEQ ID NO: 2639 - protein, 9 aa, Homo sapiens
  Light chain CDR3 for antibody 1320 (IGKV5-2)
LQHDNFPYT

SEQ ID NO: 2640 - protein, 18 aa, Homo sapiens
  Heavy chain CDR3 for antibody 1320 (IGHV3-33)
ARDRDRYGSGTYPDAIDI

SEQ ID NO: 2641 - protein, 9 aa, Homo sapiens
  Light chain CDR3 for antibody 1321 (IGKV3-11)
QQRSNWPWT

SEQ ID NO: 2642 - protein, 18 aa, Homo sapiens
  Heavy chain CDR3 for antibody 1321 (IGHV4-59)
AREGDYVWGSYRPNWFDP

SEQ ID NO: 2643 - protein, 9 aa, Homo sapiens
  Light chain CDR3 for antibody 1322 (IGKV5-2)
LQHDNFPYT

SEQ ID NO: 2644 - protein, 14 aa, Homo sapiens
  Heavy chain CDR3 for antibody 1322 (IGHV3-33)
VRDAMGATTAWFDP

SEQ ID NO: 2645 - protein, 9 aa, Homo sapiens
  Light chain CDR3 for antibody 1323 (IGKV5-2)
LQHDNFPWT

SEQ ID NO: 2646 - protein, 19 aa, Homo sapiens
  Heavy chain CDR3 for antibody 1323 (IGHV1-18)
ARDDILTGYSLYYYYGMDV

SEQ ID NO: 2647 - protein, 9 aa, Homo sapiens
  Light chain CDR3 for antibody 1324 (IGKV1-17)
LQHNSYPYT

SEQ ID NO: 2648 - protein, 13 aa, Homo sapiens
  Heavy chain CDR3 for antibody 1324 (IGHV3-23)
AKDRGGSYSYFDF

SEQ ID NO: 2649 - protein, 8 aa, Homo sapiens
  Light chain CDR3 for antibody 1325 (IGKV3D-7)
QQDYNSLT

SEQ ID NO: 2650 - protein, 10 aa, Homo sapiens
  Heavy chain CDR3 for antibody 1325 (IGHV3-33)
ARDGLRYFDW

SEQ ID NO: 2651 - protein, 9 aa, Homo sapiens
  Light chain CDR3 for antibody 1326 (IGKV1-6)
LQDYNYPYT

SEQ ID NO: 2652 - protein, 19 aa, Homo sapiens
  Heavy chain CDR3 for antibody 1326 (IGHV5-51)
ARHGEKGKRITMVRGSLDV

SEQ ID NO: 2653 - protein, 9 aa, Homo sapiens
  Light chain CDR3 for antibody 1327 (IGKV1D-16)
QQYNSYPYT

SEQ ID NO: 2654 - protein, 13 aa, Homo sapiens
  Heavy chain CDR3 for antibody 1327 (IGHV3-11)
ARDEGYSGYNLDN

SEQ ID NO: 2655 - protein, 9 aa, Homo sapiens
  Light chain CDR3 for antibody 1328 (IGKV1-17)
LQQNSYPWT

SEQ ID NO: 2656 - protein, 11 aa, Homo sapiens
  Heavy chain CDR3 for antibody 1328 (IGHV4-59)
ARSLRYSFFDY

SEQ ID NO: 2657 - protein, 9 aa, Homo sapiens
  Light chain CDR3 for antibody 1329 (IGKV5-2)
LQHDNFPWT

SEQ ID NO: 2658 - protein, 14 aa, Homo sapiens
  Heavy chain CDR3 for antibody 1329 (IGHV1-46)
ARRGIVGALDAFDI

SEQ ID NO: 2659 - protein, 9 aa, Homo sapiens
  Light chain CDR3 for antibody 1330 (IGKV1D-16)
QQYNSYPLT

SEQ ID NO: 2660 - protein, 14 aa, Homo sapiens
  Heavy chain CDR3 for antibody 1330 (IGHV3-33)
AREDYYGPLNWFDP

SEQ ID NO: 2661 - protein, 9 aa, Homo sapiens
  Light chain CDR3 for antibody 1331 (IGKV5-2)
LQHDNFPWT

SEQ ID NO: 2662 - protein, 14 aa, Homo sapiens
  Heavy chain CDR3 for antibody 1331 (IGHV3-33)
ARDREQQLVRYFDY

SEQ ID NO: 2663 - protein, 9 aa, Homo sapiens
  Light chain CDR3 for antibody 1332 (IGKV1-17)
LQHNSYPYT

SEQ ID NO: 2664 - protein, 18 aa, Homo sapiens
  Heavy chain CDR3 for antibody 1332 (IGHV3-13)
ARDYYGSGSLYYYYGMDV

SEQ ID NO: 2665 - protein, 9 aa, Homo sapiens
  Light chain CDR3 for antibody 1333 (IGKV6-21)
HQSSSLPYT

SEQ ID NO: 2666 - protein, 17 aa, Homo sapiens
  Heavy chain CDR3 for antibody 1333 (IGHV3-33)
VREGGLLWVGELSLFDY

SEQ ID NO: 2667 - protein, 9 aa, Homo sapiens
  Light chain CDR3 for antibody 1334 (IGKV1D-13)
QQFNNYPHT

SEQ ID NO: 2668 - protein, 11 aa, Homo sapiens
  Heavy chain CDR3 for antibody 1334 (IGHV3-33)
ARDRVLTPFDY

SEQ ID NO: 2669 - protein, 9 aa, Homo sapiens
  Light chain CDR3 for antibody 1335 (IGKV3-20)
QQYGSSPYT

SEQ ID NO: 2670 - protein, 9 aa, Homo sapiens
  Heavy chain CDR3 for antibody 1335 (IGHV3-13)
ARDRWYFDL

SEQ ID NO: 2671 - protein, 9 aa, Homo sapiens
  Light chain CDR3 for antibody 1336 (IGKV1-17)
LQHNSYPYT

SEQ ID NO: 2672 - protein, 10 aa, Homo sapiens
  Heavy chain CDR3 for antibody 1336 (IGHV3-30)
ARDGLESFDY

SEQ ID NO: 2673 - protein, 8 aa, Homo sapiens
  Light chain CDR3 for antibody 1337 (IGKV1-5)
QQYNSYYT

SEQ ID NO: 2674 - protein, 13 aa, Homo sapiens
  Heavy chain CDR3 for antibody 1337 (IGHV4-59)
ARDAGYSSSWFDY

SEQ ID NO: 2675 - protein, 9 aa, Homo sapiens
  Light chain CDR3 for antibody 1338 (IGKV1D-16)
QQYNSYPLT

SEQ ID NO: 2676 - protein, 20 aa, Homo sapiens
  Heavy chain CDR3 for antibody 1338 (IGHV3-33)
ARDPAQLERRYYYFYYGMDV

SEQ ID NO: 2677 - protein, 9 aa, Homo sapiens
  Light chain CDR3 for antibody 1339 (IGKV1-6)
LQDYNYPYT

SEQ ID NO: 2678 - protein, 15 aa, Homo sapiens
  Heavy chain CDR3 for antibody 1339 (IGHV1-46)
ARGAVDDYYYYGMDV

SEQ ID NO: 2679 - protein, 9 aa, Homo sapiens
  Light chain CDR3 for antibody 1340 (IGKV6-21)
HQSSILPYT

SEQ ID NO: 2680 - protein, 13 aa, Homo sapiens
  Heavy chain CDR3 for antibody 1340 (IGHV3-33)
VRRIAVAGTEGDC

SEQ ID NO: 2681 - protein, 9 aa, Homo sapiens
  Light chain CDR3 for antibody 1341 (IGKV5-2)
LQHDNFPYT

SEQ ID NO: 2682 - protein, 15 aa, Homo sapiens
  Heavy chain CDR3 for antibody 1341 (IGHV3-30)
ARRGYGSGSPDAFDL

SEQ ID NO: 2683 - protein, 9 aa, Homo sapiens
  Light chain CDR3 for antibody 1342 (IGKV1-39)
QQSYRTPLT

SEQ ID NO: 2684 - protein, 9 aa, Homo sapiens
  Heavy chain CDR3 for antibody 1342 (IGHV3-13)
ARDRWYFDL

SEQ ID NO: 2685 - protein, 9 aa, Homo sapiens
  Light chain CDR3 for antibody 1343 (IGKV3-20)
QQYGSSPYT

SEQ ID NO: 2686 - protein, 16 aa, Homo sapiens
  Heavy chain CDR3 for antibody 1343 (IGHV3-33)
ARAVYYGSGSSLIMDV

SEQ ID NO: 2687 - protein, 9 aa, Homo sapiens
  Light chain CDR3 for antibody 1344 (IGKV3D-20)
QQYGSSPYT

SEQ ID NO: 2688 - protein, 10 aa, Homo sapiens
  Heavy chain CDR3 for antibody 1344 (IGHV3-23)
AKDHYGDYPY

SEQ ID NO: 2689 - protein, 9 aa, Homo sapiens
  Light chain CDR3 for antibody 1345 (IGKV5-2)
LQHDNFPYT

SEQ ID NO: 2690 - protein, 17 aa, Homo sapiens
  Heavy chain CDR3 for antibody 1345 (IGHV3-33)
ARAYYDILTGYSYYFDY

SEQ ID NO: 2691 - protein, 9 aa, Homo sapiens
  Light chain CDR3 for antibody 1346 (IGKV3-20)
QQYGSSPYT

SEQ ID NO: 2692 - protein, 11 aa, Homo sapiens
  Heavy chain CDR3 for antibody 1346 (IGHV3-33)
AREAANWGFDY

SEQ ID NO: 2693 - protein, 9 aa, Homo sapiens
  Light chain CDR3 for antibody 1347 (IGKV1-27)
QKYNSAPYT

SEQ ID NO: 2694 - protein, 13 aa, Homo sapiens
  Heavy chain CDR3 for antibody 1347 (IGHV3-33)
ARAFTMVRGVIDY

SEQ ID NO: 2695 - protein, 9 aa, Homo sapiens
  Light chain CDR3 for antibody 1348 (IGKV1-16)
QQYNSYPYT

SEQ ID NO: 2696 - protein, 11 aa, Homo sapiens
  Heavy chain CDR3 for antibody 1348 (IGHV4-59)
ARETGDDAFDI

SEQ ID NO: 2697 - protein, 9 aa, Homo sapiens
  Light chain CDR3 for antibody 1349 (IGKV5-2)
LQHDNFPYT

SEQ ID NO: 2698 - protein, 9 aa, Homo sapiens
  Heavy chain CDR3 for antibody 1349 (IGHV3-30)
ARDYFHYDY

SEQ ID NO: 2699 - protein, 9 aa, Homo sapiens
  Light chain CDR3 for antibody 1350 (IGKV3D-7)
QQDYNLPYT

SEQ ID NO: 2700 - protein, 16 aa, Homo sapiens
  Heavy chain CDR3 for antibody 1350 (IGHV4-39)
ARRGVLVVTAIPGFDY

SEQ ID NO: 2701 - protein, 9 aa, Homo sapiens
  Light chain CDR3 for antibody 1351 (IGKV6-21)
HQSSSLPYT

SEQ ID NO: 2702 - protein, 13 aa, Homo sapiens
  Heavy chain CDR3 for antibody 1351 (IGHV4-39)
ARHEVMVRGVFDY

SEQ ID NO: 2703 - protein, 9 aa, Homo sapiens
  Light chain CDR3 for antibody 1352 (IGKV1-17)
LQHNSYPYT

SEQ ID NO: 2704 - protein, 11 aa, Homo sapiens
  Heavy chain CDR3 for antibody 1352 (IGHV3-74)
ARDRGNWGFDY

SEQ ID NO: 2705 - protein, 10 aa, Homo sapiens
  Light chain CDR3 for antibody 1353 (IGKV1-39)
QQSYSTPMYT

SEQ ID NO: 2706 - protein, 11 aa, Homo sapiens
  Heavy chain CDR3 for antibody 1353 (IGHV3-33)
ARDRSSGPFDY

SEQ ID NO: 2707 - protein, 9 aa, Homo sapiens
  Light chain CDR3 for antibody 1354 (IGKV1D-16)
QQYNSYPYT

SEQ ID NO: 2708 - protein, 19 aa, Homo sapiens
  Heavy chain CDR3 for antibody 1354 (IGHV1-24)
ATAGLQWFGEKIGYYGMDV

SEQ ID NO: 2709 - protein, 9 aa, Homo sapiens
  Light chain CDR3 for antibody 1355 (IGKV1D-13)
QQFNNYPHT

SEQ ID NO: 2710 - protein, 18 aa, Homo sapiens
  Heavy chain CDR3 for antibody 1355 (IGHV4-59)
AREGHYYTSGSYYKAFDY

SEQ ID NO: 2711 - protein, 9 aa, Homo sapiens
  Light chain CDR3 for antibody 1356 (IGKV6-21)
HQSSSLPQT

SEQ ID NO: 2712 - protein, 14 aa, Homo sapiens
  Heavy chain CDR3 for antibody 1356 (IGHV3-64)
ARGRASSGPYYFDY

SEQ ID NO: 2713 - protein, 9 aa, Homo sapiens
  Light chain CDR3 for antibody 1357 (IGKV1-6)
LQDYNYPYT

SEQ ID NO: 2714 - protein, 15 aa, Homo sapiens
  Heavy chain CDR3 for antibody 1357 (IGHV3-33)
AKDRNSGYDWGGFDY

SEQ ID NO: 2715 - protein, 10 aa, Homo sapiens
  Light chain CDR3 for antibody 1358 (IGKV3-11)
QQRSIWPPYT

SEQ ID NO: 2716 - protein, 9 aa, Homo sapiens
  Heavy chain CDR3 for antibody 1358 (IGHV3-23)
AIGRYYFDY

SEQ ID NO: 2717 - protein, 9 aa, Homo sapiens
  Light chain CDR3 for antibody 1359 (IGKV3-20)
QQYGSSPYT

SEQ ID NO: 2718 - protein, 21 aa, Homo sapiens
  Heavy chain CDR3 for antibody 1359 (IGHV3-23)
AKDIDYYGSGSYPLYYYGMDV

SEQ ID NO: 2719 - protein, 9 aa, Homo sapiens
  Light chain CDR3 for antibody 1360 (IGKV3-20)
QQYGSSPYT

SEQ ID NO: 2720 - protein, 8 aa, Homo sapiens
  Heavy chain CDR3 for antibody 1360 (IGHV3-23)
AKESLLDY

SEQ ID NO: 2721 - protein, 9 aa, Homo sapiens
  Light chain CDR3 for antibody 1361 (IGKV6-21)
HQSSSLPYT

SEQ ID NO: 2722 - protein, 17 aa, Homo sapiens
  Heavy chain CDR3 for antibody 1361 (IGHV3-33)
ARVYYDILTGYSPAFDI

SEQ ID NO: 2723 - protein, 9 aa, Homo sapiens
  Light chain CDR3 for antibody 1362 (IGKV1-6)
LQDHDYPWT

SEQ ID NO: 2724 - protein, 10 aa, Homo sapiens
  Heavy chain CDR3 for antibody 1362 (IGHV3-72)
CRDREGFGDV

SEQ ID NO: 2725 - protein, 9 aa, Homo sapiens
  Light chain CDR3 for antibody 1363 (IGKV5-2)
LQHDNFPYT

SEQ ID NO: 2726 - protein, 17 aa, Homo sapiens
  Heavy chain CDR3 for antibody 1363 (IGHV3-33)
VREGGLLWVGELSLFDY

SEQ ID NO: 2727 - protein, 9 aa, Homo sapiens
  Light chain CDR3 for antibody 1364 (IGKV3D-20)
QQYGSSPYT

SEQ ID NO: 2728 - protein, 15 aa, Homo sapiens
  Heavy chain CDR3 for antibody 1364 (IGHV3-30)
ARRGYGSGSPDAFDL

SEQ ID NO: 2729 - protein, 9 aa, Homo sapiens
  Light chain CDR3 for antibody 1365 (IGKV3-20)
QQYGSSPYT

SEQ ID NO: 2730 - protein, 13 aa, Homo sapiens
  Heavy chain CDR3 for antibody 1365 (IGHV1-46)
ARRQVGYYYGMDV

SEQ ID NO: 2731 - protein, 9 aa, Homo sapiens
  Light chain CDR3 for antibody 1366 (IGKV5-2)
LQHDNFPYT

SEQ ID NO: 2732 - protein, 10 aa, Homo sapiens
  Heavy chain CDR3 for antibody 1366 (IGHV3-23)
AKDHYGDYPY

SEQ ID NO: 2733 - protein, 9 aa, Homo sapiens
  Light chain CDR3 for antibody 1367 (IGKV1-39)
QQSYRTPLT

SEQ ID NO: 2734 - protein, 9 aa, Homo sapiens
  Heavy chain CDR3 for antibody 1367 (IGHV3-30)
ARDNWGFDY

SEQ ID NO: 2735 - protein, 9 aa, Homo sapiens
  Light chain CDR3 for antibody 1368 (IGKV5-2)
LQHDNFPWT

SEQ ID NO: 2736 - protein, 17 aa, Homo sapiens
  Heavy chain CDR3 for antibody 1368 (IGHV4-59)
ARRITMVREIIITAFDY

SEQ ID NO: 2737 - protein, 9 aa, Homo sapiens
  Light chain CDR3 for antibody 1369 (IGKV6-21)
HQSSSLPYT

SEQ ID NO: 2738 - protein, 9 aa, Homo sapiens
  Heavy chain CDR3 for antibody 1369 (IGHV3-30)
ARDYFHYDY

SEQ ID NO: 2739 - protein, 9 aa, Homo sapiens
  Light chain CDR3 for antibody 1370 (IGKV5-2)
LQHDNFPWT

SEQ ID NO: 2740 - protein, 18 aa, Homo sapiens
  Heavy chain CDR3 for antibody 1370 (IGHV4-59)
ARERGNWNDVDYYYGMDV

SEQ ID NO: 2741 - protein, 9 aa, Homo sapiens
  Light chain CDR3 for antibody 1371 (IGKV1-39)
QQSYSTPLT

SEQ ID NO: 2742 - protein, 20 aa, Homo sapiens
  Heavy chain CDR3 for antibody 1371 (IGHV3-20)
ARDLCSSTSCYGYYYYGMDV

SEQ ID NO: 2743 - protein, 9 aa, Homo sapiens
  Light chain CDR3 for antibody 1372 (IGKV6-21)
HQSSSLPYT

SEQ ID NO: 2744 - protein, 12 aa, Homo sapiens
  Heavy chain CDR3 for antibody 1372 (IGHV1-24)
ASDWAYYYGMDV

SEQ ID NO: 2745 - protein, 9 aa, Homo sapiens
  Light chain CDR3 for antibody 1373 (IGKV5-2)
LQHDNFPYT

SEQ ID NO: 2746 - protein, 14 aa, Homo sapiens
  Heavy chain CDR3 for antibody 1373 (IGHV3-33)
ARDGYDFLTGPFDY

SEQ ID NO: 2747 - protein, 9 aa, Homo sapiens
  Light chain CDR3 for antibody 1374 (IGKV1D-16)
QQYNSFPLT

SEQ ID NO: 2748 - protein, 12 aa, Homo sapiens
  Heavy chain CDR3 for antibody 1374 (IGHV4-59)
ARDRSGWAYFDY

SEQ ID NO: 2749 - protein, 9 aa, Homo sapiens
  Light chain CDR3 for antibody 1375 (IGKV1D-16)
QQYNSYPYT

SEQ ID NO: 2750 - protein, 13 aa, Homo sapiens
  Heavy chain CDR3 for antibody 1375 (IGHV1-18)
ARSYYGSGSPFDY

SEQ ID NO: 2751 - protein, 9 aa, Homo sapiens
  Light chain CDR3 for antibody 1376 (IGKV3-20)
QQYGSSPYT

SEQ ID NO: 2752 - protein, 13 aa, Homo sapiens
  Heavy chain CDR3 for antibody 1376 (IGHV4-39)
ARRDVLAPAAFDY

SEQ ID NO: 2753 - protein, 8 aa, Homo sapiens
  Light chain CDR3 for antibody 1377 (IGKV1-5)
QQYNSYWT

SEQ ID NO: 2754 - protein, 11 aa, Homo sapiens
  Heavy chain CDR3 for antibody 1377 (IGHV3-33)
ARDRSSGPFDY

SEQ ID NO: 2755 - protein, 8 aa, Homo sapiens
  Light chain CDR3 for antibody 1378 (IGKV1-5)
QQYNSYYT

SEQ ID NO: 2756 - protein, 16 aa, Homo sapiens
  Heavy chain CDR3 for antibody 1378 (IGHV3-23)
AKEGMVLRYFDWLWDY

SEQ ID NO: 2757 - protein, 9 aa, Homo sapiens
  Light chain CDR3 for antibody 1379 (IGKV1D-16)
QQYNSYPLT

SEQ ID NO: 2758 - protein, 10 aa, Homo sapiens
  Heavy chain CDR3 for antibody 1379 (IGHV3-23)
AKEQWLVLDY

SEQ ID NO: 2759 - protein, 9 aa, Homo sapiens
  Light chain CDR3 for antibody 1380 (IGKV3-20)
QQYGSSPYT

SEQ ID NO: 2760 - protein, 9 aa, Homo sapiens
  Heavy chain CDR3 for antibody 1380 (IGHV3-30)
ARDYFHYDY

SEQ ID NO: 2761 - protein, 9 aa, Homo sapiens
  Light chain CDR3 for antibody 1381 (IGKV5-2)
LQHDNFPYT

SEQ ID NO: 2762 - protein, 12 aa, Homo sapiens
  Heavy chain CDR3 for antibody 1381 (IGHV3-23)
AKDGWFGESLDY

SEQ ID NO: 2763 - protein, 9 aa, Homo sapiens
  Light chain CDR3 for antibody 1382 (IGKV1-39)
QQSYSTPLT

SEQ ID NO: 2764 - protein, 12 aa, Homo sapiens
  Heavy chain CDR3 for antibody 1382 (IGHV3-33)
ARGYFGSGYAHF

SEQ ID NO: 2765 - protein, 9 aa, Homo sapiens
  Light chain CDR3 for antibody 1383 (IGKV1D-16)
QQYNSYPYT

SEQ ID NO: 2766 - protein, 14 aa, Homo sapiens
  Heavy chain CDR3 for antibody 1383 (IGHV3-33)
ARDLNYDILNGGGY

SEQ ID NO: 2767 - protein, 9 aa, Homo sapiens
  Light chain CDR3 for antibody 1384 (IGKV1-17)
LQHNSYPYT

SEQ ID NO: 2768 - protein, 17 aa, Homo sapiens
  Heavy chain CDR3 for antibody 1384 (IGHV3-33)
ARDSYDILTGYYKPFDY

SEQ ID NO: 2769 - protein, 9 aa, Homo sapiens
  Light chain CDR3 for antibody 1385 (IGKV5-2)
LQHDNFPYT

SEQ ID NO: 2770 - protein, 16 aa, Homo sapiens
  Heavy chain CDR3 for antibody 1385 (IGHV3-33)
ARGYDMLTGDYYGMDV

SEQ ID NO: 2771 - protein, 9 aa, Homo sapiens
  Light chain CDR3 for antibody 1386 (IGKV1-6)
LQDYNYPYT

SEQ ID NO: 2772 - protein, 16 aa, Homo sapiens
  Heavy chain CDR3 for antibody 1386 (IGHV3-20)
AREGYSSSWFDRNFDY

SEQ ID NO: 2773 - protein, 9 aa, Homo sapiens
  Light chain CDR3 for antibody 1387 (IGKV1D-16)
QQYNSYPYT

SEQ ID NO: 2774 - protein, 14 aa, Homo sapiens
  Heavy chain CDR3 for antibody 1387 (IGHV3-64)
ARDHAAGGYSHSDY

SEQ ID NO: 2775 - protein, 9 aa, Homo sapiens
  Light chain CDR3 for antibody 1388 (IGKV3-20)
QQYGSSPYT

SEQ ID NO: 2776 - protein, 18 aa, Homo sapiens
  Heavy chain CDR3 for antibody 1388 (IGHV3-33)
ARDRDRYGSGTYPDAIDI

SEQ ID NO: 2777 - protein, 9 aa, Homo sapiens
  Light chain CDR3 for antibody 1389 (IGKV5-2)
LQHDNFPWT

SEQ ID NO: 2778 - protein, 18 aa, Homo sapiens
  Heavy chain CDR3 for antibody 1389 (IGHV6-1)
ARDQYSYGPYYYYYGMDV

SEQ ID NO: 2779 - protein, 9 aa, Homo sapiens
  Light chain CDR3 for antibody 1390 (IGKV3D-7)
QQDYNLPLT

SEQ ID NO: 2780 - protein, 13 aa, Homo sapiens
  Heavy chain CDR3 for antibody 1390 (IGHV4-61)
ARDGSSSGWDFDY

SEQ ID NO: 2781 - protein, 9 aa, Homo sapiens
  Light chain CDR3 for antibody 1391 (IGKV3-11)
QQRSNWPYT

SEQ ID NO: 2782 - protein, 14 aa, Homo sapiens
  Heavy chain CDR3 for antibody 1391 (IGHV3-23)
AKSRIVGALYYFDY

SEQ ID NO: 2783 - protein, 9 aa, Homo sapiens
  Light chain CDR3 for antibody 1392 (IGKV2-30)
MQGTHWPLT

SEQ ID NO: 2784 - protein, 15 aa, Homo sapiens
  Heavy chain CDR3 for antibody 1392 (IGHV3-30)
ARGAMVRGVDYGMDV

SEQ ID NO: 2785 - protein, 9 aa, Homo sapiens
  Light chain CDR3 for antibody 1393 (IGKV6-21)
HQSSSLPYT

SEQ ID NO: 2786 - protein, 14 aa, Homo sapiens
  Heavy chain CDR3 for antibody 1393 (IGHV3-33)
ARAGSGYDRDWFDP

SEQ ID NO: 2787 - protein, 9 aa, Homo sapiens
  Light chain CDR3 for antibody 1394 (IGKV1-27)
QKYNSAPYT

SEQ ID NO: 2788 - protein, 12 aa, Homo sapiens
  Heavy chain CDR3 for antibody 1394 (IGHV3-13)
AREAGIPDAFDI

SEQ ID NO: 2789 - protein, 9 aa, Homo sapiens
  Light chain CDR3 for antibody 1395 (IGKV6-21)
HQSSSLPYT

SEQ ID NO: 2790 - protein, 14 aa, Homo sapiens
  Heavy chain CDR3 for antibody 1395 (IGHV3-23)
ANWAYDILTGYLDY

SEQ ID NO: 2791 - protein, 9 aa, Homo sapiens
  Light chain CDR3 for antibody 1396 (IGKV1-39)
QQSYRTPLT

SEQ ID NO: 2792 - protein, 13 aa, Homo sapiens
  Heavy chain CDR3 for antibody 1396 (IGHV3-11)
ARDEGYRGYVLDT

SEQ ID NO: 2793 - protein, 9 aa, Homo sapiens
  Light chain CDR3 for antibody 1397 (IGKV1-39)
QQSYSTPFT

SEQ ID NO: 2794 - protein, 11 aa, Homo sapiens
  Heavy chain CDR3 for antibody 1397 (IGHV4-59)
ARSLRYSVFDY

SEQ ID NO: 2795 - protein, 9 aa, Homo sapiens
  Light chain CDR3 for antibody 1398 (IGKV6-21)
HQSSSFPHT

SEQ ID NO: 2796 - protein, 16 aa, Homo sapiens
  Heavy chain CDR3 for antibody 1398 (IGHV4-39)
ARHPLIWTGYPNWFDP

SEQ ID NO: 2797 - protein, 9 aa, Homo sapiens
  Light chain CDR3 for antibody 1399 (IGKV6-21)
HQSSSLPYT

SEQ ID NO: 2798 - protein, 12 aa, Homo sapiens
  Heavy chain CDR3 for antibody 1399 (IGHV3-33)
AREGDILTGYSL

SEQ ID NO: 2799 - protein, 9 aa, Homo sapiens
  Light chain CDR3 for antibody 1400 (IGKV3D-20)
QQYGSSPYT

SEQ ID NO: 2800 - protein, 11 aa, Homo sapiens
  Heavy chain CDR3 for antibody 1400 (IGHV3-33)
ARAGIAAVFDY

SEQ ID NO: 2801 - protein, 9 aa, Homo sapiens
  Light chain CDR3 for antibody 1401 (IGKV1D-16)
QQYNSYPLT

SEQ ID NO: 2802 - protein, 17 aa, Homo sapiens
  Heavy chain CDR3 for antibody 1401 (IGHV3-33)
ARVRGVIEGYYYYGMDV

SEQ ID NO: 2803 - protein, 9 aa, Homo sapiens
  Light chain CDR3 for antibody 1402 (IGKV5-2)
LQHDNFPYT

SEQ ID NO: 2804 - protein, 12 aa, Homo sapiens
  Heavy chain CDR3 for antibody 1402 (IGHV3-33)
AREGDILTGYSL

SEQ ID NO: 2805 - protein, 8 aa, Homo sapiens
  Light chain CDR3 for antibody 1403 (IGKV3D-7)
QQDYNLLT

SEQ ID NO: 2806 - protein, 16 aa, Homo sapiens
  Heavy chain CDR3 for antibody 1403 (IGHV3-23)
AKEGMVLRYFDWLWDY

SEQ ID NO: 2807 - protein, 9 aa, Homo sapiens
  Light chain CDR3 for antibody 1404 (IGKV1-17)
LQHNSYPYT

SEQ ID NO: 2808 - protein, 17 aa, Homo sapiens
  Heavy chain CDR3 for antibody 1404 (IGHV3-64)
ARERYYGSGSYYNWFDP

SEQ ID NO: 2809 - protein, 9 aa, Homo sapiens
  Light chain CDR3 for antibody 1405 (IGKV1D-16)
QQYNSYPYT

SEQ ID NO: 2810 - protein, 13 aa, Homo sapiens
  Heavy chain CDR3 for antibody 1405 (IGHV1-18)
ARKWEWDLLNFDY

SEQ ID NO: 2811 - protein, 9 aa, Homo sapiens
  Light chain CDR3 for antibody 1406 (IGKV5-2)
LQHDNFPYT

SEQ ID NO: 2812 - protein, 14 aa, Homo sapiens
  Heavy chain CDR3 for antibody 1406 (IGHV3-33)
ARRGSPLRPSHLDV

SEQ ID NO: 2813 - protein, 9 aa, Homo sapiens
  Light chain CDR3 for antibody 1407 (IGKV6-21)
HQSSSLPYT

SEQ ID NO: 2814 - protein, 10 aa, Homo sapiens
  Heavy chain CDR3 for antibody 1407 (IGHV3-23)
AKDHYGDYPY

SEQ ID NO: 2815 - protein, 9 aa, Homo sapiens
  Light chain CDR3 for antibody 1408 (IGKV1-17)
LQHNSYPYT

SEQ ID NO: 2816 - protein, 18 aa, Homo sapiens
  Heavy chain CDR3 for antibody 1408 (IGHV3-33)
ARDRGDILTGYYKGWFDP

SEQ ID NO: 2817 - protein, 9 aa, Homo sapiens
  Light chain CDR3 for antibody 1409 (IGKV6-21)
HQSSSLPYT

SEQ ID NO: 2818 - protein, 18 aa, Homo sapiens
  Heavy chain CDR3 for antibody 1409 (IGHV3-33)
ARDRYYDILTGYYMGFDY

SEQ ID NO: 2819 - protein, 9 aa, Homo sapiens
  Light chain CDR3 for antibody 1410 (IGKV3-20)
QQYGSSPYT

SEQ ID NO: 2820 - protein, 14 aa, Homo sapiens
  Heavy chain CDR3 for antibody 1410 (IGHV3-33)
ARDGYDFLTGPFDY

SEQ ID NO: 2821 - protein, 9 aa, Homo sapiens
  Light chain CDR3 for antibody 1411 (IGKV1-17)
LQHNSYPYT

SEQ ID NO: 2822 - protein, 18 aa, Homo sapiens
  Heavy chain CDR3 for antibody 1411 (IGHV3-33)
ARGGVLYDILTGFYGMDV

SEQ ID NO: 2823 - protein, 9 aa, Homo sapiens
  Light chain CDR3 for antibody 1412 (IGKV6-21)
HQSSSLPYT

SEQ ID NO: 2824 - protein, 12 aa, Homo sapiens
  Heavy chain CDR3 for antibody 1412 (IGHV1-46)
AREDYDIDGMDV

SEQ ID NO: 2825 - protein, 9 aa, Homo sapiens
  Light chain CDR3 for antibody 1413 (IGKV1-39)
QQSYSTPLT

SEQ ID NO: 2826 - protein, 12 aa, Homo sapiens
  Heavy chain CDR3 for antibody 1413 (IGHV3-33)
ARESGGSYSFDY

SEQ ID NO: 2827 - protein, 9 aa, Homo sapiens
  Light chain CDR3 for antibody 1414 (IGKV3-15)
QQYNNWPLT

SEQ ID NO: 2828 - protein, 16 aa, Homo sapiens
  Heavy chain CDR3 for antibody 1414 (IGHV3-23)
AKEGMVLRYFDWLWDY

SEQ ID NO: 2829 - protein, 8 aa, Homo sapiens
  Light chain CDR3 for antibody 1415 (IGKV3-20)
QQYGRSWT

SEQ ID NO: 2830 - protein, 13 aa, Homo sapiens
  Heavy chain CDR3 for antibody 1415 (IGHV3-33)
ARRGSGSPDGFDI

SEQ ID NO: 2831 - protein, 9 aa, Homo sapiens
  Light chain CDR3 for antibody 1416 (IGKV1D-16)
QQYNSYPYT

SEQ ID NO: 2832 - protein, 14 aa, Homo sapiens
  Heavy chain CDR3 for antibody 1416 (IGHV3-15)
SIYYYGSGRDFFDY

SEQ ID NO: 2833 - protein, 9 aa, Homo sapiens
  Light chain CDR3 for antibody 1417 (IGKV6-21)
HQSSSLPYT

SEQ ID NO: 2834 - protein, 13 aa, Homo sapiens
  Heavy chain CDR3 for antibody 1417 (IGHV3-33)
AKEDGDYHHYFDY

SEQ ID NO: 2835 - protein, 9 aa, Homo sapiens
  Light chain CDR3 for antibody 1418 (IGKV1-39)
QQSYSTPLT

SEQ ID NO: 2836 - protein, 13 aa, Homo sapiens
  Heavy chain CDR3 for antibody 1418 (IGHV3-33)
ARDQRYSSGWYDY

SEQ ID NO: 2837 - protein, 9 aa, Homo sapiens
  Light chain CDR3 for antibody 1419 (IGKV5-2)
LQHDNFPYT

SEQ ID NO: 2838 - protein, 18 aa, Homo sapiens
  Heavy chain CDR3 for antibody 1419 (IGHV3-23)
ARYHLYFGSGFGSDGMDV

SEQ ID NO: 2839 - protein, 9 aa, Homo sapiens
  Light chain CDR3 for antibody 1420 (IGKV1-6)
LQDYNYPYT

SEQ ID NO: 2840 - protein, 12 aa, Homo sapiens
  Heavy chain CDR3 for antibody 1420 (IGHV3-23)
AKEGLGSDYEPY

SEQ ID NO: 2841 - protein, 9 aa, Homo sapiens
  Light chain CDR3 for antibody 1421 (IGKV1-6)
LQDYKSPFT

SEQ ID NO: 2842 - protein, 16 aa, Homo sapiens
  Heavy chain CDR3 for antibody 1421 (IGHV3-23)
AKEGMVLRYFDWLWDY

SEQ ID NO: 2843 - protein, 9 aa, Homo sapiens
  Light chain CDR3 for antibody 1422 (IGKV6-21)
HQSSSLPYT

SEQ ID NO: 2844 - protein, 19 aa, Homo sapiens
  Heavy chain CDR3 for antibody 1422 (IGHV3-74)
AGTYPTFYDGSGNYYDFDY

SEQ ID NO: 2845 - protein, 8 aa, Homo sapiens
  Light chain CDR3 for antibody 1423 (IGKV3D-7)
QQDYNLVT

SEQ ID NO: 2846 - protein, 18 aa, Homo sapiens
  Heavy chain CDR3 for antibody 1423 (IGHV4-59)
AREGDYVWGSYRPNWFDP

SEQ ID NO: 2847 - protein, 9 aa, Homo sapiens
  Light chain CDR3 for antibody 1424 (IGKV3-20)
QQYGSSPYT

SEQ ID NO: 2848 - protein, 13 aa, Homo sapiens
  Heavy chain CDR3 for antibody 1424 (IGHV3-33)
ARRATLVRGVFDP

SEQ ID NO: 2849 - protein, 9 aa, Homo sapiens
  Light chain CDR3 for antibody 1425 (IGKV3-20)
QQYGSSPYT

SEQ ID NO: 2850 - protein, 12 aa, Homo sapiens
  Heavy chain CDR3 for antibody 1425 (IGHV3-33)
ARVDTAAPYFDY

SEQ ID NO: 2851 - protein, 9 aa, Homo sapiens
  Light chain CDR3 for antibody 1426 (IGKV1-17)
LQHNSYPYT

SEQ ID NO: 2852 - protein, 16 aa, Homo sapiens
  Heavy chain CDR3 for antibody 1426 (IGHV3-23)
AKEGEVLRYFDWLFNY

SEQ ID NO: 2853 - protein, 9 aa, Homo sapiens
  Light chain CDR3 for antibody 1427 (IGKV1D-13)
QQFNNYPYT

SEQ ID NO: 2854 - protein, 13 aa, Homo sapiens
  Heavy chain CDR3 for antibody 1427 (IGHV3-33)
ARAFTMVRGVIDY

SEQ ID NO: 2855 - protein, 9 aa, Homo sapiens
  Light chain CDR3 for antibody 1428 (IGKV1-17)
LQHNSYPYT

SEQ ID NO: 2856 - protein, 17 aa, Homo sapiens
  Heavy chain CDR3 for antibody 1428 (IGHV3-30)
AREGVRGLIYYYYGMDV

SEQ ID NO: 2857 - protein, 9 aa, Homo sapiens
  Light chain CDR3 for antibody 1429 (IGKV6-21)
HQSSSLPYT

SEQ ID NO: 2858 - protein, 16 aa, Homo sapiens
  Heavy chain CDR3 for antibody 1429 (IGHV3-33)
ARGYDMLTGDYYGMDV

SEQ ID NO: 2859 - protein, 9 aa, Homo sapiens
  Light chain CDR3 for antibody 1430 (IGKV6-21)
HQSSSLPYT

SEQ ID NO: 2860 - protein, 20 aa, Homo sapiens
  Heavy chain CDR3 for antibody 1430 (IGHV3-23)
AKGMGGLRYFDWPHYYGMDV

SEQ ID NO: 2861 - protein, 9 aa, Homo sapiens
  Light chain CDR3 for antibody 1431 (IGKV1-39)
QQSYSTPLT

SEQ ID NO: 2862 - protein, 13 aa, Homo sapiens
  Heavy chain CDR3 for antibody 1431 (IGHV3-33)
ARDWGYSHGYFDY

SEQ ID NO: 2863 - protein, 9 aa, Homo sapiens
  Light chain CDR3 for antibody 1432 (IGKV3-20)
QQYGSSPYT

SEQ ID NO: 2864 - protein, 13 aa, Homo sapiens
  Heavy chain CDR3 for antibody 1432 (IGHV3-33)
ARDQRYSSGWYDY

SEQ ID NO: 2865 - protein, 9 aa, Homo sapiens
  Light chain CDR3 for antibody 1433 (IGKV1D-16)
QQYNSYPLT

SEQ ID NO: 2866 - protein, 17 aa, Homo sapiens
  Heavy chain CDR3 for antibody 1433 (IGHV3-33)
ARGDGDILTGYYEWFDP

SEQ ID NO: 2867 - protein, 9 aa, Homo sapiens
  Light chain CDR3 for antibody 1434 (IGKV5-2)
LQHDNFPYT

SEQ ID NO: 2868 - protein, 15 aa, Homo sapiens
  Heavy chain CDR3 for antibody 1434 (IGHV3-33)
VCVLYDYGDYVGFDY

SEQ ID NO: 2869 - protein, 9 aa, Homo sapiens
  Light chain CDR3 for antibody 1435 (IGKV1D-16)
QQYNSYPYT

SEQ ID NO: 2870 - protein, 12 aa, Homo sapiens
  Heavy chain CDR3 for antibody 1435 (IGHV3-33)
ARDYGSGSFFDY

SEQ ID NO: 2871 - protein, 9 aa, Homo sapiens
  Light chain CDR3 for antibody 1436 (IGKV5-2)
LQHDNFPYT

SEQ ID NO: 2872 - protein, 8 aa, Homo sapiens
  Heavy chain CDR3 for antibody 1436 (IGHV3-23)
EKSAGEDV

SEQ ID NO: 2873 - protein, 9 aa, Homo sapiens
  Light chain CDR3 for antibody 1437 (IGKV1-6)
LQDYNYPYT

SEQ ID NO: 2874 - protein, 18 aa, Homo sapiens
  Heavy chain CDR3 for antibody 1437 (IGHV1-8)
ARSRIAAAGIYYYYGMDV

SEQ ID NO: 2875 - protein, 9 aa, Homo sapiens
  Light chain CDR3 for antibody 1438 (IGKV1D-16)
QQYNSYPYT

SEQ ID NO: 2876 - protein, 17 aa, Homo sapiens
  Heavy chain CDR3 for antibody 1438 (IGHV3-33)
ARDQDDILTGYYWYFDL

SEQ ID NO: 2877 - protein, 9 aa, Homo sapiens
  Light chain CDR3 for antibody 1439 (IGKV1-17)
LQHNSYPYT

SEQ ID NO: 2878 - protein, 13 aa, Homo sapiens
  Heavy chain CDR3 for antibody 1439 (IGHV3-30)
AAPFMVRGDGMDV

SEQ ID NO: 2879 - protein, 9 aa, Homo sapiens
  Light chain CDR3 for antibody 1440 (IGKV1D-13)
QQFNNYPHT

SEQ ID NO: 2880 - protein, 13 aa, Homo sapiens
  Heavy chain CDR3 for antibody 1440 (IGHV3-33)
ASTGDSYYYGMDV

SEQ ID NO: 2881 - protein, 9 aa, Homo sapiens
  Light chain CDR3 for antibody 1441 (IGKV6-21)
HQSSSLPYT

SEQ ID NO: 2882 - protein, 13 aa, Homo sapiens
  Heavy chain CDR3 for antibody 1441 (IGHV3-33)
ARGDNWNDGGFDY

SEQ ID NO: 2883 - protein, 9 aa, Homo sapiens
  Light chain CDR3 for antibody 1442 (IGKV1D-16)
QQYNSYPYT

SEQ ID NO: 2884 - protein, 14 aa, Homo sapiens
  Heavy chain CDR3 for antibody 1442 (IGHV3-33)
VSAISGSSYWYFAL

SEQ ID NO: 2885 - protein, 9 aa, Homo sapiens
  Light chain CDR3 for antibody 1443 (IGKV1-9)
QQLKSYLYT

SEQ ID NO: 2886 - protein, 13 aa, Homo sapiens
  Heavy chain CDR3 for antibody 1443 (IGHV4-59)
ARDAGYSSSWFDY

SEQ ID NO: 2887 - protein, 10 aa, Homo sapiens
  Light chain CDR3 for antibody 1444 (IGKV3-15)
QQYNNWPPIT

SEQ ID NO: 2888 - protein, 17 aa, Homo sapiens
  Heavy chain CDR3 for antibody 1444 (IGHV3-23)
AKGISVADYYYYYAFDV

SEQ ID NO: 2889 - protein, 9 aa, Homo sapiens
  Light chain CDR3 for antibody 1445 (IGKV1-27)
QKYNSAPYT

SEQ ID NO: 2890 - protein, 15 aa, Homo sapiens
  Heavy chain CDR3 for antibody 1445 (IGHV3-33)
ARDTGYSSSWNWFDP

SEQ ID NO: 2891 - protein, 9 aa, Homo sapiens
  Light chain CDR3 for antibody 1446 (IGKV1-39)
QQSYSTPFT

SEQ ID NO: 2892 - protein, 12 aa, Homo sapiens
  Heavy chain CDR3 for antibody 1446 (IGHV4-61)
ARVYSSGWLFDY

SEQ ID NO: 2893 - protein, 9 aa, Homo sapiens
  Light chain CDR3 for antibody 1447 (IGKV5-2)
LQHDNFPYT

SEQ ID NO: 2894 - protein, 15 aa, Homo sapiens
  Heavy chain CDR3 for antibody 1447 (IGHV3-33)
ARRGYNDYDPYGMDV

SEQ ID NO: 2895 - protein, 9 aa, Homo sapiens
  Light chain CDR3 for antibody 1448 (IGKV6-21)
HQSSSLPYT

SEQ ID NO: 2896 - protein, 18 aa, Homo sapiens
  Heavy chain CDR3 for antibody 1448 (IGHV3-33)
ARGLLWFGVSYYYYGMDV

SEQ ID NO: 2897 - protein, 9 aa, Homo sapiens
  Light chain CDR3 for antibody 1449 (IGKV1-17)
LQHNSYPYT

SEQ ID NO: 2898 - protein, 20 aa, Homo sapiens
  Heavy chain CDR3 for antibody 1449 (IGHV3-33)
ARDWMVRGVIITDYYYGMDV

SEQ ID NO: 2899 - protein, 9 aa, Homo sapiens
  Light chain CDR3 for antibody 1450 (IGKV5-2)
LQHDNFPYT

SEQ ID NO: 2900 - protein, 17 aa, Homo sapiens
  Heavy chain CDR3 for antibody 1450 (IGHV3-23)
AKDGIGELSYYYYGMDV

SEQ ID NO: 2901 - protein, 9 aa, Homo sapiens
  Light chain CDR3 for antibody 1451 (IGKV1-6)
LQDYNYPYT

SEQ ID NO: 2902 - protein, 24 aa, Homo sapiens
  Heavy chain CDR3 for antibody 1451 (IGHV1-46)
ARDEARGLLTGYYNMREYYYGMDV

SEQ ID NO: 2903 - protein, 9 aa, Homo sapiens
  Light chain CDR3 for antibody 1452 (IGKV5-2)
LQHDNFPYT

SEQ ID NO: 2904 - protein, 17 aa, Homo sapiens
  Heavy chain CDR3 for antibody 1452 (IGHV3-23)
AKDGSFYSSGWYDAFDI

SEQ ID NO: 2905 - protein, 9 aa, Homo sapiens
  Light chain CDR3 for antibody 1453 (IGKV1-17)
LQHNSYPYT

SEQ ID NO: 2906 - protein, 19 aa, Homo sapiens
  Heavy chain CDR3 for antibody 1453 (IGHV3-33)
ARGPYYDILTGYGYYGMDV

SEQ ID NO: 2907 - protein, 9 aa, Homo sapiens
  Light chain CDR3 for antibody 1454 (IGKV1-27)
QKYNSAPYT

SEQ ID NO: 2908 - protein, 14 aa, Homo sapiens
  Heavy chain CDR3 for antibody 1454 (IGHV3-23)
AKSRIVGALYYFDY

SEQ ID NO: 2909 - protein, 9 aa, Homo sapiens
  Light chain CDR3 for antibody 1455 (IGKV3D-20)
QQYGSSPYT

SEQ ID NO: 2910 - protein, 13 aa, Homo sapiens
  Heavy chain CDR3 for antibody 1455 (IGHV3-33)
ARVDTMVRGVMAY

SEQ ID NO: 2911 - protein, 9 aa, Homo sapiens
  Light chain CDR3 for antibody 1456 (IGKV1-17)
LQHNSYPYT

SEQ ID NO: 2912 - protein, 16 aa, Homo sapiens
  Heavy chain CDR3 for antibody 1456 (IGHV3-33)
AREVAGSYYYYYGMDV

SEQ ID NO: 2913 - protein, 9 aa, Homo sapiens
  Light chain CDR3 for antibody 1457 (IGKV3-20)
QQYGSSPYT

SEQ ID NO: 2914 - protein, 13 aa, Homo sapiens
  Heavy chain CDR3 for antibody 1457 (IGHV3-53)
ARSGSYWGYYFDY

SEQ ID NO: 2915 - protein, 9 aa, Homo sapiens
  Light chain CDR3 for antibody 1458 (IGKV1D-13)
QQFNNYPYT

SEQ ID NO: 2916 - protein, 12 aa, Homo sapiens
  Heavy chain CDR3 for antibody 1458 (IGHV3-33)
ARDRAYRGSLDY

SEQ ID NO: 2917 - protein, 9 aa, Homo sapiens
  Light chain CDR3 for antibody 1459 (IGKV1D-13)
QQFNNYPHT

SEQ ID NO: 2918 - protein, 13 aa, Homo sapiens
  Heavy chain CDR3 for antibody 1459 (IGHV3-23)
ARAFFMVRGVIDF

SEQ ID NO: 2919 - protein, 9 aa, Homo sapiens
  Light chain CDR3 for antibody 1460 (IGKV3-20)
QQYGSSPYT

SEQ ID NO: 2920 - protein, 12 aa, Homo sapiens
  Heavy chain CDR3 for antibody 1460 (IGHV3-33)
ARDPGYYYGLDV

SEQ ID NO: 2921 - protein, 8 aa, Homo sapiens
  Light chain CDR3 for antibody 1461 (IGKV3D-7)
QQDYNLLT

SEQ ID NO: 2922 - protein, 13 aa, Homo sapiens
  Heavy chain CDR3 for antibody 1461 (IGHV4-34)
ASNFYYYYYGMDV

SEQ ID NO: 2923 - protein, 9 aa, Homo sapiens
  Light chain CDR3 for antibody 1462 (IGKV1-39)
QQSYSTPLT

SEQ ID NO: 2924 - protein, 15 aa, Homo sapiens
  Heavy chain CDR3 for antibody 1462 (IGHV3-33)
ARDTGYSSSWNWFDP

SEQ ID NO: 2925 - protein, 9 aa, Homo sapiens
  Light chain CDR3 for antibody 1463 (IGKV3-20)
QQYGSSPYT

SEQ ID NO: 2926 - protein, 13 aa, Homo sapiens
  Heavy chain CDR3 for antibody 1463 (IGHV4-39)
ARHPPSRDYGMDV

SEQ ID NO: 2927 - protein, 9 aa, Homo sapiens
  Light chain CDR3 for antibody 1464 (IGKV3D-7)
QQDYNLPLT

SEQ ID NO: 2928 - protein, 9 aa, Homo sapiens
  Heavy chain CDR3 for antibody 1464 (IGHV1-18)
ARGKDWFDP

SEQ ID NO: 2929 - protein, 9 aa, Homo sapiens
  Light chain CDR3 for antibody 1465 (IGKV3-20)
QQYGSSPYT

SEQ ID NO: 2930 - protein, 14 aa, Homo sapiens
  Heavy chain CDR3 for antibody 1465 (IGHV1-2)
ARDYYGSGNYYMGY

SEQ ID NO: 2931 - protein, 9 aa, Homo sapiens
  Light chain CDR3 for antibody 1466 (IGKV1D-13)
QQFNNYPYT

SEQ ID NO: 2932 - protein, 9 aa, Homo sapiens
  Heavy chain CDR3 for antibody 1466 (IGHV3-30)
ARDYFHYDY

SEQ ID NO: 2933 - protein, 9 aa, Homo sapiens
  Light chain CDR3 for antibody 1467 (IGKV1D-16)
QQYNSYPYT

SEQ ID NO: 2934 - protein, 13 aa, Homo sapiens
  Heavy chain CDR3 for antibody 1467 (IGHV3-33)
ARALYSSSWPGDY

SEQ ID NO: 2935 - protein, 9 aa, Homo sapiens
  Light chain CDR3 for antibody 1468 (IGKV5-2)
LQHDNFPYT

SEQ ID NO: 2936 - protein, 12 aa, Homo sapiens
  Heavy chain CDR3 for antibody 1468 (IGHV3-33)
ARDPGYYYGLDV

SEQ ID NO: 2937 - protein, 9 aa, Homo sapiens
  Light chain CDR3 for antibody 1469 (IGKV5-2)
LQHDNFPYT

SEQ ID NO: 2938 - protein, 24 aa, Homo sapiens
  Heavy chain CDR3 for antibody 1469 (IGHV3-20)
ARGRITMVRGVIINPLDYYNGMDV

SEQ ID NO: 2939 - protein, 9 aa, Homo sapiens
  Light chain CDR3 for antibody 1470 (IGKV1-6)
LQDYHYPWT

SEQ ID NO: 2940 - protein, 14 aa, Homo sapiens
  Heavy chain CDR3 for antibody 1470 (IGHV3-33)
ARDGVYISSSWFDP

SEQ ID NO: 2941 - protein, 9 aa, Homo sapiens
  Light chain CDR3 for antibody 1471 (IGKV5-2)
LQHDNFPWT

SEQ ID NO: 2942 - protein, 8 aa, Homo sapiens
  Heavy chain CDR3 for antibody 1471 (IGHV4-39)
ARRGGLDY

SEQ ID NO: 2943 - protein, 9 aa, Homo sapiens
  Light chain CDR3 for antibody 1472 (IGKV1-39)
QQSYSTPFT

SEQ ID NO: 2944 - protein, 15 aa, Homo sapiens
  Heavy chain CDR3 for antibody 1472 (IGHV4-59)
ARDLGHYYGSVSIDY

SEQ ID NO: 2945 - protein, 9 aa, Homo sapiens
  Light chain CDR3 for antibody 1473 (IGKV1-39)
QQSYSTPLT

SEQ ID NO: 2946 - protein, 14 aa, Homo sapiens
  Heavy chain CDR3 for antibody 1473 (IGHV4-39)
ARQDYDILTGLFDY

SEQ ID NO: 2947 - protein, 9 aa, Homo sapiens
  Light chain CDR3 for antibody 1474 (IGKV3D-7)
QQDYNLPFT

SEQ ID NO: 2948 - protein, 9 aa, Homo sapiens
  Heavy chain CDR3 for antibody 1474 (IGHV3-23)
ATIAADFDY

SEQ ID NO: 2949 - protein, 9 aa, Homo sapiens
  Light chain CDR3 for antibody 1475 (IGKV1D-13)
QQFNNYPHT

SEQ ID NO: 2950 - protein, 15 aa, Homo sapiens
  Heavy chain CDR3 for antibody 1475 (IGHV3-33)
ARRVCSGGSCSLFDY

SEQ ID NO: 2951 - protein, 9 aa, Homo sapiens
  Light chain CDR3 for antibody 1476 (IGKV1D-13)
QQFNNYPYT

SEQ ID NO: 2952 - protein, 9 aa, Homo sapiens
  Heavy chain CDR3 for antibody 1476 (IGHV3-30)
ARDNWGFDY

SEQ ID NO: 2953 - protein, 9 aa, Homo sapiens
  Light chain CDR3 for antibody 1477 (IGKV1-9)
QQYNSYPLT

SEQ ID NO: 2954 - protein, 8 aa, Homo sapiens
  Heavy chain CDR3 for antibody 1477 (IGHV4-39)
ARRGGLDY

SEQ ID NO: 2955 - protein, 9 aa, Homo sapiens
  Light chain CDR3 for antibody 1478 (IGKV1-9)
QQLNSYPLT

SEQ ID NO: 2956 - protein, 11 aa, Homo sapiens
  Heavy chain CDR3 for antibody 1478 (IGHV3-33)
AREAANWGFDY

SEQ ID NO: 2957 - protein, 9 aa, Homo sapiens
  Light chain CDR3 for antibody 1479 (IGKV6-21)
HQSSSLPYT

SEQ ID NO: 2958 - protein, 14 aa, Homo sapiens
  Heavy chain CDR3 for antibody 1479 (IGHV3-33)
VRDAMGATTAWFDP

SEQ ID NO: 2959 - protein, 11 aa, Homo sapiens
  Light chain CDR3 for antibody 1480 (IGKV3-11)
QQRSNWPPTWT

SEQ ID NO: 2960 - protein, 13 aa, Homo sapiens
  Heavy chain CDR3 for antibody 1480 (IGHV4-34)
ASNFYYYYYGMDV

SEQ ID NO: 2961 - protein, 9 aa, Homo sapiens
  Light chain CDR3 for antibody 1481 (IGKV1-39)
QQSYSTPLT

SEQ ID NO: 2962 - protein, 15 aa, Homo sapiens
  Heavy chain CDR3 for antibody 1481 (IGHV1-18)
ARGYCSSTSCYYFDY

SEQ ID NO: 2963 - protein, 9 aa, Homo sapiens
  Light chain CDR3 for antibody 1482 (IGKV6-21)
HQSSSLPYT

SEQ ID NO: 2964 - protein, 21 aa, Homo sapiens
  Heavy chain CDR3 for antibody 1482 (IGHV3-23)
AKDIDYYGSGSYPLYYYGMDV

SEQ ID NO: 2965 - protein, 9 aa, Homo sapiens
  Light chain CDR3 for antibody 1483 (IGKV1-6)
LQDYNYPLT

SEQ ID NO: 2966 - protein, 12 aa, Homo sapiens
  Heavy chain CDR3 for antibody 1483 (IGHV1-18)
ARLGGFGEFPDC

SEQ ID NO: 2967 - protein, 9 aa, Homo sapiens
  Light chain CDR3 for antibody 1484 (IGKV1-17)
LQHNSYPYT

SEQ ID NO: 2968 - protein, 18 aa, Homo sapiens
  Heavy chain CDR3 for antibody 1484 (IGHV3-33)
ARDGRISLVRGIIDAFDI

SEQ ID NO: 2969 - protein, 9 aa, Homo sapiens
  Light chain CDR3 for antibody 1485 (IGKV1-6)
LQDYNYPYT

SEQ ID NO: 2970 - protein, 11 aa, Homo sapiens
  Heavy chain CDR3 for antibody 1485 (IGHV4-39)
AREFDWSPFDY

SEQ ID NO: 2971 - protein, 9 aa, Homo sapiens
  Light chain CDR3 for antibody 1486 (IGKV5-2)
LQHDNFPYT

SEQ ID NO: 2972 - protein, 14 aa, Homo sapiens
  Heavy chain CDR3 for antibody 1486 (IGHV3-23)
AKDRYRGYEGLFDY

SEQ ID NO: 2973 - protein, 10 aa, Homo sapiens
  Light chain CDR3 for antibody 1487 (IGKV1-17)
LQHNSYPMYT

SEQ ID NO: 2974 - protein, 16 aa, Homo sapiens
  Heavy chain CDR3 for antibody 1487 (IGHV3-23)
AKEGMVLRYFDWLWDY

SEQ ID NO: 2975 - protein, 9 aa, Homo sapiens
  Light chain CDR3 for antibody 1488 (IGKV1-9)
QQLNSYPLT

SEQ ID NO: 2976 - protein, 13 aa, Homo sapiens
  Heavy chain CDR3 for antibody 1488 (IGHV4-39)
ARRDVLAPAAFDY

SEQ ID NO: 2977 - protein, 9 aa, Homo sapiens
  Light chain CDR3 for antibody 1489 (IGKV1D-13)
QQFNNYPYT

SEQ ID NO: 2978 - protein, 18 aa, Homo sapiens
  Heavy chain CDR3 for antibody 1489 (IGHV3-33)
ARDGYSGYDYYYYYGMDV

SEQ ID NO: 2979 - protein, 8 aa, Homo sapiens
  Light chain CDR3 for antibody 1490 (IGKV3-20)
QQYGRSFT

SEQ ID NO: 2980 - protein, 13 aa, Homo sapiens
  Heavy chain CDR3 for antibody 1490 (IGHV4-59)
ARDAGYSSSWFDY

SEQ ID NO: 2981 - protein, 9 aa, Homo sapiens
  Light chain CDR3 for antibody 1491 (IGKV1-6)
LQDYNYPYT

SEQ ID NO: 2982 - protein, 10 aa, Homo sapiens
  Heavy chain CDR3 for antibody 1491 (IGHV1-18)
AREQRLGFDY

SEQ ID NO: 2983 - protein, 9 aa, Homo sapiens
  Light chain CDR3 for antibody 1492 (IGKV3-20)
QQYGSSPYT

SEQ ID NO: 2984 - protein, 12 aa, Homo sapiens
  Heavy chain CDR3 for antibody 1492 (IGHV3-33)
ASRDILTGYLGY

SEQ ID NO: 2985 - protein, 9 aa, Homo sapiens
  Light chain CDR3 for antibody 1493 (IGKV5-2)
LQHDNFPWT

SEQ ID NO: 2986 - protein, 20 aa, Homo sapiens
  Heavy chain CDR3 for antibody 1493 (IGHV1-f)
ATGLITFVRGVILTYRSFDY

SEQ ID NO: 2987 - protein, 9 aa, Homo sapiens
  Light chain CDR3 for antibody 1494 (IGKV5-2)
LQHDNFPYT

SEQ ID NO: 2988 - protein, 11 aa, Homo sapiens
  Heavy chain CDR3 for antibody 1494 (IGHV3-13)
AREAIIGPFDY

SEQ ID NO: 2989 - protein, 9 aa, Homo sapiens
  Light chain CDR3 for antibody 1495 (IGKV2-30)
AQGSYWPAS

SEQ ID NO: 2990 - protein, 10 aa, Homo sapiens
  Heavy chain CDR3 for antibody 1495 (IGHV3-72)
CRDREGFGDV

SEQ ID NO: 2991 - protein, 9 aa, Homo sapiens
  Light chain CDR3 for antibody 1496 (IGKV3D-20)
QQYGSSPYT

SEQ ID NO: 2992 - protein, 14 aa, Homo sapiens
  Heavy chain CDR3 for antibody 1496 (IGHV3-33)
ARDNILTAYYLFDY

SEQ ID NO: 2993 - protein, 9 aa, Homo sapiens
  Light chain CDR3 for antibody 1497 (IGKV1D-16)
QQYNSYPLT

SEQ ID NO: 2994 - protein, 16 aa, Homo sapiens
  Heavy chain CDR3 for antibody 1497 (IGHV3-33)
ARGDDILTHQYYGVDV

SEQ ID NO: 2995 - protein, 9 aa, Homo sapiens
  Light chain CDR3 for antibody 1498 (IGKV4-1)
QQYYSTPRT

SEQ ID NO: 2996 - protein, 17 aa, Homo sapiens
  Heavy chain CDR3 for antibody 1498 (IGHV3-23)
AKEGSSSSWYGGLYFDY

SEQ ID NO: 2997 - protein, 9 aa, Homo sapiens
  Light chain CDR3 for antibody 1499 (IGKV1-17)
LQHNSYPYT

SEQ ID NO: 2998 - protein, 17 aa, Homo sapiens
  Heavy chain CDR3 for antibody 1499 (IGHV3-30)
ARDGVGATSYYYYGMDV

SEQ ID NO: 2999 - protein, 9 aa, Homo sapiens
  Light chain CDR3 for antibody 1500 (IGKV1-9)
QQLNSYPLT

SEQ ID NO: 3000 - protein, 10 aa, Homo sapiens
  Heavy chain CDR3 for antibody 1500 (IGHV3-33)
ARDVVVYFDY

SEQ ID NO: 3001 - protein, 9 aa, Homo sapiens
  Light chain CDR3 for antibody 1501 (IGKV5-2)
LQHDNFPYT

SEQ ID NO: 3002 - protein, 14 aa, Homo sapiens
  Heavy chain CDR3 for antibody 1501 (IGHV3-33)
ARGGYSGYRYYFDY

SEQ ID NO: 3003 - protein, 9 aa, Homo sapiens
  Light chain CDR3 for antibody 1502 (IGKV5-2)
LQHDNFPYT

SEQ ID NO: 3004 - protein, 19 aa, Homo sapiens
  Heavy chain CDR3 for antibody 1502 (IGHV3-33)
ARGVRLRYFDPYYYYGMDV

SEQ ID NO: 3005 - protein, 9 aa, Homo sapiens
  Light chain CDR3 for antibody 1503 (IGKV1-17)
LQHNSYPYT

SEQ ID NO: 3006 - protein, 15 aa, Homo sapiens
  Heavy chain CDR3 for antibody 1503 (IGHV3-33)
ARRSILTGSYWYFDL

SEQ ID NO: 3007 - protein, 9 aa, Homo sapiens
  Light chain CDR3 for antibody 1504 (IGKV1-6)
LQDYNYPYT

SEQ ID NO: 3008 - protein, 17 aa, Homo sapiens
  Heavy chain CDR3 for antibody 1504 (IGHV3-23)
AKDYDILTGYSHNWFDP

SEQ ID NO: 3009 - protein, 9 aa, Homo sapiens
  Light chain CDR3 for antibody 1505 (IGKV3-20)
QQYGSSPYT

SEQ ID NO: 3010 - protein, 18 aa, Homo sapiens
  Heavy chain CDR3 for antibody 1505 (IGHV3-33)
VRDRERYGSGSYPDAFDI

SEQ ID NO: 3011 - protein, 9 aa, Homo sapiens
  Light chain CDR3 for antibody 1506 (IGKV3-20)
QQYGSSPYT

SEQ ID NO: 3012 - protein, 12 aa, Homo sapiens
  Heavy chain CDR3 for antibody 1506 (IGHV3-33)
AREGDILTGYSL

SEQ ID NO: 3013 - protein, 9 aa, Homo sapiens
  Light chain CDR3 for antibody 1507 (IGKV1D-16)
QQYNSYPLT

SEQ ID NO: 3014 - protein, 11 aa, Homo sapiens
  Heavy chain CDR3 for antibody 1507 (IGHV3-74)
ARDRGNWGFDY

SEQ ID NO: 3015 - protein, 9 aa, Homo sapiens
  Light chain CDR3 for antibody 1508 (IGKV1-39)
QQSYSTPLT

SEQ ID NO: 3016 - protein, 12 aa, Homo sapiens
  Heavy chain CDR3 for antibody 1508 (IGHV3-33)
TRGYSSKSYFDY

SEQ ID NO: 3017 - protein, 9 aa, Homo sapiens
  Light chain CDR3 for antibody 1509 (IGKV1D-16)
QQYNSYPLT

SEQ ID NO: 3018 - protein, 19 aa, Homo sapiens
  Heavy chain CDR3 for antibody 1509 (IGHV3-30)
ARRFSGYSGYDHYYYGMDV

SEQ ID NO: 3019 - protein, 9 aa, Homo sapiens
  Light chain CDR3 for antibody 1510 (IGKV1-27)
QKYNSAPYT

SEQ ID NO: 3020 - protein, 12 aa, Homo sapiens
  Heavy chain CDR3 for antibody 1510 (IGHV3-33)
TRGYSSKSYFDY

SEQ ID NO: 3021 - protein, 9 aa, Homo sapiens
  Light chain CDR3 for antibody 1511 (IGKV1-39)
QQSYSTPLT

SEQ ID NO: 3022 - protein, 13 aa, Homo sapiens
  Heavy chain CDR3 for antibody 1511 (IGHV3-33)
ARKAYGDYFYFDY

SEQ ID NO: 3023 - protein, 9 aa, Homo sapiens
  Light chain CDR3 for antibody 1512 (IGKV3D-7)
QQDYNLPYT

SEQ ID NO: 3024 - protein, 15 aa, Homo sapiens
  Heavy chain CDR3 for antibody 1512 (IGHV3-33)
ARRGGIAAAGYYFDY

SEQ ID NO: 3025 - protein, 9 aa, Homo sapiens
  Light chain CDR3 for antibody 1513 (IGKV1-39)
QQSYSTPFT

SEQ ID NO: 3026 - protein, 13 aa, Homo sapiens
  Heavy chain CDR3 for antibody 1513 (IGHV4-28)
ARKGATGYYGMDV

SEQ ID NO: 3027 - protein, 9 aa, Homo sapiens
  Light chain CDR3 for antibody 1514 (IGKV6-21)
HQSSSLPYT

SEQ ID NO: 3028 - protein, 12 aa, Homo sapiens
  Heavy chain CDR3 for antibody 1514 (IGHV3-33)
AREGTRWVYFDY

SEQ ID NO: 3029 - protein, 9 aa, Homo sapiens
  Light chain CDR3 for antibody 1515 (IGKV5-2)
LQHDNFPYT

SEQ ID NO: 3030 - protein, 17 aa, Homo sapiens
  Heavy chain CDR3 for antibody 1515 (IGHV3-66)
ARVQYDILTGYSPYFDN

SEQ ID NO: 3031 - protein, 9 aa, Homo sapiens
  Light chain CDR3 for antibody 1516 (IGKV1D-16)
QQYNSYPYT

SEQ ID NO: 3032 - protein, 17 aa, Homo sapiens
  Heavy chain CDR3 for antibody 1516 (IGHV6-1)
ARDQYSYGPYYYYGMDV

SEQ ID NO: 3033 - protein, 9 aa, Homo sapiens
  Light chain CDR3 for antibody 1517 (IGKV5-2)
LQHDNFPYT

SEQ ID NO: 3034 - protein, 11 aa, Homo sapiens
  Heavy chain CDR3 for antibody 1517 (IGHV3-33)
ARAGIAAVFDY

SEQ ID NO: 3035 - protein, 9 aa, Homo sapiens
  Light chain CDR3 for antibody 1518 (IGKV1-27)
QKYNSAPYT

SEQ ID NO: 3036 - protein, 14 aa, Homo sapiens
  Heavy chain CDR3 for antibody 1518 (IGHV3-33)
ARAISGSSYWYFDL

SEQ ID NO: 3037 - protein, 9 aa, Homo sapiens
  Light chain CDR3 for antibody 1519 (IGKV1-17)
LQHNSYPYT

SEQ ID NO: 3038 - protein, 19 aa, Homo sapiens
  Heavy chain CDR3 for antibody 1519 (IGHV3-33)
AREDYYGSGSYYNEDWFDP

SEQ ID NO: 3039 - protein, 9 aa, Homo sapiens
  Light chain CDR3 for antibody 1520 (IGKV1D-16)
QQYNSYPYT

SEQ ID NO: 3040 - protein, 17 aa, Homo sapiens
  Heavy chain CDR3 for antibody 1520 (IGHV3-33)
ARDRDDILTGFYTYFDY

SEQ ID NO: 3041 - protein, 9 aa, Homo sapiens
  Light chain CDR3 for antibody 1521 (IGKV6-21)
HQSSSLPYT

SEQ ID NO: 3042 - protein, 16 aa, Homo sapiens
  Heavy chain CDR3 for antibody 1521 (IGHV4-59)
ARYSGSYYGDYYGMDV

SEQ ID NO: 3043 - protein, 9 aa, Homo sapiens
  Light chain CDR3 for antibody 1522 (IGKV1-6)
LQDYNYPRT

SEQ ID NO: 3044 - protein, 8 aa, Homo sapiens
  Heavy chain CDR3 for antibody 1522 (IGHV4-39)
ARRGGLDY

SEQ ID NO: 3045 - protein, 9 aa, Homo sapiens
  Light chain CDR3 for antibody 1523 (IGKV3-11)
QQRSNWPRT

SEQ ID NO: 3046 - protein, 12 aa, Homo sapiens
  Heavy chain CDR3 for antibody 1523 (IGHV3-33)
AREGVMGYSGSY

SEQ ID NO: 3047 - protein, 9 aa, Homo sapiens
  Light chain CDR3 for antibody 1524 (IGKV3D-7)
QQDYNLPLT

SEQ ID NO: 3048 - protein, 9 aa, Homo sapiens
  Heavy chain CDR3 for antibody 1524 (IGHV4-59)
AREGGSGSL

SEQ ID NO: 3049 - protein, 9 aa, Homo sapiens
  Light chain CDR3 for antibody 1525 (IGKV1-39)
QQSYNTPAT

SEQ ID NO: 3050 - protein, 11 aa, Homo sapiens
  Heavy chain CDR3 for antibody 1525 (IGHV1-46)
AREQHGQAPDY

SEQ ID NO: 3051 - protein, 9 aa, Homo sapiens
  Light chain CDR3 for antibody 1526 (IGKV3-20)
QQYGSSPYT

SEQ ID NO: 3052 - protein, 13 aa, Homo sapiens
  Heavy chain CDR3 for antibody 1526 (IGHV1-18)
ARGGGVRGAPLDY

SEQ ID NO: 3053 - protein, 9 aa, Homo sapiens
  Light chain CDR3 for antibody 1527 (IGKV1-5)
QQYDSYFWT

SEQ ID NO: 3054 - protein, 15 aa, Homo sapiens
  Heavy chain CDR3 for antibody 1527 (IGHV3-15)
TTGWVRYCSGGSCRI

SEQ ID NO: 3055 - protein, 9 aa, Homo sapiens
  Light chain CDR3 for antibody 1528 (IGKV5-2)
LQHDNFPWT

SEQ ID NO: 3056 - protein, 13 aa, Homo sapiens
  Heavy chain CDR3 for antibody 1528 (IGHV4-39)
ARRDGSYYGYFDY

SEQ ID NO: 3057 - protein, 9 aa, Homo sapiens
  Light chain CDR3 for antibody 1529 (IGKV6-21)
HQSSSLPYT

SEQ ID NO: 3058 - protein, 15 aa, Homo sapiens
  Heavy chain CDR3 for antibody 1529 (IGHV3-33)
ARRGYNDYDPYGMDV

SEQ ID NO: 3059 - protein, 9 aa, Homo sapiens
  Light chain CDR3 for antibody 1530 (IGKV3D-7)
QQDYNLPLT

SEQ ID NO: 3060 - protein, 15 aa, Homo sapiens
  Heavy chain CDR3 for antibody 1530 (IGHV3-30)
ARGAMVRGVDYGMDV

SEQ ID NO: 3061 - protein, 9 aa, Homo sapiens
  Light chain CDR3 for antibody 1531 (IGKV5-2)
LQHDNFPYT

SEQ ID NO: 3062 - protein, 13 aa, Homo sapiens
  Heavy chain CDR3 for antibody 1531 (IGHV3-33)
ARGVLWFGELFDY

SEQ ID NO: 3063 - protein, 9 aa, Homo sapiens
  Light chain CDR3 for antibody 1532 (IGKV3-20)
QQYGSSPYT

SEQ ID NO: 3064 - protein, 17 aa, Homo sapiens
  Heavy chain CDR3 for antibody 1532 (IGHV3-33)
ARESLKLGIYYYYGMDV

SEQ ID NO: 3065 - protein, 9 aa, Homo sapiens
  Light chain CDR3 for antibody 1533 (IGKV1-6)
LQDFNYPRT

SEQ ID NO: 3066 - protein, 18 aa, Homo sapiens
  Heavy chain CDR3 for antibody 1533 (IGHV4-59)
AREGDYVWGSYRSNWFDP

SEQ ID NO: 3067 - protein, 9 aa, Homo sapiens
  Light chain CDR3 for antibody 1534 (IGKV1-9)
QQLKSYLYT

SEQ ID NO: 3068 - protein, 17 aa, Homo sapiens
  Heavy chain CDR3 for antibody 1534 (IGHV1-18)
ARDEGYDILTGYPHFDY

SEQ ID NO: 3069 - protein, 9 aa, Homo sapiens
  Light chain CDR3 for antibody 1535 (IGKV5-2)
LQHDNFPYT

SEQ ID NO: 3070 - protein, 12 aa, Homo sapiens
  Heavy chain CDR3 for antibody 1535 (IGHV3-h)
AREDYYYYGMDV

SEQ ID NO: 3071 - protein, 9 aa, Homo sapiens
  Light chain CDR3 for antibody 1536 (IGKV6-21)
HQSSSLPYT

SEQ ID NO: 3072 - protein, 21 aa, Homo sapiens
  Heavy chain CDR3 for antibody 1536 (IGHV3-33)
ARDEYYEIVTGYGYYHYGMDV

SEQ ID NO: 3073 - protein, 9 aa, Homo sapiens
  Light chain CDR3 for antibody 1537 (IGKV6-21)
HQSSSLPYT

SEQ ID NO: 3074 - protein, 8 aa, Homo sapiens
  Heavy chain CDR3 for antibody 1537 (IGHV3-23)
AKESLLDY

SEQ ID NO: 3075 - protein, 9 aa, Homo sapiens
  Light chain CDR3 for antibody 1538 (IGKV6-21)
HQSSSLPYT

SEQ ID NO: 3076 - protein, 12 aa, Homo sapiens
  Heavy chain CDR3 for antibody 1538 (IGHV3-h)
AREDYYYYGMDV

SEQ ID NO: 3077 - protein, 9 aa, Homo sapiens
  Light chain CDR3 for antibody 1539 (IGKV1-27)
QKYNSAPYT

SEQ ID NO: 3078 - protein, 11 aa, Homo sapiens
  Heavy chain CDR3 for antibody 1539 (IGHV3-33)
ARDKSSGWSDY

SEQ ID NO: 3079 - protein, 9 aa, Homo sapiens
  Light chain CDR3 for antibody 1540 (IGKV1-9)
QQYNSYPLT

SEQ ID NO: 3080 - protein, 13 aa, Homo sapiens
  Heavy chain CDR3 for antibody 1540 (IGHV4-59)
ANRDYYGYYGMDV

SEQ ID NO: 3081 - protein, 9 aa, Homo sapiens
  Light chain CDR3 for antibody 1541 (IGKV1D-16)
QQYNSYPYT

SEQ ID NO: 3082 - protein, 16 aa, Homo sapiens
  Heavy chain CDR3 for antibody 1541 (IGHV3-20)
ARDSSSLDYYYYGMDV

SEQ ID NO: 3083 - protein, 9 aa, Homo sapiens
  Light chain CDR3 for antibody 1542 (IGKV1-27)
QKYNSAPYT

SEQ ID NO: 3084 - protein, 12 aa, Homo sapiens
  Heavy chain CDR3 for antibody 1542 (IGHV3-33)
ARDPGYYYGLDV

SEQ ID NO: 3085 - protein, 9 aa, Homo sapiens
  Light chain CDR3 for antibody 1543 (IGKV3-20)
QQYGSSPYT

SEQ ID NO: 3086 - protein, 11 aa, Homo sapiens
  Heavy chain CDR3 for antibody 1543 (IGHV1-46)
AREEDLGAFDI

SEQ ID NO: 3087 - protein, 9 aa, Homo sapiens
  Light chain CDR3 for antibody 1544 (IGKV3-20)
QQYGSSPYT

SEQ ID NO: 3088 - protein, 17 aa, Homo sapiens
  Heavy chain CDR3 for antibody 1544 (IGHV4-34)
AGLRFFDWLFDYYGMDV

SEQ ID NO: 3089 - protein, 9 aa, Homo sapiens
  Light chain CDR3 for antibody 1545 (IGKV5-2)
LQHDNFPWT

SEQ ID NO: 3090 - protein, 15 aa, Homo sapiens
  Heavy chain CDR3 for antibody 1545 (IGHV4-39)
ARRDYDILTGYLFDY

SEQ ID NO: 3091 - protein, 9 aa, Homo sapiens
  Light chain CDR3 for antibody 1546 (IGKV5-2)
LQHDNFPWT

SEQ ID NO: 3092 - protein, 12 aa, Homo sapiens
  Heavy chain CDR3 for antibody 1546 (IGHV4-59)
ARDSGSYYYFDY

SEQ ID NO: 3093 - protein, 9 aa, Homo sapiens
  Light chain CDR3 for antibody 1547 (IGKV6-21)
HQSSSLPYT

SEQ ID NO: 3094 - protein, 12 aa, Homo sapiens
  Heavy chain CDR3 for antibody 1547 (IGHV3-33)
ARDSSGWSHFDY

SEQ ID NO: 3095 - protein, 9 aa, Homo sapiens
  Light chain CDR3 for antibody 1548 (IGKV1D-16)
QQYNSYPYT

SEQ ID NO: 3096 - protein, 14 aa, Homo sapiens
  Heavy chain CDR3 for antibody 1548 (IGHV3-33)
ARASSGSSYWYIDL

SEQ ID NO: 3097 - protein, 9 aa, Homo sapiens
  Light chain CDR3 for antibody 1549 (IGKV1D-16)
QQYNSYPLT

SEQ ID NO: 3098 - protein, 18 aa, Homo sapiens
  Heavy chain CDR3 for antibody 1549 (IGHV3-33)
ARGGYSSGWDYYYYGMDV

SEQ ID NO: 3099 - protein, 9 aa, Homo sapiens
  Light chain CDR3 for antibody 1550 (IGKV5-2)
LQHDNFPYT

SEQ ID NO: 3100 - protein, 9 aa, Homo sapiens
  Heavy chain CDR3 for antibody 1550 (IGHV3-23)
AKEQQLFDY

SEQ ID NO: 3101 - protein, 9 aa, Homo sapiens
  Light chain CDR3 for antibody 1551 (IGKV1-39)
QQSYSTPLT

SEQ ID NO: 3102 - protein, 12 aa, Homo sapiens
  Heavy chain CDR3 for antibody 1551 (IGHV1-18)
ARILFYGDYFDY

SEQ ID NO: 3103 - protein, 9 aa, Homo sapiens
  Light chain CDR3 for antibody 1552 (IGKV3-20)
QQYGSSPYT

SEQ ID NO: 3104 - protein, 7 aa, Homo sapiens
  Heavy chain CDR3 for antibody 1552 (IGHV3-33)
ARELVDY

SEQ ID NO: 3105 - protein, 9 aa, Homo sapiens
  Light chain CDR3 for antibody 1553 (IGKV3-20)
QQYGSSPYT

SEQ ID NO: 3106 - protein, 11 aa, Homo sapiens
  Heavy chain CDR3 for antibody 1553 (IGHV4-4)
AREAYYYGLDV

SEQ ID NO: 3107 - protein, 9 aa, Homo sapiens
  Light chain CDR3 for antibody 1554 (IGKV1D-13)
QQFNNYPYT

SEQ ID NO: 3108 - protein, 12 aa, Homo sapiens
  Heavy chain CDR3 for antibody 1554 (IGHV3-33)
AREGDILTGYSL

SEQ ID NO: 3109 - protein, 9 aa, Homo sapiens
  Light chain CDR3 for antibody 1555 (IGKV1-17)
LQHNSYPYT

SEQ ID NO: 3110 - protein, 17 aa, Homo sapiens
  Heavy chain CDR3 for antibody 1555 (IGHV3-33)
ARQGVLLWFGELYYFDY

SEQ ID NO: 3111 - protein, 9 aa, Homo sapiens
  Light chain CDR3 for antibody 1556 (IGKV6-21)
HQSSSLPYT

SEQ ID NO: 3112 - protein, 9 aa, Homo sapiens
  Heavy chain CDR3 for antibody 1556 (IGHV3-23)
ARIWWLKDY

SEQ ID NO: 3113 - protein, 9 aa, Homo sapiens
  Light chain CDR3 for antibody 1557 (IGKV1-6)
LQDYNYPYT

SEQ ID NO: 3114 - protein, 12 aa, Homo sapiens
  Heavy chain CDR3 for antibody 1557 (IGHV4-61)
ARVDSSGWFFDY

SEQ ID NO: 3115 - protein, 9 aa, Homo sapiens
  Light chain CDR3 for antibody 1558 (IGKV3-20)
QQYGSSPYT

SEQ ID NO: 3116 - protein, 19 aa, Homo sapiens
  Heavy chain CDR3 for antibody 1558 (IGHV3-30)
ARRFSGYSGYDHYYYGMDV

SEQ ID NO: 3117 - protein, 9 aa, Homo sapiens
  Light chain CDR3 for antibody 1559 (IGKV1D-16)
QQYNSYPYT

SEQ ID NO: 3118 - protein, 23 aa, Homo sapiens
  Heavy chain CDR3 for antibody 1559 (IGHV1-18)
ARNLHYDILTGYFPYYFYYGMDV

SEQ ID NO: 3119 - protein, 9 aa, Homo sapiens
  Light chain CDR3 for antibody 1560 (IGKV5-2)
LQHDNFPYT

SEQ ID NO: 3120 - protein, 13 aa, Homo sapiens
  Heavy chain CDR3 for antibody 1560 (IGHV3-33)
ARGDNWNDGGFDY

SEQ ID NO: 3121 - protein, 11 aa, Homo sapiens
  Light chain CDR3 for antibody 1561 (IGKV3-20)
QQYGSSPPEWT

SEQ ID NO: 3122 - protein, 13 aa, Homo sapiens
  Heavy chain CDR3 for antibody 1561 (IGHV3-33)
ARIDYYYYYGMDV

SEQ ID NO: 3123 - protein, 9 aa, Homo sapiens
  Light chain CDR3 for antibody 1562 (IGKV3-20)
QQYGSSPYT

SEQ ID NO: 3124 - protein, 18 aa, Homo sapiens
  Heavy chain CDR3 for antibody 1562 (IGHV3-13)
ARDYYGSGSLYYYYGMDV

SEQ ID NO: 3125 - protein, 9 aa, Homo sapiens
  Light chain CDR3 for antibody 1563 (IGKV6-21)
HQSSSLPYT

SEQ ID NO: 3126 - protein, 16 aa, Homo sapiens
  Heavy chain CDR3 for antibody 1563 (IGHV4-59)
ARDTPYYSGSGRPFDS

SEQ ID NO: 3127 - protein, 9 aa, Homo sapiens
  Light chain CDR3 for antibody 1564 (IGKV1-6)
LQDYNYPYT

SEQ ID NO: 3128 - protein, 17 aa, Homo sapiens
  Heavy chain CDR3 for antibody 1564 (IGHV1-24)
ATEGYDILPGYYNVLDY

SEQ ID NO: 3129 - protein, 9 aa, Homo sapiens
  Light chain CDR3 for antibody 1565 (IGKV1-27)
QKYNSAPYT

SEQ ID NO: 3130 - protein, 17 aa, Homo sapiens
  Heavy chain CDR3 for antibody 1565 (IGHV3-33)
ARGYCSRTSCYLYYFDY

SEQ ID NO: 3131 - protein, 9 aa, Homo sapiens
  Light chain CDR3 for antibody 1566 (IGKV5-2)
LQHDNFPYT

SEQ ID NO: 3132 - protein, 9 aa, Homo sapiens
  Heavy chain CDR3 for antibody 1566 (IGHV3-23)
ARIWWLKDY

SEQ ID NO: 3133 - protein, 9 aa, Homo sapiens
  Light chain CDR3 for antibody 1567 (IGKV6-21)
HQSSSLPYT

SEQ ID NO: 3134 - protein, 18 aa, Homo sapiens
  Heavy chain CDR3 for antibody 1567 (IGHV3-33)
ARREGITTIFYYYYGMDV

SEQ ID NO: 3135 - protein, 9 aa, Homo sapiens
  Light chain CDR3 for antibody 1568 (IGKV6-21)
HQSSSLPYT

SEQ ID NO: 3136 - protein, 12 aa, Homo sapiens
  Heavy chain CDR3 for antibody 1568 (IGHV3-23)
AKEYDILTGYFH

SEQ ID NO: 3137 - protein, 9 aa, Homo sapiens
  Light chain CDR3 for antibody 1569 (IGKV6-21)
HQSSSLPYT

SEQ ID NO: 3138 - protein, 11 aa, Homo sapiens
  Heavy chain CDR3 for antibody 1569 (IGHV4-59)
ARSIRYSVFDY

SEQ ID NO: 3139 - protein, 10 aa, Homo sapiens
  Light chain CDR3 for antibody 1570 (IGKV1-17)
LQHNSYPMYT

SEQ ID NO: 3140 - protein, 11 aa, Homo sapiens
  Heavy chain CDR3 for antibody 1570 (IGHV3-33)
ARDRSSGPFDY

SEQ ID NO: 3141 - protein, 9 aa, Homo sapiens
  Light chain CDR3 for antibody 1571 (IGKV1-16)
QQYNRYPYT

SEQ ID NO: 3142 - protein, 17 aa, Homo sapiens
  Heavy chain CDR3 for antibody 1571 (IGHV4-59)
ARDFLVRGEGSYYGMDV

SEQ ID NO: 3143 - protein, 8 aa, Homo sapiens
  Light chain CDR3 for antibody 1572 (IGKV3D-7)
QQDYNLLT

SEQ ID NO: 3144 - protein, 15 aa, Homo sapiens
  Heavy chain CDR3 for antibody 1572 (IGHV3-30)
ARGAMVRGVDYGMDV

SEQ ID NO: 3145 - protein, 9 aa, Homo sapiens
  Light chain CDR3 for antibody 1573 (IGKV5-2)
LQHDNFPYT

SEQ ID NO: 3146 - protein, 13 aa, Homo sapiens
  Heavy chain CDR3 for antibody 1573 (IGHV3-33)
ANTGDSYYYDMDV

SEQ ID NO: 3147 - protein, 9 aa, Homo sapiens
  Light chain CDR3 for antibody 1574 (IGKV1D-16)
QQYNSYPYT

SEQ ID NO: 3148 - protein, 12 aa, Homo sapiens
  Heavy chain CDR3 for antibody 1574 (IGHV3-23)
AKEGLGSDYEPY

SEQ ID NO: 3149 - protein, 9 aa, Homo sapiens
  Light chain CDR3 for antibody 1575 (IGKV1D-13)
QQFNNYPHT

SEQ ID NO: 3150 - protein, 13 aa, Homo sapiens
  Heavy chain CDR3 for antibody 1575 (IGHV3-33)
ARKAYGDYFYFDY

SEQ ID NO: 3151 - protein, 9 aa, Homo sapiens
  Light chain CDR3 for antibody 1576 (IGKV1-9)
QQLNSYPLT

SEQ ID NO: 3152 - protein, 26 aa, Homo sapiens
  Heavy chain CDR3 for antibody 1576 (IGHV4-39)
ARQGLLWFGDLKAYDSSGYYYGYFHH

SEQ ID NO: 3153 - protein, 9 aa, Homo sapiens
  Light chain CDR3 for antibody 1577 (IGKV1-39)
QQSYSTPLT

SEQ ID NO: 3154 - protein, 11 aa, Homo sapiens
  Heavy chain CDR3 for antibody 1577 (IGHV3-33)
ARARYTTGLDY

SEQ ID NO: 3155 - protein, 9 aa, Homo sapiens
  Light chain CDR3 for antibody 1578 (IGKV6-21)
HQSSSLPFT

SEQ ID NO: 3156 - protein, 16 aa, Homo sapiens
  Heavy chain CDR3 for antibody 1578 (IGHV3-48)
TRRRQWLAGFDWYFDL

SEQ ID NO: 3157 - protein, 9 aa, Homo sapiens
  Light chain CDR3 for antibody 1579 (IGKV5-2)
LQHDNFPYT

SEQ ID NO: 3158 - protein, 16 aa, Homo sapiens
  Heavy chain CDR3 for antibody 1579 (IGHV3-23)
AKEGEVLRYFDWLFNY

SEQ ID NO: 3159 - protein, 9 aa, Homo sapiens
  Light chain CDR3 for antibody 1580 (IGKV6-21)
HQSSSLPYT

SEQ ID NO: 3160 - protein, 9 aa, Homo sapiens
  Heavy chain CDR3 for antibody 1580 (IGHV4-59)
AGGSWDFDY

SEQ ID NO: 3161 - protein, 9 aa, Homo sapiens
  Light chain CDR3 for antibody 1581 (IGKV6-21)
HQSSSLPYT

SEQ ID NO: 3162 - protein, 24 aa, Homo sapiens
  Heavy chain CDR3 for antibody 1581 (IGHV3-20)
ARGRITMVRGVIINPLDYYNGMDV

SEQ ID NO: 3163 - protein, 9 aa, Homo sapiens
  Light chain CDR3 for antibody 1582 (IGKV3-11)
QQRSNWPWT

SEQ ID NO: 3164 - protein, 13 aa, Homo sapiens
  Heavy chain CDR3 for antibody 1582 (IGHV4-34)
ASNFYYYYYGMDV

SEQ ID NO: 3165 - protein, 9 aa, Homo sapiens
  Light chain CDR3 for antibody 1583 (IGKV1D-13)
QQFNNYPYT

SEQ ID NO: 3166 - protein, 21 aa, Homo sapiens
  Heavy chain CDR3 for antibody 1583 (IGHV3-33)
ARKRLYDILTGYYKAYYGMDV

SEQ ID NO: 3167 - protein, 9 aa, Homo sapiens
  Light chain CDR3 for antibody 1584 (IGKV1-17)
LQHNSYPYT

SEQ ID NO: 3168 - protein, 12 aa, Homo sapiens
  Heavy chain CDR3 for antibody 1584 (IGHV3-33)
ARKGYGLYVLDV

SEQ ID NO: 3169 - protein, 9 aa, Homo sapiens
  Light chain CDR3 for antibody 1585 (IGKV3-20)
QQYGSSPYT

SEQ ID NO: 3170 - protein, 10 aa, Homo sapiens
  Heavy chain CDR3 for antibody 1585 (IGHV3-30)
AREWYGGMDV

SEQ ID NO: 3171 - protein, 9 aa, Homo sapiens
  Light chain CDR3 for antibody 1586 (IGKV6-21)
HQSSSLPYT

SEQ ID NO: 3172 - protein, 13 aa, Homo sapiens
  Heavy chain CDR3 for antibody 1586 (IGHV3-33)
ARQSSGWFDAFDI

SEQ ID NO: 3173 - protein, 9 aa, Homo sapiens
  Light chain CDR3 for antibody 1587 (IGKV1-6)
LQDYNYPWT

SEQ ID NO: 3174 - protein, 13 aa, Homo sapiens
  Heavy chain CDR3 for antibody 1587 (IGHV4-61)
ASRYSSGWYPFDY

SEQ ID NO: 3175 - protein, 9 aa, Homo sapiens
  Light chain CDR3 for antibody 1588 (IGKV3D-7)
QQDYNLPYT

SEQ ID NO: 3176 - protein, 13 aa, Homo sapiens
  Heavy chain CDR3 for antibody 1588 (IGHV3-48)
AREGDPQPDAFDI

SEQ ID NO: 3177 - protein, 9 aa, Homo sapiens
  Light chain CDR3 for antibody 1589 (IGKV5-2)
LQHDNFPWT

SEQ ID NO: 3178 - protein, 17 aa, Homo sapiens
  Heavy chain CDR3 for antibody 1589 (IGHV4-39)
AGRLTYYYGSGSPSFDY

SEQ ID NO: 3179 - protein, 9 aa, Homo sapiens
  Light chain CDR3 for antibody 1590 (IGKV3-20)
QQYGSSPYT

SEQ ID NO: 3180 - protein, 5 aa, Homo sapiens
  Heavy chain CDR3 for antibody 1590 (IGHV3-33)
ARGLE

SEQ ID NO: 3181 - protein, 9 aa, Homo sapiens
  Light chain CDR3 for antibody 1591 (IGKV1D-16)
QQYNSYPLT

SEQ ID NO: 3182 - protein, 18 aa, Homo sapiens
  Heavy chain CDR3 for antibody 1591 (IGHV3-33)
AREGDYYGSGGFPNWFDP

SEQ ID NO: 3183 - protein, 9 aa, Homo sapiens
  Light chain CDR3 for antibody 1592 (IGKV1-9)
QQLNSYPRT

SEQ ID NO: 3184 - protein, 9 aa, Homo sapiens
  Heavy chain CDR3 for antibody 1592 (IGHV4-59)
ARDDGDFDY

SEQ ID NO: 3185 - protein, 9 aa, Homo sapiens
  Light chain CDR3 for antibody 1593 (IGKV6-21)
HQSSSLPYT

SEQ ID NO: 3186 - protein, 19 aa, Homo sapiens
  Heavy chain CDR3 for antibody 1593 (IGHV3-33)
ARGVRLRYFDPYYYYGMDV

SEQ ID NO: 3187 - protein, 9 aa, Homo sapiens
  Light chain CDR3 for antibody 1594 (IGKV3-20)
QQYGSSPLT

SEQ ID NO: 3188 - protein, 13 aa, Homo sapiens
  Heavy chain CDR3 for antibody 1594 (IGHV3-33)
AREYFDWLLPLDY

SEQ ID NO: 3189 - protein, 9 aa, Homo sapiens
  Light chain CDR3 for antibody 1595 (IGKV6-21)
HQSSSLPYT

SEQ ID NO: 3190 - protein, 15 aa, Homo sapiens
  Heavy chain CDR3 for antibody 1595 (IGHV3-33)
VCVLYDYGDYVGFDY

SEQ ID NO: 3191 - protein, 9 aa, Homo sapiens
  Light chain CDR3 for antibody 1596 (IGKV1D-16)
QQYNSYPLT

SEQ ID NO: 3192 - protein, 10 aa, Homo sapiens
  Heavy chain CDR3 for antibody 1596 (IGHV3-30)
AREWYGGMDV

SEQ ID NO: 3193 - protein, 9 aa, Homo sapiens
  Light chain CDR3 for antibody 1597 (IGKV5-2)
LQHDNFPYT

SEQ ID NO: 3194 - protein, 12 aa, Homo sapiens
  Heavy chain CDR3 for antibody 1597 (IGHV3-23)
AKEYDILTGYFH

SEQ ID NO: 3195 - protein, 9 aa, Homo sapiens
  Light chain CDR3 for antibody 1598 (IGKV1D-16)
QQYNSYPYT

SEQ ID NO: 3196 - protein, 14 aa, Homo sapiens
  Heavy chain CDR3 for antibody 1598 (IGHV4-39)
ARDSGYDYYYAMDV

SEQ ID NO: 3197 - protein, 9 aa, Homo sapiens
  Light chain CDR3 for antibody 1599 (IGKV1D-16)
QQYNSYPLT

SEQ ID NO: 3198 - protein, 11 aa, Homo sapiens
  Heavy chain CDR3 for antibody 1599 (IGHV3-33)
ARGTTVTHFDY

SEQ ID NO: 3199 - protein, 9 aa, Homo sapiens
  Light chain CDR3 for antibody 1600 (IGKV1-39)
QQSYSTPFT

SEQ ID NO: 3200 - protein, 16 aa, Homo sapiens
  Heavy chain CDR3 for antibody 1600 (IGHV4-59)
ARDTPYYSGSGRPFDS

SEQ ID NO: 3201 - protein, 9 aa, Homo sapiens
  Light chain CDR3 for antibody 1601 (IGKV1-9)
QQLNSYPLT

SEQ ID NO: 3202 - protein, 12 aa, Homo sapiens
  Heavy chain CDR3 for antibody 1601 (IGHV4-39)
ARMVRGVIPFDY

SEQ ID NO: 3203 - protein, 9 aa, Homo sapiens
  Light chain CDR3 for antibody 1602 (IGKV1-27)
QKYNSAPYT

SEQ ID NO: 3204 - protein, 18 aa, Homo sapiens
  Heavy chain CDR3 for antibody 1602 (IGHV3-33)
ARREGIVGATTYYYGMDV

SEQ ID NO: 3205 - protein, 9 aa, Homo sapiens
  Light chain CDR3 for antibody 1603 (IGKV1-27)
QKYNSAPYT

SEQ ID NO: 3206 - protein, 13 aa, Homo sapiens
  Heavy chain CDR3 for antibody 1603 (IGHV4-34)
ASNFYYYYYGMDV

SEQ ID NO: 3207 - protein, 9 aa, Homo sapiens
  Light chain CDR3 for antibody 1604 (IGKV1D-16)
QQYNSYPYT

SEQ ID NO: 3208 - protein, 13 aa, Homo sapiens
  Heavy chain CDR3 for antibody 1604 (IGHV3-33)
ARAFIMVRGVIDY

SEQ ID NO: 3209 - protein, 9 aa, Homo sapiens
  Light chain CDR3 for antibody 1605 (IGKV2-30)
MQGTHWPLT

SEQ ID NO: 3210 - protein, 13 aa, Homo sapiens
  Heavy chain CDR3 for antibody 1605 (IGHV4-34)
ASNFYYYYYGMDV

SEQ ID NO: 3211 - protein, 9 aa, Homo sapiens
  Light chain CDR3 for antibody 1606 (IGKV1-39)
QQSYSTPLT

SEQ ID NO: 3212 - protein, 15 aa, Homo sapiens
  Heavy chain CDR3 for antibody 1606 (IGHV3-33)
ARDHLTGYYYYGMDV

SEQ ID NO: 3213 - protein, 10 aa, Homo sapiens
  Light chain CDR3 for antibody 1607 (IGKV1-39)
QQSYSTPMYT

SEQ ID NO: 3214 - protein, 15 aa, Homo sapiens
  Heavy chain CDR3 for antibody 1607 (IGHV3-30)
ARGAMVRGVDYGMDV

SEQ ID NO: 3215 - protein, 9 aa, Homo sapiens
  Light chain CDR3 for antibody 1608 (IGKV1-39)
QQSYSTPLT

SEQ ID NO: 3216 - protein, 15 aa, Homo sapiens
  Heavy chain CDR3 for antibody 1608 (IGHV3-33)
ARDRGWKAPGYGMDV

SEQ ID NO: 3217 - protein, 9 aa, Homo sapiens
  Light chain CDR3 for antibody 1609 (IGKV1-9)
QQLNSYPLT

SEQ ID NO: 3218 - protein, 14 aa, Homo sapiens
  Heavy chain CDR3 for antibody 1609 (IGHV4-39)
ARQGTMIRGGYFDY

SEQ ID NO: 3219 - protein, 8 aa, Homo sapiens
  Light chain CDR3 for antibody 1610 (IGKV3D-7)
QQDYNLLT

SEQ ID NO: 3220 - protein, 13 aa, Homo sapiens
  Heavy chain CDR3 for antibody 1610 (IGHV3-33)
ARDYCGGDCYLDY

SEQ ID NO: 3221 - protein, 9 aa, Homo sapiens
  Light chain CDR3 for antibody 1611 (IGKV1-39)
QQSYSTPLT

SEQ ID NO: 3222 - protein, 17 aa, Homo sapiens
  Heavy chain CDR3 for antibody 1611 (IGHV3-33)
ARGYCSRTSCYLYYFDY

SEQ ID NO: 3223 - protein, 9 aa, Homo sapiens
  Light chain CDR3 for antibody 1612 (IGKV3-20)
QQYGSSPYT

SEQ ID NO: 3224 - protein, 15 aa, Homo sapiens
  Heavy chain CDR3 for antibody 1612 (IGHV1-46)
ARGAVDDYYYYGMDV

SEQ ID NO: 3225 - protein, 9 aa, Homo sapiens
  Light chain CDR3 for antibody 1613 (IGKV3-20)
QQYGSSPYT

SEQ ID NO: 3226 - protein, 17 aa, Homo sapiens
  Heavy chain CDR3 for antibody 1613 (IGHV3-33)
ARAYYDILTGYSYYFDY

SEQ ID NO: 3227 - protein, 9 aa, Homo sapiens
  Light chain CDR3 for antibody 1614 (IGKV1-39)
QQSYSTPLT

SEQ ID NO: 3228 - protein, 8 aa, Homo sapiens
  Heavy chain CDR3 for antibody 1614 (IGHV3-23)
AKETGNNY

SEQ ID NO: 3229 - protein, 9 aa, Homo sapiens
  Light chain CDR3 for antibody 1615 (IGKV1D-16)
QQYNSYPYT

SEQ ID NO: 3230 - protein, 15 aa, Homo sapiens
  Heavy chain CDR3 for antibody 1615 (IGHV3-64)
ARDGLRYFDWLFPWY

SEQ ID NO: 3231 - protein, 9 aa, Homo sapiens
  Light chain CDR3 for antibody 1616 (IGKV6-21)
HQSSSLPYT

SEQ ID NO: 3232 - protein, 15 aa, Homo sapiens
  Heavy chain CDR3 for antibody 1616 (IGHV3-30)
ARRGYGSGSPDAFDL

SEQ ID NO: 3233 - protein, 9 aa, Homo sapiens
  Light chain CDR3 for antibody 1617 (IGKV6-21)
HQSSSFPLT

SEQ ID NO: 3234 - protein, 13 aa, Homo sapiens
  Heavy chain CDR3 for antibody 1617 (IGHV3-33)
AKCIVAAIGGFDY

SEQ ID NO: 3235 - protein, 9 aa, Homo sapiens
  Light chain CDR3 for antibody 1618 (IGKV1D-16)
QQYNSYPLT

SEQ ID NO: 3236 - protein, 9 aa, Homo sapiens
  Heavy chain CDR3 for antibody 1618 (IGHV3-23)
ARIWWLKDY

SEQ ID NO: 3237 - protein, 8 aa, Homo sapiens
  Light chain CDR3 for antibody 1619 (IGKV3-20)
QQYGRSFT

SEQ ID NO: 3238 - protein, 20 aa, Homo sapiens
  Heavy chain CDR3 for antibody 1619 (IGHV3-33)
ARDNDSSGYYDYYYYYGMDV

SEQ ID NO: 3239 - protein, 9 aa, Homo sapiens
  Light chain CDR3 for antibody 1620 (IGKV3-20)
QQYGSSPYT

SEQ ID NO: 3240 - protein, 14 aa, Homo sapiens
  Heavy chain CDR3 for antibody 1620 (IGHV4-39)
ARRGVVVPPGGMDV

SEQ ID NO: 3241 - protein, 9 aa, Homo sapiens
  Light chain CDR3 for antibody 1621 (IGKV1-39)
QQSYSTPFT

SEQ ID NO: 3242 - protein, 14 aa, Homo sapiens
  Heavy chain CDR3 for antibody 1621 (IGHV4-39)
ARDSGYDYYYGMDV

SEQ ID NO: 3243 - protein, 9 aa, Homo sapiens
  Light chain CDR3 for antibody 1622 (IGKV1-9)
QQLKSYLYT

SEQ ID NO: 3244 - protein, 9 aa, Homo sapiens
  Heavy chain CDR3 for antibody 1622 (IGHV1-18)
ARGKDWFDP

SEQ ID NO: 3245 - protein, 9 aa, Homo sapiens
  Light chain CDR3 for antibody 1623 (IGKV3D-7)
QQDYNFPFT

SEQ ID NO: 3246 - protein, 19 aa, Homo sapiens
  Heavy chain CDR3 for antibody 1623 (IGHV3-74)
AREYFDILTGYYKTGFFQH

SEQ ID NO: 3247 - protein, 9 aa, Homo sapiens
  Light chain CDR3 for antibody 1624 (IGKV6-21)
HQSSSLPYT

SEQ ID NO: 3248 - protein, 8 aa, Homo sapiens
  Heavy chain CDR3 for antibody 1624 (IGHV3-23)
EKSAGEDV

SEQ ID NO: 3249 - protein, 9 aa, Homo sapiens
  Light chain CDR3 for antibody 1625 (IGKV5-2)
LQHDNFPWT

SEQ ID NO: 3250 - protein, 18 aa, Homo sapiens
  Heavy chain CDR3 for antibody 1625 (IGHV1-46)
ARDLTGRTENYYYYGMDV

SEQ ID NO: 3251 - protein, 9 aa, Homo sapiens
  Light chain CDR3 for antibody 1626 (IGKV6-21)
HQSSSLPYT

SEQ ID NO: 3252 - protein, 11 aa, Homo sapiens
  Heavy chain CDR3 for antibody 1626 (IGHV3-13)
AREAIIGPFDY

SEQ ID NO: 3253 - protein, 9 aa, Homo sapiens
  Light chain CDR3 for antibody 1627 (IGKV5-2)
LQHDNFPYT

SEQ ID NO: 3254 - protein, 19 aa, Homo sapiens
  Heavy chain CDR3 for antibody 1627 (IGHV3-30)
ARRFSGYSGYDHYYYGMDV

SEQ ID NO: 3255 - protein, 8 aa, Homo sapiens
  Light chain CDR3 for antibody 1628 (IGKV3D-7)
QQDYNLVT

SEQ ID NO: 3256 - protein, 11 aa, Homo sapiens
  Heavy chain CDR3 for antibody 1628 (IGHV4-59)
AREMGHDTFDI

SEQ ID NO: 3257 - protein, 9 aa, Homo sapiens
  Light chain CDR3 for antibody 1629 (IGKV6-21)
HQSSSLPYT

SEQ ID NO: 3258 - protein, 17 aa, Homo sapiens
  Heavy chain CDR3 for antibody 1629 (IGHV3-33)
ARESLKLGIYYYYGMDV

SEQ ID NO: 3259 - protein, 9 aa, Homo sapiens
  Light chain CDR3 for antibody 1630 (IGKV1-6)
LQDYNYPWT

SEQ ID NO: 3260 - protein, 5 aa, Homo sapiens
  Heavy chain CDR3 for antibody 1630 (IGHV3-33)
AREDY

SEQ ID NO: 3261 - protein, 9 aa, Homo sapiens
  Light chain CDR3 for antibody 1631 (IGKV5-2)
LQHDNFPYT

SEQ ID NO: 3262 - protein, 11 aa, Homo sapiens
  Heavy chain CDR3 for antibody 1631 (IGHV3-33)
AREGAVARFDY

SEQ ID NO: 3263 - protein, 9 aa, Homo sapiens
  Light chain CDR3 for antibody 1632 (IGKV3-20)
QQYGSSPYT

SEQ ID NO: 3264 - protein, 8 aa, Homo sapiens
  Heavy chain CDR3 for antibody 1632 (IGHV3-23)
AETFLFDY

SEQ ID NO: 3265 - protein, 9 aa, Homo sapiens
  Light chain CDR3 for antibody 1633 (IGKV3D-20)
QQYGSSPYT

SEQ ID NO: 3266 - protein, 19 aa, Homo sapiens
  Heavy chain CDR3 for antibody 1633 (IGHV3-33)
ARGVRLRYFDPYYYYGMDV

SEQ ID NO: 3267 - protein, 9 aa, Homo sapiens
  Light chain CDR3 for antibody 1634 (IGKV6-21)
HQSSSLPYT

SEQ ID NO: 3268 - protein, 19 aa, Homo sapiens
  Heavy chain CDR3 for antibody 1634 (IGHV3-33)
ARGPYYDILTGYGYYGMDV

SEQ ID NO: 3269 - protein, 9 aa, Homo sapiens
  Light chain CDR3 for antibody 1635 (IGKV1-6)
LQDYNYPYT

SEQ ID NO: 3270 - protein, 20 aa, Homo sapiens
  Heavy chain CDR3 for antibody 1635 (IGHV3-33)
ARRMVRGVKKTYYYYYGLDV

SEQ ID NO: 3271 - protein, 9 aa, Homo sapiens
  Light chain CDR3 for antibody 1636 (IGKV1D-16)
QQYNSYPLT

SEQ ID NO: 3272 - protein, 16 aa, Homo sapiens
  Heavy chain CDR3 for antibody 1636 (IGHV3-13)
ARDRSYESYYYYGMDV

SEQ ID NO: 3273 - protein, 9 aa, Homo sapiens
  Light chain CDR3 for antibody 1637 (IGKV1-9)
QQLKSYLYT

SEQ ID NO: 3274 - protein, 18 aa, Homo sapiens
  Heavy chain CDR3 for antibody 1637 (IGHV1-46)
ARDGDYVWGSYRSDWFDP

SEQ ID NO: 3275 - protein, 9 aa, Homo sapiens
  Light chain CDR3 for antibody 1638 (IGKV2-30)
MQGTHWPLT

SEQ ID NO: 3276 - protein, 14 aa, Homo sapiens
  Heavy chain CDR3 for antibody 1638 (IGHV3-33)
ARGAAAGNFYGLDV

SEQ ID NO: 3277 - protein, 9 aa, Homo sapiens
  Light chain CDR3 for antibody 1639 (IGKV6-21)
HQSSSLPYT

SEQ ID NO: 3278 - protein, 11 aa, Homo sapiens
  Heavy chain CDR3 for antibody 1639 (IGHV3-33)
ARGSGSYAFDS

SEQ ID NO: 3279 - protein, 9 aa, Homo sapiens
  Light chain CDR3 for antibody 1640 (IGKV1D-16)
QQYNSYPLT

SEQ ID NO: 3280 - protein, 15 aa, Homo sapiens
  Heavy chain CDR3 for antibody 1640 (IGHV3-33)
ARRSILTGSYWYFDL

SEQ ID NO: 3281 - protein, 9 aa, Homo sapiens
  Light chain CDR3 for antibody 1641 (IGKV3-20)
QQYGSSPYT

SEQ ID NO: 3282 - protein, 10 aa, Homo sapiens
  Heavy chain CDR3 for antibody 1641 (IGHV3-33)
AREWFGGFDI

SEQ ID NO: 3283 - protein, 9 aa, Homo sapiens
  Light chain CDR3 for antibody 1642 (IGKV1-9)
QQLYRYPIT

SEQ ID NO: 3284 - protein, 14 aa, Homo sapiens
  Heavy chain CDR3 for antibody 1642 (IGHV3-48)
GRDTTHDWSDGGIY

SEQ ID NO: 3285 - protein, 9 aa, Homo sapiens
  Light chain CDR3 for antibody 1643 (IGKV1D-16)
QQYNSYPYT

SEQ ID NO: 3286 - protein, 9 aa, Homo sapiens
  Heavy chain CDR3 for antibody 1643 (IGHV3-23)
AKEQLLFDY

SEQ ID NO: 3287 - protein, 9 aa, Homo sapiens
  Light chain CDR3 for antibody 1644 (IGKV5-2)
LQHDNFPWT

SEQ ID NO: 3288 - protein, 19 aa, Homo sapiens
  Heavy chain CDR3 for antibody 1644 (IGHV5-51)
ARHGEKGKRITMVRGSLDV

SEQ ID NO: 3289 - protein, 9 aa, Homo sapiens
  Light chain CDR3 for antibody 1645 (IGKV3D-7)
QQDYNLPLT

SEQ ID NO: 3290 - protein, 15 aa, Homo sapiens
  Heavy chain CDR3 for antibody 1645 (IGHV4-59)
ARDIGYYGSGSPLDY

SEQ ID NO: 3291 - protein, 9 aa, Homo sapiens
  Light chain CDR3 for antibody 1646 (IGKV5-2)
LQHDNFPYT

SEQ ID NO: 3292 - protein, 11 aa, Homo sapiens
  Heavy chain CDR3 for antibody 1646 (IGHV3-23)
AKGLWSYYFDY

SEQ ID NO: 3293 - protein, 9 aa, Homo sapiens
  Light chain CDR3 for antibody 1647 (IGKV1-39)
QQSYRTPLT

SEQ ID NO: 3294 - protein, 13 aa, Homo sapiens
  Heavy chain CDR3 for antibody 1647 (IGHV3-23)
ARAFFMVRGVIDF

SEQ ID NO: 3295 - protein, 9 aa, Homo sapiens
  Light chain CDR3 for antibody 1648 (IGKV1D-13)
QQFNNYPHT

SEQ ID NO: 3296 - protein, 15 aa, Homo sapiens
  Heavy chain CDR3 for antibody 1648 (IGHV3-33)
ARDHLTGYYYYGMDV

SEQ ID NO: 3297 - protein, 9 aa, Homo sapiens
  Light chain CDR3 for antibody 1649 (IGKV1-39)
QQSYSTPLT

SEQ ID NO: 3298 - protein, 14 aa, Homo sapiens
  Heavy chain CDR3 for antibody 1649 (IGHV3-33)
ARDRIAAASSDFDC

SEQ ID NO: 3299 - protein, 9 aa, Homo sapiens
  Light chain CDR3 for antibody 1650 (IGKV2D-28)
MQVLQTPFT

SEQ ID NO: 3300 - protein, 13 aa, Homo sapiens
  Heavy chain CDR3 for antibody 1650 (IGHV4-59)
ARDAGYSSSWFDY

SEQ ID NO: 3301 - protein, 9 aa, Homo sapiens
  Light chain CDR3 for antibody 1651 (IGKV5-2)
LQHDNFPYT

SEQ ID NO: 3302 - protein, 11 aa, Homo sapiens
  Heavy chain CDR3 for antibody 1651 (IGHV3-74)
ARDRGNWGFDY

SEQ ID NO: 3303 - protein, 8 aa, Homo sapiens
  Light chain CDR3 for antibody 1652 (IGKV3-20)
QQYTSPKT

SEQ ID NO: 3304 - protein, 14 aa, Homo sapiens
  Heavy chain CDR3 for antibody 1652 (IGHV7-4-1)
ARDNVHYGDYSLDL

SEQ ID NO: 3305 - protein, 9 aa, Homo sapiens
  Light chain CDR3 for antibody 1653 (IGKV3-20)
QQYGSSPYT

SEQ ID NO: 3306 - protein, 11 aa, Homo sapiens
  Heavy chain CDR3 for antibody 1653 (IGHV3-33)
ARGSGSYAFDS

SEQ ID NO: 3307 - protein, 9 aa, Homo sapiens
  Light chain CDR3 for antibody 1654 (IGKV1-16)
QQYNSYPYT

SEQ ID NO: 3308 - protein, 19 aa, Homo sapiens
  Heavy chain CDR3 for antibody 1654 (IGHV4-39)
ARQGDVLRYFDWLLGAFDI

SEQ ID NO: 3309 - protein, 9 aa, Homo sapiens
  Light chain CDR3 for antibody 1655 (IGKV1-39)
QQSYSTPFT

SEQ ID NO: 3310 - protein, 12 aa, Homo sapiens
  Heavy chain CDR3 for antibody 1655 (IGHV4-39)
ARHGSGSSYFDY

SEQ ID NO: 3311 - protein, 9 aa, Homo sapiens
  Light chain CDR3 for antibody 1656 (IGKV6-21)
HQSSSLPLT

SEQ ID NO: 3312 - protein, 14 aa, Homo sapiens
  Heavy chain CDR3 for antibody 1656 (IGHV3-33)
ARGGYNWNDDWFDP

SEQ ID NO: 3313 - protein, 9 aa, Homo sapiens
  Light chain CDR3 for antibody 1657 (IGKV3-20)
QQYGSSPYT

SEQ ID NO: 3314 - protein, 15 aa, Homo sapiens
  Heavy chain CDR3 for antibody 1657 (IGHV3-33)
ARGYYYGSGSFPVDY

SEQ ID NO: 3315 - protein, 9 aa, Homo sapiens
  Light chain CDR3 for antibody 1658 (IGKV5-2)
LQHDNFPYT

SEQ ID NO: 3316 - protein, 15 aa, Homo sapiens
  Heavy chain CDR3 for antibody 1658 (IGHV3-23)
AKEALRYFDWSGMDV

SEQ ID NO: 3317 - protein, 9 aa, Homo sapiens
  Light chain CDR3 for antibody 1659 (IGKV1D-16)
QQYNSYPYT

SEQ ID NO: 3318 - protein, 16 aa, Homo sapiens
  Heavy chain CDR3 for antibody 1659 (IGHV3-33)
AREVAGSYYYYYGIDV

SEQ ID NO: 3319 - protein, 9 aa, Homo sapiens
  Light chain CDR3 for antibody 1660 (IGKV1-6)
LQDYNYPRT

SEQ ID NO: 3320 - protein, 14 aa, Homo sapiens
  Heavy chain CDR3 for antibody 1660 (IGHV1-46)
ARKGIVGAFDAFDI

SEQ ID NO: 3321 - protein, 9 aa, Homo sapiens
  Light chain CDR3 for antibody 1661 (IGKV1D-16)
QQYNSYPLT

SEQ ID NO: 3322 - protein, 15 aa, Homo sapiens
  Heavy chain CDR3 for antibody 1661 (IGHV3-33)
ARDRVVRGVMGYFDY

SEQ ID NO: 3323 - protein, 9 aa, Homo sapiens
  Light chain CDR3 for antibody 1662 (IGKV1-17)
LQHNTYPYT

SEQ ID NO: 3324 - protein, 13 aa, Homo sapiens
  Heavy chain CDR3 for antibody 1662 (IGHV3-33)
ARDSGSYSYYFNY

SEQ ID NO: 3325 - protein, 9 aa, Homo sapiens
  Light chain CDR3 for antibody 1663 (IGKV5-2)
LQHDNFPWT

SEQ ID NO: 3326 - protein, 11 aa, Homo sapiens
  Heavy chain CDR3 for antibody 1663 (IGHV4-59)
VRERGYYGMDV

SEQ ID NO: 3327 - protein, 9 aa, Homo sapiens
  Light chain CDR3 for antibody 1664 (IGKV3-20)
QQYGSSPYT

SEQ ID NO: 3328 - protein, 12 aa, Homo sapiens
  Heavy chain CDR3 for antibody 1664 (IGHV3-33)
ARDYISTYGMDV

SEQ ID NO: 3329 - protein, 9 aa, Homo sapiens
  Light chain CDR3 for antibody 1665 (IGKV5-2)
LQHDNFPYT

SEQ ID NO: 3330 - protein, 12 aa, Homo sapiens
  Heavy chain CDR3 for antibody 1665 (IGHV3-33)
AREGTRWVYFDY

SEQ ID NO: 3331 - protein, 9 aa, Homo sapiens
  Light chain CDR3 for antibody 1666 (IGKV3-15)
QQYNNWPRT

SEQ ID NO: 3332 - protein, 11 aa, Homo sapiens
  Heavy chain CDR3 for antibody 1666 (IGHV3-33)
ARDRSSGPFDY

SEQ ID NO: 3333 - protein, 9 aa, Homo sapiens
  Light chain CDR3 for antibody 1667 (IGKV1D-16)
QQYNSYPYT

SEQ ID NO: 3334 - protein, 19 aa, Homo sapiens
  Heavy chain CDR3 for antibody 1667 (IGHV3-33)
ARRRDDILTGWDYYFGMDV

SEQ ID NO: 3335 - protein, 9 aa, Homo sapiens
  Light chain CDR3 for antibody 1668 (IGKV6-21)
HQSSSLPYT

SEQ ID NO: 3336 - protein, 11 aa, Homo sapiens
  Heavy chain CDR3 for antibody 1668 (IGHV3-74)
ARDRGNWGFDY

SEQ ID NO: 3337 - protein, 9 aa, Homo sapiens
  Light chain CDR3 for antibody 1669 (IGKV1D-13)
QQFNNYPYT

SEQ ID NO: 3338 - protein, 16 aa, Homo sapiens
  Heavy chain CDR3 for antibody 1669 (IGHV3-33)
ARAVYYGSGSSLIMDV

SEQ ID NO: 3339 - protein, 9 aa, Homo sapiens
  Light chain CDR3 for antibody 1670 (IGKV3-11)
QQRSNWPYT

SEQ ID NO: 3340 - protein, 20 aa, Homo sapiens
  Heavy chain CDR3 for antibody 1670 (IGHV3-33)
ARDNDSSGYYDYYYYYGMDV

SEQ ID NO: 3341 - protein, 9 aa, Homo sapiens
  Light chain CDR3 for antibody 1671 (IGKV1D-16)
QQYNSYPYT

SEQ ID NO: 3342 - protein, 17 aa, Homo sapiens
  Heavy chain CDR3 for antibody 1671 (IGHV3-23)
AKDRDWKDGYYYFGMDV

SEQ ID NO: 3343 - protein, 9 aa, Homo sapiens
  Light chain CDR3 for antibody 1672 (IGKV5-2)
LQHDNFPYT

SEQ ID NO: 3344 - protein, 8 aa, Homo sapiens
  Heavy chain CDR3 for antibody 1672 (IGHV3-23)
AKESLLDY

SEQ ID NO: 3345 - protein, 9 aa, Homo sapiens
  Light chain CDR3 for antibody 1673 (IGKV1-39)
QQSYSTPLT

SEQ ID NO: 3346 - protein, 10 aa, Homo sapiens
  Heavy chain CDR3 for antibody 1673 (IGHV3-33)
ARENSTPLDY

SEQ ID NO: 3347 - protein, 9 aa, Homo sapiens
  Light chain CDR3 for antibody 1674 (IGKV3D-7)
QQDYNLPLT

SEQ ID NO: 3348 - protein, 12 aa, Homo sapiens
  Heavy chain CDR3 for antibody 1674 (IGHV3-33)
TRGYSSKSYFDY

SEQ ID NO: 3349 - protein, 9 aa, Homo sapiens
  Light chain CDR3 for antibody 1675 (IGKV5-2)
LQHDNFPWT

SEQ ID NO: 3350 - protein, 16 aa, Homo sapiens
  Heavy chain CDR3 for antibody 1675 (IGHV4-59)
ARFYFGSGSYYWYFDL

SEQ ID NO: 3351 - protein, 9 aa, Homo sapiens
  Light chain CDR3 for antibody 1676 (IGKV1-6)
LQDYNYPFT

SEQ ID NO: 3352 - protein, 14 aa, Homo sapiens
  Heavy chain CDR3 for antibody 1676 (IGHV3-33)
ARASSGSSYWYIDL

SEQ ID NO: 3353 - protein, 11 aa, Homo sapiens
  Light chain CDR3 for antibody 1677 (IGKV1-33)
QQYDNLRRVFT

SEQ ID NO: 3354 - protein, 11 aa, Homo sapiens
  Heavy chain CDR3 for antibody 1677 (IGHV1-69)
ARDPAGRTFDI

SEQ ID NO: 3355 - protein, 9 aa, Homo sapiens
  Light chain CDR3 for antibody 1678 (IGKV3-20)
QQYGSSPYT

SEQ ID NO: 3356 - protein, 12 aa, Homo sapiens
  Heavy chain CDR3 for antibody 1678 (IGHV4-39)
ARQMVREGWFDP

SEQ ID NO: 3357 - protein, 9 aa, Homo sapiens
  Light chain CDR3 for antibody 1679 (IGKV3-20)
QQYGSSPYT

SEQ ID NO: 3358 - protein, 12 aa, Homo sapiens
  Heavy chain CDR3 for antibody 1679 (IGHV3-23)
AKEYDILTGYFH

SEQ ID NO: 3359 - protein, 9 aa, Homo sapiens
  Light chain CDR3 for antibody 1680 (IGKV1D-16)
QQYNSYPYT

SEQ ID NO: 3360 - protein, 15 aa, Homo sapiens
  Heavy chain CDR3 for antibody 1680 (IGHV1-46)
ARGRFFDWLLSPFDY

SEQ ID NO: 3361 - protein, 9 aa, Homo sapiens
  Light chain CDR3 for antibody 1681 (IGKV6-21)
HQSSSLPWT

SEQ ID NO: 3362 - protein, 17 aa, Homo sapiens
  Heavy chain CDR3 for antibody 1681 (IGHV3-33)
ARDCGSYYDYYFYGMDV

SEQ ID NO: 3363 - protein, 9 aa, Homo sapiens
  Light chain CDR3 for antibody 1682 (IGKV5-2)
LQHDNFPWT

SEQ ID NO: 3364 - protein, 20 aa, Homo sapiens
  Heavy chain CDR3 for antibody 1682 (IGHV1-18)
AREVGIAVAGTLYYYYGMDV

SEQ ID NO: 3365 - protein, 9 aa, Homo sapiens
  Light chain CDR3 for antibody 1683 (IGKV5-2)
LQHDNFPYT

SEQ ID NO: 3366 - protein, 13 aa, Homo sapiens
  Heavy chain CDR3 for antibody 1683 (IGHV3-33)
ARRYRSGWYPFDY

SEQ ID NO: 3367 - protein, 9 aa, Homo sapiens
  Light chain CDR3 for antibody 1684 (IGKV2-30)
MQGTHWPLT

SEQ ID NO: 3368 - protein, 14 aa, Homo sapiens
  Heavy chain CDR3 for antibody 1684 (IGHV3-23)
AKSRIVGALYYFDY

SEQ ID NO: 3369 - protein, 9 aa, Homo sapiens
  Light chain CDR3 for antibody 1685 (IGKV6-21)
HQSNRLPLT

SEQ ID NO: 3370 - protein, 11 aa, Homo sapiens
  Heavy chain CDR3 for antibody 1685 (IGHV3-30)
VRVGTGEFFDL

SEQ ID NO: 3371 - protein, 9 aa, Homo sapiens
  Light chain CDR3 for antibody 1686 (IGKV1-6)
LQDYNYPRT

SEQ ID NO: 3372 - protein, 12 aa, Homo sapiens
  Heavy chain CDR3 for antibody 1686 (IGHV1-18)
ARVLFDGDYFDY

SEQ ID NO: 3373 - protein, 9 aa, Homo sapiens
  Light chain CDR3 for antibody 1687 (IGKV5-2)
LQHDNFPYT

SEQ ID NO: 3374 - protein, 18 aa, Homo sapiens
  Heavy chain CDR3 for antibody 1687 (IGHV3-33)
ARERDYYGSGSYPDAFDI

SEQ ID NO: 3375 - protein, 9 aa, Homo sapiens
  Light chain CDR3 for antibody 1688 (IGKV1-39)
QQSYRTPLT

SEQ ID NO: 3376 - protein, 14 aa, Homo sapiens
  Heavy chain CDR3 for antibody 1688 (IGHV3-33)
AREGYSSNWYDFDY

SEQ ID NO: 3377 - protein, 9 aa, Homo sapiens
  Light chain CDR3 for antibody 1689 (IGKV5-2)
LQHDNFPWT

SEQ ID NO: 3378 - protein, 19 aa, Homo sapiens
  Heavy chain CDR3 for antibody 1689 (IGHV4-59)
ARDRVVGATTYYYYYGMDV

SEQ ID NO: 3379 - protein, 9 aa, Homo sapiens
  Light chain CDR3 for antibody 1690 (IGKV1-9)
QQLNSYPLT

SEQ ID NO: 3380 - protein, 7 aa, Homo sapiens
  Heavy chain CDR3 for antibody 1690 (IGHV3-33)
ARELVDY

SEQ ID NO: 3381 - protein, 9 aa, Homo sapiens
  Light chain CDR3 for antibody 1691 (IGKV1D-16)
QQYNSYPYT

SEQ ID NO: 3382 - protein, 12 aa, Homo sapiens
  Heavy chain CDR3 for antibody 1691 (IGHV3-33)
ARDGRAAAYFDN

SEQ ID NO: 3383 - protein, 9 aa, Homo sapiens
  Light chain CDR3 for antibody 1692 (IGKV3-20)
QQYGSSPYT

SEQ ID NO: 3384 - protein, 14 aa, Homo sapiens
  Heavy chain CDR3 for antibody 1692 (IGHV1-46)
ARKGIVGAFDAFDI

SEQ ID NO: 3385 - protein, 9 aa, Homo sapiens
  Light chain CDR3 for antibody 1693 (IGKV1D-16)
QQYNSYPLT

SEQ ID NO: 3386 - protein, 17 aa, Homo sapiens
  Heavy chain CDR3 for antibody 1693 (IGHV3-33)
AREDYDILTGYPFYFDY

SEQ ID NO: 3387 - protein, 9 aa, Homo sapiens
  Light chain CDR3 for antibody 1694 (IGKV1D-16)
QQYNSYPLT

SEQ ID NO: 3388 - protein, 19 aa, Homo sapiens
  Heavy chain CDR3 for antibody 1694 (IGHV3-33)
ARGPYYDILTGYGYYGMDV

SEQ ID NO: 3389 - protein, 9 aa, Homo sapiens
  Light chain CDR3 for antibody 1695 (IGKV1D-13)
QQFNNYPRT

SEQ ID NO: 3390 - protein, 17 aa, Homo sapiens
  Heavy chain CDR3 for antibody 1695 (IGHV1-18)
ARDRAFTMVRGVPPFDY

SEQ ID NO: 3391 - protein, 9 aa, Homo sapiens
  Light chain CDR3 for antibody 1696 (IGKV6-21)
HQSTSLPFT

SEQ ID NO: 3392 - protein, 11 aa, Homo sapiens
  Heavy chain CDR3 for antibody 1696 (IGHV4-59)
ARSLRYSFFDY

SEQ ID NO: 3393 - protein, 9 aa, Homo sapiens
  Light chain CDR3 for antibody 1697 (IGKV1-17)
LQHNSYPYT

SEQ ID NO: 3394 - protein, 19 aa, Homo sapiens
  Heavy chain CDR3 for antibody 1697 (IGHV3-23)
AKDGRSGSYDYYYYYGMDV

SEQ ID NO: 3395 - protein, 9 aa, Homo sapiens
  Light chain CDR3 for antibody 1698 (IGKV1-39)
QQSYSTPLT

SEQ ID NO: 3396 - protein, 14 aa, Homo sapiens
  Heavy chain CDR3 for antibody 1698 (IGHV3-33)
ARTTAAAGPRDFQH

SEQ ID NO: 3397 - protein, 9 aa, Homo sapiens
  Light chain CDR3 for antibody 1699 (IGKV3-20)
QQYGSSPYT

SEQ ID NO: 3398 - protein, 14 aa, Homo sapiens
  Heavy chain CDR3 for antibody 1699 (IGHV3-23)
ANWAYDILTGYLDY

SEQ ID NO: 3399 - protein, 9 aa, Homo sapiens
  Light chain CDR3 for antibody 1700 (IGKV1-6)
LQDHNYPYT

SEQ ID NO: 3400 - protein, 23 aa, Homo sapiens
  Heavy chain CDR3 for antibody 1700 (IGHV3-11)
ARGGDYDILTGFYNSYYYYGMDV

SEQ ID NO: 3401 - protein, 9 aa, Homo sapiens
  Light chain CDR3 for antibody 1701 (IGKV1-9)
QQLISYPLT

SEQ ID NO: 3402 - protein, 16 aa, Homo sapiens
  Heavy chain CDR3 for antibody 1701 (IGHV3-23)
AKEGMVLRYFDWLWDY

SEQ ID NO: 3403 - protein, 9 aa, Homo sapiens
  Light chain CDR3 for antibody 1702 (IGKV1-9)
QQLNSYPLT

SEQ ID NO: 3404 - protein, 13 aa, Homo sapiens
  Heavy chain CDR3 for antibody 1702 (IGHV3-23)
ASTGDSYYYGMDV

SEQ ID NO: 3405 - protein, 9 aa, Homo sapiens
  Light chain CDR3 for antibody 1703 (IGKV1D-16)
QQYNSYPYT

SEQ ID NO: 3406 - protein, 11 aa, Homo sapiens
  Heavy chain CDR3 for antibody 1703 (IGHV4-59)
ARDRGHYGMDV

SEQ ID NO: 3407 - protein, 9 aa, Homo sapiens
  Light chain CDR3 for antibody 1704 (IGKV1D-13)
QQFNNYPYT

SEQ ID NO: 3408 - protein, 18 aa, Homo sapiens
  Heavy chain CDR3 for antibody 1704 (IGHV3-33)
ARDRDRYGSGTYPDAIDI

SEQ ID NO: 3409 - protein, 9 aa, Homo sapiens
  Light chain CDR3 for antibody 1705 (IGKV1-9)
QQLNSYPRT

SEQ ID NO: 3410 - protein, 9 aa, Homo sapiens
  Heavy chain CDR3 for antibody 1705 (IGHV3-33)
ARDAVYFDY

SEQ ID NO: 3411 - protein, 9 aa, Homo sapiens
  Light chain CDR3 for antibody 1706 (IGKV1-6)
LQDYNYPYT

SEQ ID NO: 3412 - protein, 15 aa, Homo sapiens
  Heavy chain CDR3 for antibody 1706 (IGHV3-23)
AKDRDYDFLSGPFDY

SEQ ID NO: 3413 - protein, 9 aa, Homo sapiens
  Light chain CDR3 for antibody 1707 (IGKV1D-16)
QQYNSYPYT

SEQ ID NO: 3414 - protein, 16 aa, Homo sapiens
  Heavy chain CDR3 for antibody 1707 (IGHV3-33)
AKDAFYYGSGSHLFDY

SEQ ID NO: 3415 - protein, 8 aa, Homo sapiens
  Light chain CDR3 for antibody 1708 (IGKV3D-7)
QQDYNLLT

SEQ ID NO: 3416 - protein, 13 aa, Homo sapiens
  Heavy chain CDR3 for antibody 1708 (IGHV3-11)
ARDGGAAAGTWDS

SEQ ID NO: 3417 - protein, 9 aa, Homo sapiens
  Light chain CDR3 for antibody 1709 (IGKV1-17)
QQLNSYPLT

SEQ ID NO: 3418 - protein, 11 aa, Homo sapiens
  Heavy chain CDR3 for antibody 1709 (IGHV1-24)
ATELGLYYFDY

SEQ ID NO: 3419 - protein, 9 aa, Homo sapiens
  Light chain CDR3 for antibody 1710 (IGKV1-27)
QKYNSAPYT

SEQ ID NO: 3420 - protein, 17 aa, Homo sapiens
  Heavy chain CDR3 for antibody 1710 (IGHV3-33)
ARESLKLGIYYYYGMDV

SEQ ID NO: 3421 - protein, 8 aa, Homo sapiens
  Light chain CDR3 for antibody 1711 (IGKV1D-13)
QQFNNYPT

SEQ ID NO: 3422 - protein, 16 aa, Homo sapiens
  Heavy chain CDR3 for antibody 1711 (IGHV3-23)
AKEGMVLRYFDWLWDY

SEQ ID NO: 3423 - protein, 9 aa, Homo sapiens
  Light chain CDR3 for antibody 1712 (IGKV1-6)
LQDYNYPYT

SEQ ID NO: 3424 - protein, 16 aa, Homo sapiens
  Heavy chain CDR3 for antibody 1712 (IGHV3-23)
AKDGIGELSYYYGMDV

SEQ ID NO: 3425 - protein, 9 aa, Homo sapiens
  Light chain CDR3 for antibody 1713 (IGKV5-2)
LQHDNFPYT

SEQ ID NO: 3426 - protein, 13 aa, Homo sapiens
  Heavy chain CDR3 for antibody 1713 (IGHV3-33)
ASGYSGYDWYFDL

SEQ ID NO: 3427 - protein, 9 aa, Homo sapiens
  Light chain CDR3 for antibody 1714 (IGKV6-21)
HQSSSLPYT

SEQ ID NO: 3428 - protein, 18 aa, Homo sapiens
  Heavy chain CDR3 for antibody 1714 (IGHV3-33)
ARGGYSSGWDYYYYGMDV

SEQ ID NO: 3429 - protein, 9 aa, Homo sapiens
  Light chain CDR3 for antibody 1715 (IGKV3-15)
QQYNNWPLT

SEQ ID NO: 3430 - protein, 12 aa, Homo sapiens
  Heavy chain CDR3 for antibody 1715 (IGHV4-61)
ARVYSSGWLFDY

SEQ ID NO: 3431 - protein, 9 aa, Homo sapiens
  Light chain CDR3 for antibody 1716 (IGKV5-2)
LQHDNFPYT

SEQ ID NO: 3432 - protein, 10 aa, Homo sapiens
  Heavy chain CDR3 for antibody 1716 (IGHV3-33)
ARDVVVYFDY

SEQ ID NO: 3433 - protein, 9 aa, Homo sapiens
  Light chain CDR3 for antibody 1717 (IGKV1-17)
LQHNSYPWT

SEQ ID NO: 3434 - protein, 16 aa, Homo sapiens
  Heavy chain CDR3 for antibody 1717 (IGHV3-33)
ARDNFGSGSYYSHFHY

SEQ ID NO: 3435 - protein, 9 aa, Homo sapiens
  Light chain CDR3 for antibody 1718 (IGKV1-9)
QQLNSYPLT

SEQ ID NO: 3436 - protein, 17 aa, Homo sapiens
  Heavy chain CDR3 for antibody 1718 (IGHV1-18)
ARERYYGSGNYKYNMDV

SEQ ID NO: 3437 - protein, 9 aa, Homo sapiens
  Light chain CDR3 for antibody 1719 (IGKV6-21)
HQSSSLPYT

SEQ ID NO: 3438 - protein, 16 aa, Homo sapiens
  Heavy chain CDR3 for antibody 1719 (IGHV1-24)
ATEDSSSTYYYYGLDV

SEQ ID NO: 3439 - protein, 9 aa, Homo sapiens
  Light chain CDR3 for antibody 1720 (IGKV1-9)
QQYNSYPLT

SEQ ID NO: 3440 - protein, 22 aa, Homo sapiens
  Heavy chain CDR3 for antibody 1720 (IGHV4-59)
AREINYGSGSYYNEDYYYGMDV

SEQ ID NO: 3441 - protein, 9 aa, Homo sapiens
  Light chain CDR3 for antibody 1721 (IGKV1D-13)
QQFNNYPYT

SEQ ID NO: 3442 - protein, 13 aa, Homo sapiens
  Heavy chain CDR3 for antibody 1721 (IGHV3-33)
ARTDYYFYYGLDV

SEQ ID NO: 3443 - protein, 9 aa, Homo sapiens
  Light chain CDR3 for antibody 1722 (IGKV1-6)
LQDYNYPYT

SEQ ID NO: 3444 - protein, 15 aa, Homo sapiens
  Heavy chain CDR3 for antibody 1722 (IGHV3-33)
ARDGSGSYSLYGMDV

SEQ ID NO: 3445 - protein, 9 aa, Homo sapiens
  Light chain CDR3 for antibody 1723 (IGKV3-20)
QQYGSSPYT

SEQ ID NO: 3446 - protein, 21 aa, Homo sapiens
  Heavy chain CDR3 for antibody 1723 (IGHV3-33)
ARDEYYEIVTGYGYYHYGMDV

SEQ ID NO: 3447 - protein, 9 aa, Homo sapiens
  Light chain CDR3 for antibody 1724 (IGKV1D-16)
QQYNSYPYT

SEQ ID NO: 3448 - protein, 18 aa, Homo sapiens
  Heavy chain CDR3 for antibody 1724 (IGHV1-18)
ARDPNYYGSGSYYNYFDY

SEQ ID NO: 3449 - protein, 9 aa, Homo sapiens
  Light chain CDR3 for antibody 1725 (IGKV3-20)
QQYGSSPYT

SEQ ID NO: 3450 - protein, 23 aa, Homo sapiens
  Heavy chain CDR3 for antibody 1725 (IGHV3-11)
ARDEGVTMVRGVISYYYYYGMDV

SEQ ID NO: 3451 - protein, 9 aa, Homo sapiens
  Light chain CDR3 for antibody 1726 (IGKV1-39)
QQSYRTPLT

SEQ ID NO: 3452 - protein, 12 aa, Homo sapiens
  Heavy chain CDR3 for antibody 1726 (IGHV3-33)
ARDRAYRGSLDY

SEQ ID NO: 3453 - protein, 9 aa, Homo sapiens
  Light chain CDR3 for antibody 1727 (IGKV1-17)
LQHNSYPYT

SEQ ID NO: 3454 - protein, 18 aa, Homo sapiens
  Heavy chain CDR3 for antibody 1727 (IGHV3-33)
AREGYDILTGYYNVKFDY

SEQ ID NO: 3455 - protein, 9 aa, Homo sapiens
  Light chain CDR3 for antibody 1728 (IGKV1D-13)
QQFNNYPYT

SEQ ID NO: 3456 - protein, 13 aa, Homo sapiens
  Heavy chain CDR3 for antibody 1728 (IGHV3-33)
ARVDTMVRGVMAY

SEQ ID NO: 3457 - protein, 9 aa, Homo sapiens
  Light chain CDR3 for antibody 1729 (IGKV1-17)
LQHNSYPYT

SEQ ID NO: 3458 - protein, 13 aa, Homo sapiens
  Heavy chain CDR3 for antibody 1729 (IGHV1-46)
ARRQVGYYYGMDV

SEQ ID NO: 3459 - protein, 9 aa, Homo sapiens
  Light chain CDR3 for antibody 1730 (IGKV5-2)
LQHDNFPWT

SEQ ID NO: 3460 - protein, 14 aa, Homo sapiens
  Heavy chain CDR3 for antibody 1730 (IGHV4-59)
AKGGSGSYYNWFDP

SEQ ID NO: 3461 - protein, 9 aa, Homo sapiens
  Light chain CDR3 for antibody 1731 (IGKV1-39)
QQSYSTPLT

SEQ ID NO: 3462 - protein, 11 aa, Homo sapiens
  Heavy chain CDR3 for antibody 1731 (IGHV3-33)
AREAANWGFDY

SEQ ID NO: 3463 - protein, 9 aa, Homo sapiens
  Light chain CDR3 for antibody 1732 (IGKV1D-13)
QQFNNYPYT

SEQ ID NO: 3464 - protein, 8 aa, Homo sapiens
  Heavy chain CDR3 for antibody 1732 (IGHV3-23)
AKETGNNY

SEQ ID NO: 3465 - protein, 9 aa, Homo sapiens
  Light chain CDR3 for antibody 1733 (IGKV3-15)
QQYNNWPLT

SEQ ID NO: 3466 - protein, 13 aa, Homo sapiens
  Heavy chain CDR3 for antibody 1733 (IGHV4-39)
ARQWPSGYWYFDL

SEQ ID NO: 3467 - protein, 9 aa, Homo sapiens
  Light chain CDR3 for antibody 1734 (IGKV1D-13)
QQFNNYPYT

SEQ ID NO: 3468 - protein, 18 aa, Homo sapiens
  Heavy chain CDR3 for antibody 1734 (IGHV3-23)
AKEGNYYGSGSYWGYFDP

SEQ ID NO: 3469 - protein, 9 aa, Homo sapiens
  Light chain CDR3 for antibody 1735 (IGKV5-2)
LQHDNFPWT

SEQ ID NO: 3470 - protein, 23 aa, Homo sapiens
  Heavy chain CDR3 for antibody 1735 (IGHV3-11)
ARDEGVTMVRGVISYYYYYGMDV

SEQ ID NO: 3471 - protein, 9 aa, Homo sapiens
  Light chain CDR3 for antibody 1736 (IGKV3-20)
QQYGSSPYT

SEQ ID NO: 3472 - protein, 12 aa, Homo sapiens
  Heavy chain CDR3 for antibody 1736 (IGHV3-23)
AKEGLGSDYESY

SEQ ID NO: 3473 - protein, 9 aa, Homo sapiens
  Light chain CDR3 for antibody 1737 (IGKV5-2)
LQHDNFPWT

SEQ ID NO: 3474 - protein, 14 aa, Homo sapiens
  Heavy chain CDR3 for antibody 1737 (IGHV4-39)
ARQGGSGSYYNLDY

SEQ ID NO: 3475 - protein, 9 aa, Homo sapiens
  Light chain CDR3 for antibody 1738 (IGKV1-27)
QKYNSAPYT

SEQ ID NO: 3476 - protein, 14 aa, Homo sapiens
  Heavy chain CDR3 for antibody 1738 (IGHV3-33)
ARQYSYGYPYYFDY

SEQ ID NO: 3477 - protein, 9 aa, Homo sapiens
  Light chain CDR3 for antibody 1739 (IGKV6-21)
HQSSSLPYT

SEQ ID NO: 3478 - protein, 10 aa, Homo sapiens
  Heavy chain CDR3 for antibody 1739 (IGHV3-33)
ARDVVVYFDY

SEQ ID NO: 3479 - protein, 9 aa, Homo sapiens
  Light chain CDR3 for antibody 1740 (IGKV3-20)
QQYGSSIFT

SEQ ID NO: 3480 - protein, 12 aa, Homo sapiens
  Heavy chain CDR3 for antibody 1740 (IGHV3-33)
ARTDYYYYGMDV

SEQ ID NO: 3481 - protein, 9 aa, Homo sapiens
  Light chain CDR3 for antibody 1741 (IGKV1-17)
LQHNSYPYT

SEQ ID NO: 3482 - protein, 15 aa, Homo sapiens
  Heavy chain CDR3 for antibody 1741 (IGHV3-33)
ARAYDLPHYYYGMDV

SEQ ID NO: 3483 - protein, 9 aa, Homo sapiens
  Light chain CDR3 for antibody 1742 (IGKV3-15)
QQYNNWPLT

SEQ ID NO: 3484 - protein, 13 aa, Homo sapiens
  Heavy chain CDR3 for antibody 1742 (IGHV4-39)
ARREVVGGRGFDY

SEQ ID NO: 3485 - protein, 9 aa, Homo sapiens
  Light chain CDR3 for antibody 1743 (IGKV1D-13)
QQFNNYPYT

SEQ ID NO: 3486 - protein, 9 aa, Homo sapiens
  Heavy chain CDR3 for antibody 1743 (IGHV3-13)
ARDRWYFDL

SEQ ID NO: 3487 - protein, 9 aa, Homo sapiens
  Light chain CDR3 for antibody 1744 (IGKV1-9)
QQLNSYPLT

SEQ ID NO: 3488 - protein, 16 aa, Homo sapiens
  Heavy chain CDR3 for antibody 1744 (IGHV4-59)
ARFYFGSGSYYWYFDL

SEQ ID NO: 3489 - protein, 9 aa, Homo sapiens
  Light chain CDR3 for antibody 1745 (IGKV1-17)
LQHNSYPWT

SEQ ID NO: 3490 - protein, 13 aa, Homo sapiens
  Heavy chain CDR3 for antibody 1745 (IGHV3-33)
ARIDYYSYYGMDV

SEQ ID NO: 3491 - protein, 9 aa, Homo sapiens
  Light chain CDR3 for antibody 1746 (IGKV1D-16)
QQYNSYPYT

SEQ ID NO: 3492 - protein, 18 aa, Homo sapiens
  Heavy chain CDR3 for antibody 1746 (IGHV1-18)
ARDPTFYYVSGSYYKFDY

SEQ ID NO: 3493 - protein, 9 aa, Homo sapiens
  Light chain CDR3 for antibody 1747 (IGKV1D-13)
QQFNNYPYT

SEQ ID NO: 3494 - protein, 15 aa, Homo sapiens
  Heavy chain CDR3 for antibody 1747 (IGHV3-33)
ARDRGWKAPGYGMDV

SEQ ID NO: 3495 - protein, 9 aa, Homo sapiens
  Light chain CDR3 for antibody 1748 (IGKV1-39)
QQSYRVPLT

SEQ ID NO: 3496 - protein, 15 aa, Homo sapiens
  Heavy chain CDR3 for antibody 1748 (IGHV4-b)
ARHDGAVAGTGVFDT

SEQ ID NO: 3497 - protein, 9 aa, Homo sapiens
  Light chain CDR3 for antibody 1749 (IGKV1D-13)
QQFNNYPYT

SEQ ID NO: 3498 - protein, 13 aa, Homo sapiens
  Heavy chain CDR3 for antibody 1749 (IGHV3-33)
ARRYRSGWYPFDY

SEQ ID NO: 3499 - protein, 9 aa, Homo sapiens
  Light chain CDR3 for antibody 1750 (IGKV6-21)
HQSSSLPYT

SEQ ID NO: 3500 - protein, 9 aa, Homo sapiens
  Heavy chain CDR3 for antibody 1750 (IGHV4-59)
ARGGASFDY

SEQ ID NO: 3501 - protein, 9 aa, Homo sapiens
  Light chain CDR3 for antibody 1751 (IGKV1D-16)
QQYNSYPYT

SEQ ID NO: 3502 - protein, 12 aa, Homo sapiens
  Heavy chain CDR3 for antibody 1751 (IGHV3-33)
ARDPGYFFGLDV

SEQ ID NO: 3503 - protein, 9 aa, Homo sapiens
  Light chain CDR3 for antibody 1752 (IGKV1-27)
QKYNSAPYT

SEQ ID NO: 3504 - protein, 9 aa, Homo sapiens
  Heavy chain CDR3 for antibody 1752 (IGHV3-30)
ARDNWGFDY

SEQ ID NO: 3505 - protein, 9 aa, Homo sapiens
  Light chain CDR3 for antibody 1753 (IGKV1-27)
QKYNSAPYT

SEQ ID NO: 3506 - protein, 12 aa, Homo sapiens
  Heavy chain CDR3 for antibody 1753 (IGHV3-33)
ARDLVGATPFDY

SEQ ID NO: 3507 - protein, 9 aa, Homo sapiens
  Light chain CDR3 for antibody 1754 (IGKV3-20)
QQYGSSPYT

SEQ ID NO: 3508 - protein, 9 aa, Homo sapiens
  Heavy chain CDR3 for antibody 1754 (IGHV3-23)
ARIWWLKDY

SEQ ID NO: 3509 - protein, 9 aa, Homo sapiens
  Light chain CDR3 for antibody 1755 (IGKV1D-16)
QQYNSYPYT

SEQ ID NO: 3510 - protein, 15 aa, Homo sapiens
  Heavy chain CDR3 for antibody 1755 (IGHV1-2)
ARDLGYYGSGSRMDV

SEQ ID NO: 3511 - protein, 9 aa, Homo sapiens
  Light chain CDR3 for antibody 1756 (IGKV3-15)
QQYNNWPLT

SEQ ID NO: 3512 - protein, 13 aa, Homo sapiens
  Heavy chain CDR3 for antibody 1756 (IGHV3-33)
ARDYCGGDCYLDY

SEQ ID NO: 3513 - protein, 9 aa, Homo sapiens
  Light chain CDR3 for antibody 1757 (IGKV1D-13)
QQFNNYPHT

SEQ ID NO: 3514 - protein, 14 aa, Homo sapiens
  Heavy chain CDR3 for antibody 1757 (IGHV4-39)
ARDSGYDYYYGMDV

SEQ ID NO: 3515 - protein, 9 aa, Homo sapiens
  Light chain CDR3 for antibody 1758 (IGKV1-17)
LQHNSYPYT

SEQ ID NO: 3516 - protein, 11 aa, Homo sapiens
  Heavy chain CDR3 for antibody 1758 (IGHV1-46)
AREEDLGAFDI

SEQ ID NO: 3517 - protein, 9 aa, Homo sapiens
  Light chain CDR3 for antibody 1759 (IGKV6-21)
HQSSSLPYT

SEQ ID NO: 3518 - protein, 13 aa, Homo sapiens
  Heavy chain CDR3 for antibody 1759 (IGHV3-21)
ARDSTLVRGVFPY

SEQ ID NO: 3519 - protein, 9 aa, Homo sapiens
  Light chain CDR3 for antibody 1760 (IGKV1D-16)
QQYNSYPYT

SEQ ID NO: 3520 - protein, 13 aa, Homo sapiens
  Heavy chain CDR3 for antibody 1760 (IGHV3-33)
ARDPLYSGSYFDY

SEQ ID NO: 3521 - protein, 9 aa, Homo sapiens
  Light chain CDR3 for antibody 1761 (IGKV1-6)
LQDYNYPYT

SEQ ID NO: 3522 - protein, 14 aa, Homo sapiens
  Heavy chain CDR3 for antibody 1761 (IGHV3-33)
ARGYGSGSYYSFDY

SEQ ID NO: 3523 - protein, 9 aa, Homo sapiens
  Light chain CDR3 for antibody 1762 (IGKV5-2)
LQHDNFPWT

SEQ ID NO: 3524 - protein, 14 aa, Homo sapiens
  Heavy chain CDR3 for antibody 1762 (IGHV1-2)
ARDYYGSGNYYMGY

SEQ ID NO: 3525 - protein, 9 aa, Homo sapiens
  Light chain CDR3 for antibody 1763 (IGKV1-27)
QKYNSAPYT

SEQ ID NO: 3526 - protein, 18 aa, Homo sapiens
  Heavy chain CDR3 for antibody 1763 (IGHV3-23)
AKDRITGTTYGYYSGLDV

SEQ ID NO: 3527 - protein, 9 aa, Homo sapiens
  Light chain CDR3 for antibody 1764 (IGKV5-2)
LQHDNFPYT

SEQ ID NO: 3528 - protein, 16 aa, Homo sapiens
  Heavy chain CDR3 for antibody 1764 (IGHV3-33)
ARDNFGSGSYYSHFHY

SEQ ID NO: 3529 - protein, 9 aa, Homo sapiens
  Light chain CDR3 for antibody 1765 (IGKV5-2)
LQHDNFPWT

SEQ ID NO: 3530 - protein, 14 aa, Homo sapiens
  Heavy chain CDR3 for antibody 1765 (IGHV4-39)
ARHGYYGSSNWFDP

SEQ ID NO: 3531 - protein, 9 aa, Homo sapiens
  Light chain CDR3 for antibody 1766 (IGKV1-17)
LQHNSYPYT

SEQ ID NO: 3532 - protein, 12 aa, Homo sapiens
  Heavy chain CDR3 for antibody 1766 (IGHV3-33)
ARKQWLVQAFDI

SEQ ID NO: 3533 - protein, 9 aa, Homo sapiens
  Light chain CDR3 for antibody 1767 (IGKV3-20)
QQYGSSPYT

SEQ ID NO: 3534 - protein, 17 aa, Homo sapiens
  Heavy chain CDR3 for antibody 1767 (IGHV3-33)
ARDWFGELSDYYYGMDV

SEQ ID NO: 3535 - protein, 9 aa, Homo sapiens
  Light chain CDR3 for antibody 1768 (IGKV1D-13)
QQFNNYPYT

SEQ ID NO: 3536 - protein, 12 aa, Homo sapiens
  Heavy chain CDR3 for antibody 1768 (IGHV3-33)
ARVDTAAPYFDY

SEQ ID NO: 3537 - protein, 9 aa, Homo sapiens
  Light chain CDR3 for antibody 1769 (IGKV5-2)
LQHDNFPYT

SEQ ID NO: 3538 - protein, 17 aa, Homo sapiens
  Heavy chain CDR3 for antibody 1769 (IGHV3-64)
ARERYYGSGSYYNWFDP

SEQ ID NO: 3539 - protein, 9 aa, Homo sapiens
  Light chain CDR3 for antibody 1770 (IGKV2-30)
MQGTHWPLT

SEQ ID NO: 3540 - protein, 16 aa, Homo sapiens
  Heavy chain CDR3 for antibody 1770 (IGHV4-59)
ARGRYFEWLLGDVFDI

SEQ ID NO: 3541 - protein, 9 aa, Homo sapiens
  Light chain CDR3 for antibody 1771 (IGKV3-20)
QQYGSSPYT

SEQ ID NO: 3542 - protein, 20 aa, Homo sapiens
  Heavy chain CDR3 for antibody 1771 (IGHV3-33)
ARDPAQLERRYYYFYYGMDV

SEQ ID NO: 3543 - protein, 9 aa, Homo sapiens
  Light chain CDR3 for antibody 1772 (IGKV5-2)
LQHDNFPWT

SEQ ID NO: 3544 - protein, 16 aa, Homo sapiens
  Heavy chain CDR3 for antibody 1772 (IGHV1-8)
AREGTMVRGVTYAFDI

SEQ ID NO: 3545 - protein, 9 aa, Homo sapiens
  Light chain CDR3 for antibody 1773 (IGKV3-15)
QQYNNWPYT

SEQ ID NO: 3546 - protein, 18 aa, Homo sapiens
  Heavy chain CDR3 for antibody 1773 (IGHV3-33)
ARREGIVGATTYYYGMDV

SEQ ID NO: 3547 - protein, 9 aa, Homo sapiens
  Light chain CDR3 for antibody 1774 (IGKV1D-16)
QQYNSYPYT

SEQ ID NO: 3548 - protein, 17 aa, Homo sapiens
  Heavy chain CDR3 for antibody 1774 (IGHV1-24)
ATHYGSGSHYKGYGMDV

SEQ ID NO: 3549 - protein, 9 aa, Homo sapiens
  Light chain CDR3 for antibody 1775 (IGKV5-2)
LQHDNFPWT

SEQ ID NO: 3550 - protein, 11 aa, Homo sapiens
  Heavy chain CDR3 for antibody 1775 (IGHV4-59)
ARDGVRGVFDI

SEQ ID NO: 3551 - protein, 9 aa, Homo sapiens
  Light chain CDR3 for antibody 1776 (IGKV1D-16)
QQYNSYPYT

SEQ ID NO: 3552 - protein, 10 aa, Homo sapiens
  Heavy chain CDR3 for antibody 1776 (IGHV3-30)
ARGSWYGFDY

SEQ ID NO: 3553 - protein, 9 aa, Homo sapiens
  Light chain CDR3 for antibody 1777 (IGKV6-21)
HQSSSLPYT

SEQ ID NO: 3554 - protein, 20 aa, Homo sapiens
  Heavy chain CDR3 for antibody 1777 (IGHV1-f)
ATGLITFVRGVILTYRSFDY

SEQ ID NO: 3555 - protein, 9 aa, Homo sapiens
  Light chain CDR3 for antibody 1778 (IGKV3-20)
QQYGSSPYT

SEQ ID NO: 3556 - protein, 20 aa, Homo sapiens
  Heavy chain CDR3 for antibody 1778 (IGHV3-33)
ARDNDSSGYYDYYYYYGMDV

SEQ ID NO: 3557 - protein, 9 aa, Homo sapiens
  Light chain CDR3 for antibody 1779 (IGKV1-39)
QQSYSTPLT

SEQ ID NO: 3558 - protein, 8 aa, Homo sapiens
  Heavy chain CDR3 for antibody 1779 (IGHV3-23)
AETFLFDY

SEQ ID NO: 3559 - protein, 9 aa, Homo sapiens
  Light chain CDR3 for antibody 1780 (IGKV5-2)
LQHDNFPYT

SEQ ID NO: 3560 - protein, 12 aa, Homo sapiens
  Heavy chain CDR3 for antibody 1780 (IGHV3-33)
ARDGYSSRNFDY

SEQ ID NO: 3561 - protein, 10 aa, Homo sapiens
  Light chain CDR3 for antibody 1781 (IGKV3-11)
QQRSNWPIFT

SEQ ID NO: 3562 - protein, 13 aa, Homo sapiens
  Heavy chain CDR3 for antibody 1781 (IGHV3-23)
ASPFNWNDGFFDY

SEQ ID NO: 3563 - protein, 9 aa, Homo sapiens
  Light chain CDR3 for antibody 1782 (IGKV6-21)
HQSSSLPYT

SEQ ID NO: 3564 - protein, 15 aa, Homo sapiens
  Heavy chain CDR3 for antibody 1782 (IGHV3-33)
ARDRVGVKDYYSMDV

SEQ ID NO: 3565 - protein, 9 aa, Homo sapiens
  Light chain CDR3 for antibody 1783 (IGKV1-39)
QQSYSTPLT

SEQ ID NO: 3566 - protein, 12 aa, Homo sapiens
  Heavy chain CDR3 for antibody 1783 (IGHV3-33)
ARDLVGATPFDY

SEQ ID NO: 3567 - protein, 9 aa, Homo sapiens
  Light chain CDR3 for antibody 1784 (IGKV6-21)
HQSSSLPYT

SEQ ID NO: 3568 - protein, 20 aa, Homo sapiens
  Heavy chain CDR3 for antibody 1784 (IGHV3-33)
SRGGATLVRGVIDYYYGMDV

SEQ ID NO: 3569 - protein, 9 aa, Homo sapiens
  Light chain CDR3 for antibody 1785 (IGKV1-9)
QQLNSYPWT

SEQ ID NO: 3570 - protein, 15 aa, Homo sapiens
  Heavy chain CDR3 for antibody 1785 (IGHV3-33)
ARRICSGGSCSLFDY

SEQ ID NO: 3571 - protein, 9 aa, Homo sapiens
  Light chain CDR3 for antibody 1786 (IGKV3-20)
HQYGSSPLT

SEQ ID NO: 3572 - protein, 13 aa, Homo sapiens
  Heavy chain CDR3 for antibody 1786 (IGHV4-61)
ARMGREQWLGFDY

SEQ ID NO: 3573 - protein, 9 aa, Homo sapiens
  Light chain CDR3 for antibody 1787 (IGKV3-20)
QQYGSSPYT

SEQ ID NO: 3574 - protein, 17 aa, Homo sapiens
  Heavy chain CDR3 for antibody 1787 (IGHV3-33)
ARGFSGYDGYYYYGMDV

SEQ ID NO: 3575 - protein, 9 aa, Homo sapiens
  Light chain CDR3 for antibody 1788 (IGKV3-20)
QQYGSSPYT

SEQ ID NO: 3576 - protein, 14 aa, Homo sapiens
  Heavy chain CDR3 for antibody 1788 (IGHV3-20)
ARDGGSTSFDWFDP

SEQ ID NO: 3577 - protein, 9 aa, Homo sapiens
  Light chain CDR3 for antibody 1789 (IGKV3-20)
QQYGSSPLT

SEQ ID NO: 3578 - protein, 12 aa, Homo sapiens
  Heavy chain CDR3 for antibody 1789 (IGHV4-61)
ARVDSSGWFFDY

SEQ ID NO: 3579 - protein, 9 aa, Homo sapiens
  Light chain CDR3 for antibody 1790 (IGKV2D-28)
MQATQFPLT

SEQ ID NO: 3580 - protein, 18 aa, Homo sapiens
  Heavy chain CDR3 for antibody 1790 (IGHV3-33)
AREAIVVVPAAPYYGMDV

SEQ ID NO: 3581 - protein, 9 aa, Homo sapiens
  Light chain CDR3 for antibody 1791 (IGKV6-21)
HQSSSLPYT

SEQ ID NO: 3582 - protein, 20 aa, Homo sapiens
  Heavy chain CDR3 for antibody 1791 (IGHV3-33)
ARDPAQLERRYYYFYYGMDV

SEQ ID NO: 3583 - protein, 9 aa, Homo sapiens
  Light chain CDR3 for antibody 1792 (IGKV6-21)
HQSSSLPYT

SEQ ID NO: 3584 - protein, 16 aa, Homo sapiens
  Heavy chain CDR3 for antibody 1792 (IGHV3-33)
ARGDDILTHQYYGVDV

SEQ ID NO: 3585 - protein, 9 aa, Homo sapiens
  Light chain CDR3 for antibody 1793 (IGKV1D-16)
QQYNSYPYT

SEQ ID NO: 3586 - protein, 15 aa, Homo sapiens
  Heavy chain CDR3 for antibody 1793 (IGHV3-33)
ARDRGMVRGDGYLDY

SEQ ID NO: 3587 - protein, 9 aa, Homo sapiens
  Light chain CDR3 for antibody 1794 (IGKV5-2)
LQHDNFPYT

SEQ ID NO: 3588 - protein, 17 aa, Homo sapiens
  Heavy chain CDR3 for antibody 1794 (IGHV3-33)
ARVRGVIEGYYYYGMDV

SEQ ID NO: 3589 - protein, 9 aa, Homo sapiens
  Light chain CDR3 for antibody 1795 (IGKV1-6)
LQDYNYPYT

SEQ ID NO: 3590 - protein, 8 aa, Homo sapiens
  Heavy chain CDR3 for antibody 1795 (IGHV3-20)
APHWIFDY

SEQ ID NO: 3591 - protein, 9 aa, Homo sapiens
  Light chain CDR3 for antibody 1796 (IGKV5-2)
LQHDNFPWT

SEQ ID NO: 3592 - protein, 12 aa, Homo sapiens
  Heavy chain CDR3 for antibody 1796 (IGHV4-39)
ARHPRYLDAFDI

SEQ ID NO: 3593 - protein, 9 aa, Homo sapiens
  Light chain CDR3 for antibody 1797 (IGKV1-16)
QQYNSYPYT

SEQ ID NO: 3594 - protein, 16 aa, Homo sapiens
  Heavy chain CDR3 for antibody 1797 (IGHV1-24)
ATDWNDRGYYYYGMDV

SEQ ID NO: 3595 - protein, 9 aa, Homo sapiens
  Light chain CDR3 for antibody 1798 (IGKV1-39)
QQSYSTPLT

SEQ ID NO: 3596 - protein, 9 aa, Homo sapiens
  Heavy chain CDR3 for antibody 1798 (IGHV3-33)
ARATVGVDY

SEQ ID NO: 3597 - protein, 9 aa, Homo sapiens
  Light chain CDR3 for antibody 1799 (IGKV5-2)
LQHDNFPYT

SEQ ID NO: 3598 - protein, 11 aa, Homo sapiens
  Heavy chain CDR3 for antibody 1799 (IGHV3-33)
ARGTTVTHFDY

SEQ ID NO: 3599 - protein, 9 aa, Homo sapiens
  Light chain CDR3 for antibody 1800 (IGKV1-6)
LQDYNYPRT

SEQ ID NO: 3600 - protein, 13 aa, Homo sapiens
  Heavy chain CDR3 for antibody 1800 (IGHV4-39)
ARRDVLAPAAFDY

SEQ ID NO: 3601 - protein, 9 aa, Homo sapiens
  Light chain CDR3 for antibody 1801 (IGKV6-21)
HQSSSLPYT

SEQ ID NO: 3602 - protein, 11 aa, Homo sapiens
  Heavy chain CDR3 for antibody 1801 (IGHV3-23)
AKGLWSYYFDY

SEQ ID NO: 3603 - protein, 9 aa, Homo sapiens
  Light chain CDR3 for antibody 1802 (IGKV3-15)
QQYNNWPLT

SEQ ID NO: 3604 - protein, 13 aa, Homo sapiens
  Heavy chain CDR3 for antibody 1802 (IGHV3-11)
ARDGGAAAGTWDS

SEQ ID NO: 3605 - protein, 9 aa, Homo sapiens
  Light chain CDR3 for antibody 1803 (IGKV5-2)
LQHDNFPWT

SEQ ID NO: 3606 - protein, 15 aa, Homo sapiens
  Heavy chain CDR3 for antibody 1803 (IGHV4-39)
ARHSGYSSGWYPFDY

SEQ ID NO: 3607 - protein, 9 aa, Homo sapiens
  Light chain CDR3 for antibody 1804 (IGKV5-2)
LQHDNFPYT

SEQ ID NO: 3608 - protein, 12 aa, Homo sapiens
  Heavy chain CDR3 for antibody 1804 (IGHV3-33)
ASRDILTGYLGY

SEQ ID NO: 3609 - protein, 9 aa, Homo sapiens
  Light chain CDR3 for antibody 1805 (IGKV1-27)
QKYNSAPYT

SEQ ID NO: 3610 - protein, 11 aa, Homo sapiens
  Heavy chain CDR3 for antibody 1805 (IGHV4-59)
AREMGHDTFDI

SEQ ID NO: 3611 - protein, 9 aa, Homo sapiens
  Light chain CDR3 for antibody 1806 (IGKV1D-16)
QQYNSYPYT

SEQ ID NO: 3612 - protein, 9 aa, Homo sapiens
  Heavy chain CDR3 for antibody 1806 (IGHV3-13)
ARDHWYFDL

SEQ ID NO: 3613 - protein, 9 aa, Homo sapiens
  Light chain CDR3 for antibody 1807 (IGKV6-21)
HQSSSLPYT

SEQ ID NO: 3614 - protein, 15 aa, Homo sapiens
  Heavy chain CDR3 for antibody 1807 (IGHV3-23)
AKDGGWNYYYYGMDV

SEQ ID NO: 3615 - protein, 9 aa, Homo sapiens
  Light chain CDR3 for antibody 1808 (IGKV1D-16)
QQYNSYPYT

SEQ ID NO: 3616 - protein, 14 aa, Homo sapiens
  Heavy chain CDR3 for antibody 1808 (IGHV3-33)
ARDGYDILTGPMDV

SEQ ID NO: 3617 - protein, 9 aa, Homo sapiens
  Light chain CDR3 for antibody 1809 (IGKV1-6)
LQDYKSPFT

SEQ ID NO: 3618 - protein, 19 aa, Homo sapiens
  Heavy chain CDR3 for antibody 1809 (IGHV3-23)
AKDREMAATSHYYYYGMDV

SEQ ID NO: 3619 - protein, 9 aa, Homo sapiens
  Light chain CDR3 for antibody 1810 (IGKV1-27)
QKYNSAPYT

SEQ ID NO: 3620 - protein, 12 aa, Homo sapiens
  Heavy chain CDR3 for antibody 1810 (IGHV3-33)
ARDRAYRGSLDY

SEQ ID NO: 3621 - protein, 9 aa, Homo sapiens
  Light chain CDR3 for antibody 1811 (IGKV6-21)
HQSSSLPYT

SEQ ID NO: 3622 - protein, 14 aa, Homo sapiens
  Heavy chain CDR3 for antibody 1811 (IGHV1-46)
ARRGIVGALDAFDI

SEQ ID NO: 3623 - protein, 9 aa, Homo sapiens
  Light chain CDR3 for antibody 1812 (IGKV2-30)
MQASYWPNT

SEQ ID NO: 3624 - protein, 11 aa, Homo sapiens
  Heavy chain CDR3 for antibody 1812 (IGHV3-23)
AKEQKEAAMGA

SEQ ID NO: 3625 - protein, 9 aa, Homo sapiens
  Light chain CDR3 for antibody 1813 (IGKV6-21)
HQSSSLPLT

SEQ ID NO: 3626 - protein, 20 aa, Homo sapiens
  Heavy chain CDR3 for antibody 1813 (IGHV4-39)
ARHPPYYYDSSGYFYGAFDV

SEQ ID NO: 3627 - protein, 9 aa, Homo sapiens
  Light chain CDR3 for antibody 1814 (IGKV3-20)
QQYGSSPYT

SEQ ID NO: 3628 - protein, 17 aa, Homo sapiens
  Heavy chain CDR3 for antibody 1814 (IGHV3-15)
TTERYPRRYYYYFGMDV

SEQ ID NO: 3629 - protein, 9 aa, Homo sapiens
  Light chain CDR3 for antibody 1815 (IGKV1-16)
QQYNSYPYT

SEQ ID NO: 3630 - protein, 18 aa, Homo sapiens
  Heavy chain CDR3 for antibody 1815 (IGHV4-59)
ARDNHYYSSGTYSNWFDP

SEQ ID NO: 3631 - protein, 10 aa, Homo sapiens
  Light chain CDR3 for antibody 1816 (IGKV1-39)
QQSYSTPLFT

SEQ ID NO: 3632 - protein, 12 aa, Homo sapiens
  Heavy chain CDR3 for antibody 1816 (IGHV1-46)
TFSRSGGGCVDY

SEQ ID NO: 3633 - protein, 9 aa, Homo sapiens
  Light chain CDR3 for antibody 1817 (IGKV6-21)
HQSSSLPWT

SEQ ID NO: 3634 - protein, 12 aa, Homo sapiens
  Heavy chain CDR3 for antibody 1817 (IGHV3-33)
ARVIDWLKPMDV

SEQ ID NO: 3635 - protein, 10 aa, Homo sapiens
  Light chain CDR3 for antibody 1818 (IGKV1-17)
LQHNSYPMYT

SEQ ID NO: 3636 - protein, 13 aa, Homo sapiens
  Heavy chain CDR3 for antibody 1818 (IGHV4-59)
ARDAGYSSSWFDY

SEQ ID NO: 3637 - protein, 9 aa, Homo sapiens
  Light chain CDR3 for antibody 1819 (IGKV5-2)
LQHDNFPYT

SEQ ID NO: 3638 - protein, 21 aa, Homo sapiens
  Heavy chain CDR3 for antibody 1819 (IGHV3-33)
ARDEYYEIVTGYGYYHYGMDV

SEQ ID NO: 3639 - protein, 9 aa, Homo sapiens
  Light chain CDR3 for antibody 1820 (IGKV1-6)
LQDYNYPYT

SEQ ID NO: 3640 - protein, 18 aa, Homo sapiens
  Heavy chain CDR3 for antibody 1820 (IGHV3-23)
AKVGDFFASGNYWDYFDY

SEQ ID NO: 3641 - protein, 9 aa, Homo sapiens
  Light chain CDR3 for antibody 1821 (IGKV1-9)
QQLKSYLYT

SEQ ID NO: 3642 - protein, 12 aa, Homo sapiens
  Heavy chain CDR3 for antibody 1821 (IGHV1-18)
ARILFYGDYFDY

SEQ ID NO: 3643 - protein, 9 aa, Homo sapiens
  Light chain CDR3 for antibody 1822 (IGKV1D-16)
QQYNSYPYT

SEQ ID NO: 3644 - protein, 14 aa, Homo sapiens
  Heavy chain CDR3 for antibody 1822 (IGHV1-18)
AREGGSYFYYGVDV

SEQ ID NO: 3645 - protein, 9 aa, Homo sapiens
  Light chain CDR3 for antibody 1823 (IGKV3-20)
QQYGSSPYT

SEQ ID NO: 3646 - protein, 9 aa, Homo sapiens
  Heavy chain CDR3 for antibody 1823 (IGHV4-59)
ARGGASFDY

SEQ ID NO: 3647 - protein, 9 aa, Homo sapiens
  Light chain CDR3 for antibody 1824 (IGKV1-17)
LQHNSYPYT

SEQ ID NO: 3648 - protein, 12 aa, Homo sapiens
  Heavy chain CDR3 for antibody 1824 (IGHV3-23)
AKEGIVGVPFDY

SEQ ID NO: 3649 - protein, 9 aa, Homo sapiens
  Light chain CDR3 for antibody 1825 (IGKV6-21)
HQSSSLPYT

SEQ ID NO: 3650 - protein, 15 aa, Homo sapiens
  Heavy chain CDR3 for antibody 1825 (IGHV3-33)
ARGYYYGSGSFPVDY

SEQ ID NO: 3651 - protein, 9 aa, Homo sapiens
  Light chain CDR3 for antibody 1826 (IGKV1-27)
QKYNSAPYT

SEQ ID NO: 3652 - protein, 15 aa, Homo sapiens
  Heavy chain CDR3 for antibody 1826 (IGHV3-33)
ARDRGWKAPGYGMDV

SEQ ID NO: 3653 - protein, 9 aa, Homo sapiens
  Light chain CDR3 for antibody 1827 (IGKV6-21)
HQSSSLPYT

SEQ ID NO: 3654 - protein, 18 aa, Homo sapiens
  Heavy chain CDR3 for antibody 1827 (IGHV1-46)
ARDLTGRTENYYYYGMDV

SEQ ID NO: 3655 - protein, 8 aa, Homo sapiens
  Light chain CDR3 for antibody 1828 (IGKV1-5)
QQYNSYWT

SEQ ID NO: 3656 - protein, 15 aa, Homo sapiens
  Heavy chain CDR3 for antibody 1828 (IGHV3-30)
ARGAMVRGVDYGMDV

SEQ ID NO: 3657 - protein, 9 aa, Homo sapiens
  Light chain CDR3 for antibody 1829 (IGKV5-2)
LQHDNFPWT

SEQ ID NO: 3658 - protein, 18 aa, Homo sapiens
  Heavy chain CDR3 for antibody 1829 (IGHV1-18)
ARDRYYYDSGSYYYGMDV

SEQ ID NO: 3659 - protein, 8 aa, Homo sapiens
  Light chain CDR3 for antibody 1830 (IGKV3D-7)
QQDYNLPT

SEQ ID NO: 3660 - protein, 11 aa, Homo sapiens
  Heavy chain CDR3 for antibody 1830 (IGHV3-33)
ARDSAVGPKDY

SEQ ID NO: 3661 - protein, 9 aa, Homo sapiens
  Light chain CDR3 for antibody 1831 (IGKV3-20)
QQYGSSPYT

SEQ ID NO: 3662 - protein, 17 aa, Homo sapiens
  Heavy chain CDR3 for antibody 1831 (IGHV3-33)
ARGEQWLGYYYYYGMDV

SEQ ID NO: 3663 - protein, 9 aa, Homo sapiens
  Light chain CDR3 for antibody 1832 (IGKV1-17)
LQHNSYPYT

SEQ ID NO: 3664 - protein, 14 aa, Homo sapiens
  Heavy chain CDR3 for antibody 1832 (IGHV3-33)
ARKGYSGRYYYFDY

SEQ ID NO: 3665 - protein, 9 aa, Homo sapiens
  Light chain CDR3 for antibody 1833 (IGKV1-9)
QQLNSYPWT

SEQ ID NO: 3666 - protein, 14 aa, Homo sapiens
  Heavy chain CDR3 for antibody 1833 (IGHV3-33)
ARASSGSSYWYFDL

SEQ ID NO: 3667 - protein, 9 aa, Homo sapiens
  Light chain CDR3 for antibody 1834 (IGKV1-17)
LQHNSYPYT

SEQ ID NO: 3668 - protein, 16 aa, Homo sapiens
  Heavy chain CDR3 for antibody 1834 (IGHV3-33)
ARDQGILTGYYTALDY

SEQ ID NO: 3669 - protein, 9 aa, Homo sapiens
  Light chain CDR3 for antibody 1835 (IGKV3-15)
QQYNNWPRT

SEQ ID NO: 3670 - protein, 18 aa, Homo sapiens
  Heavy chain CDR3 for antibody 1835 (IGHV3-33)
AREGYYGSGSYYRGWFDP

SEQ ID NO: 3671 - protein, 9 aa, Homo sapiens
  Light chain CDR3 for antibody 1836 (IGKV1-9)
QQLNSYPLT

SEQ ID NO: 3672 - protein, 19 aa, Homo sapiens
  Heavy chain CDR3 for antibody 1836 (IGHV5-51)
ARHGEKGKRITMVRGSLDV

SEQ ID NO: 3673 - protein, 9 aa, Homo sapiens
  Light chain CDR3 for antibody 1837 (IGKV1-9)
QQLNSFPFT

SEQ ID NO: 3674 - protein, 10 aa, Homo sapiens
  Heavy chain CDR3 for antibody 1837 (IGHV3-33)
ARDPSGCFDY

SEQ ID NO: 3675 - protein, 9 aa, Homo sapiens
  Light chain CDR3 for antibody 1838 (IGKV3-15)
QQYNNWPLT

SEQ ID NO: 3676 - protein, 12 aa, Homo sapiens
  Heavy chain CDR3 for antibody 1838 (IGHV3-23)
AKDGYSYGYFDY

SEQ ID NO: 3677 - protein, 9 aa, Homo sapiens
  Light chain CDR3 for antibody 1839 (IGKV6-21)
HQSSSLPYT

SEQ ID NO: 3678 - protein, 18 aa, Homo sapiens
  Heavy chain CDR3 for antibody 1839 (IGHV3-33)
ARERDYYGSGSYPDAFDI

SEQ ID NO: 3679 - protein, 7 aa, Homo sapiens
  Light chain CDR3 for antibody 1840 (IGKV3-20)
QQYGSYT

SEQ ID NO: 3680 - protein, 10 aa, Homo sapiens
  Heavy chain CDR3 for antibody 1840 (IGHV3-21)
ARRWERYFDY

SEQ ID NO: 3681 - protein, 9 aa, Homo sapiens
  Light chain CDR3 for antibody 1841 (IGKV2-30)
MQGTHWPLT

SEQ ID NO: 3682 - protein, 12 aa, Homo sapiens
  Heavy chain CDR3 for antibody 1841 (IGHV3-33)
ARGYFGSGYAHF

SEQ ID NO: 3683 - protein, 9 aa, Homo sapiens
  Light chain CDR3 for antibody 1842 (IGKV6-21)
HQSSSLPYT

SEQ ID NO: 3684 - protein, 12 aa, Homo sapiens
  Heavy chain CDR3 for antibody 1842 (IGHV3-33)
ARKGYDMHEFDI

SEQ ID NO: 3685 - protein, 9 aa, Homo sapiens
  Light chain CDR3 for antibody 1843 (IGKV3D-7)
QQDYNLPLT

SEQ ID NO: 3686 - protein, 18 aa, Homo sapiens
  Heavy chain CDR3 for antibody 1843 (IGHV3-33)
ARREGIVGATTYYYGMDV

SEQ ID NO: 3687 - protein, 9 aa, Homo sapiens
  Light chain CDR3 for antibody 1844 (IGKV1-17)
LQHNSYPYT

SEQ ID NO: 3688 - protein, 14 aa, Homo sapiens
  Heavy chain CDR3 for antibody 1844 (IGHV3-33)
ARDNILTVYYLFDY

SEQ ID NO: 3689 - protein, 9 aa, Homo sapiens
  Light chain CDR3 for antibody 1845 (IGKV1-6)
LQDYNYPRT

SEQ ID NO: 3690 - protein, 11 aa, Homo sapiens
  Heavy chain CDR3 for antibody 1845 (IGHV4-59)
TRETLERGFDY

SEQ ID NO: 3691 - protein, 9 aa, Homo sapiens
  Light chain CDR3 for antibody 1846 (IGKV2D-28)
MQARQTPFT

SEQ ID NO: 3692 - protein, 15 aa, Homo sapiens
  Heavy chain CDR3 for antibody 1846 (IGHV3-15)
TTDLSSAPWYNCFDP

SEQ ID NO: 3693 - protein, 9 aa, Homo sapiens
  Light chain CDR3 for antibody 1847 (IGKV1-17)
LQHNSYPWT

SEQ ID NO: 3694 - protein, 14 aa, Homo sapiens
  Heavy chain CDR3 for antibody 1847 (IGHV3-33)
ARDREQQLVRYFDY

SEQ ID NO: 3695 - protein, 9 aa, Homo sapiens
  Light chain CDR3 for antibody 1848 (IGKV1-39)
QQSYSTPLT

SEQ ID NO: 3696 - protein, 17 aa, Homo sapiens
  Heavy chain CDR3 for antibody 1848 (IGHV3-33)
ARESLKLGIYYYYGMDV

SEQ ID NO: 3697 - protein, 9 aa, Homo sapiens
  Light chain CDR3 for antibody 1849 (IGKV5-2)
LQHDNFPYT

SEQ ID NO: 3698 - protein, 19 aa, Homo sapiens
  Heavy chain CDR3 for antibody 1849 (IGHV3-33)
ARGPYYDILTGYGYYGMDV

SEQ ID NO: 3699 - protein, 9 aa, Homo sapiens
  Light chain CDR3 for antibody 1850 (IGKV5-2)
LQHDNFPWT

SEQ ID NO: 3700 - protein, 19 aa, Homo sapiens
  Heavy chain CDR3 for antibody 1850 (IGHV4-39)
ARQGDVLRYFDWLLGAFDI

SEQ ID NO: 3701 - protein, 9 aa, Homo sapiens
  Light chain CDR3 for antibody 1851 (IGKV1D-13)
QQFNNYPYT

SEQ ID NO: 3702 - protein, 14 aa, Homo sapiens
  Heavy chain CDR3 for antibody 1851 (IGHV3-33)
VRDAMGATTAWFDP

SEQ ID NO: 3703 - protein, 9 aa, Homo sapiens
  Light chain CDR3 for antibody 1852 (IGKV1-6)
LQDYNYPYT

SEQ ID NO: 3704 - protein, 13 aa, Homo sapiens
  Heavy chain CDR3 for antibody 1852 (IGHV3-33)
ARALYSSSWPGDY

SEQ ID NO: 3705 - protein, 9 aa, Homo sapiens
  Light chain CDR3 for antibody 1853 (IGKV1-9)
QQLNNYPWT

SEQ ID NO: 3706 - protein, 20 aa, Homo sapiens
  Heavy chain CDR3 for antibody 1853 (IGHV3-33)
ARTMGSGSYYKAYYYYVMDV

SEQ ID NO: 3707 - protein, 9 aa, Homo sapiens
  Light chain CDR3 for antibody 1854 (IGKV3-11)
QQRSNWPWT

SEQ ID NO: 3708 - protein, 11 aa, Homo sapiens
  Heavy chain CDR3 for antibody 1854 (IGHV4-59)
AREMGHDTFDI

SEQ ID NO: 3709 - protein, 9 aa, Homo sapiens
  Light chain CDR3 for antibody 1855 (IGKV1D-16)
QQYNSYPLT

SEQ ID NO: 3710 - protein, 12 aa, Homo sapiens
  Heavy chain CDR3 for antibody 1855 (IGHV3-33)
AKDPGWQQLAEY

SEQ ID NO: 3711 - protein, 9 aa, Homo sapiens
  Light chain CDR3 for antibody 1856 (IGKV1-39)
QQSYSTPLT

SEQ ID NO: 3712 - protein, 13 aa, Homo sapiens
  Heavy chain CDR3 for antibody 1856 (IGHV3-53)
ARSGSYWGYYFDY

SEQ ID NO: 3713 - protein, 8 aa, Homo sapiens
  Light chain CDR3 for antibody 1857 (IGKV1-5)
QQYNSYYT

SEQ ID NO: 3714 - protein, 18 aa, Homo sapiens
  Heavy chain CDR3 for antibody 1857 (IGHV4-59)
AREGDYVWGSYRPNWFDP

SEQ ID NO: 3715 - protein, 9 aa, Homo sapiens
  Light chain CDR3 for antibody 1858 (IGKV3D-7)
QQDYNLPLT

SEQ ID NO: 3716 - protein, 13 aa, Homo sapiens
  Heavy chain CDR3 for antibody 1858 (IGHV4-39)
ARQWPSGYWYFDL

SEQ ID NO: 3717 - protein, 9 aa, Homo sapiens
  Light chain CDR3 for antibody 1859 (IGKV3D-20)
QQYGSSPYT

SEQ ID NO: 3718 - protein, 20 aa, Homo sapiens
  Heavy chain CDR3 for antibody 1859 (IGHV3-33)
SRGGATLVRGVIDYYYGMDV

SEQ ID NO: 3719 - protein, 9 aa, Homo sapiens
  Light chain CDR3 for antibody 1860 (IGKV1-33)
QQYDNLPFT

SEQ ID NO: 3720 - protein, 11 aa, Homo sapiens
  Heavy chain CDR3 for antibody 1860 (IGHV3-33)
ARDRSSGPFDY

SEQ ID NO: 3721 - protein, 9 aa, Homo sapiens
  Light chain CDR3 for antibody 1861 (IGKV1-39)
QQSYSTPLT

SEQ ID NO: 3722 - protein, 10 aa, Homo sapiens
  Heavy chain CDR3 for antibody 1861 (IGHV3-33)
ARDVVVYFDY

SEQ ID NO: 3723 - protein, 9 aa, Homo sapiens
  Light chain CDR3 for antibody 1862 (IGKV1-9)
QQLNSYPLT

SEQ ID NO: 3724 - protein, 18 aa, Homo sapiens
  Heavy chain CDR3 for antibody 1862 (IGHV3-13)
ARDYYGSGSLYYYYGMDV

SEQ ID NO: 3725 - protein, 9 aa, Homo sapiens
  Light chain CDR3 for antibody 1863 (IGKV1-39)
QQSYSTPLT

SEQ ID NO: 3726 - protein, 14 aa, Homo sapiens
  Heavy chain CDR3 for antibody 1863 (IGHV3-33)
ARAGSGYDRDWFDP

SEQ ID NO: 3727 - protein, 9 aa, Homo sapiens
  Light chain CDR3 for antibody 1864 (IGKV1-17)
LQHNSYPYT

SEQ ID NO: 3728 - protein, 15 aa, Homo sapiens
  Heavy chain CDR3 for antibody 1864 (IGHV3-74)
SRGSGSHYFYYGMDV

SEQ ID NO: 3729 - protein, 9 aa, Homo sapiens
  Light chain CDR3 for antibody 1865 (IGKV3D-7)
QQDYEFPLT

SEQ ID NO: 3730 - protein, 13 aa, Homo sapiens
  Heavy chain CDR3 for antibody 1865 (IGHV4-39)
ARREVVGGRGFDY

SEQ ID NO: 3731 - protein, 10 aa, Homo sapiens
  Light chain CDR3 for antibody 1866 (IGKV1-33)
QQYDTLPPWT

SEQ ID NO: 3732 - protein, 15 aa, Homo sapiens
  Heavy chain CDR3 for antibody 1866 (IGHV3-33)
TKDEYPGNQIEAFDI

SEQ ID NO: 3733 - protein, 9 aa, Homo sapiens
  Light chain CDR3 for antibody 1867 (IGKV3D-7)
QQDYNLPWT

SEQ ID NO: 3734 - protein, 21 aa, Homo sapiens
  Heavy chain CDR3 for antibody 1867 (IGHV3-23)
AKDHQWEPQLEIGYYYYGMDV

SEQ ID NO: 3735 - protein, 9 aa, Homo sapiens
  Light chain CDR3 for antibody 1868 (IGKV5-2)
LQHDNFPYT

SEQ ID NO: 3736 - protein, 13 aa, Homo sapiens
  Heavy chain CDR3 for antibody 1868 (IGHV3-23)
AKDRGYSSTSTAY

SEQ ID NO: 3737 - protein, 9 aa, Homo sapiens
  Light chain CDR3 for antibody 1869 (IGKV1-6)
LQDYNYPYT

SEQ ID NO: 3738 - protein, 17 aa, Homo sapiens
  Heavy chain CDR3 for antibody 1869 (IGHV3-30)
ARESLWFGEANHFVMDV

SEQ ID NO: 3739 - protein, 9 aa, Homo sapiens
  Light chain CDR3 for antibody 1870 (IGKV3D-7)
QQDYNLPYT

SEQ ID NO: 3740 - protein, 17 aa, Homo sapiens
  Heavy chain CDR3 for antibody 1870 (IGHV3-33)
AREKGLGIDYYYYGMDV

SEQ ID NO: 3741 - protein, 9 aa, Homo sapiens
  Light chain CDR3 for antibody 1871 (IGKV6-21)
HQSSSLPYT

SEQ ID NO: 3742 - protein, 15 aa, Homo sapiens
  Heavy chain CDR3 for antibody 1871 (IGHV3-23)
AKEFTMVRGVITPDY

SEQ ID NO: 3743 - protein, 9 aa, Homo sapiens
  Light chain CDR3 for antibody 1872 (IGKV1-6)
LQDYNYPWT

SEQ ID NO: 3744 - protein, 16 aa, Homo sapiens
  Heavy chain CDR3 for antibody 1872 (IGHV3-33)
ARESLKLGIYYYGMDV

SEQ ID NO: 3745 - protein, 9 aa, Homo sapiens
  Light chain CDR3 for antibody 1873 (IGKV1-17)
LQHNSYPYT

SEQ ID NO: 3746 - protein, 14 aa, Homo sapiens
  Heavy chain CDR3 for antibody 1873 (IGHV3-20)
ARDEGSGGYDVFDI

SEQ ID NO: 3747 - protein, 9 aa, Homo sapiens
  Light chain CDR3 for antibody 1874 (IGKV1-6)
LQDYNYPYT

SEQ ID NO: 3748 - protein, 14 aa, Homo sapiens
  Heavy chain CDR3 for antibody 1874 (IGHV1-46)
ARSYYDILTGAFDI

SEQ ID NO: 3749 - protein, 9 aa, Homo sapiens
  Light chain CDR3 for antibody 1875 (IGKV5-2)
LQHDNFPYT

SEQ ID NO: 3750 - protein, 20 aa, Homo sapiens
  Heavy chain CDR3 for antibody 1875 (IGHV3-33)
ARDNDSSGYYDYYYYYGMDV

SEQ ID NO: 3751 - protein, 9 aa, Homo sapiens
  Light chain CDR3 for antibody 1876 (IGKV5-2)
LQHDNFPYT

SEQ ID NO: 3752 - protein, 15 aa, Homo sapiens
  Heavy chain CDR3 for antibody 1876 (IGHV3-33)
ARGYYYGSGSFPVDY

SEQ ID NO: 3753 - protein, 9 aa, Homo sapiens
  Light chain CDR3 for antibody 1877 (IGKV1-39)
QQSYSTPST

SEQ ID NO: 3754 - protein, 16 aa, Homo sapiens
  Heavy chain CDR3 for antibody 1877 (IGHV3-48)
ARWFSRSSTGVSYMDV

SEQ ID NO: 3755 - protein, 9 aa, Homo sapiens
  Light chain CDR3 for antibody 1878 (IGKV1D-16)
QQYNSYPYT

SEQ ID NO: 3756 - protein, 21 aa, Homo sapiens
  Heavy chain CDR3 for antibody 1878 (IGHV1-18)
ASGVLIWFGELLSEDYYDMDV

SEQ ID NO: 3757 - protein, 9 aa, Homo sapiens
  Light chain CDR3 for antibody 1879 (IGKV1-9)
QQGNTYSRT

SEQ ID NO: 3758 - protein, 13 aa, Homo sapiens
  Heavy chain CDR3 for antibody 1879 (IGHV4-59)
ARDAGYSSSWFDY

SEQ ID NO: 3759 - protein, 9 aa, Homo sapiens
  Light chain CDR3 for antibody 1880 (IGKV3-20)
QQYGSSPYT

SEQ ID NO: 3760 - protein, 13 aa, Homo sapiens
  Heavy chain CDR3 for antibody 1880 (IGHV3-30)
AAPFMVRGDGMDV

SEQ ID NO: 3761 - protein, 9 aa, Homo sapiens
  Light chain CDR3 for antibody 1881 (IGKV5-2)
LQHDNFPYT

SEQ ID NO: 3762 - protein, 9 aa, Homo sapiens
  Heavy chain CDR3 for antibody 1881 (IGHV3-33)
AREYKEFDY

SEQ ID NO: 3763 - protein, 10 aa, Homo sapiens
  Light chain CDR3 for antibody 1882 (IGKV3-11)
QQRSNWPIFT

SEQ ID NO: 3764 - protein, 14 aa, Homo sapiens
  Heavy chain CDR3 for antibody 1882 (IGHV3-33)
ARGAAAGNFYGLDV

SEQ ID NO: 3765 - protein, 9 aa, Homo sapiens
  Light chain CDR3 for antibody 1883 (IGKV5-2)
LQHDNFPYT

SEQ ID NO: 3766 - protein, 13 aa, Homo sapiens
  Heavy chain CDR3 for antibody 1883 (IGHV3-30)
AAPFMVRGDGMDV

SEQ ID NO: 3767 - protein, 9 aa, Homo sapiens
  Light chain CDR3 for antibody 1884 (IGKV1-6)
LQDYNYPYT

SEQ ID NO: 3768 - protein, 16 aa, Homo sapiens
  Heavy chain CDR3 for antibody 1884 (IGHV3-33)
ARDQGILTGYYTALDY

SEQ ID NO: 3769 - protein, 11 aa, Homo sapiens
  Light chain CDR3 for antibody 1885 (IGKV3-11)
QQRSNWPPTWT

SEQ ID NO: 3770 - protein, 11 aa, Homo sapiens
  Heavy chain CDR3 for antibody 1885 (IGHV4-59)
AREMGHDTFDI

SEQ ID NO: 3771 - protein, 9 aa, Homo sapiens
  Light chain CDR3 for antibody 1886 (IGKV1-17)
LQHNSYPYT

SEQ ID NO: 3772 - protein, 12 aa, Homo sapiens
  Heavy chain CDR3 for antibody 1886 (IGHV3-23)
AKDRSYYYGMDV

SEQ ID NO: 3773 - protein, 9 aa, Homo sapiens
  Light chain CDR3 for antibody 1887 (IGKV5-2)
LQHDNFPWT

SEQ ID NO: 3774 - protein, 11 aa, Homo sapiens
  Heavy chain CDR3 for antibody 1887 (IGHV4-59)
TRDRGLGSFDY

SEQ ID NO: 3775 - protein, 9 aa, Homo sapiens
  Light chain CDR3 for antibody 1888 (IGKV1-39)
QQSYSTPFT

SEQ ID NO: 3776 - protein, 16 aa, Homo sapiens
  Heavy chain CDR3 for antibody 1888 (IGHV4-59)
ARYSGSYYGDYYGMDV

SEQ ID NO: 3777 - protein, 9 aa, Homo sapiens
  Light chain CDR3 for antibody 1889 (IGKV1-17)
LQHNSYPYT

SEQ ID NO: 3778 - protein, 8 aa, Homo sapiens
  Heavy chain CDR3 for antibody 1889 (IGHV3-20)
APHWIFDY

SEQ ID NO: 3779 - protein, 9 aa, Homo sapiens
  Light chain CDR3 for antibody 1890 (IGKV1D-13)
QQFNNYPYT

SEQ ID NO: 3780 - protein, 11 aa, Homo sapiens
  Heavy chain CDR3 for antibody 1890 (IGHV4-59)
ARSIRYSVFDY

SEQ ID NO: 3781 - protein, 9 aa, Homo sapiens
  Light chain CDR3 for antibody 1891 (IGKV1-9)
QQLNGYPFT

SEQ ID NO: 3782 - protein, 18 aa, Homo sapiens
  Heavy chain CDR3 for antibody 1891 (IGHV4-59)
AREGDYVWGSYRPNWFDP

SEQ ID NO: 3783 - protein, 9 aa, Homo sapiens
  Light chain CDR3 for antibody 1892 (IGKV1-39)
QQSYSTPLT

SEQ ID NO: 3784 - protein, 15 aa, Homo sapiens
  Heavy chain CDR3 for antibody 1892 (IGHV3-33)
ARRVCSGGSCSLFDY

SEQ ID NO: 3785 - protein, 9 aa, Homo sapiens
  Light chain CDR3 for antibody 1893 (IGKV5-2)
LQHDNFPYT

SEQ ID NO: 3786 - protein, 18 aa, Homo sapiens
  Heavy chain CDR3 for antibody 1893 (IGHV3-33)
ARREGITLIFYYYYGMDV

SEQ ID NO: 3787 - protein, 8 aa, Homo sapiens
  Light chain CDR3 for antibody 1894 (IGKV1D-13)
QQFNNYPT

SEQ ID NO: 3788 - protein, 13 aa, Homo sapiens
  Heavy chain CDR3 for antibody 1894 (IGHV3-33)
ARDYCGGDCYLDY

SEQ ID NO: 3789 - protein, 10 aa, Homo sapiens
  Light chain CDR3 for antibody 1895 (IGKV3-11)
QQRSNWPIFT

SEQ ID NO: 3790 - protein, 12 aa, Homo sapiens
  Heavy chain CDR3 for antibody 1895 (IGHV3-13)
AREAGIPDAFDI

SEQ ID NO: 3791 - protein, 9 aa, Homo sapiens
  Light chain CDR3 for antibody 1896 (IGKV6-21)
HQSSSLPYT

SEQ ID NO: 3792 - protein, 11 aa, Homo sapiens
  Heavy chain CDR3 for antibody 1896 (IGHV3-23)
ARDPGSITGDY

SEQ ID NO: 3793 - protein, 9 aa, Homo sapiens
  Light chain CDR3 for antibody 1897 (IGKV5-2)
LQHDNFPYT

SEQ ID NO: 3794 - protein, 16 aa, Homo sapiens
  Heavy chain CDR3 for antibody 1897 (IGHV3-23)
ARNWNDVGDYYYGMDV

SEQ ID NO: 3795 - protein, 9 aa, Homo sapiens
  Light chain CDR3 for antibody 1898 (IGKV3D-20)
QQYGSSPYT

SEQ ID NO: 3796 - protein, 12 aa, Homo sapiens
  Heavy chain CDR3 for antibody 1898 (IGHV3-33)
ARKGYDMHEFDI

SEQ ID NO: 3797 - protein, 9 aa, Homo sapiens
  Light chain CDR3 for antibody 1899 (IGKV1D-16)
QQYNSYPLT

SEQ ID NO: 3798 - protein, 12 aa, Homo sapiens
  Heavy chain CDR3 for antibody 1899 (IGHV3-33)
ARGYFTSGSAHY

SEQ ID NO: 3799 - protein, 9 aa, Homo sapiens
  Light chain CDR3 for antibody 1900 (IGKV1-17)
LQHNSYPYT

SEQ ID NO: 3800 - protein, 19 aa, Homo sapiens
  Heavy chain CDR3 for antibody 1900 (IGHV5-51)
ARHGEKGKRITMVRGSLDV

SEQ ID NO: 3801 - protein, 9 aa, Homo sapiens
  Light chain CDR3 for antibody 1901 (IGKV1-6)
LQDYNYPYT

SEQ ID NO: 3802 - protein, 20 aa, Homo sapiens
  Heavy chain CDR3 for antibody 1901 (IGHV1-f)
ATHYDILTGSPYYYYCALDV

SEQ ID NO: 3803 - protein, 9 aa, Homo sapiens
  Light chain CDR3 for antibody 1902 (IGKV5-2)
LQHDNFPYT

SEQ ID NO: 3804 - protein, 11 aa, Homo sapiens
  Heavy chain CDR3 for antibody 1902 (IGHV3-23)
ARDPGSITGDY

SEQ ID NO: 3805 - protein, 9 aa, Homo sapiens
  Light chain CDR3 for antibody 1903 (IGKV5-2)
LQHDNFPWT

SEQ ID NO: 3806 - protein, 11 aa, Homo sapiens
  Heavy chain CDR3 for antibody 1903 (IGHV4-59)
ARDRGHYGMDV

SEQ ID NO: 3807 - protein, 9 aa, Homo sapiens
  Light chain CDR3 for antibody 1904 (IGKV6-21)
HQSSSLPYT

SEQ ID NO: 3808 - protein, 13 aa, Homo sapiens
  Heavy chain CDR3 for antibody 1904 (IGHV3-23)
AKDRGYSSTSTAY

SEQ ID NO: 3809 - protein, 9 aa, Homo sapiens
  Light chain CDR3 for antibody 1905 (IGKV6-21)
HQSSSLPYT

SEQ ID NO: 3810 - protein, 17 aa, Homo sapiens
  Heavy chain CDR3 for antibody 1905 (IGHV3-66)
ARVQYDILTGYSPYFDN

SEQ ID NO: 3811 - protein, 9 aa, Homo sapiens
  Light chain CDR3 for antibody 1906 (IGKV2-30)
MQGTHWPPT

SEQ ID NO: 3812 - protein, 15 aa, Homo sapiens
  Heavy chain CDR3 for antibody 1906 (IGHV3-33)
ARDGALYGSGSSLAY

SEQ ID NO: 3813 - protein, 9 aa, Homo sapiens
  Light chain CDR3 for antibody 1907 (IGKV3D-7)
RQDYNLPWT

SEQ ID NO: 3814 - protein, 6 aa, Homo sapiens
  Heavy chain CDR3 for antibody 1907 (IGHV4-59)
ARDGDY

SEQ ID NO: 3815 - protein, 9 aa, Homo sapiens
  Light chain CDR3 for antibody 1908 (IGKV2D-28)
MQALQTPPT

SEQ ID NO: 3816 - protein, 16 aa, Homo sapiens
  Heavy chain CDR3 for antibody 1908 (IGHV3-23)
AKEGMVLRYFDWLWDY

SEQ ID NO: 3817 - protein, 9 aa, Homo sapiens
  Light chain CDR3 for antibody 1909 (IGKV1-16)
QQYNSYPYT

SEQ ID NO: 3818 - protein, 12 aa, Homo sapiens
  Heavy chain CDR3 for antibody 1909 (IGHV4-39)
ARDSGSYYFFDY

SEQ ID NO: 3819 - protein, 9 aa, Homo sapiens
  Light chain CDR3 for antibody 1910 (IGKV1D-16)
QQYNSYPYT

SEQ ID NO: 3820 - protein, 19 aa, Homo sapiens
  Heavy chain CDR3 for antibody 1910 (IGHV1-18)
ARDTTLVRGLMNYYYGMDV

SEQ ID NO: 3821 - protein, 9 aa, Homo sapiens
  Light chain CDR3 for antibody 1911 (IGKV1D-16)
QQYNSYPLT

SEQ ID NO: 3822 - protein, 14 aa, Homo sapiens
  Heavy chain CDR3 for antibody 1911 (IGHV3-23)
AKDRYRGYEGLFDY

SEQ ID NO: 3823 - protein, 9 aa, Homo sapiens
  Light chain CDR3 for antibody 1912 (IGKV5-2)
LQHDNFPYT

SEQ ID NO: 3824 - protein, 13 aa, Homo sapiens
  Heavy chain CDR3 for antibody 1912 (IGHV3-21)
ARDSTLVRGVFPY

SEQ ID NO: 3825 - protein, 9 aa, Homo sapiens
  Light chain CDR3 for antibody 1913 (IGKV3-15)
QQYNNWPYT

SEQ ID NO: 3826 - protein, 13 aa, Homo sapiens
  Heavy chain CDR3 for antibody 1913 (IGHV4-39)
ARRFDILTGAFDY

SEQ ID NO: 3827 - protein, 9 aa, Homo sapiens
  Light chain CDR3 for antibody 1914 (IGKV1-9)
QQYNSYPLT

SEQ ID NO: 3828 - protein, 17 aa, Homo sapiens
  Heavy chain CDR3 for antibody 1914 (IGHV4-59)
ARDRELLWFGEFGGMDV

SEQ ID NO: 3829 - protein, 9 aa, Homo sapiens
  Light chain CDR3 for antibody 1915 (IGKV3D-20)
QQYGSSPYT

SEQ ID NO: 3830 - protein, 15 aa, Homo sapiens
  Heavy chain CDR3 for antibody 1915 (IGHV3-66)
ARDRDYYYYYYGMDV

SEQ ID NO: 3831 - protein, 8 aa, Homo sapiens
  Light chain CDR3 for antibody 1916 (IGKV1D-13)
QQFNNYPT

SEQ ID NO: 3832 - protein, 15 aa, Homo sapiens
  Heavy chain CDR3 for antibody 1916 (IGHV3-30)
ARGAMVRGVDYGMDV

SEQ ID NO: 3833 - protein, 9 aa, Homo sapiens
  Light chain CDR3 for antibody 1917 (IGKV6-21)
HQSSSLPYT

SEQ ID NO: 3834 - protein, 19 aa, Homo sapiens
  Heavy chain CDR3 for antibody 1917 (IGHV1-18)
ARDDILTGYSLYYYYGMDV

SEQ ID NO: 3835 - protein, 9 aa, Homo sapiens
  Light chain CDR3 for antibody 1918 (IGKV6-21)
HQSSSLPLT

SEQ ID NO: 3836 - protein, 23 aa, Homo sapiens
  Heavy chain CDR3 for antibody 1918 (IGHV3-30)
ARDGDYFGSGSQRDYHYYYGLDV

SEQ ID NO: 3837 - protein, 9 aa, Homo sapiens
  Light chain CDR3 for antibody 1919 (IGKV1-6)
LQDYNYPRT

SEQ ID NO: 3838 - protein, 16 aa, Homo sapiens
  Heavy chain CDR3 for antibody 1919 (IGHV1-24)
ATEDSSSYYYYYGMDV

SEQ ID NO: 3839 - protein, 9 aa, Homo sapiens
  Light chain CDR3 for antibody 1920 (IGKV1-6)
LQDYNYPYT

SEQ ID NO: 3840 - protein, 23 aa, Homo sapiens
  Heavy chain CDR3 for antibody 1920 (IGHV1-18)
ARNLHYDILTGYFPYYFYYGMDV

SEQ ID NO: 3841 - protein, 9 aa, Homo sapiens
  Light chain CDR3 for antibody 1921 (IGKV1-6)
LQDYNYPWT

SEQ ID NO: 3842 - protein, 11 aa, Homo sapiens
  Heavy chain CDR3 for antibody 1921 (IGHV1-24)
ATGSPLLWFGD

SEQ ID NO: 3843 - protein, 9 aa, Homo sapiens
  Light chain CDR3 for antibody 1922 (IGKV6-21)
HQSSSLPYT

SEQ ID NO: 3844 - protein, 13 aa, Homo sapiens
  Heavy chain CDR3 for antibody 1922 (IGHV3-33)
AREYCSGGSCYDY

SEQ ID NO: 3845 - protein, 9 aa, Homo sapiens
  Light chain CDR3 for antibody 1923 (IGKV1-17)
LQHNSYPYT

SEQ ID NO: 3846 - protein, 17 aa, Homo sapiens
  Heavy chain CDR3 for antibody 1923 (IGHV3-23)
AKDYDILTGYSHNWFDP

SEQ ID NO: 3847 - protein, 9 aa, Homo sapiens
  Light chain CDR3 for antibody 1924 (IGKV1-9)
QQLNSYPLT

SEQ ID NO: 3848 - protein, 14 aa, Homo sapiens
  Heavy chain CDR3 for antibody 1924 (IGHV3-33)
ARDKSYPLSYGMDV

SEQ ID NO: 3849 - protein, 9 aa, Homo sapiens
  Light chain CDR3 for antibody 1925 (IGKV1-27)
QKYNSAPYT

SEQ ID NO: 3850 - protein, 18 aa, Homo sapiens
  Heavy chain CDR3 for antibody 1925 (IGHV1-46)
ARDGDYVWGSYRSNWFDP

SEQ ID NO: 3851 - protein, 9 aa, Homo sapiens
  Light chain CDR3 for antibody 1926 (IGKV1D-13)
QQFNNYPRT

SEQ ID NO: 3852 - protein, 12 aa, Homo sapiens
  Heavy chain CDR3 for antibody 1926 (IGHV3-64)
AREFPWGDYFDY

SEQ ID NO: 3853 - protein, 9 aa, Homo sapiens
  Light chain CDR3 for antibody 1927 (IGKV1D-16)
QQYNSYPLT

SEQ ID NO: 3854 - protein, 18 aa, Homo sapiens
  Heavy chain CDR3 for antibody 1927 (IGHV3-33)
AREGYDILTGYYNVKFDY

SEQ ID NO: 3855 - protein, 9 aa, Homo sapiens
  Light chain CDR3 for antibody 1928 (IGKV1-6)
LQDYNYPYT

SEQ ID NO: 3856 - protein, 17 aa, Homo sapiens
  Heavy chain CDR3 for antibody 1928 (IGHV4-59)
ARDRELLWFGEFGGMDV

SEQ ID NO: 3857 - protein, 9 aa, Homo sapiens
  Light chain CDR3 for antibody 1929 (IGKV3-20)
QQYGSSPYT

SEQ ID NO: 3858 - protein, 14 aa, Homo sapiens
  Heavy chain CDR3 for antibody 1929 (IGHV3-33)
VRDQGSMVRGGGDY

SEQ ID NO: 3859 - protein, 9 aa, Homo sapiens
  Light chain CDR3 for antibody 1930 (IGKV1-9)
QQYNSYPLT

SEQ ID NO: 3860 - protein, 17 aa, Homo sapiens
  Heavy chain CDR3 for antibody 1930 (IGHV4-59)
AREGADSGIYYHWYFDL

SEQ ID NO: 3861 - protein, 9 aa, Homo sapiens
  Light chain CDR3 for antibody 1931 (IGKV5-2)
LQHDNFPWT

SEQ ID NO: 3862 - protein, 18 aa, Homo sapiens
  Heavy chain CDR3 for antibody 1931 (IGHV3-33)
ARGGYSSGWDYYYYGMDV

SEQ ID NO: 3863 - protein, 9 aa, Homo sapiens
  Light chain CDR3 for antibody 1932 (IGKV3D-7)
QQDYNLPLT

SEQ ID NO: 3864 - protein, 18 aa, Homo sapiens
  Heavy chain CDR3 for antibody 1932 (IGHV4-59)
ARVTIVRGVTIGRGWFDP

SEQ ID NO: 3865 - protein, 9 aa, Homo sapiens
  Light chain CDR3 for antibody 1933 (IGKV3-20)
QQYGSSPYT

SEQ ID NO: 3866 - protein, 13 aa, Homo sapiens
  Heavy chain CDR3 for antibody 1933 (IGHV3-33)
ARDSSSWYHWFDP

SEQ ID NO: 3867 - protein, 9 aa, Homo sapiens
  Light chain CDR3 for antibody 1934 (IGKV1-6)
LQDYNYPYT

SEQ ID NO: 3868 - protein, 17 aa, Homo sapiens
  Heavy chain CDR3 for antibody 1934 (IGHV3-23)
AKDRPVTTLYYYFGMDV

SEQ ID NO: 3869 - protein, 9 aa, Homo sapiens
  Light chain CDR3 for antibody 1935 (IGKV3D-20)
QQYGSSPYT

SEQ ID NO: 3870 - protein, 10 aa, Homo sapiens
  Heavy chain CDR3 for antibody 1935 (IGHV3-33)
ARNILTPLDY

SEQ ID NO: 3871 - protein, 9 aa, Homo sapiens
  Light chain CDR3 for antibody 1936 (IGKV1-27)
QKYNSAPYT

SEQ ID NO: 3872 - protein, 13 aa, Homo sapiens
  Heavy chain CDR3 for antibody 1936 (IGHV3-33)
ASTGDSYYYGMDV

SEQ ID NO: 3873 - protein, 9 aa, Homo sapiens
  Light chain CDR3 for antibody 1937 (IGKV5-2)
LQHDNFPYT

SEQ ID NO: 3874 - protein, 10 aa, Homo sapiens
  Heavy chain CDR3 for antibody 1937 (IGHV3-74)
ARENWGGFDY

SEQ ID NO: 3875 - protein, 9 aa, Homo sapiens
  Light chain CDR3 for antibody 1938 (IGKV1-39)
QQGFSTPWT

SEQ ID NO: 3876 - protein, 18 aa, Homo sapiens
  Heavy chain CDR3 for antibody 1938 (IGHV4-39)
ARQYYFGSGNYYRGWFDP

SEQ ID NO: 3877 - protein, 9 aa, Homo sapiens
  Light chain CDR3 for antibody 1939 (IGKV1D-17)
LQHISYPYT

SEQ ID NO: 3878 - protein, 15 aa, Homo sapiens
  Heavy chain CDR3 for antibody 1939 (IGHV3-33)
ARDSGGGAGTLPFDY

SEQ ID NO: 3879 - protein, 9 aa, Homo sapiens
  Light chain CDR3 for antibody 1940 (IGKV1-39)
QQSYSTPLT

SEQ ID NO: 3880 - protein, 20 aa, Homo sapiens
  Heavy chain CDR3 for antibody 1940 (IGHV1-f)
ATGLITFVRGVILTYRSFDY

SEQ ID NO: 3881 - protein, 9 aa, Homo sapiens
  Light chain CDR3 for antibody 1941 (IGKV1-6)
LQDYNYPLT

SEQ ID NO: 3882 - protein, 10 aa, Homo sapiens
  Heavy chain CDR3 for antibody 1941 (IGHV3-23)
AKARNGGLDY

SEQ ID NO: 3883 - protein, 9 aa, Homo sapiens
  Light chain CDR3 for antibody 1942 (IGKV1D-13)
QQFNNYPHT

SEQ ID NO: 3884 - protein, 7 aa, Homo sapiens
  Heavy chain CDR3 for antibody 1942 (IGHV1-46)
AREGGDY

SEQ ID NO: 3885 - protein, 9 aa, Homo sapiens
  Light chain CDR3 for antibody 1943 (IGKV1D-16)
QQYNSYPYT

SEQ ID NO: 3886 - protein, 17 aa, Homo sapiens
  Heavy chain CDR3 for antibody 1943 (IGHV3-23)
AKEGSSSSWYGGLYFDY

SEQ ID NO: 3887 - protein, 9 aa, Homo sapiens
  Light chain CDR3 for antibody 1944 (IGKV6-21)
HQSSSLPYT

SEQ ID NO: 3888 - protein, 13 aa, Homo sapiens
  Heavy chain CDR3 for antibody 1944 (IGHV4-28)
ARKGATGYYGMDV

SEQ ID NO: 3889 - protein, 9 aa, Homo sapiens
  Light chain CDR3 for antibody 1945 (IGKV3-20)
QQYGSSPYT

SEQ ID NO: 3890 - protein, 14 aa, Homo sapiens
  Heavy chain CDR3 for antibody 1945 (IGHV4-39)
ARQGGSGSYYNLDY

SEQ ID NO: 3891 - protein, 9 aa, Homo sapiens
  Light chain CDR3 for antibody 1946 (IGKV1D-16)
QQYNSYPYT

SEQ ID NO: 3892 - protein, 16 aa, Homo sapiens
  Heavy chain CDR3 for antibody 1946 (IGHV3-23)
AKDLRYFDWSLYAFDI

SEQ ID NO: 3893 - protein, 9 aa, Homo sapiens
  Light chain CDR3 for antibody 1947 (IGKV5-2)
LQHDNFPYT

SEQ ID NO: 3894 - protein, 17 aa, Homo sapiens
  Heavy chain CDR3 for antibody 1947 (IGHV3-33)
ARDLIGPLSSSWYPFDY

SEQ ID NO: 3895 - protein, 9 aa, Homo sapiens
  Light chain CDR3 for antibody 1948 (IGKV1-39)
QQSYSTPLT

SEQ ID NO: 3896 - protein, 11 aa, Homo sapiens
  Heavy chain CDR3 for antibody 1948 (IGHV3-13)
AREAIIGPFDY

SEQ ID NO: 3897 - protein, 9 aa, Homo sapiens
  Light chain CDR3 for antibody 1949 (IGKV1-9)
QQLNSYPWT

SEQ ID NO: 3898 - protein, 19 aa, Homo sapiens
  Heavy chain CDR3 for antibody 1949 (IGHV3-20)
ARGGSGSYYNGYYYYGMDV

SEQ ID NO: 3899 - protein, 9 aa, Homo sapiens
  Light chain CDR3 for antibody 1950 (IGKV1-9)
QQYNSYPLT

SEQ ID NO: 3900 - protein, 14 aa, Homo sapiens
  Heavy chain CDR3 for antibody 1950 (IGHV3-23)
AKEDTAMASYYFDY

SEQ ID NO: 3901 - protein, 9 aa, Homo sapiens
  Light chain CDR3 for antibody 1951 (IGKV3-20)
QQYGSSPYT

SEQ ID NO: 3902 - protein, 14 aa, Homo sapiens
  Heavy chain CDR3 for antibody 1951 (IGHV3-33)
VRDAMGATTAWFDP

SEQ ID NO: 3903 - protein, 9 aa, Homo sapiens
  Light chain CDR3 for antibody 1952 (IGKV5-2)
LQHDNFPYT

SEQ ID NO: 3904 - protein, 15 aa, Homo sapiens
  Heavy chain CDR3 for antibody 1952 (IGHV3-23)
AKEFTMVRGVITPDY

SEQ ID NO: 3905 - protein, 9 aa, Homo sapiens
  Light chain CDR3 for antibody 1953 (IGKV1-39)
QQSYSTPLT

SEQ ID NO: 3906 - protein, 18 aa, Homo sapiens
  Heavy chain CDR3 for antibody 1953 (IGHV3-33)
ARREGIVGATTYYYGMDV

SEQ ID NO: 3907 - protein, 9 aa, Homo sapiens
  Light chain CDR3 for antibody 1954 (IGKV1-16)
QQYNRYPYT

SEQ ID NO: 3908 - protein, 15 aa, Homo sapiens
  Heavy chain CDR3 for antibody 1954 (IGHV4-59)
ARDLGHYYGSVSIDY

SEQ ID NO: 3909 - protein, 9 aa, Homo sapiens
  Light chain CDR3 for antibody 1955 (IGKV1-39)
QQSYSTPLT

SEQ ID NO: 3910 - protein, 15 aa, Homo sapiens
  Heavy chain CDR3 for antibody 1955 (IGHV3-23)
AKDGSYYDYYYGMDV

SEQ ID NO: 3911 - protein, 9 aa, Homo sapiens
  Light chain CDR3 for antibody 1956 (IGKV1-6)
LQDYNYPYT

SEQ ID NO: 3912 - protein, 10 aa, Homo sapiens
  Heavy chain CDR3 for antibody 1956 (IGHV3-33)
ARDGLRYFDW

SEQ ID NO: 3913 - protein, 9 aa, Homo sapiens
  Light chain CDR3 for antibody 1957 (IGKV5-2)
LQHDNFPYT

SEQ ID NO: 3914 - protein, 17 aa, Homo sapiens
  Heavy chain CDR3 for antibody 1957 (IGHV3-23)
AKDTITMVRGALFGMDV

SEQ ID NO: 3915 - protein, 9 aa, Homo sapiens
  Light chain CDR3 for antibody 1958 (IGKV1-39)
QQSYSTPLT

SEQ ID NO: 3916 - protein, 10 aa, Homo sapiens
  Heavy chain CDR3 for antibody 1958 (IGHV3-33)
ARDGSGSQPI

SEQ ID NO: 3917 - protein, 9 aa, Homo sapiens
  Light chain CDR3 for antibody 1959 (IGKV1D-13)
QQFNNYPYT

SEQ ID NO: 3918 - protein, 15 aa, Homo sapiens
  Heavy chain CDR3 for antibody 1959 (IGHV3-33)
ARGYYYGSGSFPVDY

SEQ ID NO: 3919 - protein, 9 aa, Homo sapiens
  Light chain CDR3 for antibody 1960 (IGKV5-2)
LQHDNFPYT

SEQ ID NO: 3920 - protein, 13 aa, Homo sapiens
  Heavy chain CDR3 for antibody 1960 (IGHV3-23)
AKDRGGSYSYFDF

SEQ ID NO: 3921 - protein, 9 aa, Homo sapiens
  Light chain CDR3 for antibody 1961 (IGKV1-39)
QQSYSTPLT

SEQ ID NO: 3922 - protein, 20 aa, Homo sapiens
  Heavy chain CDR3 for antibody 1961 (IGHV3-11)
ARGGATLIRGLIDYYYGMDV

SEQ ID NO: 3923 - protein, 9 aa, Homo sapiens
  Light chain CDR3 for antibody 1962 (IGKV1-39)
QQSYTTPYT

SEQ ID NO: 3924 - protein, 15 aa, Homo sapiens
  Heavy chain CDR3 for antibody 1962 (IGHV3-13)
ARVRAYCRGDCHPDY

SEQ ID NO: 3925 - protein, 9 aa, Homo sapiens
  Light chain CDR3 for antibody 1963 (IGKV3-20)
QQYGSSPYT

SEQ ID NO: 3926 - protein, 15 aa, Homo sapiens
  Heavy chain CDR3 for antibody 1963 (IGHV3-74)
ARGSGSHYHYYGMDV

SEQ ID NO: 3927 - protein, 9 aa, Homo sapiens
  Light chain CDR3 for antibody 1964 (IGKV3-20)
QQYGSSPYT

SEQ ID NO: 3928 - protein, 12 aa, Homo sapiens
  Heavy chain CDR3 for antibody 1964 (IGHV3-h)
AREDYYYYGMDV

SEQ ID NO: 3929 - protein, 8 aa, Homo sapiens
  Light chain CDR3 for antibody 1965 (IGKV3-20)
QQYGRSFT

SEQ ID NO: 3930 - protein, 13 aa, Homo sapiens
  Heavy chain CDR3 for antibody 1965 (IGHV4-34)
ASNFYYYYYGMDV

SEQ ID NO: 3931 - protein, 9 aa, Homo sapiens
  Light chain CDR3 for antibody 1966 (IGKV6-21)
HQSSSLPYT

SEQ ID NO: 3932 - protein, 9 aa, Homo sapiens
  Heavy chain CDR3 for antibody 1966 (IGHV3-23)
AKEQQLFDY

SEQ ID NO: 3933 - protein, 9 aa, Homo sapiens
  Light chain CDR3 for antibody 1967 (IGKV1-39)
QQSYSTPLT

SEQ ID NO: 3934 - protein, 18 aa, Homo sapiens
  Heavy chain CDR3 for antibody 1967 (IGHV3-23)
AKDRITGTTYGYYSGLDV

SEQ ID NO: 3935 - protein, 9 aa, Homo sapiens
  Light chain CDR3 for antibody 1968 (IGKV5-2)
LQHDNFPWT

SEQ ID NO: 3936 - protein, 13 aa, Homo sapiens
  Heavy chain CDR3 for antibody 1968 (IGHV1-46)
ARVKLGSLGAFDI

SEQ ID NO: 3937 - protein, 9 aa, Homo sapiens
  Light chain CDR3 for antibody 1969 (IGKV5-2)
LQHDNFPYT

SEQ ID NO: 3938 - protein, 15 aa, Homo sapiens
  Heavy chain CDR3 for antibody 1969 (IGHV3-33)
AREGLRYFHYYGMDV

SEQ ID NO: 3939 - protein, 9 aa, Homo sapiens
  Light chain CDR3 for antibody 1970 (IGKV3-15)
QQYNNWPLT

SEQ ID NO: 3940 - protein, 13 aa, Homo sapiens
  Heavy chain CDR3 for antibody 1970 (IGHV4-39)
ARHVLLWFGEFDP

SEQ ID NO: 3941 - protein, 9 aa, Homo sapiens
  Light chain CDR3 for antibody 1971 (IGKV1D-16)
QQYNSYPYT

SEQ ID NO: 3942 - protein, 18 aa, Homo sapiens
  Heavy chain CDR3 for antibody 1971 (IGHV3-33)
VREGGYYGSGSYPDAFDI

SEQ ID NO: 3943 - protein, 9 aa, Homo sapiens
  Light chain CDR3 for antibody 1972 (IGKV1-9)
QQLNSYPLT

SEQ ID NO: 3944 - protein, 13 aa, Homo sapiens
  Heavy chain CDR3 for antibody 1972 (IGHV4-39)
ARRDGSYYGYFGY

SEQ ID NO: 3945 - protein, 9 aa, Homo sapiens
  Light chain CDR3 for antibody 1973 (IGKV1-16)
QQYNSYPYT

SEQ ID NO: 3946 - protein, 17 aa, Homo sapiens
  Heavy chain CDR3 for antibody 1973 (IGHV3-33)
ARENDILTGSYYYGMDV

SEQ ID NO: 3947 - protein, 9 aa, Homo sapiens
  Light chain CDR3 for antibody 1974 (IGKV5-2)
LQHDNFPYT

SEQ ID NO: 3948 - protein, 11 aa, Homo sapiens
  Heavy chain CDR3 for antibody 1974 (IGHV1-24)
ATELGLYYFDY

SEQ ID NO: 3949 - protein, 9 aa, Homo sapiens
  Light chain CDR3 for antibody 1975 (IGKV1-39)
QQSYSTPLT

SEQ ID NO: 3950 - protein, 13 aa, Homo sapiens
  Heavy chain CDR3 for antibody 1975 (IGHV3-23)
ASTGDSYYYGMDV

SEQ ID NO: 3951 - protein, 9 aa, Homo sapiens
  Light chain CDR3 for antibody 1976 (IGKV6-21)
HQSSSLPYT

SEQ ID NO: 3952 - protein, 19 aa, Homo sapiens
  Heavy chain CDR3 for antibody 1976 (IGHV3-30)
ARRFSGYSGYDHYYYGMDV

SEQ ID NO: 3953 - protein, 9 aa, Homo sapiens
  Light chain CDR3 for antibody 1977 (IGKV3D-7)
QQDYNLPLT

SEQ ID NO: 3954 - protein, 15 aa, Homo sapiens
  Heavy chain CDR3 for antibody 1977 (IGHV4-59)
ARDLGHYYGSVSIDY

SEQ ID NO: 3955 - protein, 9 aa, Homo sapiens
  Light chain CDR3 for antibody 1978 (IGKV1-27)
QKYNSAPYT

SEQ ID NO: 3956 - protein, 14 aa, Homo sapiens
  Heavy chain CDR3 for antibody 1978 (IGHV3-33)
VRDAMGATTAWFDP

SEQ ID NO: 3957 - protein, 9 aa, Homo sapiens
  Light chain CDR3 for antibody 1979 (IGKV3-15)
QQYNNWPLT

SEQ ID NO: 3958 - protein, 15 aa, Homo sapiens
  Heavy chain CDR3 for antibody 1979 (IGHV4-59)
ARDLGHYYGSVSIDY

SEQ ID NO: 3959 - protein, 9 aa, Homo sapiens
  Light chain CDR3 for antibody 1980 (IGKV1-39)
QQSYSTPLT

SEQ ID NO: 3960 - protein, 14 aa, Homo sapiens
  Heavy chain CDR3 for antibody 1980 (IGHV3-23)
ANWAYDILTGYLDY

SEQ ID NO: 3961 - protein, 9 aa, Homo sapiens
  Light chain CDR3 for antibody 1981 (IGKV6-21)
HQSSSLPYT

SEQ ID NO: 3962 - protein, 18 aa, Homo sapiens
  Heavy chain CDR3 for antibody 1981 (IGHV3-33)
ARERGYYGSDIYPAAFDI

SEQ ID NO: 3963 - protein, 9 aa, Homo sapiens
  Light chain CDR3 for antibody 1982 (IGKV1-9)
QQLNSYPLT

SEQ ID NO: 3964 - protein, 16 aa, Homo sapiens
  Heavy chain CDR3 for antibody 1982 (IGHV1-24)
ATEDSSSYYYYYGMDV

SEQ ID NO: 3965 - protein, 9 aa, Homo sapiens
  Light chain CDR3 for antibody 1983 (IGKV1D-16)
QQYNSYPYT

SEQ ID NO: 3966 - protein, 14 aa, Homo sapiens
  Heavy chain CDR3 for antibody 1983 (IGHV3-33)
AREEDYYYYYDMDV

SEQ ID NO: 3967 - protein, 9 aa, Homo sapiens
  Light chain CDR3 for antibody 1984 (IGKV3-15)
QQYNNWPLT

SEQ ID NO: 3968 - protein, 12 aa, Homo sapiens
  Heavy chain CDR3 for antibody 1984 (IGHV4-39)
ARHGSGSSYFDY

SEQ ID NO: 3969 - protein, 9 aa, Homo sapiens
  Light chain CDR3 for antibody 1985 (IGKV1-9)
QQLNSYPLT

SEQ ID NO: 3970 - protein, 11 aa, Homo sapiens
  Heavy chain CDR3 for antibody 1985 (IGHV4-59)
VRERGYYGMDV

SEQ ID NO: 3971 - protein, 9 aa, Homo sapiens
  Light chain CDR3 for antibody 1986 (IGKV2-30)
MQGTHWPLT

SEQ ID NO: 3972 - protein, 13 aa, Homo sapiens
  Heavy chain CDR3 for antibody 1986 (IGHV3-33)
ARDWGYSHGYFDY

SEQ ID NO: 3973 - protein, 9 aa, Homo sapiens
  Light chain CDR3 for antibody 1987 (IGKV6-21)
HQSSSLPFT

SEQ ID NO: 3974 - protein, 5 aa, Homo sapiens
  Heavy chain CDR3 for antibody 1987 (IGHV4-39)
ARGDY

SEQ ID NO: 3975 - protein, 9 aa, Homo sapiens
  Light chain CDR3 for antibody 1988 (IGKV5-2)
LQHDNFPYT

SEQ ID NO: 3976 - protein, 16 aa, Homo sapiens
  Heavy chain CDR3 for antibody 1988 (IGHV3-30)
ARDIAVAGHVYYGMDV

SEQ ID NO: 3977 - protein, 9 aa, Homo sapiens
  Light chain CDR3 for antibody 1989 (IGKV1-17)
LQHNSYPYT

SEQ ID NO: 3978 - protein, 26 aa, Homo sapiens
  Heavy chain CDR3 for antibody 1989 (IGHV4-39)
ARQGLLWFGDLKAYDSSGYYYGYFHH

SEQ ID NO: 3979 - protein, 10 aa, Homo sapiens
  Light chain CDR3 for antibody 1990 (IGKV1-39)
QQSYSTPMYT

SEQ ID NO: 3980 - protein, 13 aa, Homo sapiens
  Heavy chain CDR3 for antibody 1990 (IGHV3-33)
ARDYCGGDCYLDY

SEQ ID NO: 3981 - protein, 9 aa, Homo sapiens
  Light chain CDR3 for antibody 1991 (IGKV1-16)
QQYNRYPYT

SEQ ID NO: 3982 - protein, 9 aa, Homo sapiens
  Heavy chain CDR3 for antibody 1991 (IGHV4-59)
AGGSWDFDY

SEQ ID NO: 3983 - protein, 9 aa, Homo sapiens
  Light chain CDR3 for antibody 1992 (IGKV5-2)
LQHDNFPYT

SEQ ID NO: 3984 - protein, 17 aa, Homo sapiens
  Heavy chain CDR3 for antibody 1992 (IGHV3-23)
AKEYCSGGSCYVYYFDY

SEQ ID NO: 3985 - protein, 9 aa, Homo sapiens
  Light chain CDR3 for antibody 1993 (IGKV6-21)
HQSSSLPYT

SEQ ID NO: 3986 - protein, 10 aa, Homo sapiens
  Heavy chain CDR3 for antibody 1993 (IGHV3-74)
ARENWGGFDY

SEQ ID NO: 3987 - protein, 9 aa, Homo sapiens
  Light chain CDR3 for antibody 1994 (IGKV5-2)
LQHDNFPYT

SEQ ID NO: 3988 - protein, 16 aa, Homo sapiens
  Heavy chain CDR3 for antibody 1994 (IGHV3-13)
ARDRSYESYYYYGMDV

SEQ ID NO: 3989 - protein, 9 aa, Homo sapiens
  Light chain CDR3 for antibody 1995 (IGKV3-11)
QQRSNWPYT

SEQ ID NO: 3990 - protein, 18 aa, Homo sapiens
  Heavy chain CDR3 for antibody 1995 (IGHV3-33)
ARREGITTIFYYYYGMDV

SEQ ID NO: 3991 - protein, 9 aa, Homo sapiens
  Light chain CDR3 for antibody 1996 (IGKV1D-16)
QQYNSYPLT

SEQ ID NO: 3992 - protein, 13 aa, Homo sapiens
  Heavy chain CDR3 for antibody 1996 (IGHV3-33)
ARDSSSWYHWFDP

SEQ ID NO: 3993 - protein, 9 aa, Homo sapiens
  Light chain CDR3 for antibody 1997 (IGKV6-21)
HQSSSLPYT

SEQ ID NO: 3994 - protein, 17 aa, Homo sapiens
  Heavy chain CDR3 for antibody 1997 (IGHV3-64)
ARERYYGSGSYYNWFDP

SEQ ID NO: 3995 - protein, 9 aa, Homo sapiens
  Light chain CDR3 for antibody 1998 (IGKV1D-13)
QQFNNYPYT

SEQ ID NO: 3996 - protein, 14 aa, Homo sapiens
  Heavy chain CDR3 for antibody 1998 (IGHV3-33)
ARRGSPLRPSHLDV

SEQ ID NO: 3997 - protein, 9 aa, Homo sapiens
  Light chain CDR3 for antibody 1999 (IGKV2-30)
MQGTHWPLT

SEQ ID NO: 3998 - protein, 15 aa, Homo sapiens
  Heavy chain CDR3 for antibody 1999 (IGHV3-20)
ARDRGSSGWRDWFDP

SEQ ID NO: 3999 - protein, 9 aa, Homo sapiens
  Light chain CDR3 for antibody 2000 (IGKV1-27)
QKYNSAPYT

SEQ ID NO: 4000 - protein, 9 aa, Homo sapiens
  Heavy chain CDR3 for antibody 2000 (IGHV3-13)
ARDRWYFDL

SEQ ID NO: 4001 - protein, 9 aa, Homo sapiens
  Light chain CDR3 for antibody 2001 (IGKV1-39)
QQSYSTPLT

SEQ ID NO: 4002 - protein, 14 aa, Homo sapiens
  Heavy chain CDR3 for antibody 2001 (IGHV3-33)
ARDREQQLVRYFDY

SEQ ID NO: 4003 - protein, 8 aa, Homo sapiens
  Light chain CDR3 for antibody 2002 (IGKV3D-7)
QQDYNLVT

SEQ ID NO: 4004 - protein, 16 aa, Homo sapiens
  Heavy chain CDR3 for antibody 2002 (IGHV4-59)
ARGRYFEWLLGDVFDI

SEQ ID NO: 4005 - protein, 9 aa, Homo sapiens
  Light chain CDR3 for antibody 2003 (IGKV5-2)
LQHDNFPYT

SEQ ID NO: 4006 - protein, 15 aa, Homo sapiens
  Heavy chain CDR3 for antibody 2003 (IGHV3-23)
AKDGGWNYYYYGMDV

SEQ ID NO: 4007 - protein, 9 aa, Homo sapiens
  Light chain CDR3 for antibody 2004 (IGKV1-17)
LQHNSYPYT

SEQ ID NO: 4008 - protein, 14 aa, Homo sapiens
  Heavy chain CDR3 for antibody 2004 (IGHV3-33)
ARDTVAAGFNGMDV

SEQ ID NO: 4009 - protein, 9 aa, Homo sapiens
  Light chain CDR3 for antibody 2005 (IGKV1D-13)
QQFNNYPHT

SEQ ID NO: 4010 - protein, 14 aa, Homo sapiens
  Heavy chain CDR3 for antibody 2005 (IGHV3-33)
ARDKTYPLSYGMDV

SEQ ID NO: 4011 - protein, 9 aa, Homo sapiens
  Light chain CDR3 for antibody 2006 (IGKV3-20)
QQYGSSPYT

SEQ ID NO: 4012 - protein, 15 aa, Homo sapiens
  Heavy chain CDR3 for antibody 2006 (IGHV3-23)
AKDGFYYGSGSSFDH

SEQ ID NO: 4013 - protein, 9 aa, Homo sapiens
  Light chain CDR3 for antibody 2007 (IGKV1D-13)
QQFNNYPHT

SEQ ID NO: 4014 - protein, 11 aa, Homo sapiens
  Heavy chain CDR3 for antibody 2007 (IGHV3-33)
ARARYTTGLDY

SEQ ID NO: 4015 - protein, 9 aa, Homo sapiens
  Light chain CDR3 for antibody 2008 (IGKV5-2)
LQHDNFPYT

SEQ ID NO: 4016 - protein, 14 aa, Homo sapiens
  Heavy chain CDR3 for antibody 2008 (IGHV3-20)
ARDGGSTCYDWFDP

SEQ ID NO: 4017 - protein, 9 aa, Homo sapiens
  Light chain CDR3 for antibody 2009 (IGKV1-9)
QQYNSYPLT

SEQ ID NO: 4018 - protein, 8 aa, Homo sapiens
  Heavy chain CDR3 for antibody 2009 (IGHV3-23)
AKESLLDY

SEQ ID NO: 4019 - protein, 9 aa, Homo sapiens
  Light chain CDR3 for antibody 2010 (IGKV1-39)
QQSYSTPLT

SEQ ID NO: 4020 - protein, 16 aa, Homo sapiens
  Heavy chain CDR3 for antibody 2010 (IGHV3-33)
ARGYDMLTGDYYGMDV

SEQ ID NO: 4021 - protein, 9 aa, Homo sapiens
  Light chain CDR3 for antibody 2011 (IGKV1-9)
QQLISYPLT

SEQ ID NO: 4022 - protein, 13 aa, Homo sapiens
  Heavy chain CDR3 for antibody 2011 (IGHV3-11)
ARDGGAAAGTWDS

SEQ ID NO: 4023 - protein, 9 aa, Homo sapiens
  Light chain CDR3 for antibody 2012 (IGKV1D-13)
QQFNNYPHT

SEQ ID NO: 4024 - protein, 14 aa, Homo sapiens
  Heavy chain CDR3 for antibody 2012 (IGHV3-23)
AKEDTAMASYYFDY

SEQ ID NO: 4025 - protein, 9 aa, Homo sapiens
  Light chain CDR3 for antibody 2013 (IGKV6-21)
HQSSSLPYT

SEQ ID NO: 4026 - protein, 14 aa, Homo sapiens
  Heavy chain CDR3 for antibody 2013 (IGHV3-33)
VRDQGSMVRGGGDY

SEQ ID NO: 4027 - protein, 9 aa, Homo sapiens
  Light chain CDR3 for antibody 2014 (IGKV1-39)
QQSYSTPLT

SEQ ID NO: 4028 - protein, 17 aa, Homo sapiens
  Heavy chain CDR3 for antibody 2014 (IGHV3-33)
VREGGLLWVGELSLFDY

SEQ ID NO: 4029 - protein, 9 aa, Homo sapiens
  Light chain CDR3 for antibody 2015 (IGKV5-2)
LQHDNFPWT

SEQ ID NO: 4030 - protein, 20 aa, Homo sapiens
  Heavy chain CDR3 for antibody 2015 (IGHV3-33)
ARDPAQLERRYYYFYYGMDV

SEQ ID NO: 4031 - protein, 8 aa, Homo sapiens
  Light chain CDR3 for antibody 2016 (IGKV3D-7)
QQDYNLVT

SEQ ID NO: 4032 - protein, 17 aa, Homo sapiens
  Heavy chain CDR3 for antibody 2016 (IGHV4-59)
ARRTTMVREIIVTHFDY

SEQ ID NO: 4033 - protein, 9 aa, Homo sapiens
  Light chain CDR3 for antibody 2017 (IGKV5-2)
LQHDNFPYT

SEQ ID NO: 4034 - protein, 13 aa, Homo sapiens
  Heavy chain CDR3 for antibody 2017 (IGHV3-23)
AKDRGLRYYGMDV

SEQ ID NO: 4035 - protein, 9 aa, Homo sapiens
  Light chain CDR3 for antibody 2018 (IGKV5-2)
LQHDNFPYT

SEQ ID NO: 4036 - protein, 14 aa, Homo sapiens
  Heavy chain CDR3 for antibody 2018 (IGHV3-33)
VRDQGSMVRGGGDY

SEQ ID NO: 4037 - protein, 9 aa, Homo sapiens
  Light chain CDR3 for antibody 2019 (IGKV6-21)
HQSSSLPYT

SEQ ID NO: 4038 - protein, 11 aa, Homo sapiens
  Heavy chain CDR3 for antibody 2019 (IGHV4-4)
AREAYYYGLDV

SEQ ID NO: 4039 - protein, 9 aa, Homo sapiens
  Light chain CDR3 for antibody 2020 (IGKV1D-16)
QQYNSYPYT

SEQ ID NO: 4040 - protein, 10 aa, Homo sapiens
  Heavy chain CDR3 for antibody 2020 (IGHV3-33)
AREGLRYFDH

SEQ ID NO: 4041 - protein, 9 aa, Homo sapiens
  Light chain CDR3 for antibody 2021 (IGKV5-2)
LQHDNFPWT

SEQ ID NO: 4042 - protein, 19 aa, Homo sapiens
  Heavy chain CDR3 for antibody 2021 (IGHV3-33)
TRDPHYDILTGYAYYGMDV

SEQ ID NO: 4043 - protein, 8 aa, Homo sapiens
  Light chain CDR3 for antibody 2022 (IGKV3-15)
QQYNNWLT

SEQ ID NO: 4044 - protein, 15 aa, Homo sapiens
  Heavy chain CDR3 for antibody 2022 (IGHV3-33)
ARVPNYGSGSYFFDY

SEQ ID NO: 4045 - protein, 9 aa, Homo sapiens
  Light chain CDR3 for antibody 2023 (IGKV6-21)
HQSSSLPYT

SEQ ID NO: 4046 - protein, 11 aa, Homo sapiens
  Heavy chain CDR3 for antibody 2023 (IGHV3-23)
GEFSSGWSFDY

SEQ ID NO: 4047 - protein, 9 aa, Homo sapiens
  Light chain CDR3 for antibody 2024 (IGKV5-2)
LQHDNFPYT

SEQ ID NO: 4048 - protein, 10 aa, Homo sapiens
  Heavy chain CDR3 for antibody 2024 (IGHV3-30)
AREWYGGMDV

SEQ ID NO: 4049 - protein, 9 aa, Homo sapiens
  Light chain CDR3 for antibody 2025 (IGKV1-6)
LQDYNYPYT

SEQ ID NO: 4050 - protein, 17 aa, Homo sapiens
  Heavy chain CDR3 for antibody 2025 (IGHV3-23)
AKEGSSSSWYGGLYFDY

SEQ ID NO: 4051 - protein, 9 aa, Homo sapiens
  Light chain CDR3 for antibody 2026 (IGKV1-39)
QQSYSTPLT

SEQ ID NO: 4052 - protein, 18 aa, Homo sapiens
  Heavy chain CDR3 for antibody 2026 (IGHV3-33)
ARDRDRYGSGTYPDAIDI

SEQ ID NO: 4053 - protein, 9 aa, Homo sapiens
  Light chain CDR3 for antibody 2027 (IGKV1-6)
LQDYKSPFT

SEQ ID NO: 4054 - protein, 11 aa, Homo sapiens
  Heavy chain CDR3 for antibody 2027 (IGHV3-33)
ARDRSSGPFDY

SEQ ID NO: 4055 - protein, 9 aa, Homo sapiens
  Light chain CDR3 for antibody 2028 (IGKV1-27)
QKYNSAPYT

SEQ ID NO: 4056 - protein, 18 aa, Homo sapiens
  Heavy chain CDR3 for antibody 2028 (IGHV3-33)
ARGLLWFGVSYYYYGMDV

SEQ ID NO: 4057 - protein, 9 aa, Homo sapiens
  Light chain CDR3 for antibody 2029 (IGKV1D-16)
QQYNSYPYT

SEQ ID NO: 4058 - protein, 13 aa, Homo sapiens
  Heavy chain CDR3 for antibody 2029 (IGHV3-33)
TRRIAVAGAEGDY

SEQ ID NO: 4059 - protein, 9 aa, Homo sapiens
  Light chain CDR3 for antibody 2030 (IGKV1-9)
QQLNSYPLT

SEQ ID NO: 4060 - protein, 13 aa, Homo sapiens
  Heavy chain CDR3 for antibody 2030 (IGHV3-11)
ARDEGYRGYVLDN

SEQ ID NO: 4061 - protein, 9 aa, Homo sapiens
  Light chain CDR3 for antibody 2031 (IGKV1D-13)
QHFNNYMYT

SEQ ID NO: 4062 - protein, 13 aa, Homo sapiens
  Heavy chain CDR3 for antibody 2031 (IGHV4-59)
ARDAGYSSSWFDY

SEQ ID NO: 4063 - protein, 8 aa, Homo sapiens
  Light chain CDR3 for antibody 2032 (IGKV3D-7)
QQDYNLLT

SEQ ID NO: 4064 - protein, 12 aa, Homo sapiens
  Heavy chain CDR3 for antibody 2032 (IGHV4-61)
ARVYSSGWLFDY

SEQ ID NO: 4065 - protein, 9 aa, Homo sapiens
  Light chain CDR3 for antibody 2033 (IGKV5-2)
LQHDNFPYT

SEQ ID NO: 4066 - protein, 18 aa, Homo sapiens
  Heavy chain CDR3 for antibody 2033 (IGHV3-33)
ARERGYYGSDIYPAAFDI

SEQ ID NO: 4067 - protein, 9 aa, Homo sapiens
  Light chain CDR3 for antibody 2034 (IGKV1D-16)
QQYNSYPYT

SEQ ID NO: 4068 - protein, 15 aa, Homo sapiens
  Heavy chain CDR3 for antibody 2034 (IGHV1-18)
ARIYYGSGSSYYFDY

SEQ ID NO: 4069 - protein, 9 aa, Homo sapiens
  Light chain CDR3 for antibody 2035 (IGKV1D-13)
QQFNNYPYT

SEQ ID NO: 4070 - protein, 19 aa, Homo sapiens
  Heavy chain CDR3 for antibody 2035 (IGHV1-18)
ARDDILTGYSLYYYYGMDV

SEQ ID NO: 4071 - protein, 9 aa, Homo sapiens
  Light chain CDR3 for antibody 2036 (IGKV1-16)
QQYNSYPYT

SEQ ID NO: 4072 - protein, 13 aa, Homo sapiens
  Heavy chain CDR3 for antibody 2036 (IGHV4-39)
ARREVVGGRGFDY

SEQ ID NO: 4073 - protein, 9 aa, Homo sapiens
  Light chain CDR3 for antibody 2037 (IGKV1-6)
LQDYNYPYT

SEQ ID NO: 4074 - protein, 15 aa, Homo sapiens
  Heavy chain CDR3 for antibody 2037 (IGHV1-46)
ARGRFFDWLLSPFDY

SEQ ID NO: 4075 - protein, 10 aa, Homo sapiens
  Light chain CDR3 for antibody 2038 (IGKV1-17)
LQHNSYPMYT

SEQ ID NO: 4076 - protein, 13 aa, Homo sapiens
  Heavy chain CDR3 for antibody 2038 (IGHV3-33)
ARDYCGGDCYLDY

SEQ ID NO: 4077 - protein, 9 aa, Homo sapiens
  Light chain CDR3 for antibody 2039 (IGKV3D-20)
QQYGSSPYT

SEQ ID NO: 4078 - protein, 18 aa, Homo sapiens
  Heavy chain CDR3 for antibody 2039 (IGHV3-33)
ARERDYYGSGSYPDAFDI

SEQ ID NO: 4079 - protein, 9 aa, Homo sapiens
  Light chain CDR3 for antibody 2040 (IGKV1D-13)
QQFNNYPHT

SEQ ID NO: 4080 - protein, 13 aa, Homo sapiens
  Heavy chain CDR3 for antibody 2040 (IGHV3-11)
ARDEGYRGYVLDT

SEQ ID NO: 4081 - protein, 10 aa, Homo sapiens
  Light chain CDR3 for antibody 2041 (IGKV1-27)
QKYNSAPMYT

SEQ ID NO: 4082 - protein, 13 aa, Homo sapiens
  Heavy chain CDR3 for antibody 2041 (IGHV4-59)
ARDAGYSSSWFDY

SEQ ID NO: 4083 - protein, 9 aa, Homo sapiens
  Light chain CDR3 for antibody 2042 (IGKV6-21)
HQSSSLPYT

SEQ ID NO: 4084 - protein, 13 aa, Homo sapiens
  Heavy chain CDR3 for antibody 2042 (IGHV3-66)
ANTGDSYYYGFYV

SEQ ID NO: 4085 - protein, 9 aa, Homo sapiens
  Light chain CDR3 for antibody 2043 (IGKV1-39)
QQSYSTPLT

SEQ ID NO: 4086 - protein, 13 aa, Homo sapiens
  Heavy chain CDR3 for antibody 2043 (IGHV3-33)
ARRATLVRGVFDP

SEQ ID NO: 4087 - protein, 9 aa, Homo sapiens
  Light chain CDR3 for antibody 2044 (IGKV3-20)
QQYGSSPYT

SEQ ID NO: 4088 - protein, 15 aa, Homo sapiens
  Heavy chain CDR3 for antibody 2044 (IGHV3-23)
AKDGGWNYYYYGMDV

SEQ ID NO: 4089 - protein, 9 aa, Homo sapiens
  Light chain CDR3 for antibody 2045 (IGKV1-17)
LQHNSYPYT

SEQ ID NO: 4090 - protein, 18 aa, Homo sapiens
  Heavy chain CDR3 for antibody 2045 (IGHV3-33)
ARKGGYYSGSGSYRHFDF

SEQ ID NO: 4091 - protein, 8 aa, Homo sapiens
  Light chain CDR3 for antibody 2046 (IGKV3D-7)
QQDYNLLT

SEQ ID NO: 4092 - protein, 14 aa, Homo sapiens
  Heavy chain CDR3 for antibody 2046 (IGHV3-33)
ARGAAAGNFYGLDV

SEQ ID NO: 4093 - protein, 9 aa, Homo sapiens
  Light chain CDR3 for antibody 2047 (IGKV1-9)
QQYNSYPLT

SEQ ID NO: 4094 - protein, 11 aa, Homo sapiens
  Heavy chain CDR3 for antibody 2047 (IGHV4-39)
ARLLVGATTDY

SEQ ID NO: 4095 - protein, 9 aa, Homo sapiens
  Light chain CDR3 for antibody 2048 (IGKV1D-13)
QQFNNYPYT

SEQ ID NO: 4096 - protein, 13 aa, Homo sapiens
  Heavy chain CDR3 for antibody 2048 (IGHV4-59)
ARTMVRGVAPFDY

SEQ ID NO: 4097 - protein, 9 aa, Homo sapiens
  Light chain CDR3 for antibody 2049 (IGKV1D-16)
QQYNSYPLT

SEQ ID NO: 4098 - protein, 15 aa, Homo sapiens
  Heavy chain CDR3 for antibody 2049 (IGHV1-46)
ARGAVDDYYYYGMDV

SEQ ID NO: 4099 - protein, 9 aa, Homo sapiens
  Light chain CDR3 for antibody 2050 (IGKV1-6)
LQDYNYPRT

SEQ ID NO: 4100 - protein, 7 aa, Homo sapiens
  Heavy chain CDR3 for antibody 2050 (IGHV4-59)
AELFFDY

SEQ ID NO: 4101 - protein, 9 aa, Homo sapiens
  Light chain CDR3 for antibody 2051 (IGKV1-27)
QKYNSAPYT

SEQ ID NO: 4102 - protein, 14 aa, Homo sapiens
  Heavy chain CDR3 for antibody 2051 (IGHV3-33)
ARTTAAAGPRDFQH

SEQ ID NO: 4103 - protein, 9 aa, Homo sapiens
  Light chain CDR3 for antibody 2052 (IGKV3-11)
QQRSNWPPT

SEQ ID NO: 4104 - protein, 12 aa, Homo sapiens
  Heavy chain CDR3 for antibody 2052 (IGHV3-33)
ARGYFGSGYAHF

SEQ ID NO: 4105 - protein, 9 aa, Homo sapiens
  Light chain CDR3 for antibody 2053 (IGKV5-2)
LQHDNFPYT

SEQ ID NO: 4106 - protein, 18 aa, Homo sapiens
  Heavy chain CDR3 for antibody 2053 (IGHV1-8)
ARSRIAAAGIYYYYGMDV

SEQ ID NO: 4107 - protein, 9 aa, Homo sapiens
  Light chain CDR3 for antibody 2054 (IGKV5-2)
LQHDNFPWT

SEQ ID NO: 4108 - protein, 13 aa, Homo sapiens
  Heavy chain CDR3 for antibody 2054 (IGHV4-59)
ANRDYYGYYGMDV

SEQ ID NO: 4109 - protein, 9 aa, Homo sapiens
  Light chain CDR3 for antibody 2055 (IGKV1-27)
QKYNSAPYT

SEQ ID NO: 4110 - protein, 11 aa, Homo sapiens
  Heavy chain CDR3 for antibody 2055 (IGHV3-33)
AREAANWGFDY

SEQ ID NO: 4111 - protein, 9 aa, Homo sapiens
  Light chain CDR3 for antibody 2056 (IGKV1-27)
QKYNSAPYT

SEQ ID NO: 4112 - protein, 15 aa, Homo sapiens
  Heavy chain CDR3 for antibody 2056 (IGHV3-33)
ARDHLTGYYYYGMDV

SEQ ID NO: 4113 - protein, 9 aa, Homo sapiens
  Light chain CDR3 for antibody 2057 (IGKV1-27)
QKYNSAPYT

SEQ ID NO: 4114 - protein, 11 aa, Homo sapiens
  Heavy chain CDR3 for antibody 2057 (IGHV3-33)
ARARYTTGLDY

SEQ ID NO: 4115 - protein, 8 aa, Homo sapiens
  Light chain CDR3 for antibody 2058 (IGKV3D-7)
QQDYNLLT

SEQ ID NO: 4116 - protein, 13 aa, Homo sapiens
  Heavy chain CDR3 for antibody 2058 (IGHV3-33)
ARDWGYSHGYFDY

SEQ ID NO: 4117 - protein, 9 aa, Homo sapiens
  Light chain CDR3 for antibody 2059 (IGKV5-2)
LQHDNFPYT

SEQ ID NO: 4118 - protein, 12 aa, Homo sapiens
  Heavy chain CDR3 for antibody 2059 (IGHV3-13)
ARDRGYSGYFDY

SEQ ID NO: 4119 - protein, 9 aa, Homo sapiens
  Light chain CDR3 for antibody 2060 (IGKV6-21)
HQSSSLPYT

SEQ ID NO: 4120 - protein, 14 aa, Homo sapiens
  Heavy chain CDR3 for antibody 2060 (IGHV3-23)
AKDRYRGYEGLFDY

SEQ ID NO: 4121 - protein, 9 aa, Homo sapiens
  Light chain CDR3 for antibody 2061 (IGKV1-39)
QQSYSTPLT

SEQ ID NO: 4122 - protein, 14 aa, Homo sapiens
  Heavy chain CDR3 for antibody 2061 (IGHV3-33)
ARDKTYPLSYGMDV

SEQ ID NO: 4123 - protein, 9 aa, Homo sapiens
  Light chain CDR3 for antibody 2062 (IGKV1D-16)
QQYNSYPLT

SEQ ID NO: 4124 - protein, 10 aa, Homo sapiens
  Heavy chain CDR3 for antibody 2062 (IGHV3-33)
ARNILTPLDY

SEQ ID NO: 4125 - protein, 9 aa, Homo sapiens
  Light chain CDR3 for antibody 2063 (IGKV1-9)
QQYNSYPLT

SEQ ID NO: 4126 - protein, 10 aa, Homo sapiens
  Heavy chain CDR3 for antibody 2063 (IGHV4-39)
ARQLGNWFDP

SEQ ID NO: 4127 - protein, 9 aa, Homo sapiens
  Light chain CDR3 for antibody 2064 (IGKV1-9)
QQLNSYPLT

SEQ ID NO: 4128 - protein, 16 aa, Homo sapiens
  Heavy chain CDR3 for antibody 2064 (IGHV3-33)
ARDGSMVRRIHDAFDF

SEQ ID NO: 4129 - protein, 9 aa, Homo sapiens
  Light chain CDR3 for antibody 2065 (IGKV1D-16)
QQYNSYPLT

SEQ ID NO: 4130 - protein, 18 aa, Homo sapiens
  Heavy chain CDR3 for antibody 2065 (IGHV3-33)
ARGGVLYDILTGFYGMDV

SEQ ID NO: 4131 - protein, 9 aa, Homo sapiens
  Light chain CDR3 for antibody 2066 (IGKV6-21)
HQSSSLPYT

SEQ ID NO: 4132 - protein, 16 aa, Homo sapiens
  Heavy chain CDR3 for antibody 2066 (IGHV3-13)
ARDRSYESYYYYGMDV

SEQ ID NO: 4133 - protein, 9 aa, Homo sapiens
  Light chain CDR3 for antibody 2067 (IGKV1-6)
LQDYNYPYT

SEQ ID NO: 4134 - protein, 11 aa, Homo sapiens
  Heavy chain CDR3 for antibody 2067 (IGHV3-23)
AKEGTYFDIPH

SEQ ID NO: 4135 - protein, 9 aa, Homo sapiens
  Light chain CDR3 for antibody 2068 (IGKV1D-13)
QQFNNYPYT

SEQ ID NO: 4136 - protein, 21 aa, Homo sapiens
  Heavy chain CDR3 for antibody 2068 (IGHV3-33)
ARDEYYEIVTGYGYYHYGMDV

SEQ ID NO: 4137 - protein, 9 aa, Homo sapiens
  Light chain CDR3 for antibody 2069 (IGKV1-6)
LQDYNYPYT

SEQ ID NO: 4138 - protein, 15 aa, Homo sapiens
  Heavy chain CDR3 for antibody 2069 (IGHV4-39)
ARQGLVATIKGYFQH

SEQ ID NO: 4139 - protein, 9 aa, Homo sapiens
  Light chain CDR3 for antibody 2070 (IGKV3D-7)
QQDSNLPYT

SEQ ID NO: 4140 - protein, 13 aa, Homo sapiens
  Heavy chain CDR3 for antibody 2070 (IGHV4-59)
ARDAGYSSSWFDY

SEQ ID NO: 4141 - protein, 9 aa, Homo sapiens
  Light chain CDR3 for antibody 2071 (IGKV1-17)
LQHNSYPYT

SEQ ID NO: 4142 - protein, 10 aa, Homo sapiens
  Heavy chain CDR3 for antibody 2071 (IGHV3-33)
ARDLGWSFDH

SEQ ID NO: 4143 - protein, 9 aa, Homo sapiens
  Light chain CDR3 for antibody 2072 (IGKV5-2)
LQHDNFPYT

SEQ ID NO: 4144 - protein, 20 aa, Homo sapiens
  Heavy chain CDR3 for antibody 2072 (IGHV3-33)
AREDYYGSGSYYPAYNWFDP

SEQ ID NO: 4145 - protein, 9 aa, Homo sapiens
  Light chain CDR3 for antibody 2073 (IGKV1D-16)
QQYNSYPLT

SEQ ID NO: 4146 - protein, 20 aa, Homo sapiens
  Heavy chain CDR3 for antibody 2073 (IGHV3-33)
ARDWMVRGVIITDYYYGMDV

SEQ ID NO: 4147 - protein, 9 aa, Homo sapiens
  Light chain CDR3 for antibody 2074 (IGKV6-21)
HQSSSLPYT

SEQ ID NO: 4148 - protein, 15 aa, Homo sapiens
  Heavy chain CDR3 for antibody 2074 (IGHV3-23)
AKDLSSGWYAYFFDY

SEQ ID NO: 4149 - protein, 9 aa, Homo sapiens
  Light chain CDR3 for antibody 2075 (IGKV5-2)
LQHDNFPYT

SEQ ID NO: 4150 - protein, 16 aa, Homo sapiens
  Heavy chain CDR3 for antibody 2075 (IGHV3-33)
ARGDDILTHQYYGVDV

SEQ ID NO: 4151 - protein, 9 aa, Homo sapiens
  Light chain CDR3 for antibody 2076 (IGKV1D-13)
QQFNNYPRT

SEQ ID NO: 4152 - protein, 12 aa, Homo sapiens
  Heavy chain CDR3 for antibody 2076 (IGHV1-24)
ASDWAYYYGMDV

SEQ ID NO: 4153 - protein, 9 aa, Homo sapiens
  Light chain CDR3 for antibody 2077 (IGKV1-39)
QQSYSTPLT

SEQ ID NO: 4154 - protein, 18 aa, Homo sapiens
  Heavy chain CDR3 for antibody 2077 (IGHV3-23)
ARYHLYFGSGFGSDGMDV

SEQ ID NO: 4155 - protein, 9 aa, Homo sapiens
  Light chain CDR3 for antibody 2078 (IGKV2-30)
MQGTHWPLT

SEQ ID NO: 4156 - protein, 9 aa, Homo sapiens
  Heavy chain CDR3 for antibody 2078 (IGHV1-18)
ARGKDWFDP

SEQ ID NO: 4157 - protein, 9 aa, Homo sapiens
  Light chain CDR3 for antibody 2079 (IGKV4-1)
QQYYTTPYT

SEQ ID NO: 4158 - protein, 14 aa, Homo sapiens
  Heavy chain CDR3 for antibody 2079 (IGHV3-33)
AREGILTGYYPFDY

SEQ ID NO: 4159 - protein, 9 aa, Homo sapiens
  Light chain CDR3 for antibody 2080 (IGKV1-6)
LQDYKSPFT

SEQ ID NO: 4160 - protein, 13 aa, Homo sapiens
  Heavy chain CDR3 for antibody 2080 (IGHV4-59)
ARDAGYSSSWFDY

SEQ ID NO: 4161 - protein, 9 aa, Homo sapiens
  Light chain CDR3 for antibody 2081 (IGKV1-17)
LQHNSYPYT

SEQ ID NO: 4162 - protein, 15 aa, Homo sapiens
  Heavy chain CDR3 for antibody 2081 (IGHV3-23)
AKDRDYDFLSGPFDY

SEQ ID NO: 4163 - protein, 9 aa, Homo sapiens
  Light chain CDR3 for antibody 2082 (IGKV3-20)
QQYGSSPYT

SEQ ID NO: 4164 - protein, 21 aa, Homo sapiens
  Heavy chain CDR3 for antibody 2082 (IGHV4-59)
ARGPSRYDILTGYSYYYGMDV

SEQ ID NO: 4165 - protein, 9 aa, Homo sapiens
  Light chain CDR3 for antibody 2083 (IGKV5-2)
LQHDNFPYT

SEQ ID NO: 4166 - protein, 15 aa, Homo sapiens
  Heavy chain CDR3 for antibody 2083 (IGHV3-33)
ARDRVVRGVMGYFDY

SEQ ID NO: 4167 - protein, 9 aa, Homo sapiens
  Light chain CDR3 for antibody 2084 (IGKV1-6)
LQDFNYPRT

SEQ ID NO: 4168 - protein, 16 aa, Homo sapiens
  Heavy chain CDR3 for antibody 2084 (IGHV4-59)
ARGRYFDWLLGDVFDI

SEQ ID NO: 4169 - protein, 9 aa, Homo sapiens
  Light chain CDR3 for antibody 2085 (IGKV5-2)
LQHDNFPYT

SEQ ID NO: 4170 - protein, 11 aa, Homo sapiens
  Heavy chain CDR3 for antibody 2085 (IGHV3-33)
ARDRATATVDY

SEQ ID NO: 4171 - protein, 9 aa, Homo sapiens
  Light chain CDR3 for antibody 2086 (IGKV1-39)
QQSYRTPLT

SEQ ID NO: 4172 - protein, 17 aa, Homo sapiens
  Heavy chain CDR3 for antibody 2086 (IGHV3-33)
ARGFSGYDGYYYYGMDV

SEQ ID NO: 4173 - protein, 9 aa, Homo sapiens
  Light chain CDR3 for antibody 2087 (IGKV5-2)
LQHDNFPYT

SEQ ID NO: 4174 - protein, 17 aa, Homo sapiens
  Heavy chain CDR3 for antibody 2087 (IGHV3-33)
ARGGAAAGPYLYYGLDV

SEQ ID NO: 4175 - protein, 8 aa, Homo sapiens
  Light chain CDR3 for antibody 2088 (IGKV1D-13)
QQFNNYYT

SEQ ID NO: 4176 - protein, 9 aa, Homo sapiens
  Heavy chain CDR3 for antibody 2088 (IGHV1-18)
ARGKDWFDP

SEQ ID NO: 4177 - protein, 9 aa, Homo sapiens
  Light chain CDR3 for antibody 2089 (IGKV1-6)
LQDYNYPNT

SEQ ID NO: 4178 - protein, 7 aa, Homo sapiens
  Heavy chain CDR3 for antibody 2089 (IGHV1-46)
AREGGDY

SEQ ID NO: 4179 - protein, 9 aa, Homo sapiens
  Light chain CDR3 for antibody 2090 (IGKV1-39)
QQSYRTPLT

SEQ ID NO: 4180 - protein, 17 aa, Homo sapiens
  Heavy chain CDR3 for antibody 2090 (IGHV3-33)
ARAYYDILTGYSYYFDY

SEQ ID NO: 4181 - protein, 9 aa, Homo sapiens
  Light chain CDR3 for antibody 2091 (IGKV1-9)
QQLNSYPLT

SEQ ID NO: 4182 - protein, 10 aa, Homo sapiens
  Heavy chain CDR3 for antibody 2091 (IGHV3-30)
ARDGLESFDY

SEQ ID NO: 4183 - protein, 9 aa, Homo sapiens
  Light chain CDR3 for antibody 2092 (IGKV1-39)
QQSYRTPLT

SEQ ID NO: 4184 - protein, 21 aa, Homo sapiens
  Heavy chain CDR3 for antibody 2092 (IGHV3-23)
AKDIDYYGSGSYPLYYYGMDV

SEQ ID NO: 4185 - protein, 9 aa, Homo sapiens
  Light chain CDR3 for antibody 2093 (IGKV1-27)
QKYNSAPYT

SEQ ID NO: 4186 - protein, 8 aa, Homo sapiens
  Heavy chain CDR3 for antibody 2093 (IGHV3-23)
AKETGNNY

SEQ ID NO: 4187 - protein, 9 aa, Homo sapiens
  Light chain CDR3 for antibody 2094 (IGKV1-27)
QKYNSAPYT

SEQ ID NO: 4188 - protein, 15 aa, Homo sapiens
  Heavy chain CDR3 for antibody 2094 (IGHV3-33)
ARRICSGGSCSLFDY

SEQ ID NO: 4189 - protein, 9 aa, Homo sapiens
  Light chain CDR3 for antibody 2095 (IGKV1-39)
QQSYRTPLT

SEQ ID NO: 4190 - protein, 14 aa, Homo sapiens
  Heavy chain CDR3 for antibody 2095 (IGHV3-11)
ARAISGSSYWYFDL

SEQ ID NO: 4191 - protein, 9 aa, Homo sapiens
  Light chain CDR3 for antibody 2096 (IGKV1-6)
LQDYNYPYT

SEQ ID NO: 4192 - protein, 11 aa, Homo sapiens
  Heavy chain CDR3 for antibody 2096 (IGHV3-33)
ARDRSTGWLDY

SEQ ID NO: 4193 - protein, 9 aa, Homo sapiens
  Light chain CDR3 for antibody 2097 (IGKV1-27)
QKYNSAPYT

SEQ ID NO: 4194 - protein, 16 aa, Homo sapiens
  Heavy chain CDR3 for antibody 2097 (IGHV3-33)
ARGYDMLTGDYYGMDV

SEQ ID NO: 4195 - protein, 9 aa, Homo sapiens
  Light chain CDR3 for antibody 2098 (IGKV1-6)
LQDHKHPFT

SEQ ID NO: 4196 - protein, 16 aa, Homo sapiens
  Heavy chain CDR3 for antibody 2098 (IGHV3-15)
AADLGDHADAYATLDN

SEQ ID NO: 4197 - protein, 8 aa, Homo sapiens
  Light chain CDR3 for antibody 2099 (IGKV3D-7)
QQDYNLLT

SEQ ID NO: 4198 - protein, 12 aa, Homo sapiens
  Heavy chain CDR3 for antibody 2099 (IGHV1-18)
ARILFYGDYFDY

SEQ ID NO: 4199 - protein, 8 aa, Homo sapiens
  Light chain CDR3 for antibody 2100 (IGKV1D-13)
QQFNNYYT

SEQ ID NO: 4200 - protein, 12 aa, Homo sapiens
  Heavy chain CDR3 for antibody 2100 (IGHV1-46)
ARGLTGDHAVDI

SEQ ID NO: 4201 - protein, 9 aa, Homo sapiens
  Light chain CDR3 for antibody 2101 (IGKV1-9)
QQLKSYLYT

SEQ ID NO: 4202 - protein, 17 aa, Homo sapiens
  Heavy chain CDR3 for antibody 2101 (IGHV1-18)
ARDRAFTMVRGVPPFDY

SEQ ID NO: 4203 - protein, 9 aa, Homo sapiens
  Light chain CDR3 for antibody 2102 (IGKV1-16)
QQYNSYPYT

SEQ ID NO: 4204 - protein, 9 aa, Homo sapiens
  Heavy chain CDR3 for antibody 2102 (IGHV4-59)
AREGGSGSL

SEQ ID NO: 4205 - protein, 9 aa, Homo sapiens
  Light chain CDR3 for antibody 2103 (IGKV1D-16)
QQYNSYPYT

SEQ ID NO: 4206 - protein, 13 aa, Homo sapiens
  Heavy chain CDR3 for antibody 2103 (IGHV3-30)
ARVGDSVMVPFDY

SEQ ID NO: 4207 - protein, 9 aa, Homo sapiens
  Light chain CDR3 for antibody 2104 (IGKV3-20)
QQYGSSPYT

SEQ ID NO: 4208 - protein, 11 aa, Homo sapiens
  Heavy chain CDR3 for antibody 2104 (IGHV3-33)
ARGTTVTHFDY

SEQ ID NO: 4209 - protein, 9 aa, Homo sapiens
  Light chain CDR3 for antibody 2105 (IGKV1-39)
QQSYSTPLT

SEQ ID NO: 4210 - protein, 11 aa, Homo sapiens
  Heavy chain CDR3 for antibody 2105 (IGHV3-33)
ARDTWDDYFDY

SEQ ID NO: 4211 - protein, 9 aa, Homo sapiens
  Light chain CDR3 for antibody 2106 (IGKV1D-16)
QQYNSYPLT

SEQ ID NO: 4212 - protein, 13 aa, Homo sapiens
  Heavy chain CDR3 for antibody 2106 (IGHV3-23)
AKDRGGSYSYFDF

SEQ ID NO: 4213 - protein, 9 aa, Homo sapiens
  Light chain CDR3 for antibody 2107 (IGKV5-2)
LQHDNFPYT

SEQ ID NO: 4214 - protein, 12 aa, Homo sapiens
  Heavy chain CDR3 for antibody 2107 (IGHV3-23)
AKEGLGSDYEPY

SEQ ID NO: 4215 - protein, 9 aa, Homo sapiens
  Light chain CDR3 for antibody 2108 (IGKV3-11)
QQRSNWPLT

SEQ ID NO: 4216 - protein, 14 aa, Homo sapiens
  Heavy chain CDR3 for antibody 2108 (IGHV3-33)
ARDRIAAASSDFDC

SEQ ID NO: 4217 - protein, 9 aa, Homo sapiens
  Light chain CDR3 for antibody 2109 (IGKV6-21)
HQSSSLPYT

SEQ ID NO: 4218 - protein, 13 aa, Homo sapiens
  Heavy chain CDR3 for antibody 2109 (IGHV3-33)
ARGVLWFGELFDY

SEQ ID NO: 4219 - protein, 9 aa, Homo sapiens
  Light chain CDR3 for antibody 2110 (IGKV6-21)
HQSSSLPYT

SEQ ID NO: 4220 - protein, 17 aa, Homo sapiens
  Heavy chain CDR3 for antibody 2110 (IGHV4-39)
ARQGWYYGSGSSLLFDY

SEQ ID NO: 4221 - protein, 9 aa, Homo sapiens
  Light chain CDR3 for antibody 2111 (IGKV1-39)
QQSYSTPLT

SEQ ID NO: 4222 - protein, 17 aa, Homo sapiens
  Heavy chain CDR3 for antibody 2111 (IGHV3-33)
ARGEQWLGYYYYYGMDV

SEQ ID NO: 4223 - protein, 9 aa, Homo sapiens
  Light chain CDR3 for antibody 2112 (IGKV6-21)
HQSSSLPYT

SEQ ID NO: 4224 - protein, 17 aa, Homo sapiens
  Heavy chain CDR3 for antibody 2112 (IGHV3-33)
ARDLIGPLSSSWYPFDY

SEQ ID NO: 4225 - protein, 9 aa, Homo sapiens
  Light chain CDR3 for antibody 2113 (IGKV2D-28)
MQVLQTPFT

SEQ ID NO: 4226 - protein, 18 aa, Homo sapiens
  Heavy chain CDR3 for antibody 2113 (IGHV4-59)
AREGDYVWGSYRPNWFDP

SEQ ID NO: 4227 - protein, 9 aa, Homo sapiens
  Light chain CDR3 for antibody 2114 (IGKV5-2)
LQHDNFPWT

SEQ ID NO: 4228 - protein, 12 aa, Homo sapiens
  Heavy chain CDR3 for antibody 2114 (IGHV4-39)
ARREVILGAFDY

SEQ ID NO: 4229 - protein, 9 aa, Homo sapiens
  Light chain CDR3 for antibody 2115 (IGKV1D-16)
QQYNSYPYT

SEQ ID NO: 4230 - protein, 9 aa, Homo sapiens
  Heavy chain CDR3 for antibody 2115 (IGHV1-18)
ARGGWGFEY

SEQ ID NO: 4231 - protein, 9 aa, Homo sapiens
  Light chain CDR3 for antibody 2116 (IGKV6-21)
HQSSSLPYT

SEQ ID NO: 4232 - protein, 14 aa, Homo sapiens
  Heavy chain CDR3 for antibody 2116 (IGHV1-46)
ARDGVGAKEGGFDY

SEQ ID NO: 4233 - protein, 9 aa, Homo sapiens
  Light chain CDR3 for antibody 2117 (IGKV1-39)
QQSYSTPLT

SEQ ID NO: 4234 - protein, 10 aa, Homo sapiens
  Heavy chain CDR3 for antibody 2117 (IGHV3-23)
AKEQWLVLDY

SEQ ID NO: 4235 - protein, 9 aa, Homo sapiens
  Light chain CDR3 for antibody 2118 (IGKV1-6)
LQDYNYPYT

SEQ ID NO: 4236 - protein, 12 aa, Homo sapiens
  Heavy chain CDR3 for antibody 2118 (IGHV3-33)
ARGGIAVDVCDI

SEQ ID NO: 4237 - protein, 9 aa, Homo sapiens
  Light chain CDR3 for antibody 2119 (IGKV6-21)
HQSSSLPYT

SEQ ID NO: 4238 - protein, 13 aa, Homo sapiens
  Heavy chain CDR3 for antibody 2119 (IGHV1-2)
ARDGVRGSFGMDV

SEQ ID NO: 4239 - protein, 9 aa, Homo sapiens
  Light chain CDR3 for antibody 2120 (IGKV1D-16)
QQYNSYPLT

SEQ ID NO: 4240 - protein, 19 aa, Homo sapiens
  Heavy chain CDR3 for antibody 2120 (IGHV3-23)
AKDGRSGSYDYYYYYGMDV

SEQ ID NO: 4241 - protein, 9 aa, Homo sapiens
  Light chain CDR3 for antibody 2121 (IGKV1D-16)
QQYNSYPYT

SEQ ID NO: 4242 - protein, 12 aa, Homo sapiens
  Heavy chain CDR3 for antibody 2121 (IGHV4-39)
ARHGSGSSYFDY

SEQ ID NO: 4243 - protein, 9 aa, Homo sapiens
  Light chain CDR3 for antibody 2122 (IGKV5-2)
LQHDNFPWT

SEQ ID NO: 4244 - protein, 17 aa, Homo sapiens
  Heavy chain CDR3 for antibody 2122 (IGHV4-59)
AREGADSGIYYHWYFDL

SEQ ID NO: 4245 - protein, 9 aa, Homo sapiens
  Light chain CDR3 for antibody 2123 (IGKV3-20)
QQYGSSPYT

SEQ ID NO: 4246 - protein, 17 aa, Homo sapiens
  Heavy chain CDR3 for antibody 2123 (IGHV4-59)
AREGADSGIYYHWYFDL

SEQ ID NO: 4247 - protein, 9 aa, Homo sapiens
  Light chain CDR3 for antibody 2124 (IGKV2-30)
MQGTHWPLT

SEQ ID NO: 4248 - protein, 12 aa, Homo sapiens
  Heavy chain CDR3 for antibody 2124 (IGHV1-18)
ARILFYGDYFDY

SEQ ID NO: 4249 - protein, 9 aa, Homo sapiens
  Light chain CDR3 for antibody 2125 (IGKV1-39)
QQSYSTPLT

SEQ ID NO: 4250 - protein, 19 aa, Homo sapiens
  Heavy chain CDR3 for antibody 2125 (IGHV1-18)
ARDDILTGYSLYYYYGMDV

SEQ ID NO: 4251 - protein, 9 aa, Homo sapiens
  Light chain CDR3 for antibody 2126 (IGKV1-17)
LQHNSYPYT

SEQ ID NO: 4252 - protein, 18 aa, Homo sapiens
  Heavy chain CDR3 for antibody 2126 (IGHV3-23)
AKVGDFFASGNYWDYFDY

SEQ ID NO: 4253 - protein, 9 aa, Homo sapiens
  Light chain CDR3 for antibody 2127 (IGKV6-21)
HQSSSLPYT

SEQ ID NO: 4254 - protein, 13 aa, Homo sapiens
  Heavy chain CDR3 for antibody 2127 (IGHV3-23)
AKDRGGSYSYFDF

SEQ ID NO: 4255 - protein, 9 aa, Homo sapiens
  Light chain CDR3 for antibody 2128 (IGKV5-2)
LQHDNFPYT

SEQ ID NO: 4256 - protein, 13 aa, Homo sapiens
  Heavy chain CDR3 for antibody 2128 (IGHV3-33)
ARQSSGWFDAFDI

SEQ ID NO: 4257 - protein, 9 aa, Homo sapiens
  Light chain CDR3 for antibody 2129 (IGKV3D-7)
QQDYNLPYT

SEQ ID NO: 4258 - protein, 14 aa, Homo sapiens
  Heavy chain CDR3 for antibody 2129 (IGHV4-39)
ARRGVIVPAAGFDP

SEQ ID NO: 4259 - protein, 9 aa, Homo sapiens
  Light chain CDR3 for antibody 2130 (IGKV3-20)
QQYGSSPYT

SEQ ID NO: 4260 - protein, 19 aa, Homo sapiens
  Heavy chain CDR3 for antibody 2130 (IGHV3-33)
AREDYYGSGSYYNEDWFDP

SEQ ID NO: 4261 - protein, 9 aa, Homo sapiens
  Light chain CDR3 for antibody 2131 (IGKV1-6)
QQEYNYPLT

SEQ ID NO: 4262 - protein, 12 aa, Homo sapiens
  Heavy chain CDR3 for antibody 2131 (IGHV1-46)
ARGLTGDHAVDI

SEQ ID NO: 4263 - protein, 9 aa, Homo sapiens
  Light chain CDR3 for antibody 2132 (IGKV6-21)
HQSSSLPYT

SEQ ID NO: 4264 - protein, 20 aa, Homo sapiens
  Heavy chain CDR3 for antibody 2132 (IGHV1-18)
AREVGIAVAGTLYYYYGMDV

SEQ ID NO: 4265 - protein, 9 aa, Homo sapiens
  Light chain CDR3 for antibody 2133 (IGKV5-2)
LQHDNFPYT

SEQ ID NO: 4266 - protein, 7 aa, Homo sapiens
  Heavy chain CDR3 for antibody 2133 (IGHV3-33)
ARELVDY

SEQ ID NO: 4267 - protein, 9 aa, Homo sapiens
  Light chain CDR3 for antibody 2134 (IGKV1D-16)
QQYNSYPYT

SEQ ID NO: 4268 - protein, 14 aa, Homo sapiens
  Heavy chain CDR3 for antibody 2134 (IGHV3-20)
ARDRGSSFFDAFDI

SEQ ID NO: 4269 - protein, 9 aa, Homo sapiens
  Light chain CDR3 for antibody 2135 (IGKV1D-13)
QQFNNYPHT

SEQ ID NO: 4270 - protein, 17 aa, Homo sapiens
  Heavy chain CDR3 for antibody 2135 (IGHV3-33)
VREGGLLWVGELSLFDY

SEQ ID NO: 4271 - protein, 9 aa, Homo sapiens
  Light chain CDR3 for antibody 2136 (IGKV1-39)
QQSYSTPLT

SEQ ID NO: 4272 - protein, 18 aa, Homo sapiens
  Heavy chain CDR3 for antibody 2136 (IGHV3-33)
ARDRYYDILTGYYMGFDY

SEQ ID NO: 4273 - protein, 9 aa, Homo sapiens
  Light chain CDR3 for antibody 2137 (IGKV5-2)
LQHDNFPWT

SEQ ID NO: 4274 - protein, 21 aa, Homo sapiens
  Heavy chain CDR3 for antibody 2137 (IGHV4-59)
AAGVLLWFGEPNYYYYYGMDV

SEQ ID NO: 4275 - protein, 9 aa, Homo sapiens
  Light chain CDR3 for antibody 2138 (IGKV1D-17)
LQHNSYPYT

SEQ ID NO: 4276 - protein, 18 aa, Homo sapiens
  Heavy chain CDR3 for antibody 2138 (IGHV3-23)
AKDLYYYGSGSYYPVFDY

SEQ ID NO: 4277 - protein, 9 aa, Homo sapiens
  Light chain CDR3 for antibody 2139 (IGKV1D-16)
QQYYSYPRT

SEQ ID NO: 4278 - protein, 13 aa, Homo sapiens
  Heavy chain CDR3 for antibody 2139 (IGHV4-34)
ASNFYYYYYGMDV

SEQ ID NO: 4279 - protein, 9 aa, Homo sapiens
  Light chain CDR3 for antibody 2140 (IGKV3-20)
QQYGSSPYT

SEQ ID NO: 4280 - protein, 13 aa, Homo sapiens
  Heavy chain CDR3 for antibody 2140 (IGHV3-33)
VSTGDSYYYVMDV

SEQ ID NO: 4281 - protein, 9 aa, Homo sapiens
  Light chain CDR3 for antibody 2141 (IGKV3-11)
QQRSNWPYT

SEQ ID NO: 4282 - protein, 13 aa, Homo sapiens
  Heavy chain CDR3 for antibody 2141 (IGHV3-33)
ARDQRYSSGWYDY

SEQ ID NO: 4283 - protein, 9 aa, Homo sapiens
  Light chain CDR3 for antibody 2142 (IGKV1-27)
QKYNSAPYT

SEQ ID NO: 4284 - protein, 12 aa, Homo sapiens
  Heavy chain CDR3 for antibody 2142 (IGHV3-33)
ASEYFGSGSAHY

SEQ ID NO: 4285 - protein, 9 aa, Homo sapiens
  Light chain CDR3 for antibody 2143 (IGKV1-16)
QQYNSYPYT

SEQ ID NO: 4286 - protein, 15 aa, Homo sapiens
  Heavy chain CDR3 for antibody 2143 (IGHV4-39)
ARHSGYSSGWYPFDY

SEQ ID NO: 4287 - protein, 9 aa, Homo sapiens
  Light chain CDR3 for antibody 2144 (IGKV3D-7)
QQDYEFPIT

SEQ ID NO: 4288 - protein, 13 aa, Homo sapiens
  Heavy chain CDR3 for antibody 2144 (IGHV4-59)
ARDAGYSSSWFDY

SEQ ID NO: 4289 - protein, 9 aa, Homo sapiens
  Light chain CDR3 for antibody 2145 (IGKV3-20)
QQYGGSLFT

SEQ ID NO: 4290 - protein, 13 aa, Homo sapiens
  Heavy chain CDR3 for antibody 2145 (IGHV3-33)
TRTDYYFYYGMDV

SEQ ID NO: 4291 - protein, 9 aa, Homo sapiens
  Light chain CDR3 for antibody 2146 (IGKV3-11)
QQRSNWPWT

SEQ ID NO: 4292 - protein, 18 aa, Homo sapiens
  Heavy chain CDR3 for antibody 2146 (IGHV4-59)
AREGHYYTSGSYYKAFDY

SEQ ID NO: 4293 - protein, 8 aa, Homo sapiens
  Light chain CDR3 for antibody 2147 (IGKV6-21)
HQSSSLPT

SEQ ID NO: 4294 - protein, 16 aa, Homo sapiens
  Heavy chain CDR3 for antibody 2147 (IGHV3-23)
AKEGMVLRYFDWLWDY

SEQ ID NO: 4295 - protein, 7 aa, Homo sapiens
  Light chain CDR3 for antibody 2148 (IGKV1-5)
QQYNTWT

SEQ ID NO: 4296 - protein, 12 aa, Homo sapiens
  Heavy chain CDR3 for antibody 2148 (IGHV3-74)
ARDKGGRNGMDV

SEQ ID NO: 4297 - protein, 9 aa, Homo sapiens
  Light chain CDR3 for antibody 2149 (IGKV1D-13)
QQFNNYPYT

SEQ ID NO: 4298 - protein, 18 aa, Homo sapiens
  Heavy chain CDR3 for antibody 2149 (IGHV3-33)
AREGYDILTGDYRLGFDY

SEQ ID NO: 4299 - protein, 9 aa, Homo sapiens
  Light chain CDR3 for antibody 2150 (IGKV1-39)
QQSYRTPLT

SEQ ID NO: 4300 - protein, 14 aa, Homo sapiens
  Heavy chain CDR3 for antibody 2150 (IGHV1-46)
ARRGIVGALDAFDI

SEQ ID NO: 4301 - protein, 9 aa, Homo sapiens
  Light chain CDR3 for antibody 2151 (IGKV3-15)
QQYNNWPLT

SEQ ID NO: 4302 - protein, 9 aa, Homo sapiens
  Heavy chain CDR3 for antibody 2151 (IGHV1-18)
ARGKDWFDP

SEQ ID NO: 4303 - protein, 9 aa, Homo sapiens
  Light chain CDR3 for antibody 2152 (IGKV1D-16)
QQYNSYPLT

SEQ ID NO: 4304 - protein, 19 aa, Homo sapiens
  Heavy chain CDR3 for antibody 2152 (IGHV3-33)
AREDYYGSGSYYNEDWFDP

SEQ ID NO: 4305 - protein, 9 aa, Homo sapiens
  Light chain CDR3 for antibody 2153 (IGKV1-39)
QQSYRTPLT

SEQ ID NO: 4306 - protein, 17 aa, Homo sapiens
  Heavy chain CDR3 for antibody 2153 (IGHV3-23)
AKDGIGELSYYYYGMDV

SEQ ID NO: 4307 - protein, 9 aa, Homo sapiens
  Light chain CDR3 for antibody 2154 (IGKV1D-16)
QQYITYPYT

SEQ ID NO: 4308 - protein, 17 aa, Homo sapiens
  Heavy chain CDR3 for antibody 2154 (IGHV3-64)
ARERYYGSGSYYNWFDP

SEQ ID NO: 4309 - protein, 9 aa, Homo sapiens
  Light chain CDR3 for antibody 2155 (IGKV1-27)
QKYNSAPYT

SEQ ID NO: 4310 - protein, 16 aa, Homo sapiens
  Heavy chain CDR3 for antibody 2155 (IGHV3-33)
ARAVYYGSGSSLIMDV

SEQ ID NO: 4311 - protein, 9 aa, Homo sapiens
  Light chain CDR3 for antibody 2156 (IGKV2-30)
MQGTHWPLT

SEQ ID NO: 4312 - protein, 12 aa, Homo sapiens
  Heavy chain CDR3 for antibody 2156 (IGHV1-46)
ARGLTGDHAVDI

SEQ ID NO: 4313 - protein, 9 aa, Homo sapiens
  Light chain CDR3 for antibody 2157 (IGKV1-17)
LQHNSYPYT

SEQ ID NO: 4314 - protein, 12 aa, Homo sapiens
  Heavy chain CDR3 for antibody 2157 (IGHV3-33)
ARDLVRGIRMDV

SEQ ID NO: 4315 - protein, 9 aa, Homo sapiens
  Light chain CDR3 for antibody 2158 (IGKV5-2)
LQHDNFPYT

SEQ ID NO: 4316 - protein, 17 aa, Homo sapiens
  Heavy chain CDR3 for antibody 2158 (IGHV3-33)
ARGDGDILTGYYEWFDP

SEQ ID NO: 4317 - protein, 9 aa, Homo sapiens
  Light chain CDR3 for antibody 2159 (IGKV1-39)
QQSYSTPLT

SEQ ID NO: 4318 - protein, 12 aa, Homo sapiens
  Heavy chain CDR3 for antibody 2159 (IGHV3-33)
AREGDILTGYSL

SEQ ID NO: 4319 - protein, 9 aa, Homo sapiens
  Light chain CDR3 for antibody 2160 (IGKV5-2)
LQHDNFPWT

SEQ ID NO: 4320 - protein, 13 aa, Homo sapiens
  Heavy chain CDR3 for antibody 2160 (IGHV3-23)
ASTGDSYYYGMDV

SEQ ID NO: 4321 - protein, 9 aa, Homo sapiens
  Light chain CDR3 for antibody 2161 (IGKV1-39)
QQSYSTPLT

SEQ ID NO: 4322 - protein, 21 aa, Homo sapiens
  Heavy chain CDR3 for antibody 2161 (IGHV3-33)
ARKRLYDILTGYYKAYYGMDV

SEQ ID NO: 4323 - protein, 9 aa, Homo sapiens
  Light chain CDR3 for antibody 2162 (IGKV1-17)
LQHNSYPYT

SEQ ID NO: 4324 - protein, 19 aa, Homo sapiens
  Heavy chain CDR3 for antibody 2162 (IGHV4-59)
ARDRVVGATTYYYYYGMDV

SEQ ID NO: 4325 - protein, 9 aa, Homo sapiens
  Light chain CDR3 for antibody 2163 (IGKV1D-13)
QQFNNYPHT

SEQ ID NO: 4326 - protein, 15 aa, Homo sapiens
  Heavy chain CDR3 for antibody 2163 (IGHV1-18)
ARGYCSSTSCYYFDY

SEQ ID NO: 4327 - protein, 9 aa, Homo sapiens
  Light chain CDR3 for antibody 2164 (IGKV6-21)
HQSSSLPYT

SEQ ID NO: 4328 - protein, 14 aa, Homo sapiens
  Heavy chain CDR3 for antibody 2164 (IGHV3-33)
ARRGYSGYDWYFDY

SEQ ID NO: 4329 - protein, 9 aa, Homo sapiens
  Light chain CDR3 for antibody 2165 (IGKV1-27)
QKYNSAPYT

SEQ ID NO: 4330 - protein, 12 aa, Homo sapiens
  Heavy chain CDR3 for antibody 2165 (IGHV3-33)
AREGDILTGYSL

SEQ ID NO: 4331 - protein, 9 aa, Homo sapiens
  Light chain CDR3 for antibody 2166 (IGKV1-27)
QKYNSAPYT

SEQ ID NO: 4332 - protein, 16 aa, Homo sapiens
  Heavy chain CDR3 for antibody 2166 (IGHV4-59)
ARGRYFEWLLGDVFDI

SEQ ID NO: 4333 - protein, 9 aa, Homo sapiens
  Light chain CDR3 for antibody 2167 (IGKV1D-16)
QQYNSYPLT

SEQ ID NO: 4334 - protein, 18 aa, Homo sapiens
  Heavy chain CDR3 for antibody 2167 (IGHV3-33)
ARDQGIVVLPGAPWYFDP

SEQ ID NO: 4335 - protein, 9 aa, Homo sapiens
  Light chain CDR3 for antibody 2168 (IGKV5-2)
LQHDNFPWT

SEQ ID NO: 4336 - protein, 11 aa, Homo sapiens
  Heavy chain CDR3 for antibody 2168 (IGHV4-59)
ARETGDDAFDI

SEQ ID NO: 4337 - protein, 9 aa, Homo sapiens
  Light chain CDR3 for antibody 2169 (IGKV3-11)
QQRSNWPYT

SEQ ID NO: 4338 - protein, 13 aa, Homo sapiens
  Heavy chain CDR3 for antibody 2169 (IGHV3-33)
ARDWGYSHGYFDY

SEQ ID NO: 4339 - protein, 9 aa, Homo sapiens
  Light chain CDR3 for antibody 2170 (IGKV5-2)
LQHDKFPYT

SEQ ID NO: 4340 - protein, 14 aa, Homo sapiens
  Heavy chain CDR3 for antibody 2170 (IGHV3-33)
ARAISGSSYWYFDL

SEQ ID NO: 4341 - protein, 9 aa, Homo sapiens
  Light chain CDR3 for antibody 2171 (IGKV1-17)
LQHNSYPYT

SEQ ID NO: 4342 - protein, 17 aa, Homo sapiens
  Heavy chain CDR3 for antibody 2171 (IGHV3-33)
AREGYYYGSGSYHFFDY

SEQ ID NO: 4343 - protein, 9 aa, Homo sapiens
  Light chain CDR3 for antibody 2172 (IGKV5-2)
LQHDNFPWT

SEQ ID NO: 4344 - protein, 16 aa, Homo sapiens
  Heavy chain CDR3 for antibody 2172 (IGHV1-18)
ARYFDWLLRDYYGMDV

SEQ ID NO: 4345 - protein, 9 aa, Homo sapiens
  Light chain CDR3 for antibody 2173 (IGKV1D-13)
QQFNNYPHT

SEQ ID NO: 4346 - protein, 16 aa, Homo sapiens
  Heavy chain CDR3 for antibody 2173 (IGHV3-23)
AKEGEVLRYFDWLFNY

SEQ ID NO: 4347 - protein, 9 aa, Homo sapiens
  Light chain CDR3 for antibody 2174 (IGKV3D-7)
QQDYNLPLT

SEQ ID NO: 4348 - protein, 13 aa, Homo sapiens
  Heavy chain CDR3 for antibody 2174 (IGHV3-33)
ARDQRYSSGWYDY

SEQ ID NO: 4349 - protein, 9 aa, Homo sapiens
  Light chain CDR3 for antibody 2175 (IGKV1-6)
LQDYNYPWT

SEQ ID NO: 4350 - protein, 6 aa, Homo sapiens
  Heavy chain CDR3 for antibody 2175 (IGHV3-33)
AREGDY

SEQ ID NO: 4351 - protein, 9 aa, Homo sapiens
  Light chain CDR3 for antibody 2176 (IGKV1-39)
QQSYSTPLT

SEQ ID NO: 4352 - protein, 18 aa, Homo sapiens
  Heavy chain CDR3 for antibody 2176 (IGHV3-33)
ARGLLWFGVSYYYYGMDV

SEQ ID NO: 4353 - protein, 9 aa, Homo sapiens
  Light chain CDR3 for antibody 2177 (IGKV3-20)
QQYGSSPYT

SEQ ID NO: 4354 - protein, 17 aa, Homo sapiens
  Heavy chain CDR3 for antibody 2177 (IGHV3-33)
ARVRGVIEGYYYYGMDV

SEQ ID NO: 4355 - protein, 9 aa, Homo sapiens
  Light chain CDR3 for antibody 2178 (IGKV1-39)
QQSYSTPLT

SEQ ID NO: 4356 - protein, 12 aa, Homo sapiens
  Heavy chain CDR3 for antibody 2178 (IGHV4-39)
ARQMVREGWFDP

SEQ ID NO: 4357 - protein, 9 aa, Homo sapiens
  Light chain CDR3 for antibody 2179 (IGKV1D-13)
QQFNNYPYT

SEQ ID NO: 4358 - protein, 10 aa, Homo sapiens
  Heavy chain CDR3 for antibody 2179 (IGHV3-33)
ARDVVVYFDY

SEQ ID NO: 4359 - protein, 9 aa, Homo sapiens
  Light chain CDR3 for antibody 2180 (IGKV1-17)
LQHNSYPYT

SEQ ID NO: 4360 - protein, 14 aa, Homo sapiens
  Heavy chain CDR3 for antibody 2180 (IGHV3-33)
AREGYSSGWDYFDH

SEQ ID NO: 4361 - protein, 9 aa, Homo sapiens
  Light chain CDR3 for antibody 2181 (IGKV3D-20)
QQYGSSPYT

SEQ ID NO: 4362 - protein, 16 aa, Homo sapiens
  Heavy chain CDR3 for antibody 2181 (IGHV3-33)
ARDGSMVRRIHDAFDF

SEQ ID NO: 4363 - protein, 9 aa, Homo sapiens
  Light chain CDR3 for antibody 2182 (IGKV1-6)
LQDYNYPWT

SEQ ID NO: 4364 - protein, 13 aa, Homo sapiens
  Heavy chain CDR3 for antibody 2182 (IGHV3-23)
AKERLRYFDWLAY

SEQ ID NO: 4365 - protein, 9 aa, Homo sapiens
  Light chain CDR3 for antibody 2183 (IGKV6-21)
HQSSSLPYT

SEQ ID NO: 4366 - protein, 18 aa, Homo sapiens
  Heavy chain CDR3 for antibody 2183 (IGHV3-30)
ARDRHHDILTGYSDAFEI

SEQ ID NO: 4367 - protein, 9 aa, Homo sapiens
  Light chain CDR3 for antibody 2184 (IGKV6-21)
HQSSSLPLT

SEQ ID NO: 4368 - protein, 18 aa, Homo sapiens
  Heavy chain CDR3 for antibody 2184 (IGHV4-59)
ASMVRGVIMAYDYYGMDV

SEQ ID NO: 4369 - protein, 9 aa, Homo sapiens
  Light chain CDR3 for antibody 2185 (IGKV1D-13)
QQFNNYPYT

SEQ ID NO: 4370 - protein, 21 aa, Homo sapiens
  Heavy chain CDR3 for antibody 2185 (IGHV3-23)
AKDIDYYGSGSYPLYYYGMDV

SEQ ID NO: 4371 - protein, 9 aa, Homo sapiens
  Light chain CDR3 for antibody 2186 (IGKV1-39)
QQSYRTPLT

SEQ ID NO: 4372 - protein, 13 aa, Homo sapiens
  Heavy chain CDR3 for antibody 2186 (IGHV3-11)
ARTDYYFYYGLDV

SEQ ID NO: 4373 - protein, 9 aa, Homo sapiens
  Light chain CDR3 for antibody 2187 (IGKV6-21)
HQSSSLPYT

SEQ ID NO: 4374 - protein, 18 aa, Homo sapiens
  Heavy chain CDR3 for antibody 2187 (IGHV1-18)
ARDRYYYDSGSYYYGMDV

SEQ ID NO: 4375 - protein, 9 aa, Homo sapiens
  Light chain CDR3 for antibody 2188 (IGKV3-20)
QLYGSSPYT

SEQ ID NO: 4376 - protein, 13 aa, Homo sapiens
  Heavy chain CDR3 for antibody 2188 (IGHV3-33)
ARTDYYYYYGLDA

SEQ ID NO: 4377 - protein, 11 aa, Homo sapiens
  Light chain CDR3 for antibody 2189 (IGKV3-11)
QQRSNWPPTWT

SEQ ID NO: 4378 - protein, 18 aa, Homo sapiens
  Heavy chain CDR3 for antibody 2189 (IGHV4-59)
AREGHYYTSGSYYKAFDY

SEQ ID NO: 4379 - protein, 9 aa, Homo sapiens
  Light chain CDR3 for antibody 2190 (IGKV1-6)
LQDYNYPRT

SEQ ID NO: 4380 - protein, 18 aa, Homo sapiens
  Heavy chain CDR3 for antibody 2190 (IGHV4-59)
AREGHYYRSGTYYKAFDY

SEQ ID NO: 4381 - protein, 9 aa, Homo sapiens
  Light chain CDR3 for antibody 2191 (IGKV1-39)
QQSYSTPLT

SEQ ID NO: 4382 - protein, 17 aa, Homo sapiens
  Heavy chain CDR3 for antibody 2191 (IGHV3-33)
ARVYYDILTGYSPAFDI

SEQ ID NO: 4383 - protein, 9 aa, Homo sapiens
  Light chain CDR3 for antibody 2192 (IGKV1-9)
QQYNSYPLT

SEQ ID NO: 4384 - protein, 14 aa, Homo sapiens
  Heavy chain CDR3 for antibody 2192 (IGHV3-20)
ARDGGSTSFDWFDP

SEQ ID NO: 4385 - protein, 9 aa, Homo sapiens
  Light chain CDR3 for antibody 2193 (IGKV5-2)
LQHDNFPYT

SEQ ID NO: 4386 - protein, 18 aa, Homo sapiens
  Heavy chain CDR3 for antibody 2193 (IGHV3-33)
VRDRERYGSGSYPDAFDI

SEQ ID NO: 4387 - protein, 9 aa, Homo sapiens
  Light chain CDR3 for antibody 2194 (IGKV1-9)
QQLNSYPLT

SEQ ID NO: 4388 - protein, 11 aa, Homo sapiens
  Heavy chain CDR3 for antibody 2194 (IGHV3-33)
ARAGIAALFDY

SEQ ID NO: 4389 - protein, 9 aa, Homo sapiens
  Light chain CDR3 for antibody 2195 (IGKV5-2)
LQHDNFPWT

SEQ ID NO: 4390 - protein, 17 aa, Homo sapiens
  Heavy chain CDR3 for antibody 2195 (IGHV4-59)
ARDRELLWFGEFGGMDV

SEQ ID NO: 4391 - protein, 9 aa, Homo sapiens
  Light chain CDR3 for antibody 2196 (IGKV1-39)
QQSYSTPYT

SEQ ID NO: 4392 - protein, 10 aa, Homo sapiens
  Heavy chain CDR3 for antibody 2196 (IGHV3-23)
ANSGNYYFDY

SEQ ID NO: 4393 - protein, 9 aa, Homo sapiens
  Light chain CDR3 for antibody 2197 (IGKV1-17)
LQHNSYPYT

SEQ ID NO: 4394 - protein, 12 aa, Homo sapiens
  Heavy chain CDR3 for antibody 2197 (IGHV1-18)
ARVLFDGDYFDY

SEQ ID NO: 4395 - protein, 9 aa, Homo sapiens
  Light chain CDR3 for antibody 2198 (IGKV1-27)
QKYNSAPYT

SEQ ID NO: 4396 - protein, 17 aa, Homo sapiens
  Heavy chain CDR3 for antibody 2198 (IGHV3-33)
ARVYYDILTGYSPAFDI

SEQ ID NO: 4397 - protein, 8 aa, Homo sapiens
  Light chain CDR3 for antibody 2199 (IGKV1-5)
QQYNSYYT

SEQ ID NO: 4398 - protein, 15 aa, Homo sapiens
  Heavy chain CDR3 for antibody 2199 (IGHV3-20)
ARDRGSSGWRDWFDP

SEQ ID NO: 4399 - protein, 9 aa, Homo sapiens
  Light chain CDR3 for antibody 2200 (IGKV5-2)
LQHDNFPWT

SEQ ID NO: 4400 - protein, 13 aa, Homo sapiens
  Heavy chain CDR3 for antibody 2200 (IGHV3-33)
ARIDYYSYYGMDV

SEQ ID NO: 4401 - protein, 9 aa, Homo sapiens
  Light chain CDR3 for antibody 2201 (IGKV3-20)
QQYGSSPYT

SEQ ID NO: 4402 - protein, 13 aa, Homo sapiens
  Heavy chain CDR3 for antibody 2201 (IGHV3-23)
AKDRGYSSTSTAY

SEQ ID NO: 4403 - protein, 8 aa, Homo sapiens
  Light chain CDR3 for antibody 2202 (IGKV1-5)
QQYNSYWT

SEQ ID NO: 4404 - protein, 13 aa, Homo sapiens
  Heavy chain CDR3 for antibody 2202 (IGHV3-33)
ARDYCGGDCYLDY

SEQ ID NO: 4405 - protein, 9 aa, Homo sapiens
  Light chain CDR3 for antibody 2203 (IGKV1D-13)
QQFNNYPHT

SEQ ID NO: 4406 - protein, 17 aa, Homo sapiens
  Heavy chain CDR3 for antibody 2203 (IGHV3-33)
ARAYYDILTGYSYYFDY

SEQ ID NO: 4407 - protein, 9 aa, Homo sapiens
  Light chain CDR3 for antibody 2204 (IGKV1-17)
LQHNSYPYT

SEQ ID NO: 4408 - protein, 15 aa, Homo sapiens
  Heavy chain CDR3 for antibody 2204 (IGHV3-33)
ARDEHYDILTGYWGY

SEQ ID NO: 4409 - protein, 9 aa, Homo sapiens
  Light chain CDR3 for antibody 2205 (IGKV3-20)
QQYGSSPYT

SEQ ID NO: 4410 - protein, 11 aa, Homo sapiens
  Heavy chain CDR3 for antibody 2205 (IGHV3-23)
AKGLWSYYFDY

SEQ ID NO: 4411 - protein, 9 aa, Homo sapiens
  Light chain CDR3 for antibody 2206 (IGKV3-20)
QQYGSSPLT

SEQ ID NO: 4412 - protein, 9 aa, Homo sapiens
  Heavy chain CDR3 for antibody 2206 (IGHV1-8)
ARGPRIMDV

SEQ ID NO: 4413 - protein, 9 aa, Homo sapiens
  Light chain CDR3 for antibody 2207 (IGKV3D-20)
QQYGSSPYT

SEQ ID NO: 4414 - protein, 13 aa, Homo sapiens
  Heavy chain CDR3 for antibody 2207 (IGHV3-23)
ASTGDSYYYGMDV

SEQ ID NO: 4415 - protein, 9 aa, Homo sapiens
  Light chain CDR3 for antibody 2208 (IGKV1D-16)
QQYNSYPYT

SEQ ID NO: 4416 - protein, 10 aa, Homo sapiens
  Heavy chain CDR3 for antibody 2208 (IGHV3-23)
AKDQVGATDC

SEQ ID NO: 4417 - protein, 9 aa, Homo sapiens
  Light chain CDR3 for antibody 2209 (IGKV1-6)
LQDYNYPYT

SEQ ID NO: 4418 - protein, 13 aa, Homo sapiens
  Heavy chain CDR3 for antibody 2209 (IGHV4-39)
ARRDGGYYGYFDY

SEQ ID NO: 4419 - protein, 9 aa, Homo sapiens
  Light chain CDR3 for antibody 2210 (IGKV3-20)
QQYGSSPRT

SEQ ID NO: 4420 - protein, 17 aa, Homo sapiens
  Heavy chain CDR3 for antibody 2210 (IGHV1-18)
ARERYYGSGIYKYAMDV

SEQ ID NO: 4421 - protein, 9 aa, Homo sapiens
  Light chain CDR3 for antibody 2211 (IGKV6-21)
HQSSSLPYT

SEQ ID NO: 4422 - protein, 17 aa, Homo sapiens
  Heavy chain CDR3 for antibody 2211 (IGHV3-23)
AKDYDILTGYSHNWFDP

SEQ ID NO: 4423 - protein, 9 aa, Homo sapiens
  Light chain CDR3 for antibody 2212 (IGKV5-2)
LQHDNFPYT

SEQ ID NO: 4424 - protein, 8 aa, Homo sapiens
  Heavy chain CDR3 for antibody 2212 (IGHV3-33)
ARDRGFDY

SEQ ID NO: 4425 - protein, 9 aa, Homo sapiens
  Light chain CDR3 for antibody 2213 (IGKV6-21)
HQSSSLPYT

SEQ ID NO: 4426 - protein, 18 aa, Homo sapiens
  Heavy chain CDR3 for antibody 2213 (IGHV3-33)
ARDEYYGSGIYYNYGMDV

SEQ ID NO: 4427 - protein, 9 aa, Homo sapiens
  Light chain CDR3 for antibody 2214 (IGKV1D-16)
QQYNSYPLT

SEQ ID NO: 4428 - protein, 12 aa, Homo sapiens
  Heavy chain CDR3 for antibody 2214 (IGHV3-33)
ARKQWLVQAFDI

SEQ ID NO: 4429 - protein, 9 aa, Homo sapiens
  Light chain CDR3 for antibody 2215 (IGKV3-20)
QQYGSSPYT

SEQ ID NO: 4430 - protein, 17 aa, Homo sapiens
  Heavy chain CDR3 for antibody 2215 (IGHV3-33)
ARGGAAAGPYLYYGLDV

SEQ ID NO: 4431 - protein, 9 aa, Homo sapiens
  Light chain CDR3 for antibody 2216 (IGKV6-21)
HQSFGLPYT

SEQ ID NO: 4432 - protein, 13 aa, Homo sapiens
  Heavy chain CDR3 for antibody 2216 (IGHV3-11)
AREGIAVAGDFDH

SEQ ID NO: 4433 - protein, 9 aa, Homo sapiens
  Light chain CDR3 for antibody 2217 (IGKV1-6)
LQDYNYALT

SEQ ID NO: 4434 - protein, 17 aa, Homo sapiens
  Heavy chain CDR3 for antibody 2217 (IGHV3-49)
ARRVTLVRVPIKNWFDP

SEQ ID NO: 4435 - protein, 9 aa, Homo sapiens
  Light chain CDR3 for antibody 2218 (IGKV1-33)
QQYDNLPFT

SEQ ID NO: 4436 - protein, 15 aa, Homo sapiens
  Heavy chain CDR3 for antibody 2218 (IGHV3-30)
ARGAMVRGVDYGMDV

SEQ ID NO: 4437 - protein, 9 aa, Homo sapiens
  Light chain CDR3 for antibody 2219 (IGKV1-39)
QQSYRTPLT

SEQ ID NO: 4438 - protein, 15 aa, Homo sapiens
  Heavy chain CDR3 for antibody 2219 (IGHV3-33)
ARRGYNDYDPYGMDV

SEQ ID NO: 4439 - protein, 9 aa, Homo sapiens
  Light chain CDR3 for antibody 2220 (IGKV1-16)
QQYNSYPYT

SEQ ID NO: 4440 - protein, 16 aa, Homo sapiens
  Heavy chain CDR3 for antibody 2220 (IGHV4-59)
AGGSGSYRDYYYGMDV

SEQ ID NO: 4441 - protein, 9 aa, Homo sapiens
  Light chain CDR3 for antibody 2221 (IGKV1-6)
LQDYNYPYT

SEQ ID NO: 4442 - protein, 13 aa, Homo sapiens
  Heavy chain CDR3 for antibody 2221 (IGHV1-18)
ARGGGVRGAPLDY

SEQ ID NO: 4443 - protein, 9 aa, Homo sapiens
  Light chain CDR3 for antibody 2222 (IGKV1-6)
LQDYNYPRT

SEQ ID NO: 4444 - protein, 16 aa, Homo sapiens
  Heavy chain CDR3 for antibody 2222 (IGHV3-33)
ARGFSGYDGYYYGMDV

SEQ ID NO: 4445 - protein, 9 aa, Homo sapiens
  Light chain CDR3 for antibody 2223 (IGKV3D-7)
QQDYNLPLT

SEQ ID NO: 4446 - protein, 15 aa, Homo sapiens
  Heavy chain CDR3 for antibody 2223 (IGHV3-20)
ARDRGSSGWRDWFDP

SEQ ID NO: 4447 - protein, 10 aa, Homo sapiens
  Light chain CDR3 for antibody 2224 (IGKV1-39)
QQSYSTPMYT

SEQ ID NO: 4448 - protein, 13 aa, Homo sapiens
  Heavy chain CDR3 for antibody 2224 (IGHV3-33)
ARDWGYSHGYFDY

SEQ ID NO: 4449 - protein, 9 aa, Homo sapiens
  Light chain CDR3 for antibody 2225 (IGKV5-2)
LQHDNFPWT

SEQ ID NO: 4450 - protein, 14 aa, Homo sapiens
  Heavy chain CDR3 for antibody 2225 (IGHV1-18)
ARCFGSGSYGWFDP

SEQ ID NO: 4451 - protein, 9 aa, Homo sapiens
  Light chain CDR3 for antibody 2226 (IGKV2-30)
MQGTHWPLT

SEQ ID NO: 4452 - protein, 13 aa, Homo sapiens
  Heavy chain CDR3 for antibody 2226 (IGHV3-33)
ARAFTMVRGVIDY

SEQ ID NO: 4453 - protein, 9 aa, Homo sapiens
  Light chain CDR3 for antibody 2227 (IGKV1-27)
QKYNSAPYT

SEQ ID NO: 4454 - protein, 15 aa, Homo sapiens
  Heavy chain CDR3 for antibody 2227 (IGHV3-33)
VCVLYDYGDYVGFDY

SEQ ID NO: 4455 - protein, 9 aa, Homo sapiens
  Light chain CDR3 for antibody 2228 (IGKV3-15)
QQYNNWPLT

SEQ ID NO: 4456 - protein, 17 aa, Homo sapiens
  Heavy chain CDR3 for antibody 2228 (IGHV4-59)
ARDFLVRGEGSYYGMDV

SEQ ID NO: 4457 - protein, 9 aa, Homo sapiens
  Light chain CDR3 for antibody 2229 (IGKV5-2)
LQHDNFPYT

SEQ ID NO: 4458 - protein, 13 aa, Homo sapiens
  Heavy chain CDR3 for antibody 2229 (IGHV3-33)
AREYCSGGSCYDY

SEQ ID NO: 4459 - protein, 9 aa, Homo sapiens
  Light chain CDR3 for antibody 2230 (IGKV1D-16)
QQYNSYPYT

SEQ ID NO: 4460 - protein, 13 aa, Homo sapiens
  Heavy chain CDR3 for antibody 2230 (IGHV3-33)
ARDGYSYGPYFDY

SEQ ID NO: 4461 - protein, 9 aa, Homo sapiens
  Light chain CDR3 for antibody 2231 (IGKV3-15)
QQYNNWPLT

SEQ ID NO: 4462 - protein, 17 aa, Homo sapiens
  Heavy chain CDR3 for antibody 2231 (IGHV1-18)
ARDEGYDILTGYPHFDY

SEQ ID NO: 4463 - protein, 9 aa, Homo sapiens
  Light chain CDR3 for antibody 2232 (IGKV1-39)
QQSYSTPYT

SEQ ID NO: 4464 - protein, 12 aa, Homo sapiens
  Heavy chain CDR3 for antibody 2232 (IGHV3-23)
AGGDFWGGNPLY

SEQ ID NO: 4465 - protein, 10 aa, Homo sapiens
  Light chain CDR3 for antibody 2233 (IGKV3-11)
QQRSNWPIFT

SEQ ID NO: 4466 - protein, 12 aa, Homo sapiens
  Heavy chain CDR3 for antibody 2233 (IGHV4-61)
ARVYSSGWLFDY

SEQ ID NO: 4467 - protein, 9 aa, Homo sapiens
  Light chain CDR3 for antibody 2234 (IGKV1-6)
LQDYNYPYT

SEQ ID NO: 4468 - protein, 12 aa, Homo sapiens
  Heavy chain CDR3 for antibody 2234 (IGHV3-23)
AKESLYTPTDDY

SEQ ID NO: 4469 - protein, 9 aa, Homo sapiens
  Light chain CDR3 for antibody 2235 (IGKV1D-16)
QQYNSYPYT

SEQ ID NO: 4470 - protein, 12 aa, Homo sapiens
  Heavy chain CDR3 for antibody 2235 (IGHV3-13)
AIGTMVRGIPDY

SEQ ID NO: 4471 - protein, 9 aa, Homo sapiens
  Light chain CDR3 for antibody 2236 (IGKV1D-16)
QQYNSYPLT

SEQ ID NO: 4472 - protein, 17 aa, Homo sapiens
  Heavy chain CDR3 for antibody 2236 (IGHV3-33)
ARDWFGELSDYYYGMDV

SEQ ID NO: 4473 - protein, 9 aa, Homo sapiens
  Light chain CDR3 for antibody 2237 (IGKV1-9)
QQLKSYLYT

SEQ ID NO: 4474 - protein, 12 aa, Homo sapiens
  Heavy chain CDR3 for antibody 2237 (IGHV1-46)
ARGLTGDHAVDI

SEQ ID NO: 4475 - protein, 9 aa, Homo sapiens
  Light chain CDR3 for antibody 2238 (IGKV5-2)
LQHDNFPWT

SEQ ID NO: 4476 - protein, 14 aa, Homo sapiens
  Heavy chain CDR3 for antibody 2238 (IGHV1-46)
ARDGVGAKEGGFDY

SEQ ID NO: 4477 - protein, 9 aa, Homo sapiens
  Light chain CDR3 for antibody 2239 (IGKV1D-16)
QQYNSYPLT

SEQ ID NO: 4478 - protein, 15 aa, Homo sapiens
  Heavy chain CDR3 for antibody 2239 (IGHV3-33)
ARDGSGSYSLYGMDV

SEQ ID NO: 4479 - protein, 9 aa, Homo sapiens
  Light chain CDR3 for antibody 2240 (IGKV3D-20)
QQYGSSPYT

SEQ ID NO: 4480 - protein, 17 aa, Homo sapiens
  Heavy chain CDR3 for antibody 2240 (IGHV3-23)
AKDTITMVRGALFGMDV

SEQ ID NO: 4481 - protein, 9 aa, Homo sapiens
  Light chain CDR3 for antibody 2241 (IGKV6-21)
HQSSSLPYT

SEQ ID NO: 4482 - protein, 10 aa, Homo sapiens
  Heavy chain CDR3 for antibody 2241 (IGHV3-30)
AREWYGGMDV

SEQ ID NO: 4483 - protein, 9 aa, Homo sapiens
  Light chain CDR3 for antibody 2242 (IGKV5-2)
LQHDNFPWT

SEQ ID NO: 4484 - protein, 10 aa, Homo sapiens
  Heavy chain CDR3 for antibody 2242 (IGHV4-39)
ARQLGNWFDP

SEQ ID NO: 4485 - protein, 9 aa, Homo sapiens
  Light chain CDR3 for antibody 2243 (IGKV1-39)
QQSYSTPLT

SEQ ID NO: 4486 - protein, 20 aa, Homo sapiens
  Heavy chain CDR3 for antibody 2243 (IGHV3-23)
AKDREMAATSHYYYYYGMDV

SEQ ID NO: 4487 - protein, 9 aa, Homo sapiens
  Light chain CDR3 for antibody 2244 (IGKV1-6)
LQDYNYPYT

SEQ ID NO: 4488 - protein, 15 aa, Homo sapiens
  Heavy chain CDR3 for antibody 2244 (IGHV3-33)
ARDRGMVRGDGYLDY

SEQ ID NO: 4489 - protein, 9 aa, Homo sapiens
  Light chain CDR3 for antibody 2245 (IGKV3D-7)
QQDYNLPLT

SEQ ID NO: 4490 - protein, 17 aa, Homo sapiens
  Heavy chain CDR3 for antibody 2245 (IGHV3-33)
ARGYCSRTSCYLYYFDY

SEQ ID NO: 4491 - protein, 9 aa, Homo sapiens
  Light chain CDR3 for antibody 2246 (IGKV3-20)
QQYGSSPYT

SEQ ID NO: 4492 - protein, 16 aa, Homo sapiens
  Heavy chain CDR3 for antibody 2246 (IGHV4-59)
ARFYFGSGSYYWYFDL

SEQ ID NO: 4493 - protein, 9 aa, Homo sapiens
  Light chain CDR3 for antibody 2247 (IGKV1D-16)
QQYNSYPYT

SEQ ID NO: 4494 - protein, 14 aa, Homo sapiens
  Heavy chain CDR3 for antibody 2247 (IGHV3-20)
ARDGGSGSYDGLDV

SEQ ID NO: 4495 - protein, 9 aa, Homo sapiens
  Light chain CDR3 for antibody 2248 (IGKV1-6)
QQEYNYPLT

SEQ ID NO: 4496 - protein, 18 aa, Homo sapiens
  Heavy chain CDR3 for antibody 2248 (IGHV1-46)
ARDGDYVWGSYRSDWFDP

SEQ ID NO: 4497 - protein, 9 aa, Homo sapiens
  Light chain CDR3 for antibody 2249 (IGKV1-6)
LQDYNYPWT

SEQ ID NO: 4498 - protein, 18 aa, Homo sapiens
  Heavy chain CDR3 for antibody 2249 (IGHV4-59)
AREGHYYTSGSYYKAFDY

SEQ ID NO: 4499 - protein, 9 aa, Homo sapiens
  Light chain CDR3 for antibody 2250 (IGKV1-9)
QQLNSYPLT

SEQ ID NO: 4500 - protein, 16 aa, Homo sapiens
  Heavy chain CDR3 for antibody 2250 (IGHV3-33)
ARGYDMLTGDYYGMDV

SEQ ID NO: 4501 - protein, 9 aa, Homo sapiens
  Light chain CDR3 for antibody 2251 (IGKV6-21)
HQSSSLPYT

SEQ ID NO: 4502 - protein, 19 aa, Homo sapiens
  Heavy chain CDR3 for antibody 2251 (IGHV3-33)
ARDSGYSGYDYYYYYGMDV

SEQ ID NO: 4503 - protein, 9 aa, Homo sapiens
  Light chain CDR3 for antibody 2252 (IGKV6-21)
HQSSSLPYT

SEQ ID NO: 4504 - protein, 17 aa, Homo sapiens
  Heavy chain CDR3 for antibody 2252 (IGHV3-23)
AKEYCSGGSCYVYYFDY

SEQ ID NO: 4505 - protein, 9 aa, Homo sapiens
  Light chain CDR3 for antibody 2253 (IGKV3-15)
QQYNNWPLT

SEQ ID NO: 4506 - protein, 15 aa, Homo sapiens
  Heavy chain CDR3 for antibody 2253 (IGHV3-20)
ARDRGSSGWRDWFDP

SEQ ID NO: 4507 - protein, 8 aa, Homo sapiens
  Light chain CDR3 for antibody 2254 (IGKV1-5)
QQYNSYYT

SEQ ID NO: 4508 - protein, 17 aa, Homo sapiens
  Heavy chain CDR3 for antibody 2254 (IGHV1-18)
ARDRAFTMVRGVPPFDY

SEQ ID NO: 4509 - protein, 9 aa, Homo sapiens
  Light chain CDR3 for antibody 2255 (IGKV6-21)
HQSSSLPYT

SEQ ID NO: 4510 - protein, 15 aa, Homo sapiens
  Heavy chain CDR3 for antibody 2255 (IGHV3-23)
AKDRDYDFLSGPFDY

SEQ ID NO: 4511 - protein, 10 aa, Homo sapiens
  Light chain CDR3 for antibody 2256 (IGKV3-11)
QQRSNWPIFT

SEQ ID NO: 4512 - protein, 15 aa, Homo sapiens
  Heavy chain CDR3 for antibody 2256 (IGHV3-20)
ARDRGSSGWRDWFDP

SEQ ID NO: 4513 - protein, 9 aa, Homo sapiens
  Light chain CDR3 for antibody 2257 (IGKV1-27)
QKYNSAPYT

SEQ ID NO: 4514 - protein, 18 aa, Homo sapiens
  Heavy chain CDR3 for antibody 2257 (IGHV4-59)
AREGHYYTSGSYYKAFDY

SEQ ID NO: 4515 - protein, 9 aa, Homo sapiens
  Light chain CDR3 for antibody 2258 (IGKV1-39)
QQSYSTPLT

SEQ ID NO: 4516 - protein, 12 aa, Homo sapiens
  Heavy chain CDR3 for antibody 2258 (IGHV1-24)
ASDWAYYYGMDV

SEQ ID NO: 4517 - protein, 9 aa, Homo sapiens
  Light chain CDR3 for antibody 2259 (IGKV1-6)
LQDYNYPYT

SEQ ID NO: 4518 - protein, 17 aa, Homo sapiens
  Heavy chain CDR3 for antibody 2259 (IGHV1-24)
ATHYGSGSHYKGYGMDV

SEQ ID NO: 4519 - protein, 9 aa, Homo sapiens
  Light chain CDR3 for antibody 2260 (IGKV2-30)
MQGTHWPLT

SEQ ID NO: 4520 - protein, 17 aa, Homo sapiens
  Heavy chain CDR3 for antibody 2260 (IGHV3-33)
ARGYCSRTSCYLYYFDY

SEQ ID NO: 4521 - protein, 9 aa, Homo sapiens
  Light chain CDR3 for antibody 2261 (IGKV6-21)
HQSSSLPYT

SEQ ID NO: 4522 - protein, 15 aa, Homo sapiens
  Heavy chain CDR3 for antibody 2261 (IGHV3-74)
ARGSGSHYHYYGMDV

SEQ ID NO: 4523 - protein, 9 aa, Homo sapiens
  Light chain CDR3 for antibody 2262 (IGKV1-17)
LQHNSYPYT

SEQ ID NO: 4524 - protein, 17 aa, Homo sapiens
  Heavy chain CDR3 for antibody 2262 (IGHV3-23)
AKDTITMVRGALFGMDV

SEQ ID NO: 4525 - protein, 9 aa, Homo sapiens
  Light chain CDR3 for antibody 2263 (IGKV1D-13)
QQFNNYPYT

SEQ ID NO: 4526 - protein, 12 aa, Homo sapiens
  Heavy chain CDR3 for antibody 2263 (IGHV4-61)
ARVYSSGWLFDY

SEQ ID NO: 4527 - protein, 8 aa, Homo sapiens
  Light chain CDR3 for antibody 2264 (IGKV1D-13)
QQFNNYPT

SEQ ID NO: 4528 - protein, 14 aa, Homo sapiens
  Heavy chain CDR3 for antibody 2264 (IGHV3-33)
ARGAAAGNFYGLDV

SEQ ID NO: 4529 - protein, 9 aa, Homo sapiens
  Light chain CDR3 for antibody 2265 (IGKV5-2)
LQHDNFPWT

SEQ ID NO: 4530 - protein, 15 aa, Homo sapiens
  Heavy chain CDR3 for antibody 2265 (IGHV1-24)
ATHWDLRYYYYGMDV

SEQ ID NO: 4531 - protein, 9 aa, Homo sapiens
  Light chain CDR3 for antibody 2266 (IGKV6-21)
HQSSSLPYT

SEQ ID NO: 4532 - protein, 17 aa, Homo sapiens
  Heavy chain CDR3 for antibody 2266 (IGHV3-33)
ARGGAAAGPYLYYGLDV

SEQ ID NO: 4533 - protein, 9 aa, Homo sapiens
  Light chain CDR3 for antibody 2267 (IGKV1-39)
QQSYRTPLT

SEQ ID NO: 4534 - protein, 18 aa, Homo sapiens
  Heavy chain CDR3 for antibody 2267 (IGHV1-46)
ARDGDYVWGSYRSDWFDP

SEQ ID NO: 4535 - protein, 9 aa, Homo sapiens
  Light chain CDR3 for antibody 2268 (IGKV1D-13)
QQFNNYPHT

SEQ ID NO: 4536 - protein, 13 aa, Homo sapiens
  Heavy chain CDR3 for antibody 2268 (IGHV3-33)
ARRATLVRGVFDP

SEQ ID NO: 4537 - protein, 9 aa, Homo sapiens
  Light chain CDR3 for antibody 2269 (IGKV1D-16)
QQYNSYPLT

SEQ ID NO: 4538 - protein, 16 aa, Homo sapiens
  Heavy chain CDR3 for antibody 2269 (IGHV3-23)
AKEGEVLRYFDWLFNY

SEQ ID NO: 4539 - protein, 9 aa, Homo sapiens
  Light chain CDR3 for antibody 2270 (IGKV5-2)
LQHDNFPWT

SEQ ID NO: 4540 - protein, 13 aa, Homo sapiens
  Heavy chain CDR3 for antibody 2270 (IGHV1-18)
ARSITMVRGVIGY

SEQ ID NO: 4541 - protein, 10 aa, Homo sapiens
  Light chain CDR3 for antibody 2271 (IGKV1-39)
QQSYSTPMYT

SEQ ID NO: 4542 - protein, 16 aa, Homo sapiens
  Heavy chain CDR3 for antibody 2271 (IGHV3-23)
AKEGMVLRYFDWLWDY

SEQ ID NO: 4543 - protein, 9 aa, Homo sapiens
  Light chain CDR3 for antibody 2272 (IGKV5-2)
LQHDNFPWT

SEQ ID NO: 4544 - protein, 15 aa, Homo sapiens
  Heavy chain CDR3 for antibody 2272 (IGHV4-39)
ARQGLVATIKGYFQH

SEQ ID NO: 4545 - protein, 9 aa, Homo sapiens
  Light chain CDR3 for antibody 2273 (IGKV6-21)
HQSSSLPYT

SEQ ID NO: 4546 - protein, 13 aa, Homo sapiens
  Heavy chain CDR3 for antibody 2273 (IGHV3-30)
AAPFMVRGDGMDV

SEQ ID NO: 4547 - protein, 9 aa, Homo sapiens
  Light chain CDR3 for antibody 2274 (IGKV1D-13)
QQFNNYPHT

SEQ ID NO: 4548 - protein, 17 aa, Homo sapiens
  Heavy chain CDR3 for antibody 2274 (IGHV3-23)
AKDGSFYSSGWYDAFDI

SEQ ID NO: 4549 - protein, 8 aa, Homo sapiens
  Light chain CDR3 for antibody 2275 (IGKV3D-7)
QQDYNLLT

SEQ ID NO: 4550 - protein, 18 aa, Homo sapiens
  Heavy chain CDR3 for antibody 2275 (IGHV1-46)
ARDGDYVWGSYRSDWFDP

SEQ ID NO: 4551 - protein, 9 aa, Homo sapiens
  Light chain CDR3 for antibody 2276 (IGKV1-6)
LQDYKSPFT

SEQ ID NO: 4552 - protein, 15 aa, Homo sapiens
  Heavy chain CDR3 for antibody 2276 (IGHV3-30)
ARGAMVRGVDYGMDV

SEQ ID NO: 4553 - protein, 10 aa, Homo sapiens
  Light chain CDR3 for antibody 2277 (IGKV1-39)
QQSYSTPMYT

SEQ ID NO: 4554 - protein, 13 aa, Homo sapiens
  Heavy chain CDR3 for antibody 2277 (IGHV4-59)
ARDAGYSSSWFDY

SEQ ID NO: 4555 - protein, 9 aa, Homo sapiens
  Light chain CDR3 for antibody 2278 (IGKV1-6)
LQDYNYPYT

SEQ ID NO: 4556 - protein, 18 aa, Homo sapiens
  Heavy chain CDR3 for antibody 2278 (IGHV3-23)
AKDGRSGSYDYYYYGMDV

SEQ ID NO: 4557 - protein, 9 aa, Homo sapiens
  Light chain CDR3 for antibody 2279 (IGKV1-6)
LQDYNYPYT

SEQ ID NO: 4558 - protein, 9 aa, Homo sapiens
  Heavy chain CDR3 for antibody 2279 (IGHV3-33)
AANSYGLDY

SEQ ID NO: 4559 - protein, 9 aa, Homo sapiens
  Light chain CDR3 for antibody 2280 (IGKV3D-20)
QQYGSSPYT

SEQ ID NO: 4560 - protein, 12 aa, Homo sapiens
  Heavy chain CDR3 for antibody 2280 (IGHV3-33)
AREGTGGNWFDP

SEQ ID NO: 4561 - protein, 9 aa, Homo sapiens
  Light chain CDR3 for antibody 2281 (IGKV5-2)
LQHDNFPYT

SEQ ID NO: 4562 - protein, 17 aa, Homo sapiens
  Heavy chain CDR3 for antibody 2281 (IGHV3-33)
ARDWFGELSDYYYGMDV

SEQ ID NO: 4563 - protein, 9 aa, Homo sapiens
  Light chain CDR3 for antibody 2282 (IGKV3D-7)
QQDYTLPLT

SEQ ID NO: 4564 - protein, 11 aa, Homo sapiens
  Heavy chain CDR3 for antibody 2282 (IGHV4-59)
ARSIRYSVFDY

SEQ ID NO: 4565 - protein, 9 aa, Homo sapiens
  Light chain CDR3 for antibody 2283 (IGKV3-11)
QQRSNWPYT

SEQ ID NO: 4566 - protein, 12 aa, Homo sapiens
  Heavy chain CDR3 for antibody 2283 (IGHV3-33)
TRGYSSKSYFDY

SEQ ID NO: 4567 - protein, 9 aa, Homo sapiens
  Light chain CDR3 for antibody 2284 (IGKV1D-16)
QQYNSYPLT

SEQ ID NO: 4568 - protein, 11 aa, Homo sapiens
  Heavy chain CDR3 for antibody 2284 (IGHV3-23)
AKEGTYFDIPH

SEQ ID NO: 4569 - protein, 9 aa, Homo sapiens
  Light chain CDR3 for antibody 2285 (IGKV1D-16)
QQYNSYPLT

SEQ ID NO: 4570 - protein, 18 aa, Homo sapiens
  Heavy chain CDR3 for antibody 2285 (IGHV3-33)
ARDGRISLVRGIIDAFDI

SEQ ID NO: 4571 - protein, 9 aa, Homo sapiens
  Light chain CDR3 for antibody 2286 (IGKV1-6)
LQDYNYPWT

SEQ ID NO: 4572 - protein, 15 aa, Homo sapiens
  Heavy chain CDR3 for antibody 2286 (IGHV3-64)
ARDGLRYFDWLFPWY

SEQ ID NO: 4573 - protein, 9 aa, Homo sapiens
  Light chain CDR3 for antibody 2287 (IGKV6-21)
HQSSSLPYT

SEQ ID NO: 4574 - protein, 14 aa, Homo sapiens
  Heavy chain CDR3 for antibody 2287 (IGHV1-2)
ARDYYGSGNYYMGY

SEQ ID NO: 4575 - protein, 9 aa, Homo sapiens
  Light chain CDR3 for antibody 2288 (IGKV1-17)
LQHNSYPLT

SEQ ID NO: 4576 - protein, 12 aa, Homo sapiens
  Heavy chain CDR3 for antibody 2288 (IGHV3-33)
ARAAAGTPSLDY

SEQ ID NO: 4577 - protein, 9 aa, Homo sapiens
  Light chain CDR3 for antibody 2289 (IGKV3D-20)
QQYGSSPYT

SEQ ID NO: 4578 - protein, 17 aa, Homo sapiens
  Heavy chain CDR3 for antibody 2289 (IGHV3-23)
AKGNYGSGSYYNGDFQH

SEQ ID NO: 4579 - protein, 11 aa, Homo sapiens
  Light chain CDR3 for antibody 2290 (IGKV3-11)
QQRSNWPPTWT

SEQ ID NO: 4580 - protein, 16 aa, Homo sapiens
  Heavy chain CDR3 for antibody 2290 (IGHV4-59)
ARGRYFEWLLGDVFDI

SEQ ID NO: 4581 - protein, 10 aa, Homo sapiens
  Light chain CDR3 for antibody 2291 (IGKV1-17)
LQHNSYPMYT

SEQ ID NO: 4582 - protein, 15 aa, Homo sapiens
  Heavy chain CDR3 for antibody 2291 (IGHV3-30)
ARGAMVRGVDYGMDV

SEQ ID NO: 4583 - protein, 9 aa, Homo sapiens
  Light chain CDR3 for antibody 2292 (IGKV3-20)
QQYGSSPRT

SEQ ID NO: 4584 - protein, 9 aa, Homo sapiens
  Heavy chain CDR3 for antibody 2292 (IGHV3-13)
ARDHWYFDL

SEQ ID NO: 4585 - protein, 9 aa, Homo sapiens
  Light chain CDR3 for antibody 2293 (IGKV5-2)
LQHDNFPYT

SEQ ID NO: 4586 - protein, 12 aa, Homo sapiens
  Heavy chain CDR3 for antibody 2293 (IGHV3-23)
AKEGIVGVPFDY

SEQ ID NO: 4587 - protein, 9 aa, Homo sapiens
  Light chain CDR3 for antibody 2294 (IGKV1D-13)
QQFNNYPYT

SEQ ID NO: 4588 - protein, 10 aa, Homo sapiens
  Heavy chain CDR3 for antibody 2294 (IGHV3-23)
AKEQWLVLDY

SEQ ID NO: 4589 - protein, 9 aa, Homo sapiens
  Light chain CDR3 for antibody 2295 (IGKV6-21)
HQSSSLPYT

SEQ ID NO: 4590 - protein, 18 aa, Homo sapiens
  Heavy chain CDR3 for antibody 2295 (IGHV6-1)
ARDQYSYGPYYYYYGMDV

SEQ ID NO: 4591 - protein, 9 aa, Homo sapiens
  Light chain CDR3 for antibody 2296 (IGKV5-2)
LQHDNFPYT

SEQ ID NO: 4592 - protein, 18 aa, Homo sapiens
  Heavy chain CDR3 for antibody 2296 (IGHV3-33)
ARDEYYGSGIYYNYGMDV

SEQ ID NO: 4593 - protein, 8 aa, Homo sapiens
  Light chain CDR3 for antibody 2297 (IGKV1D-13)
QQFNNYYT

SEQ ID NO: 4594 - protein, 17 aa, Homo sapiens
  Heavy chain CDR3 for antibody 2297 (IGHV1-18)
ARDEGYDILTGYPHFDY

SEQ ID NO: 4595 - protein, 9 aa, Homo sapiens
  Light chain CDR3 for antibody 2298 (IGKV1-6)
LQDYNYPWT

SEQ ID NO: 4596 - protein, 11 aa, Homo sapiens
  Heavy chain CDR3 for antibody 2298 (IGHV4-59)
ARETGDDAFDI

SEQ ID NO: 4597 - protein, 9 aa, Homo sapiens
  Light chain CDR3 for antibody 2299 (IGKV1-6)
LQDYNYPYT

SEQ ID NO: 4598 - protein, 15 aa, Homo sapiens
  Heavy chain CDR3 for antibody 2299 (IGHV3-23)
AKDGFYYGSGSSFDH

SEQ ID NO: 4599 - protein, 9 aa, Homo sapiens
  Light chain CDR3 for antibody 2300 (IGKV1D-16)
QQYNSYPYT

SEQ ID NO: 4600 - protein, 20 aa, Homo sapiens
  Heavy chain CDR3 for antibody 2300 (IGHV3-23)
AKDRETGTTSYHYYYYGMDV

SEQ ID NO: 4601 - protein, 9 aa, Homo sapiens
  Light chain CDR3 for antibody 2301 (IGKV1-17)
LQHNSYPYT

SEQ ID NO: 4602 - protein, 11 aa, Homo sapiens
  Heavy chain CDR3 for antibody 2301 (IGHV1-24)
ATYFGSGSLDY

SEQ ID NO: 4603 - protein, 9 aa, Homo sapiens
  Light chain CDR3 for antibody 2302 (IGKV6-21)
HQSSSLPYT

SEQ ID NO: 4604 - protein, 12 aa, Homo sapiens
  Heavy chain CDR3 for antibody 2302 (IGHV3-23)
AKESLYTPTDDY

SEQ ID NO: 4605 - protein, 9 aa, Homo sapiens
  Light chain CDR3 for antibody 2303 (IGKV6-21)
HQSSSLPYT

SEQ ID NO: 4606 - protein, 17 aa, Homo sapiens
  Heavy chain CDR3 for antibody 2303 (IGHV3-23)
AKDRPVTTLYYYFGMDV

SEQ ID NO: 4607 - protein, 9 aa, Homo sapiens
  Light chain CDR3 for antibody 2304 (IGKV1-39)
QQSYSTPLT

SEQ ID NO: 4608 - protein, 13 aa, Homo sapiens
  Heavy chain CDR3 for antibody 2304 (IGHV1-2)
ARDGVRGSFGMDV

SEQ ID NO: 4609 - protein, 9 aa, Homo sapiens
  Light chain CDR3 for antibody 2305 (IGKV1-17)
LQHNSYPWT

SEQ ID NO: 4610 - protein, 14 aa, Homo sapiens
  Heavy chain CDR3 for antibody 2305 (IGHV3-20)
ARDGGSTCYDWFDP

SEQ ID NO: 4611 - protein, 9 aa, Homo sapiens
  Light chain CDR3 for antibody 2306 (IGKV3D-7)
QQDYNLPLT

SEQ ID NO: 4612 - protein, 20 aa, Homo sapiens
  Heavy chain CDR3 for antibody 2306 (IGHV3-20)
ARDLCSSTSCYGYYYYGMDV

SEQ ID NO: 4613 - protein, 9 aa, Homo sapiens
  Light chain CDR3 for antibody 2307 (IGKV6-21)
HQSSSLPYT

SEQ ID NO: 4614 - protein, 10 aa, Homo sapiens
  Heavy chain CDR3 for antibody 2307 (IGHV3-33)
AREWFGGFDI

SEQ ID NO: 4615 - protein, 9 aa, Homo sapiens
  Light chain CDR3 for antibody 2308 (IGKV1-27)
QKYNSAPYT

SEQ ID NO: 4616 - protein, 13 aa, Homo sapiens
  Heavy chain CDR3 for antibody 2308 (IGHV3-33)
ARRYRSGWYPFDY

SEQ ID NO: 4617 - protein, 10 aa, Homo sapiens
  Light chain CDR3 for antibody 2309 (IGKV1-39)
QQSYSTPMYT

SEQ ID NO: 4618 - protein, 13 aa, Homo sapiens
  Heavy chain CDR3 for antibody 2309 (IGHV3-11)
ARDGGAAAGTWDS

SEQ ID NO: 4619 - protein, 9 aa, Homo sapiens
  Light chain CDR3 for antibody 2310 (IGKV3-20)
QQYGSSPYT

SEQ ID NO: 4620 - protein, 13 aa, Homo sapiens
  Heavy chain CDR3 for antibody 2310 (IGHV3-23)
AKDRGGSYSYFDF

SEQ ID NO: 4621 - protein, 9 aa, Homo sapiens
  Light chain CDR3 for antibody 2311 (IGKV2-30)
MQGTHWPLT

SEQ ID NO: 4622 - protein, 17 aa, Homo sapiens
  Heavy chain CDR3 for antibody 2311 (IGHV1-18)
ARDEGYDILTGYPHFDY

SEQ ID NO: 4623 - protein, 9 aa, Homo sapiens
  Light chain CDR3 for antibody 2312 (IGKV3D-20)
QQYGSSPYT

SEQ ID NO: 4624 - protein, 17 aa, Homo sapiens
  Heavy chain CDR3 for antibody 2312 (IGHV3-33)
ARGDGDILTGYYEWFDP

SEQ ID NO: 4625 - protein, 9 aa, Homo sapiens
  Light chain CDR3 for antibody 2313 (IGKV1D-16)
QQYNSYPYT

SEQ ID NO: 4626 - protein, 15 aa, Homo sapiens
  Heavy chain CDR3 for antibody 2313 (IGHV3-33)
ARGYYYGSGSYPLDY

SEQ ID NO: 4627 - protein, 9 aa, Homo sapiens
  Light chain CDR3 for antibody 2314 (IGKV5-2)
LQHDNFPYT

SEQ ID NO: 4628 - protein, 19 aa, Homo sapiens
  Heavy chain CDR3 for antibody 2314 (IGHV3-33)
ARDSGYSGYDYYYYYGMDV

SEQ ID NO: 4629 - protein, 9 aa, Homo sapiens
  Light chain CDR3 for antibody 2315 (IGKV1-27)
QKYNSAPYT

SEQ ID NO: 4630 - protein, 10 aa, Homo sapiens
  Heavy chain CDR3 for antibody 2315 (IGHV3-33)
ARDVVVYFDY

SEQ ID NO: 4631 - protein, 8 aa, Homo sapiens
  Light chain CDR3 for antibody 2316 (IGKV3-11)
QQRSNWLT

SEQ ID NO: 4632 - protein, 12 aa, Homo sapiens
  Heavy chain CDR3 for antibody 2316 (IGHV1-46)
ARGLTGDHAVDI

SEQ ID NO: 4633 - protein, 9 aa, Homo sapiens
  Light chain CDR3 for antibody 2317 (IGKV2-30)
MQGTHWPLT

SEQ ID NO: 4634 - protein, 13 aa, Homo sapiens
  Heavy chain CDR3 for antibody 2317 (IGHV3-33)
ARRATLVRGVFDP

SEQ ID NO: 4635 - protein, 9 aa, Homo sapiens
  Light chain CDR3 for antibody 2318 (IGKV1-27)
QKYNSAPYT

SEQ ID NO: 4636 - protein, 9 aa, Homo sapiens
  Heavy chain CDR3 for antibody 2318 (IGHV3-30)
ARDYFHYDY

SEQ ID NO: 4637 - protein, 9 aa, Homo sapiens
  Light chain CDR3 for antibody 2319 (IGKV1-17)
LQHNSYPYT

SEQ ID NO: 4638 - protein, 19 aa, Homo sapiens
  Heavy chain CDR3 for antibody 2319 (IGHV3-33)
ARDRYYDILTGYSSYYFDY

SEQ ID NO: 4639 - protein, 9 aa, Homo sapiens
  Light chain CDR3 for antibody 2320 (IGKV6-21)
HQSSSLPYT

SEQ ID NO: 4640 - protein, 16 aa, Homo sapiens
  Heavy chain CDR3 for antibody 2320 (IGHV3-30)
ARDIAVAGHVYYGMDV

SEQ ID NO: 4641 - protein, 9 aa, Homo sapiens
  Light chain CDR3 for antibody 2321 (IGKV3D-7)
QQDYNLPLT

SEQ ID NO: 4642 - protein, 18 aa, Homo sapiens
  Heavy chain CDR3 for antibody 2321 (IGHV3-33)
AREIAAAGTKGLYYGMDV

SEQ ID NO: 4643 - protein, 9 aa, Homo sapiens
  Light chain CDR3 for antibody 2322 (IGKV3-20)
QQYGSSPYT

SEQ ID NO: 4644 - protein, 10 aa, Homo sapiens
  Heavy chain CDR3 for antibody 2322 (IGHV3-23)
AKENWNDFDY

SEQ ID NO: 4645 - protein, 8 aa, Homo sapiens
  Light chain CDR3 for antibody 2323 (IGKV3D-7)
QQDYNLLT

SEQ ID NO: 4646 - protein, 12 aa, Homo sapiens
  Heavy chain CDR3 for antibody 2323 (IGHV3-33)
ARGYFGSGYAHF

SEQ ID NO: 4647 - protein, 11 aa, Homo sapiens
  Light chain CDR3 for antibody 2324 (IGKV3-11)
QQRSNWPPTWT

SEQ ID NO: 4648 - protein, 14 aa, Homo sapiens
  Heavy chain CDR3 for antibody 2324 (IGHV4-39)
ARQDYDILTGLFDY

SEQ ID NO: 4649 - protein, 9 aa, Homo sapiens
  Light chain CDR3 for antibody 2325 (IGKV1-6)
LQDYNYPYT

SEQ ID NO: 4650 - protein, 21 aa, Homo sapiens
  Heavy chain CDR3 for antibody 2325 (IGHV1-18)
ASGVLIWFGELLSEDYYDMDV

SEQ ID NO: 4651 - protein, 9 aa, Homo sapiens
  Light chain CDR3 for antibody 2326 (IGKV3-20)
QQYGSSSWT

SEQ ID NO: 4652 - protein, 12 aa, Homo sapiens
  Heavy chain CDR3 for antibody 2326 (IGHV3-30)
ARDFTGHYTSDV

SEQ ID NO: 4653 - protein, 9 aa, Homo sapiens
  Light chain CDR3 for antibody 2327 (IGKV5-2)
LQHDNFPYT

SEQ ID NO: 4654 - protein, 19 aa, Homo sapiens
  Heavy chain CDR3 for antibody 2327 (IGHV3-23)
AKDGRSGSYDYYYYYGMDV

SEQ ID NO: 4655 - protein, 9 aa, Homo sapiens
  Light chain CDR3 for antibody 2328 (IGKV1-39)
QQSYRTPLT

SEQ ID NO: 4656 - protein, 16 aa, Homo sapiens
  Heavy chain CDR3 for antibody 2328 (IGHV1-24)
ATEDSSSTYYYYGLDV

SEQ ID NO: 4657 - protein, 9 aa, Homo sapiens
  Light chain CDR3 for antibody 2329 (IGKV1-9)
QQLNSYPLT

SEQ ID NO: 4658 - protein, 14 aa, Homo sapiens
  Heavy chain CDR3 for antibody 2329 (IGHV3-33)
ARDNILTAYYLFDY

SEQ ID NO: 4659 - protein, 9 aa, Homo sapiens
  Light chain CDR3 for antibody 2330 (IGKV5-2)
LQHDNFPWT

SEQ ID NO: 4660 - protein, 16 aa, Homo sapiens
  Heavy chain CDR3 for antibody 2330 (IGHV4-59)
AGGSGSYRDYYYGMDV

SEQ ID NO: 4661 - protein, 9 aa, Homo sapiens
  Light chain CDR3 for antibody 2331 (IGKV2-30)
MQGTHWPLT

SEQ ID NO: 4662 - protein, 13 aa, Homo sapiens
  Heavy chain CDR3 for antibody 2331 (IGHV3-23)
ASPFNWNDGFFDY

SEQ ID NO: 4663 - protein, 9 aa, Homo sapiens
  Light chain CDR3 for antibody 2332 (IGKV1-39)
QQSYSTPLT

SEQ ID NO: 4664 - protein, 13 aa, Homo sapiens
  Heavy chain CDR3 for antibody 2332 (IGHV4-39)
ARHPPSRDYGMDV

SEQ ID NO: 4665 - protein, 9 aa, Homo sapiens
  Light chain CDR3 for antibody 2333 (IGKV1-9)
QQLKSYPYT

SEQ ID NO: 4666 - protein, 11 aa, Homo sapiens
  Heavy chain CDR3 for antibody 2333 (IGHV3-33)
ARDRSSGPFDY

SEQ ID NO: 4667 - protein, 9 aa, Homo sapiens
  Light chain CDR3 for antibody 2334 (IGKV3D-7)
QQDYNLPYT

SEQ ID NO: 4668 - protein, 13 aa, Homo sapiens
  Heavy chain CDR3 for antibody 2334 (IGHV3-33)
ARAFTMVRGVIDY

SEQ ID NO: 4669 - protein, 9 aa, Homo sapiens
  Light chain CDR3 for antibody 2335 (IGKV5-2)
LQHDNFPYT

SEQ ID NO: 4670 - protein, 13 aa, Homo sapiens
  Heavy chain CDR3 for antibody 2335 (IGHV3-11)
ARDEGYSGYNLDN

SEQ ID NO: 4671 - protein, 9 aa, Homo sapiens
  Light chain CDR3 for antibody 2336 (IGKV1-6)
LQDYNYPHT

SEQ ID NO: 4672 - protein, 16 aa, Homo sapiens
  Heavy chain CDR3 for antibody 2336 (IGHV3-30)
ARDGVGATSYYYGMDV

SEQ ID NO: 4673 - protein, 9 aa, Homo sapiens
  Light chain CDR3 for antibody 2337 (IGKV3-20)
QQYGSSPYT

SEQ ID NO: 4674 - protein, 14 aa, Homo sapiens
  Heavy chain CDR3 for antibody 2337 (IGHV3-33)
AREDYYGPLNWFDP

SEQ ID NO: 4675 - protein, 8 aa, Homo sapiens
  Light chain CDR3 for antibody 2338 (IGKV1-5)
QQYNSYYT

SEQ ID NO: 4676 - protein, 14 aa, Homo sapiens
  Heavy chain CDR3 for antibody 2338 (IGHV3-23)
AKSRIVGALYYFDY

SEQ ID NO: 4677 - protein, 8 aa, Homo sapiens
  Light chain CDR3 for antibody 2339 (IGKV1D-13)
QQFNNYPT

SEQ ID NO: 4678 - protein, 13 aa, Homo sapiens
  Heavy chain CDR3 for antibody 2339 (IGHV4-59)
ARDAGYSSSWFDY

SEQ ID NO: 4679 - protein, 9 aa, Homo sapiens
  Light chain CDR3 for antibody 2340 (IGKV1-6)
LQDYNYPYT

SEQ ID NO: 4680 - protein, 19 aa, Homo sapiens
  Heavy chain CDR3 for antibody 2340 (IGHV3-33)
ARRRDDILTGWDYYFGMDV

SEQ ID NO: 4681 - protein, 9 aa, Homo sapiens
  Light chain CDR3 for antibody 2341 (IGKV1-9)
QQLISYPLT

SEQ ID NO: 4682 - protein, 11 aa, Homo sapiens
  Heavy chain CDR3 for antibody 2341 (IGHV3-33)
ARDRVLTPFDY

SEQ ID NO: 4683 - protein, 9 aa, Homo sapiens
  Light chain CDR3 for antibody 2342 (IGKV5-2)
LQHDNFPYT

SEQ ID NO: 4684 - protein, 11 aa, Homo sapiens
  Heavy chain CDR3 for antibody 2342 (IGHV3-23)
GEFSSGWSFDY

SEQ ID NO: 4685 - protein, 9 aa, Homo sapiens
  Light chain CDR3 for antibody 2343 (IGKV3D-20)
QQYGSSPYT

SEQ ID NO: 4686 - protein, 17 aa, Homo sapiens
  Heavy chain CDR3 for antibody 2343 (IGHV4-34)
ARDGSGSYTHYYYGMDV

SEQ ID NO: 4687 - protein, 9 aa, Homo sapiens
  Light chain CDR3 for antibody 2344 (IGKV1-17)
LQHNSYPYT

SEQ ID NO: 4688 - protein, 16 aa, Homo sapiens
  Heavy chain CDR3 for antibody 2344 (IGHV3-64)
ARGRYFDWLLGDWFDP

SEQ ID NO: 4689 - protein, 9 aa, Homo sapiens
  Light chain CDR3 for antibody 2345 (IGKV2-30)
MQGTHWPLT

SEQ ID NO: 4690 - protein, 14 aa, Homo sapiens
  Heavy chain CDR3 for antibody 2345 (IGHV3-33)
ARDWNDVYYYGMDV

SEQ ID NO: 4691 - protein, 9 aa, Homo sapiens
  Light chain CDR3 for antibody 2346 (IGKV1-39)
QQSYSTPLT

SEQ ID NO: 4692 - protein, 17 aa, Homo sapiens
  Heavy chain CDR3 for antibody 2346 (IGHV3-23)
AKDGSFYSSGWYDAFDI

SEQ ID NO: 4693 - protein, 9 aa, Homo sapiens
  Light chain CDR3 for antibody 2347 (IGKV6-21)
HQSSSLPWT

SEQ ID NO: 4694 - protein, 14 aa, Homo sapiens
  Heavy chain CDR3 for antibody 2347 (IGHV3-23)
AKEDTAMASYYFDY

SEQ ID NO: 4695 - protein, 9 aa, Homo sapiens
  Light chain CDR3 for antibody 2348 (IGKV3-20)
QQYGSSPYT

SEQ ID NO: 4696 - protein, 20 aa, Homo sapiens
  Heavy chain CDR3 for antibody 2348 (IGHV3-33)
ARDWMVRGVIITDYYYGMDV

SEQ ID NO: 4697 - protein, 9 aa, Homo sapiens
  Light chain CDR3 for antibody 2349 (IGKV5-2)
LQHDNFPWT

SEQ ID NO: 4698 - protein, 11 aa, Homo sapiens
  Heavy chain CDR3 for antibody 2349 (IGHV4-59)
ARDGSWEPFDY

SEQ ID NO: 4699 - protein, 9 aa, Homo sapiens
  Light chain CDR3 for antibody 2350 (IGKV3-20)
QQYGSSPYT

SEQ ID NO: 4700 - protein, 17 aa, Homo sapiens
  Heavy chain CDR3 for antibody 2350 (IGHV3-33)
AREDYDILTGYPFYFDY

SEQ ID NO: 4701 - protein, 9 aa, Homo sapiens
  Light chain CDR3 for antibody 2351 (IGKV1D-16)
QQYNSYPYT

SEQ ID NO: 4702 - protein, 13 aa, Homo sapiens
  Heavy chain CDR3 for antibody 2351 (IGHV4-39)
ARRGVVAPAAFDY

SEQ ID NO: 4703 - protein, 9 aa, Homo sapiens
  Light chain CDR3 for antibody 2352 (IGKV1D-16)
QQYNSYPLT

SEQ ID NO: 4704 - protein, 19 aa, Homo sapiens
  Heavy chain CDR3 for antibody 2352 (IGHV1-18)
ARGGHIGVVTAFHGYGMDV

SEQ ID NO: 4705 - protein, 8 aa, Homo sapiens
  Light chain CDR3 for antibody 2353 (IGKV3-20)
QQYGRSFT

SEQ ID NO: 4706 - protein, 11 aa, Homo sapiens
  Heavy chain CDR3 for antibody 2353 (IGHV4-59)
AREMGHDTFDI

SEQ ID NO: 4707 - protein, 9 aa, Homo sapiens
  Light chain CDR3 for antibody 2354 (IGKV1-27)
QKYNSAPYT

SEQ ID NO: 4708 - protein, 13 aa, Homo sapiens
  Heavy chain CDR3 for antibody 2354 (IGHV3-33)
ARTDYYFYYGLDV

SEQ ID NO: 4709 - protein, 9 aa, Homo sapiens
  Light chain CDR3 for antibody 2355 (IGKV3-20)
QQYGSSPLT

SEQ ID NO: 4710 - protein, 14 aa, Homo sapiens
  Heavy chain CDR3 for antibody 2355 (IGHV1-46)
ARDGVGAKEGGFDY

SEQ ID NO: 4711 - protein, 9 aa, Homo sapiens
  Light chain CDR3 for antibody 2356 (IGKV1-9)
QQGNTYSRT

SEQ ID NO: 4712 - protein, 18 aa, Homo sapiens
  Heavy chain CDR3 for antibody 2356 (IGHV4-59)
AREGDYVWGSYRPNWFDP

SEQ ID NO: 4713 - protein, 9 aa, Homo sapiens
  Light chain CDR3 for antibody 2357 (IGKV1D-16)
QQYNSYPYT

SEQ ID NO: 4714 - protein, 14 aa, Homo sapiens
  Heavy chain CDR3 for antibody 2357 (IGHV3-23)
AKGGDVLTGYYPDY

SEQ ID NO: 4715 - protein, 9 aa, Homo sapiens
  Light chain CDR3 for antibody 2358 (IGKV3-20)
QQYGSSPYT

SEQ ID NO: 4716 - protein, 18 aa, Homo sapiens
  Heavy chain CDR3 for antibody 2358 (IGHV3-33)
ARKGGYYSGSGSYRHFDF

SEQ ID NO: 4717 - protein, 9 aa, Homo sapiens
  Light chain CDR3 for antibody 2359 (IGKV1-17)
LQHNSYPLT

SEQ ID NO: 4718 - protein, 14 aa, Homo sapiens
  Heavy chain CDR3 for antibody 2359 (IGHV1-46)
ARKGIVGGFDAFDV

SEQ ID NO: 4719 - protein, 9 aa, Homo sapiens
  Light chain CDR3 for antibody 2360 (IGKV5-2)
LQHDNFPWT

SEQ ID NO: 4720 - protein, 17 aa, Homo sapiens
  Heavy chain CDR3 for antibody 2360 (IGHV4-34)
ARDGSGSYTHYYYGMDV

SEQ ID NO: 4721 - protein, 9 aa, Homo sapiens
  Light chain CDR3 for antibody 2361 (IGKV1-6)
LQDYNYPYT

SEQ ID NO: 4722 - protein, 18 aa, Homo sapiens
  Heavy chain CDR3 for antibody 2361 (IGHV3-33)
AREGYFGSGSYYRNWFDP

SEQ ID NO: 4723 - protein, 9 aa, Homo sapiens
  Light chain CDR3 for antibody 2362 (IGKV1-39)
QQSYSTPLT

SEQ ID NO: 4724 - protein, 11 aa, Homo sapiens
  Heavy chain CDR3 for antibody 2362 (IGHV3-33)
ARDKSSGWSDY

SEQ ID NO: 4725 - protein, 9 aa, Homo sapiens
  Light chain CDR3 for antibody 2363 (IGKV3-20)
QQYGSSPYT

SEQ ID NO: 4726 - protein, 20 aa, Homo sapiens
  Heavy chain CDR3 for antibody 2363 (IGHV1-8)
ARGDGTMVRGIYYYYYGMDV

SEQ ID NO: 4727 - protein, 9 aa, Homo sapiens
  Light chain CDR3 for antibody 2364 (IGKV3-20)
QQFGSSPYT

SEQ ID NO: 4728 - protein, 5 aa, Homo sapiens
  Heavy chain CDR3 for antibody 2364 (IGHV3-33)
ARGGL

SEQ ID NO: 4729 - protein, 11 aa, Homo sapiens
  Light chain CDR3 for antibody 2365 (IGKV3-11)
QQRSNWPPTWT

SEQ ID NO: 4730 - protein, 13 aa, Homo sapiens
  Heavy chain CDR3 for antibody 2365 (IGHV4-39)
ARQWPSGYWYFDL

SEQ ID NO: 4731 - protein, 9 aa, Homo sapiens
  Light chain CDR3 for antibody 2366 (IGKV1D-13)
QQFNNYPYT

SEQ ID NO: 4732 - protein, 20 aa, Homo sapiens
  Heavy chain CDR3 for antibody 2366 (IGHV3-33)
SRGGATLVRGVIDYYYGMDV

SEQ ID NO: 4733 - protein, 9 aa, Homo sapiens
  Light chain CDR3 for antibody 2367 (IGKV3-20)
QQYGSSPYT

SEQ ID NO: 4734 - protein, 15 aa, Homo sapiens
  Heavy chain CDR3 for antibody 2367 (IGHV3-33)
ARDRVVRGVMGYFDY

SEQ ID NO: 4735 - protein, 9 aa, Homo sapiens
  Light chain CDR3 for antibody 2368 (IGKV3-20)
QQYGSSPYT

SEQ ID NO: 4736 - protein, 14 aa, Homo sapiens
  Heavy chain CDR3 for antibody 2368 (IGHV3-20)
ARDEGSGGYDVFDI

SEQ ID NO: 4737 - protein, 9 aa, Homo sapiens
  Light chain CDR3 for antibody 2369 (IGKV2-30)
MQGTHWPLT

SEQ ID NO: 4738 - protein, 11 aa, Homo sapiens
  Heavy chain CDR3 for antibody 2369 (IGHV4-59)
AREMGHDTFDI

SEQ ID NO: 4739 - protein, 9 aa, Homo sapiens
  Light chain CDR3 for antibody 2370 (IGKV6-21)
HQSSSLPYT

SEQ ID NO: 4740 - protein, 10 aa, Homo sapiens
  Heavy chain CDR3 for antibody 2370 (IGHV3-33)
ARNILTPLDY

SEQ ID NO: 4741 - protein, 9 aa, Homo sapiens
  Light chain CDR3 for antibody 2371 (IGKV3-20)
QQYGSSPYT

SEQ ID NO: 4742 - protein, 14 aa, Homo sapiens
  Heavy chain CDR3 for antibody 2371 (IGHV3-33)
ARDTVAAGFNGMDV

SEQ ID NO: 4743 - protein, 9 aa, Homo sapiens
  Light chain CDR3 for antibody 2372 (IGKV1-9)
QQLNSLPRT

SEQ ID NO: 4744 - protein, 14 aa, Homo sapiens
  Heavy chain CDR3 for antibody 2372 (IGHV3-33)
ARDHRDNSYYGMDV

SEQ ID NO: 4745 - protein, 9 aa, Homo sapiens
  Light chain CDR3 for antibody 2373 (IGKV1-17)
QQYNNWPYT

SEQ ID NO: 4746 - protein, 17 aa, Homo sapiens
  Heavy chain CDR3 for antibody 2373 (IGHV4-59)
ARDPVGATKYYYYGMDV

SEQ ID NO: 4747 - protein, 9 aa, Homo sapiens
  Light chain CDR3 for antibody 2374 (IGKV4-1)
QQYYSSPFT

SEQ ID NO: 4748 - protein, 14 aa, Homo sapiens
  Heavy chain CDR3 for antibody 2374 (IGHV3-73)
AASNSSGWLEYFQH

SEQ ID NO: 4749 - protein, 9 aa, Homo sapiens
  Light chain CDR3 for antibody 2375 (IGKV3-20)
QQYGSSPYT

SEQ ID NO: 4750 - protein, 13 aa, Homo sapiens
  Heavy chain CDR3 for antibody 2375 (IGHV3-33)
ASGYSGYDWYFDL

SEQ ID NO: 4751 - protein, 9 aa, Homo sapiens
  Light chain CDR3 for antibody 2376 (IGKV3-20)
QQYGSSPYT

SEQ ID NO: 4752 - protein, 14 aa, Homo sapiens
  Heavy chain CDR3 for antibody 2376 (IGHV3-33)
ARKGYSGRYYYFDY

SEQ ID NO: 4753 - protein, 9 aa, Homo sapiens
  Light chain CDR3 for antibody 2377 (IGKV6-21)
HQSSSLPYT

SEQ ID NO: 4754 - protein, 11 aa, Homo sapiens
  Heavy chain CDR3 for antibody 2377 (IGHV1-46)
AREEDLGAFDI

SEQ ID NO: 4755 - protein, 9 aa, Homo sapiens
  Light chain CDR3 for antibody 2378 (IGKV1D-13)
QQFNNYPHT

SEQ ID NO: 4756 - protein, 15 aa, Homo sapiens
  Heavy chain CDR3 for antibody 2378 (IGHV3-23)
AKEALRYFDWSGMDV

SEQ ID NO: 4757 - protein, 9 aa, Homo sapiens
  Light chain CDR3 for antibody 2379 (IGKV1D-16)
QQYNSYPLT

SEQ ID NO: 4758 - protein, 11 aa, Homo sapiens
  Heavy chain CDR3 for antibody 2379 (IGHV1-46)
AREEDLGAFDI

SEQ ID NO: 4759 - protein, 9 aa, Homo sapiens
  Light chain CDR3 for antibody 2380 (IGKV1D-13)
QRFNNYLYT

SEQ ID NO: 4760 - protein, 15 aa, Homo sapiens
  Heavy chain CDR3 for antibody 2380 (IGHV3-30)
ARGAMVRGVDYGMDV

SEQ ID NO: 4761 - protein, 9 aa, Homo sapiens
  Light chain CDR3 for antibody 2381 (IGKV1-9)
QQYNSYPLT

SEQ ID NO: 4762 - protein, 12 aa, Homo sapiens
  Heavy chain CDR3 for antibody 2381 (IGHV4-59)
ARHPRYLDAFDI

SEQ ID NO: 4763 - protein, 9 aa, Homo sapiens
  Light chain CDR3 for antibody 2382 (IGKV6-21)
HQSSSLPYT

SEQ ID NO: 4764 - protein, 15 aa, Homo sapiens
  Heavy chain CDR3 for antibody 2382 (IGHV3-33)
AKDRNSGYDWGGFDY

SEQ ID NO: 4765 - protein, 9 aa, Homo sapiens
  Light chain CDR3 for antibody 2383 (IGKV3-20)
QQYGSSPYT

SEQ ID NO: 4766 - protein, 18 aa, Homo sapiens
  Heavy chain CDR3 for antibody 2383 (IGHV3-33)
AREGSYYGSGSFPNWFDP

SEQ ID NO: 4767 - protein, 9 aa, Homo sapiens
  Light chain CDR3 for antibody 2384 (IGKV6-21)
HQSSSLPYT

SEQ ID NO: 4768 - protein, 26 aa, Homo sapiens
  Heavy chain CDR3 for antibody 2384 (IGHV4-39)
ARQGLLWFGDLKAYDSSGYYYGYFHH

SEQ ID NO: 4769 - protein, 10 aa, Homo sapiens
  Light chain CDR3 for antibody 2385 (IGKV3-11)
QQRSNWPIFT

SEQ ID NO: 4770 - protein, 14 aa, Homo sapiens
  Heavy chain CDR3 for antibody 2385 (IGHV4-39)
ARQDYDILTGLFDY

SEQ ID NO: 4771 - protein, 9 aa, Homo sapiens
  Light chain CDR3 for antibody 2386 (IGKV3-20)
QQYGSSPLT

SEQ ID NO: 4772 - protein, 17 aa, Homo sapiens
  Heavy chain CDR3 for antibody 2386 (IGHV1-8)
ARGDYYGSGSPYWYFDL

SEQ ID NO: 4773 - protein, 8 aa, Homo sapiens
  Light chain CDR3 for antibody 2387 (IGKV1D-13)
QQFNNYPT

SEQ ID NO: 4774 - protein, 11 aa, Homo sapiens
  Heavy chain CDR3 for antibody 2387 (IGHV3-33)
ARDRVLTPFDY

SEQ ID NO: 4775 - protein, 9 aa, Homo sapiens
  Light chain CDR3 for antibody 2388 (IGKV1-17)
LQHNSYPYT

SEQ ID NO: 4776 - protein, 13 aa, Homo sapiens
  Heavy chain CDR3 for antibody 2388 (IGHV3-11)
ARDEGYRGYVLDN

SEQ ID NO: 4777 - protein, 9 aa, Homo sapiens
  Light chain CDR3 for antibody 2389 (IGKV3-15)
QQYNNWPLT

SEQ ID NO: 4778 - protein, 11 aa, Homo sapiens
  Heavy chain CDR3 for antibody 2389 (IGHV4-59)
ARSIRYSVFDY

SEQ ID NO: 4779 - protein, 9 aa, Homo sapiens
  Light chain CDR3 for antibody 2390 (IGKV1-27)
QKYNSAPYT

SEQ ID NO: 4780 - protein, 17 aa, Homo sapiens
  Heavy chain CDR3 for antibody 2390 (IGHV4-59)
ARDFLVRGEGSYYGMDV

SEQ ID NO: 4781 - protein, 9 aa, Homo sapiens
  Light chain CDR3 for antibody 2391 (IGKV1-27)
QKYNSAPYT

SEQ ID NO: 4782 - protein, 10 aa, Homo sapiens
  Heavy chain CDR3 for antibody 2391 (IGHV3-23)
AKGDRWRFDP

SEQ ID NO: 4783 - protein, 9 aa, Homo sapiens
  Light chain CDR3 for antibody 2392 (IGKV1-39)
QQSYSTPLT

SEQ ID NO: 4784 - protein, 12 aa, Homo sapiens
  Heavy chain CDR3 for antibody 2392 (IGHV3-33)
ASRDILTGYLGY

SEQ ID NO: 4785 - protein, 9 aa, Homo sapiens
  Light chain CDR3 for antibody 2393 (IGKV1D-16)
QQYNSYPLT

SEQ ID NO: 4786 - protein, 17 aa, Homo sapiens
  Heavy chain CDR3 for antibody 2393 (IGHV3-30)
AREGVRGLIYYYYGMDV

SEQ ID NO: 4787 - protein, 9 aa, Homo sapiens
  Light chain CDR3 for antibody 2394 (IGKV6-21)
HQSSSLPYT

SEQ ID NO: 4788 - protein, 15 aa, Homo sapiens
  Heavy chain CDR3 for antibody 2394 (IGHV3-33)
AREGLRYFHYYGMDV

SEQ ID NO: 4789 - protein, 9 aa, Homo sapiens
  Light chain CDR3 for antibody 2395 (IGKV3-20)
QQYGSSPYT

SEQ ID NO: 4790 - protein, 24 aa, Homo sapiens
  Heavy chain CDR3 for antibody 2395 (IGHV1-46)
ARDEARGLLTGYYNMREYYYGMDV

SEQ ID NO: 4791 - protein, 9 aa, Homo sapiens
  Light chain CDR3 for antibody 2396 (IGKV2-30)
MQGTHWPLT

SEQ ID NO: 4792 - protein, 13 aa, Homo sapiens
  Heavy chain CDR3 for antibody 2396 (IGHV3-33)
ARDQRYSSGWYDY

SEQ ID NO: 4793 - protein, 9 aa, Homo sapiens
  Light chain CDR3 for antibody 2397 (IGKV1D-13)
QQFNNYPHT

SEQ ID NO: 4794 - protein, 13 aa, Homo sapiens
  Heavy chain CDR3 for antibody 2397 (IGHV4-39)
ARHVLLWFGEFDP

SEQ ID NO: 4795 - protein, 9 aa, Homo sapiens
  Light chain CDR3 for antibody 2398 (IGKV1-17)
LQHNSYPWT

SEQ ID NO: 4796 - protein, 13 aa, Homo sapiens
  Heavy chain CDR3 for antibody 2398 (IGHV3-21)
ARDSTLVRGVFPY

SEQ ID NO: 4797 - protein, 9 aa, Homo sapiens
  Light chain CDR3 for antibody 2399 (IGKV6-21)
HQSSSLPYT

SEQ ID NO: 4798 - protein, 13 aa, Homo sapiens
  Heavy chain CDR3 for antibody 2399 (IGHV4-39)
ARRDVLAPAAFDY

SEQ ID NO: 4799 - protein, 9 aa, Homo sapiens
  Light chain CDR3 for antibody 2400 (IGKV1-9)
QQLKSYLYT

SEQ ID NO: 4800 - protein, 18 aa, Homo sapiens
  Heavy chain CDR3 for antibody 2400 (IGHV4-59)
AREGDYVWGSYRPNWFDP

SEQ ID NO: 4801 - protein, 9 aa, Homo sapiens
  Light chain CDR3 for antibody 2401 (IGKV5-2)
LQHDNFPWT

SEQ ID NO: 4802 - protein, 19 aa, Homo sapiens
  Heavy chain CDR3 for antibody 2401 (IGHV1-24)
ATAGLQWFGEKIGYYGMDV

SEQ ID NO: 4803 - protein, 9 aa, Homo sapiens
  Light chain CDR3 for antibody 2402 (IGKV1-39)
QQSYSTPLT

SEQ ID NO: 4804 - protein, 15 aa, Homo sapiens
  Heavy chain CDR3 for antibody 2402 (IGHV3-33)
ARDSRPEIIGPPFDY

SEQ ID NO: 4805 - protein, 9 aa, Homo sapiens
  Light chain CDR3 for antibody 2403 (IGKV1-39)
QQSYSTPLT

SEQ ID NO: 4806 - protein, 13 aa, Homo sapiens
  Heavy chain CDR3 for antibody 2403 (IGHV1-46)
ARVKLGSLGAFDI

SEQ ID NO: 4807 - protein, 8 aa, Homo sapiens
  Light chain CDR3 for antibody 2404 (IGKV3-20)
QQYGSSLT

SEQ ID NO: 4808 - protein, 16 aa, Homo sapiens
  Heavy chain CDR3 for antibody 2404 (IGHV3-23)
AKEGMVLRYFDWLWDY

SEQ ID NO: 4809 - protein, 9 aa, Homo sapiens
  Light chain CDR3 for antibody 2405 (IGKV3-20)
QQYGSSPYT

SEQ ID NO: 4810 - protein, 17 aa, Homo sapiens
  Heavy chain CDR3 for antibody 2405 (IGHV3-33)
ARDPARGNVRSFYGLDV

SEQ ID NO: 4811 - protein, 9 aa, Homo sapiens
  Light chain CDR3 for antibody 2406 (IGKV1D-13)
QQFNNYPYT

SEQ ID NO: 4812 - protein, 16 aa, Homo sapiens
  Heavy chain CDR3 for antibody 2406 (IGHV3-33)
ARGDDILTHQYYGVDV

SEQ ID NO: 4813 - protein, 11 aa, Homo sapiens
  Light chain CDR3 for antibody 2407 (IGKV3-11)
QQRSNWPPTWT

SEQ ID NO: 4814 - protein, 13 aa, Homo sapiens
  Heavy chain CDR3 for antibody 2407 (IGHV4-39)
ARREVVGGRGFDY

SEQ ID NO: 4815 - protein, 10 aa, Homo sapiens
  Light chain CDR3 for antibody 2408 (IGKV3-11)
QQRSNWPIFT

SEQ ID NO: 4816 - protein, 18 aa, Homo sapiens
  Heavy chain CDR3 for antibody 2408 (IGHV1-46)
ARDGDYVWGSYRSDWFDP

SEQ ID NO: 4817 - protein, 9 aa, Homo sapiens
  Light chain CDR3 for antibody 2409 (IGKV6-21)
HQSSSLPYT

SEQ ID NO: 4818 - protein, 13 aa, Homo sapiens
  Heavy chain CDR3 for antibody 2409 (IGHV3-23)
AKDRGLRYYGMDV

SEQ ID NO: 4819 - protein, 8 aa, Homo sapiens
  Light chain CDR3 for antibody 2410 (IGKV3D-7)
QQDYNLVT

SEQ ID NO: 4820 - protein, 9 aa, Homo sapiens
  Heavy chain CDR3 for antibody 2410 (IGHV4-59)
AREGGSGSL

SEQ ID NO: 4821 - protein, 9 aa, Homo sapiens
  Light chain CDR3 for antibody 2411 (IGKV6-21)
HQSSSLPHT

SEQ ID NO: 4822 - protein, 15 aa, Homo sapiens
  Heavy chain CDR3 for antibody 2411 (IGHV1-18)
ARGSYDSSGYYYFDY

SEQ ID NO: 4823 - protein, 9 aa, Homo sapiens
  Light chain CDR3 for antibody 2412 (IGKV1-39)
QQSYRTPLT

SEQ ID NO: 4824 - protein, 12 aa, Homo sapiens
  Heavy chain CDR3 for antibody 2412 (IGHV3-33)
ARVDAAAPYFDY

SEQ ID NO: 4825 - protein, 9 aa, Homo sapiens
  Light chain CDR3 for antibody 2413 (IGKV1-6)
LQDYNYPYT

SEQ ID NO: 4826 - protein, 19 aa, Homo sapiens
  Heavy chain CDR3 for antibody 2413 (IGHV3-20)
ARDPPTQALHYYYYYGMDV

SEQ ID NO: 4827 - protein, 9 aa, Homo sapiens
  Light chain CDR3 for antibody 2414 (IGKV1-16)
QQYKSYPYT

SEQ ID NO: 4828 - protein, 18 aa, Homo sapiens
  Heavy chain CDR3 for antibody 2414 (IGHV4-59)
AREGGYVWGSYRSNWFDP

SEQ ID NO: 4829 - protein, 9 aa, Homo sapiens
  Light chain CDR3 for antibody 2415 (IGKV5-2)
LQHDNFPYT

SEQ ID NO: 4830 - protein, 13 aa, Homo sapiens
  Heavy chain CDR3 for antibody 2415 (IGHV3-33)
ARDYTMVRGVMNY

SEQ ID NO: 4831 - protein, 9 aa, Homo sapiens
  Light chain CDR3 for antibody 2416 (IGKV5-2)
LQHDNFPWT

SEQ ID NO: 4832 - protein, 20 aa, Homo sapiens
  Heavy chain CDR3 for antibody 2416 (IGHV3-33)
SRGGATLVRGVIDYYYGMDV

SEQ ID NO: 4833 - protein, 9 aa, Homo sapiens
  Light chain CDR3 for antibody 2417 (IGKV5-2)
LQHDNFPYT

SEQ ID NO: 4834 - protein, 17 aa, Homo sapiens
  Heavy chain CDR3 for antibody 2417 (IGHV1-18)
ARERYYGSGNYKYNMDV

SEQ ID NO: 4835 - protein, 9 aa, Homo sapiens
  Light chain CDR3 for antibody 2418 (IGKV1-27)
QKYNSAPYT

SEQ ID NO: 4836 - protein, 15 aa, Homo sapiens
  Heavy chain CDR3 for antibody 2418 (IGHV3-23)
AKDGSYYDYYYGMDV

SEQ ID NO: 4837 - protein, 9 aa, Homo sapiens
  Light chain CDR3 for antibody 2419 (IGKV1-17)
LQHNSYPYT

SEQ ID NO: 4838 - protein, 14 aa, Homo sapiens
  Heavy chain CDR3 for antibody 2419 (IGHV4-39)
ARQGTMIRGGYFDY

SEQ ID NO: 4839 - protein, 9 aa, Homo sapiens
  Light chain CDR3 for antibody 2420 (IGKV5-2)
LQHDNFPYT

SEQ ID NO: 4840 - protein, 16 aa, Homo sapiens
  Heavy chain CDR3 for antibody 2420 (IGHV3-33)
ARDKNTDYDILTGFDY

SEQ ID NO: 4841 - protein, 9 aa, Homo sapiens
  Light chain CDR3 for antibody 2421 (IGKV1-27)
QKYNSAPYT

SEQ ID NO: 4842 - protein, 14 aa, Homo sapiens
  Heavy chain CDR3 for antibody 2421 (IGHV3-33)
VRDQGSMVRGGGDY

SEQ ID NO: 4843 - protein, 9 aa, Homo sapiens
  Light chain CDR3 for antibody 2422 (IGKV1-27)
QKYNSAPYT

SEQ ID NO: 4844 - protein, 21 aa, Homo sapiens
  Heavy chain CDR3 for antibody 2422 (IGHV3-33)
ARKRLYDILTGYYKAYYGMDV

SEQ ID NO: 4845 - protein, 8 aa, Homo sapiens
  Light chain CDR3 for antibody 2423 (IGKV1D-13)
QQFNNYPT

SEQ ID NO: 4846 - protein, 13 aa, Homo sapiens
  Heavy chain CDR3 for antibody 2423 (IGHV4-34)
ASNFYYYYYGMDV

SEQ ID NO: 4847 - protein, 9 aa, Homo sapiens
  Light chain CDR3 for antibody 2424 (IGKV1-6)
LQDYNYPYT

SEQ ID NO: 4848 - protein, 14 aa, Homo sapiens
  Heavy chain CDR3 for antibody 2424 (IGHV3-23)
AKGGDVLTGYYPDY

SEQ ID NO: 4849 - protein, 9 aa, Homo sapiens
  Light chain CDR3 for antibody 2425 (IGKV3-20)
QQYGSSPYT

SEQ ID NO: 4850 - protein, 16 aa, Homo sapiens
  Heavy chain CDR3 for antibody 2425 (IGHV3-13)
ARDRSYESYYYYGMDV

SEQ ID NO: 4851 - protein, 9 aa, Homo sapiens
  Light chain CDR3 for antibody 2426 (IGKV3D-7)
QQDYNLPLT

SEQ ID NO: 4852 - protein, 13 aa, Homo sapiens
  Heavy chain CDR3 for antibody 2426 (IGHV3-11)
ARDEGYRGYVLDN

SEQ ID NO: 4853 - protein, 9 aa, Homo sapiens
  Light chain CDR3 for antibody 2427 (IGKV6-21)
HQSSSLPYT

SEQ ID NO: 4854 - protein, 12 aa, Homo sapiens
  Heavy chain CDR3 for antibody 2427 (IGHV3-33)
ARDGYSSRNFDY

SEQ ID NO: 4855 - protein, 9 aa, Homo sapiens
  Light chain CDR3 for antibody 2428 (IGKV1-39)
QQSYRTPLT

SEQ ID NO: 4856 - protein, 9 aa, Homo sapiens
  Heavy chain CDR3 for antibody 2428 (IGHV1-8)
ARGRLDFDY

SEQ ID NO: 4857 - protein, 9 aa, Homo sapiens
  Light chain CDR3 for antibody 2429 (IGKV1D-16)
QQYNSFPLT

SEQ ID NO: 4858 - protein, 16 aa, Homo sapiens
  Heavy chain CDR3 for antibody 2429 (IGHV4-59)
ARDTPYYSGSGRPFDS

SEQ ID NO: 4859 - protein, 9 aa, Homo sapiens
  Light chain CDR3 for antibody 2430 (IGKV1D-16)
QQYNSYPLT

SEQ ID NO: 4860 - protein, 14 aa, Homo sapiens
  Heavy chain CDR3 for antibody 2430 (IGHV3-33)
ARDTVAAGFNGMDV

SEQ ID NO: 4861 - protein, 9 aa, Homo sapiens
  Light chain CDR3 for antibody 2431 (IGKV1D-13)
QQFNNYPHT

SEQ ID NO: 4862 - protein, 18 aa, Homo sapiens
  Heavy chain CDR3 for antibody 2431 (IGHV3-33)
ARGYYGSGNFYKDSGMDV

SEQ ID NO: 4863 - protein, 9 aa, Homo sapiens
  Light chain CDR3 for antibody 2432 (IGKV3D-20)
QQYGSSPYT

SEQ ID NO: 4864 - protein, 16 aa, Homo sapiens
  Heavy chain CDR3 for antibody 2432 (IGHV3-33)
ARGDDILTHQYYGVDV

SEQ ID NO: 4865 - protein, 9 aa, Homo sapiens
  Light chain CDR3 for antibody 2433 (IGKV1-39)
QQSYRTPLT

SEQ ID NO: 4866 - protein, 17 aa, Homo sapiens
  Heavy chain CDR3 for antibody 2433 (IGHV1-18)
ARERYYGSGIYKYAMDV

SEQ ID NO: 4867 - protein, 9 aa, Homo sapiens
  Light chain CDR3 for antibody 2434 (IGKV1-16)
QHYNDYPFT

SEQ ID NO: 4868 - protein, 11 aa, Homo sapiens
  Heavy chain CDR3 for antibody 2434 (IGHV3-33)
ARDRSSGPFDY

SEQ ID NO: 4869 - protein, 9 aa, Homo sapiens
  Light chain CDR3 for antibody 2435 (IGKV5-2)
LQHDNFPWT

SEQ ID NO: 4870 - protein, 18 aa, Homo sapiens
  Heavy chain CDR3 for antibody 2435 (IGHV3-33)
ARDYDSLTTYPEDYGMDV

SEQ ID NO: 4871 - protein, 9 aa, Homo sapiens
  Light chain CDR3 for antibody 2436 (IGKV1-27)
QKYNSAPYT

SEQ ID NO: 4872 - protein, 20 aa, Homo sapiens
  Heavy chain CDR3 for antibody 2436 (IGHV3-20)
ARDLCSSTSCYGYYYYGMDV

SEQ ID NO: 4873 - protein, 9 aa, Homo sapiens
  Light chain CDR3 for antibody 2437 (IGKV3-20)
QQYGSSPYT

SEQ ID NO: 4874 - protein, 15 aa, Homo sapiens
  Heavy chain CDR3 for antibody 2437 (IGHV3-23)
AKEFTMVRGVITPDY

SEQ ID NO: 4875 - protein, 9 aa, Homo sapiens
  Light chain CDR3 for antibody 2438 (IGKV1-17)
LQHNSYPWT

SEQ ID NO: 4876 - protein, 17 aa, Homo sapiens
  Heavy chain CDR3 for antibody 2438 (IGHV4-39)
ARQGWYYGSGSSLLFDY

SEQ ID NO: 4877 - protein, 11 aa, Homo sapiens
  Light chain CDR3 for antibody 2439 (IGKV3-11)
QQRSNWPPTWT

SEQ ID NO: 4878 - protein, 9 aa, Homo sapiens
  Heavy chain CDR3 for antibody 2439 (IGHV4-59)
AREGGSGSL

SEQ ID NO: 4879 - protein, 9 aa, Homo sapiens
  Light chain CDR3 for antibody 2440 (IGKV3-20)
QQYGSSPYT

SEQ ID NO: 4880 - protein, 9 aa, Homo sapiens
  Heavy chain CDR3 for antibody 2440 (IGHV3-30)
ARDNWGFDY

SEQ ID NO: 4881 - protein, 9 aa, Homo sapiens
  Light chain CDR3 for antibody 2441 (IGKV6-21)
HQSSSLPYT

SEQ ID NO: 4882 - protein, 19 aa, Homo sapiens
  Heavy chain CDR3 for antibody 2441 (IGHV3-23)
AKDGRSGSYDYYYYYGMDV

SEQ ID NO: 4883 - protein, 9 aa, Homo sapiens
  Light chain CDR3 for antibody 2442 (IGKV6-21)
HQSSSLPYT

SEQ ID NO: 4884 - protein, 17 aa, Homo sapiens
  Heavy chain CDR3 for antibody 2442 (IGHV3-30)
AREGVRGLIYYYYGMDV

SEQ ID NO: 4885 - protein, 9 aa, Homo sapiens
  Light chain CDR3 for antibody 2443 (IGKV1-16)
QQYSRYPYT

SEQ ID NO: 4886 - protein, 18 aa, Homo sapiens
  Heavy chain CDR3 for antibody 2443 (IGHV4-59)
AREGDYVWGSYRPNWFDP

SEQ ID NO: 4887 - protein, 9 aa, Homo sapiens
  Light chain CDR3 for antibody 2444 (IGKV3-11)
QQRSNWPYT

SEQ ID NO: 4888 - protein, 8 aa, Homo sapiens
  Heavy chain CDR3 for antibody 2444 (IGHV3-23)
EKSAGEDV

SEQ ID NO: 4889 - protein, 9 aa, Homo sapiens
  Light chain CDR3 for antibody 2445 (IGKV3-11)
QQRSNWPLT

SEQ ID NO: 4890 - protein, 10 aa, Homo sapiens
  Heavy chain CDR3 for antibody 2445 (IGHV3-33)
ARDVVVYFDY

SEQ ID NO: 4891 - protein, 9 aa, Homo sapiens
  Light chain CDR3 for antibody 2446 (IGKV5-2)
LQHDNFPWT

SEQ ID NO: 4892 - protein, 22 aa, Homo sapiens
  Heavy chain CDR3 for antibody 2446 (IGHV4-59)
AREINYGSGSYYNEDYYYGMDV

SEQ ID NO: 4893 - protein, 9 aa, Homo sapiens
  Light chain CDR3 for antibody 2447 (IGKV6-21)
HQSSSLPYT

SEQ ID NO: 4894 - protein, 19 aa, Homo sapiens
  Heavy chain CDR3 for antibody 2447 (IGHV3-33)
TRDPHYDILTGYAYYGMDV

SEQ ID NO: 4895 - protein, 9 aa, Homo sapiens
  Light chain CDR3 for antibody 2448 (IGKV1-16)
QQYNSYPYT

SEQ ID NO: 4896 - protein, 17 aa, Homo sapiens
  Heavy chain CDR3 for antibody 2448 (IGHV4-39)
AGRLTYYYGSGSPSSDY

SEQ ID NO: 4897 - protein, 9 aa, Homo sapiens
  Light chain CDR3 for antibody 2449 (IGKV2-30)
MQGTHWPLT

SEQ ID NO: 4898 - protein, 13 aa, Homo sapiens
  Heavy chain CDR3 for antibody 2449 (IGHV3-33)
ARRYRSGWYPFDY

SEQ ID NO: 4899 - protein, 9 aa, Homo sapiens
  Light chain CDR3 for antibody 2450 (IGKV1-9)
QQLNSYPLT

SEQ ID NO: 4900 - protein, 17 aa, Homo sapiens
  Heavy chain CDR3 for antibody 2450 (IGHV1-18)
ARVRAFTMVRGVPPFDY

SEQ ID NO: 4901 - protein, 9 aa, Homo sapiens
  Light chain CDR3 for antibody 2451 (IGKV1-6)
LQDYNYPYT

SEQ ID NO: 4902 - protein, 18 aa, Homo sapiens
  Heavy chain CDR3 for antibody 2451 (IGHV1-18)
ARDRGYYYGSGSYSPFDY

SEQ ID NO: 4903 - protein, 9 aa, Homo sapiens
  Light chain CDR3 for antibody 2452 (IGKV1-27)
QKYNSAPYT

SEQ ID NO: 4904 - protein, 20 aa, Homo sapiens
  Heavy chain CDR3 for antibody 2452 (IGHV3-33)
SRGGATLVRGVIDYYYGMDV

SEQ ID NO: 4905 - protein, 9 aa, Homo sapiens
  Light chain CDR3 for antibody 2453 (IGKV1D-16)
QQYNSYPYT

SEQ ID NO: 4906 - protein, 12 aa, Homo sapiens
  Heavy chain CDR3 for antibody 2453 (IGHV1-46)
ARGLTGDHASDI

SEQ ID NO: 4907 - protein, 8 aa, Homo sapiens
  Light chain CDR3 for antibody 2454 (IGKV1D-16)
QQYNYPFT

SEQ ID NO: 4908 - protein, 12 aa, Homo sapiens
  Heavy chain CDR3 for antibody 2454 (IGHV3-23)
AKEYDILTGYFH

SEQ ID NO: 4909 - protein, 9 aa, Homo sapiens
  Light chain CDR3 for antibody 2455 (IGKV6-21)
HQSSSLPYT

SEQ ID NO: 4910 - protein, 16 aa, Homo sapiens
  Heavy chain CDR3 for antibody 2455 (IGHV3-23)
ARNWNDVGDYYYGMDV

SEQ ID NO: 4911 - protein, 9 aa, Homo sapiens
  Light chain CDR3 for antibody 2456 (IGKV3-20)
QQYGSSPYT

SEQ ID NO: 4912 - protein, 14 aa, Homo sapiens
  Heavy chain CDR3 for antibody 2456 (IGHV3-33)
ARDGAAAALDAFDI

SEQ ID NO: 4913 - protein, 9 aa, Homo sapiens
  Light chain CDR3 for antibody 2457 (IGKV3-20)
QQYGSSPYT

SEQ ID NO: 4914 - protein, 16 aa, Homo sapiens
  Heavy chain CDR3 for antibody 2457 (IGHV3-33)
ARDKNTDYDILTGFDY

SEQ ID NO: 4915 - protein, 9 aa, Homo sapiens
  Light chain CDR3 for antibody 2458 (IGKV1-6)
LQDYNYPYT

SEQ ID NO: 4916 - protein, 17 aa, Homo sapiens
  Heavy chain CDR3 for antibody 2458 (IGHV3-33)
ARVYYDILTGYSPAFDI

SEQ ID NO: 4917 - protein, 9 aa, Homo sapiens
  Light chain CDR3 for antibody 2459 (IGKV3-20)
QQYGSSPYT

SEQ ID NO: 4918 - protein, 19 aa, Homo sapiens
  Heavy chain CDR3 for antibody 2459 (IGHV3-33)
ARRKNYYGSGSWHYYGMDV

SEQ ID NO: 4919 - protein, 9 aa, Homo sapiens
  Light chain CDR3 for antibody 2460 (IGKV1-9)
QQLNSYPWT

SEQ ID NO: 4920 - protein, 11 aa, Homo sapiens
  Heavy chain CDR3 for antibody 2460 (IGHV4-59)
ARSLRYSFFDY

SEQ ID NO: 4921 - protein, 9 aa, Homo sapiens
  Light chain CDR3 for antibody 2461 (IGKV1-17)
LQHNSYPYT

SEQ ID NO: 4922 - protein, 15 aa, Homo sapiens
  Heavy chain CDR3 for antibody 2461 (IGHV3-23)
AKDLSSGWYAYFFDY

SEQ ID NO: 4923 - protein, 9 aa, Homo sapiens
  Light chain CDR3 for antibody 2462 (IGKV6-21)
HQSSSLPYT

SEQ ID NO: 4924 - protein, 17 aa, Homo sapiens
  Heavy chain CDR3 for antibody 2462 (IGHV3-33)
ARGDGDILTGYYEWFDP

SEQ ID NO: 4925 - protein, 9 aa, Homo sapiens
  Light chain CDR3 for antibody 2463 (IGKV1-27)
QKYNSAPYT

SEQ ID NO: 4926 - protein, 17 aa, Homo sapiens
  Heavy chain CDR3 for antibody 2463 (IGHV3-33)
ARAYYDILTGYSYYFDY

SEQ ID NO: 4927 - protein, 9 aa, Homo sapiens
  Light chain CDR3 for antibody 2464 (IGKV1-39)
QQSYSTPLT

SEQ ID NO: 4928 - protein, 13 aa, Homo sapiens
  Heavy chain CDR3 for antibody 2464 (IGHV3-33)
AKEDGDYHHYFDY

SEQ ID NO: 4929 - protein, 9 aa, Homo sapiens
  Light chain CDR3 for antibody 2465 (IGKV3-11)
QQRSNWMYT

SEQ ID NO: 4930 - protein, 18 aa, Homo sapiens
  Heavy chain CDR3 for antibody 2465 (IGHV4-59)
AREGDYVWGSYRPNWFDP

SEQ ID NO: 4931 - protein, 9 aa, Homo sapiens
  Light chain CDR3 for antibody 2466 (IGKV3D-7)
QQDYNLPWT

SEQ ID NO: 4932 - protein, 14 aa, Homo sapiens
  Heavy chain CDR3 for antibody 2466 (IGHV3-33)
AREGYSSNWYDFDY

SEQ ID NO: 4933 - protein, 9 aa, Homo sapiens
  Light chain CDR3 for antibody 2467 (IGKV1-17)
LQHNSYPLT

SEQ ID NO: 4934 - protein, 9 aa, Homo sapiens
  Heavy chain CDR3 for antibody 2467 (IGHV3-23)
ATIAADFDY

SEQ ID NO: 4935 - protein, 9 aa, Homo sapiens
  Light chain CDR3 for antibody 2468 (IGKV1D-16)
QQYNSYPYT

SEQ ID NO: 4936 - protein, 14 aa, Homo sapiens
  Heavy chain CDR3 for antibody 2468 (IGHV3-33)
ARWELPFYYSGMDV

SEQ ID NO: 4937 - protein, 9 aa, Homo sapiens
  Light chain CDR3 for antibody 2469 (IGKV1D-13)
QQFNNYPYT

SEQ ID NO: 4938 - protein, 9 aa, Homo sapiens
  Heavy chain CDR3 for antibody 2469 (IGHV3-23)
ARIWWLKDY

SEQ ID NO: 4939 - protein, 9 aa, Homo sapiens
  Light chain CDR3 for antibody 2470 (IGKV6-21)
HQSSSLPYT

SEQ ID NO: 4940 - protein, 15 aa, Homo sapiens
  Heavy chain CDR3 for antibody 2470 (IGHV3-23)
AKDPRGYYYYYGMDV

SEQ ID NO: 4941 - protein, 9 aa, Homo sapiens
  Light chain CDR3 for antibody 2471 (IGKV1-39)
QQSYSTPLT

SEQ ID NO: 4942 - protein, 14 aa, Homo sapiens
  Heavy chain CDR3 for antibody 2471 (IGHV1-2)
ARDYYGSGNYYMGY

SEQ ID NO: 4943 - protein, 9 aa, Homo sapiens
  Light chain CDR3 for antibody 2472 (IGKV5-2)
LQHDNFPWT

SEQ ID NO: 4944 - protein, 13 aa, Homo sapiens
  Heavy chain CDR3 for antibody 2472 (IGHV1-46)
ARRQVGYYYGMDV

SEQ ID NO: 4945 - protein, 8 aa, Homo sapiens
  Light chain CDR3 for antibody 2473 (IGKV3D-7)
QQDYNLLT

SEQ ID NO: 4946 - protein, 12 aa, Homo sapiens
  Heavy chain CDR3 for antibody 2473 (IGHV3-13)
AREAGIPDAFDI

SEQ ID NO: 4947 - protein, 9 aa, Homo sapiens
  Light chain CDR3 for antibody 2474 (IGKV1D-16)
QQYNSYPLT

SEQ ID NO: 4948 - protein, 12 aa, Homo sapiens
  Heavy chain CDR3 for antibody 2474 (IGHV4-59)
ARGYSSSWYFDY

SEQ ID NO: 4949 - protein, 9 aa, Homo sapiens
  Light chain CDR3 for antibody 2475 (IGKV1-39)
QQSYSTPLT

SEQ ID NO: 4950 - protein, 20 aa, Homo sapiens
  Heavy chain CDR3 for antibody 2475 (IGHV3-23)
AKGMGGLRYFDWPHYYGMDV

SEQ ID NO: 4951 - protein, 9 aa, Homo sapiens
  Light chain CDR3 for antibody 2476 (IGKV1-6)
LQDYNYPWT

SEQ ID NO: 4952 - protein, 9 aa, Homo sapiens
  Heavy chain CDR3 for antibody 2476 (IGHV3-30)
VRDDYGVDV

SEQ ID NO: 4953 - protein, 10 aa, Homo sapiens
  Light chain CDR3 for antibody 2477 (IGKV3-20)
QQYGRSPPVT

SEQ ID NO: 4954 - protein, 11 aa, Homo sapiens
  Heavy chain CDR3 for antibody 2477 (IGHV3-33)
ARDRSSGPFDY

SEQ ID NO: 4955 - protein, 9 aa, Homo sapiens
  Light chain CDR3 for antibody 2478 (IGKV1-17)
LQHNSYPYT

SEQ ID NO: 4956 - protein, 15 aa, Homo sapiens
  Heavy chain CDR3 for antibody 2478 (IGHV3-33)
ARDALAVTGTGWFDP

SEQ ID NO: 4957 - protein, 9 aa, Homo sapiens
  Light chain CDR3 for antibody 2479 (IGKV6-21)
HQSSSLPYT

SEQ ID NO: 4958 - protein, 15 aa, Homo sapiens
  Heavy chain CDR3 for antibody 2479 (IGHV3-66)
ARDRDYYYYYYGMDV

SEQ ID NO: 4959 - protein, 9 aa, Homo sapiens
  Light chain CDR3 for antibody 2480 (IGKV1-39)
QQSYSTPLT

SEQ ID NO: 4960 - protein, 20 aa, Homo sapiens
  Heavy chain CDR3 for antibody 2480 (IGHV3-33)
ARDNDSSGYYDYYYYYGMDV

SEQ ID NO: 4961 - protein, 9 aa, Homo sapiens
  Light chain CDR3 for antibody 2481 (IGKV6-21)
HQSSSLPYT

SEQ ID NO: 4962 - protein, 12 aa, Homo sapiens
  Heavy chain CDR3 for antibody 2481 (IGHV3-23)
AKEGIVGVPFDY

SEQ ID NO: 4963 - protein, 8 aa, Homo sapiens
  Light chain CDR3 for antibody 2482 (IGKV3D-20)
QQYVSSVT

SEQ ID NO: 4964 - protein, 16 aa, Homo sapiens
  Heavy chain CDR3 for antibody 2482 (IGHV3-66)
ARAYTYGSGSFPYFDY

SEQ ID NO: 4965 - protein, 9 aa, Homo sapiens
  Light chain CDR3 for antibody 2483 (IGKV1-17)
LQHNSYPYT

SEQ ID NO: 4966 - protein, 10 aa, Homo sapiens
  Heavy chain CDR3 for antibody 2483 (IGHV3-33)
ARVVDTAMAY

SEQ ID NO: 4967 - protein, 9 aa, Homo sapiens
  Light chain CDR3 for antibody 2484 (IGKV1D-13)
QQFNNYPYT

SEQ ID NO: 4968 - protein, 12 aa, Homo sapiens
  Heavy chain CDR3 for antibody 2484 (IGHV3-33)
AREGTRWVYFDY

SEQ ID NO: 4969 - protein, 9 aa, Homo sapiens
  Light chain CDR3 for antibody 2485 (IGKV1-39)
QQSYSTPLT

SEQ ID NO: 4970 - protein, 14 aa, Homo sapiens
  Heavy chain CDR3 for antibody 2485 (IGHV3-33)
VRDAMGATTAWFDP

SEQ ID NO: 4971 - protein, 9 aa, Homo sapiens
  Light chain CDR3 for antibody 2486 (IGKV1-17)
LQHNSYPYT

SEQ ID NO: 4972 - protein, 18 aa, Homo sapiens
  Heavy chain CDR3 for antibody 2486 (IGHV3-33)
ARRTAAGTGDYYYYGMDV

SEQ ID NO: 4973 - protein, 10 aa, Homo sapiens
  Light chain CDR3 for antibody 2487 (IGKV1-17)
LQHNSYPMYT

SEQ ID NO: 4974 - protein, 12 aa, Homo sapiens
  Heavy chain CDR3 for antibody 2487 (IGHV3-13)
AREAGIPDAFDI

SEQ ID NO: 4975 - protein, 8 aa, Homo sapiens
  Light chain CDR3 for antibody 2488 (IGKV3-20)
QQYGRSFT

SEQ ID NO: 4976 - protein, 13 aa, Homo sapiens
  Heavy chain CDR3 for antibody 2488 (IGHV4-39)
ARREVVGGRGFDY

SEQ ID NO: 4977 - protein, 9 aa, Homo sapiens
  Light chain CDR3 for antibody 2489 (IGKV1-17)
LQHNSYPYT

SEQ ID NO: 4978 - protein, 17 aa, Homo sapiens
  Heavy chain CDR3 for antibody 2489 (IGHV3-33)
TRDSGMVRGIIIYGMDV

SEQ ID NO: 4979 - protein, 9 aa, Homo sapiens
  Light chain CDR3 for antibody 2490 (IGKV6-21)
HQSSSLPYT

SEQ ID NO: 4980 - protein, 16 aa, Homo sapiens
  Heavy chain CDR3 for antibody 2490 (IGHV3-33)
ARDGSMVRRIHDAFDF

SEQ ID NO: 4981 - protein, 9 aa, Homo sapiens
  Light chain CDR3 for antibody 2491 (IGKV3-11)
QQRSNWPPT

SEQ ID NO: 4982 - protein, 13 aa, Homo sapiens
  Heavy chain CDR3 for antibody 2491 (IGHV3-33)
ARAFTMVRGVIDY

SEQ ID NO: 4983 - protein, 9 aa, Homo sapiens
  Light chain CDR3 for antibody 2492 (IGKV1-27)
QKYNSAPYT

SEQ ID NO: 4984 - protein, 8 aa, Homo sapiens
  Heavy chain CDR3 for antibody 2492 (IGHV3-23)
AETFLFDY

SEQ ID NO: 4985 - protein, 9 aa, Homo sapiens
  Light chain CDR3 for antibody 2493 (IGKV5-2)
LQHDNFPYT

SEQ ID NO: 4986 - protein, 14 aa, Homo sapiens
  Heavy chain CDR3 for antibody 2493 (IGHV3-15)
SIYYYGSGRDFFDY

SEQ ID NO: 4987 - protein, 9 aa, Homo sapiens
  Light chain CDR3 for antibody 2494 (IGKV3-20)
QQCDSSPFT

SEQ ID NO: 4988 - protein, 13 aa, Homo sapiens
  Heavy chain CDR3 for antibody 2494 (IGHV3-33)
ARLDYYYYYGMDV

SEQ ID NO: 4989 - protein, 9 aa, Homo sapiens
  Light chain CDR3 for antibody 2495 (IGKV3-20)
QQYGSSPYT

SEQ ID NO: 4990 - protein, 19 aa, Homo sapiens
  Heavy chain CDR3 for antibody 2495 (IGHV4-59)
ARDRVVGATTYYYYYGMDV

SEQ ID NO: 4991 - protein, 11 aa, Homo sapiens
  Light chain CDR3 for antibody 2496 (IGKV3-11)
QQRSNWPPTWT

SEQ ID NO: 4992 - protein, 12 aa, Homo sapiens
  Heavy chain CDR3 for antibody 2496 (IGHV4-39)
ARHGSGSSYFDY

SEQ ID NO: 4993 - protein, 9 aa, Homo sapiens
  Light chain CDR3 for antibody 2497 (IGKV3D-7)
QQDYNLPLT

SEQ ID NO: 4994 - protein, 17 aa, Homo sapiens
  Heavy chain CDR3 for antibody 2497 (IGHV1-18)
ARDRAFTMVRGVPPFDY

SEQ ID NO: 4995 - protein, 9 aa, Homo sapiens
  Light chain CDR3 for antibody 2498 (IGKV1-17)
QQYNSYPYT

SEQ ID NO: 4996 - protein, 17 aa, Homo sapiens
  Heavy chain CDR3 for antibody 2498 (IGHV4-59)
ARRITRVREIIITAFDY

SEQ ID NO: 4997 - protein, 8 aa, Homo sapiens
  Light chain CDR3 for antibody 2499 (IGKV3-11)
QQRSNWLT

SEQ ID NO: 4998 - protein, 18 aa, Homo sapiens
  Heavy chain CDR3 for antibody 2499 (IGHV4-59)
AREGDYVWGSYRPNWFDP

SEQ ID NO: 4999 - protein, 9 aa, Homo sapiens
  Light chain CDR3 for antibody 2500 (IGKV1D-13)
QQFNNYPST

SEQ ID NO: 5000 - protein, 11 aa, Homo sapiens
  Heavy chain CDR3 for antibody 2500 (IGHV3-33)
ARDILTGFLDH

SEQ ID NO: 5001 - protein, 8 aa, Homo sapiens
  Light chain CDR3 for antibody 2501 (IGKV1-5)
QQYNSYYT

SEQ ID NO: 5002 - protein, 14 aa, Homo sapiens
  Heavy chain CDR3 for antibody 2501 (IGHV3-33)
ARGAAAGNFYGLDV

SEQ ID NO: 5003 - protein, 9 aa, Homo sapiens
  Light chain CDR3 for antibody 2502 (IGKV3-15)
QQYNNWPLT

SEQ ID NO: 5004 - protein, 19 aa, Homo sapiens
  Heavy chain CDR3 for antibody 2502 (IGHV5-51)
ARHGEKGKRITMVRGSLDV

SEQ ID NO: 5005 - protein, 9 aa, Homo sapiens
  Light chain CDR3 for antibody 2503 (IGKV3D-7)
QQDYNLPYT

SEQ ID NO: 5006 - protein, 12 aa, Homo sapiens
  Heavy chain CDR3 for antibody 2503 (IGHV3-33)
AREKGGSYSFDY

SEQ ID NO: 5007 - protein, 9 aa, Homo sapiens
  Light chain CDR3 for antibody 2504 (IGKV3-20)
QQYGSSPYT

SEQ ID NO: 5008 - protein, 19 aa, Homo sapiens
  Heavy chain CDR3 for antibody 2504 (IGHV3-33)
ARDSGYSGYDYYYYYGMDV

SEQ ID NO: 5009 - protein, 10 aa, Homo sapiens
  Light chain CDR3 for antibody 2505 (IGKV1-17)
LQHNSYPMYT

SEQ ID NO: 5010 - protein, 14 aa, Homo sapiens
  Heavy chain CDR3 for antibody 2505 (IGHV3-23)
AKSRIVGALYYFDY

SEQ ID NO: 5011 - protein, 9 aa, Homo sapiens
  Light chain CDR3 for antibody 2506 (IGKV5-2)
LQHDNFPYT

SEQ ID NO: 5012 - protein, 18 aa, Homo sapiens
  Heavy chain CDR3 for antibody 2506 (IGHV3-33)
ARKGGYYSGSGSYRHFDF

SEQ ID NO: 5013 - protein, 9 aa, Homo sapiens
  Light chain CDR3 for antibody 2507 (IGKV1-17)
LQHNSYPYT

SEQ ID NO: 5014 - protein, 10 aa, Homo sapiens
  Heavy chain CDR3 for antibody 2507 (IGHV3-23)
AKDHWGDFDY

SEQ ID NO: 5015 - protein, 9 aa, Homo sapiens
  Light chain CDR3 for antibody 2508 (IGKV6-21)
HQSSSLPYT

SEQ ID NO: 5016 - protein, 18 aa, Homo sapiens
  Heavy chain CDR3 for antibody 2508 (IGHV3-33)
AREGDYYGSGGFPNWFDP

SEQ ID NO: 5017 - protein, 9 aa, Homo sapiens
  Light chain CDR3 for antibody 2509 (IGKV1-27)
QKYNSAPYT

SEQ ID NO: 5018 - protein, 15 aa, Homo sapiens
  Heavy chain CDR3 for antibody 2509 (IGHV3-33)
ARGYYYGSGSFPVDY

SEQ ID NO: 5019 - protein, 9 aa, Homo sapiens
  Light chain CDR3 for antibody 2510 (IGKV1-17)
LQHNSYPYT

SEQ ID NO: 5020 - protein, 20 aa, Homo sapiens
  Heavy chain CDR3 for antibody 2510 (IGHV3-33)
ARDLGWATMVRGVIRAPFDY

SEQ ID NO: 5021 - protein, 9 aa, Homo sapiens
  Light chain CDR3 for antibody 2511 (IGKV3-15)
QQYNNWPLT

SEQ ID NO: 5022 - protein, 14 aa, Homo sapiens
  Heavy chain CDR3 for antibody 2511 (IGHV4-39)
ARDSGYDYYYGMDV

SEQ ID NO: 5023 - protein, 9 aa, Homo sapiens
  Light chain CDR3 for antibody 2512 (IGKV3-15)
QQYNNWPLT

SEQ ID NO: 5024 - protein, 13 aa, Homo sapiens
  Heavy chain CDR3 for antibody 2512 (IGHV4-61)
ASRYSSGWYPFDY

SEQ ID NO: 5025 - protein, 9 aa, Homo sapiens
  Light chain CDR3 for antibody 2513 (IGKV6-21)
HQSSSLPYT

SEQ ID NO: 5026 - protein, 17 aa, Homo sapiens
  Heavy chain CDR3 for antibody 2513 (IGHV4-39)
AGRLTYYFGSGSPSFDY

SEQ ID NO: 5027 - protein, 9 aa, Homo sapiens
  Light chain CDR3 for antibody 2514 (IGKV1D-13)
QQFNNYPYT

SEQ ID NO: 5028 - protein, 11 aa, Homo sapiens
  Heavy chain CDR3 for antibody 2514 (IGHV3-23)
AKGLWSYYFDY

SEQ ID NO: 5029 - protein, 9 aa, Homo sapiens
  Light chain CDR3 for antibody 2515 (IGKV5-2)
LQHDNFPYT

SEQ ID NO: 5030 - protein, 19 aa, Homo sapiens
  Heavy chain CDR3 for antibody 2515 (IGHV3-33)
AREDYYGSGSYYNEDWFDP

SEQ ID NO: 5031 - protein, 9 aa, Homo sapiens
  Light chain CDR3 for antibody 2516 (IGKV1-39)
QQSYRTPLT

SEQ ID NO: 5032 - protein, 10 aa, Homo sapiens
  Heavy chain CDR3 for antibody 2516 (IGHV3-23)
AKDHYGDYPY

SEQ ID NO: 5033 - protein, 9 aa, Homo sapiens
  Light chain CDR3 for antibody 2517 (IGKV1-9)
QQLNSYPLT

SEQ ID NO: 5034 - protein, 23 aa, Homo sapiens
  Heavy chain CDR3 for antibody 2517 (IGHV4-59)
ARERTYSGILPGYYEDYYYGMDV

SEQ ID NO: 5035 - protein, 9 aa, Homo sapiens
  Light chain CDR3 for antibody 2518 (IGKV5-2)
LQHDNFPWT

SEQ ID NO: 5036 - protein, 17 aa, Homo sapiens
  Heavy chain CDR3 for antibody 2518 (IGHV3-15)
TTERYPRRYYYYFGMDV

SEQ ID NO: 5037 - protein, 9 aa, Homo sapiens
  Light chain CDR3 for antibody 2519 (IGKV1-6)
LQDYNYPYT

SEQ ID NO: 5038 - protein, 18 aa, Homo sapiens
  Heavy chain CDR3 for antibody 2519 (IGHV4-59)
AREGHYYTSGSYYKAFDY

SEQ ID NO: 5039 - protein, 9 aa, Homo sapiens
  Light chain CDR3 for antibody 2520 (IGKV1D-16)
QQYNSYPYT

SEQ ID NO: 5040 - protein, 12 aa, Homo sapiens
  Heavy chain CDR3 for antibody 2520 (IGHV1-46)
ARGPTGDHALDI

SEQ ID NO: 5041 - protein, 9 aa, Homo sapiens
  Light chain CDR3 for antibody 2521 (IGKV3-20)
QQYGSSPYT

SEQ ID NO: 5042 - protein, 18 aa, Homo sapiens
  Heavy chain CDR3 for antibody 2521 (IGHV1-24)
ATGLRYFDWPIISNLFDY

SEQ ID NO: 5043 - protein, 9 aa, Homo sapiens
  Light chain CDR3 for antibody 2522 (IGKV6-21)
HQSSSLPYT

SEQ ID NO: 5044 - protein, 13 aa, Homo sapiens
  Heavy chain CDR3 for antibody 2522 (IGHV1-46)
ARRQVGYYYGMDV

SEQ ID NO: 5045 - protein, 9 aa, Homo sapiens
  Light chain CDR3 for antibody 2523 (IGKV1-39)
QQSYRTPLT

SEQ ID NO: 5046 - protein, 18 aa, Homo sapiens
  Heavy chain CDR3 for antibody 2523 (IGHV3-23)
AKEGNYYGSGSYWGYFDP

SEQ ID NO: 5047 - protein, 9 aa, Homo sapiens
  Light chain CDR3 for antibody 2524 (IGKV1-39)
QQSYRTPLT

SEQ ID NO: 5048 - protein, 13 aa, Homo sapiens
  Heavy chain CDR3 for antibody 2524 (IGHV3-33)
ARGDNWNDGGFDY

SEQ ID NO: 5049 - protein, 9 aa, Homo sapiens
  Light chain CDR3 for antibody 2525 (IGKV1-17)
LQHNSYPYT

SEQ ID NO: 5050 - protein, 11 aa, Homo sapiens
  Heavy chain CDR3 for antibody 2525 (IGHV3-33)
ARDRSTGWLDY

SEQ ID NO: 5051 - protein, 8 aa, Homo sapiens
  Light chain CDR3 for antibody 2526 (IGKV1-5)
QQYNSYYT

SEQ ID NO: 5052 - protein, 13 aa, Homo sapiens
  Heavy chain CDR3 for antibody 2526 (IGHV3-23)
ASPFNWNDGFFDY

SEQ ID NO: 5053 - protein, 9 aa, Homo sapiens
  Light chain CDR3 for antibody 2527 (IGKV3-15)
QQYNNWPRT

SEQ ID NO: 5054 - protein, 13 aa, Homo sapiens
  Heavy chain CDR3 for antibody 2527 (IGHV3-33)
ARDQRYSSGWYDY

SEQ ID NO: 5055 - protein, 9 aa, Homo sapiens
  Light chain CDR3 for antibody 2528 (IGKV1D-16)
QQYNSFPLT

SEQ ID NO: 5056 - protein, 13 aa, Homo sapiens
  Heavy chain CDR3 for antibody 2528 (IGHV4-59)
ARDAGYSSSWFDY

SEQ ID NO: 5057 - protein, 9 aa, Homo sapiens
  Light chain CDR3 for antibody 2529 (IGKV2-30)
MQGTHWPLT

SEQ ID NO: 5058 - protein, 18 aa, Homo sapiens
  Heavy chain CDR3 for antibody 2529 (IGHV3-33)
ARREGIVGATTYYYGMDV

SEQ ID NO: 5059 - protein, 9 aa, Homo sapiens
  Light chain CDR3 for antibody 2530 (IGKV1-6)
LQDYNYPFT

SEQ ID NO: 5060 - protein, 13 aa, Homo sapiens
  Heavy chain CDR3 for antibody 2530 (IGHV3-64)
AREKTIFPYYFDY

SEQ ID NO: 5061 - protein, 9 aa, Homo sapiens
  Light chain CDR3 for antibody 2531 (IGKV1-27)
QKYNSAPYT

SEQ ID NO: 5062 - protein, 16 aa, Homo sapiens
  Heavy chain CDR3 for antibody 2531 (IGHV3-33)
ARGGRSDWLYYYGMDV

SEQ ID NO: 5063 - protein, 9 aa, Homo sapiens
  Light chain CDR3 for antibody 2532 (IGKV1-9)
QQLNSYPLT

SEQ ID NO: 5064 - protein, 15 aa, Homo sapiens
  Heavy chain CDR3 for antibody 2532 (IGHV3-64)
ARDSRPEITGPPFDY

SEQ ID NO: 5065 - protein, 9 aa, Homo sapiens
  Light chain CDR3 for antibody 2533 (IGKV3-15)
QQYNNWPLT

SEQ ID NO: 5066 - protein, 16 aa, Homo sapiens
  Heavy chain CDR3 for antibody 2533 (IGHV4-59)
ARYSGSYYGDYYGMDV

SEQ ID NO: 5067 - protein, 9 aa, Homo sapiens
  Light chain CDR3 for antibody 2534 (IGKV6-21)
HQSSSLPYT

SEQ ID NO: 5068 - protein, 20 aa, Homo sapiens
  Heavy chain CDR3 for antibody 2534 (IGHV3-33)
ARDWMVRGVIITDYYYGMDV

SEQ ID NO: 5069 - protein, 9 aa, Homo sapiens
  Light chain CDR3 for antibody 2535 (IGKV5-2)
LQHDNFPYT

SEQ ID NO: 5070 - protein, 10 aa, Homo sapiens
  Heavy chain CDR3 for antibody 2535 (IGHV3-30)
ARDGLESFDY

SEQ ID NO: 5071 - protein, 9 aa, Homo sapiens
  Light chain CDR3 for antibody 2536 (IGKV1D-13)
QQFNNYPHT

SEQ ID NO: 5072 - protein, 13 aa, Homo sapiens
  Heavy chain CDR3 for antibody 2536 (IGHV4-39)
ARQWPSGYWYFDL

SEQ ID NO: 5073 - protein, 9 aa, Homo sapiens
  Light chain CDR3 for antibody 2537 (IGKV1-6)
LQDYNYPRT

SEQ ID NO: 5074 - protein, 19 aa, Homo sapiens
  Heavy chain CDR3 for antibody 2537 (IGHV1-18)
ARDTTLVRGLMNYYYGMDV

SEQ ID NO: 5075 - protein, 9 aa, Homo sapiens
  Light chain CDR3 for antibody 2538 (IGKV5-2)
LQHDNFPYT

SEQ ID NO: 5076 - protein, 12 aa, Homo sapiens
  Heavy chain CDR3 for antibody 2538 (IGHV3-33)
AKDPGWQQLAEY

SEQ ID NO: 5077 - protein, 9 aa, Homo sapiens
  Light chain CDR3 for antibody 2539 (IGKV1-27)
QKYNSAPYT

SEQ ID NO: 5078 - protein, 18 aa, Homo sapiens
  Heavy chain CDR3 for antibody 2539 (IGHV3-33)
ARDRDRYGSGTYPDAIDI

SEQ ID NO: 5079 - protein, 9 aa, Homo sapiens
  Light chain CDR3 for antibody 2540 (IGKV6-21)
HQSSSLPYT

SEQ ID NO: 5080 - protein, 18 aa, Homo sapiens
  Heavy chain CDR3 for antibody 2540 (IGHV4-59)
ARERGNWNDVDYYYGMDV

SEQ ID NO: 5081 - protein, 9 aa, Homo sapiens
  Light chain CDR3 for antibody 2541 (IGKV1-39)
QQSYSTPLT

SEQ ID NO: 5082 - protein, 18 aa, Homo sapiens
  Heavy chain CDR3 for antibody 2541 (IGHV3-33)
ARREGITLIFYYYYGMDV

SEQ ID NO: 5083 - protein, 8 aa, Homo sapiens
  Light chain CDR3 for antibody 2542 (IGKV1-5)
QQYNSYWT

SEQ ID NO: 5084 - protein, 12 aa, Homo sapiens
  Heavy chain CDR3 for antibody 2542 (IGHV3-33)
ARGYFGSGYAHF

SEQ ID NO: 5085 - protein, 10 aa, Homo sapiens
  Light chain CDR3 for antibody 2543 (IGKV1-17)
LQHNSYPMYT

SEQ ID NO: 5086 - protein, 14 aa, Homo sapiens
  Heavy chain CDR3 for antibody 2543 (IGHV3-33)
ARGAAAGNFYGLDV

SEQ ID NO: 5087 - protein, 9 aa, Homo sapiens
  Light chain CDR3 for antibody 2544 (IGKV6-21)
HQSSSLPYT

SEQ ID NO: 5088 - protein, 17 aa, Homo sapiens
  Heavy chain CDR3 for antibody 2544 (IGHV3-15)
TTERYPRRYYYYFGMDV

SEQ ID NO: 5089 - protein, 9 aa, Homo sapiens
  Light chain CDR3 for antibody 2545 (IGKV2-30)
MQVTHWPRT

SEQ ID NO: 5090 - protein, 20 aa, Homo sapiens
  Heavy chain CDR3 for antibody 2545 (IGHV1-2)
ARDGWDYYDSSAYYPSAFDL

SEQ ID NO: 5091 - protein, 9 aa, Homo sapiens
  Light chain CDR3 for antibody 2546 (IGKV5-2)
LQHDNFPWT

SEQ ID NO: 5092 - protein, 11 aa, Homo sapiens
  Heavy chain CDR3 for antibody 2546 (IGHV4-39)
ARLLVGATTDY

SEQ ID NO: 5093 - protein, 9 aa, Homo sapiens
  Light chain CDR3 for antibody 2547 (IGKV1D-13)
QQFNNYPHT

SEQ ID NO: 5094 - protein, 14 aa, Homo sapiens
  Heavy chain CDR3 for antibody 2547 (IGHV3-33)
ARDREQQLVRYFDY

SEQ ID NO: 5095 - protein, 9 aa, Homo sapiens
  Light chain CDR3 for antibody 2548 (IGKV1-27)
QKYNSAPYT

SEQ ID NO: 5096 - protein, 14 aa, Homo sapiens
  Heavy chain CDR3 for antibody 2548 (IGHV3-33)
ARDNILTAYYLFDY

SEQ ID NO: 5097 - protein, 9 aa, Homo sapiens
  Light chain CDR3 for antibody 2549 (IGKV1-6)
LQDYNHVGT

SEQ ID NO: 5098 - protein, 9 aa, Homo sapiens
  Heavy chain CDR3 for antibody 2549 (IGHV3-21)
GSRRPYFDS

SEQ ID NO: 5099 - protein, 9 aa, Homo sapiens
  Light chain CDR3 for antibody 2550 (IGKV1D-13)
QQFNNYPHT

SEQ ID NO: 5100 - protein, 20 aa, Homo sapiens
  Heavy chain CDR3 for antibody 2550 (IGHV3-11)
ARGGATLIRGLIDYYYGMDV

SEQ ID NO: 5101 - protein, 9 aa, Homo sapiens
  Light chain CDR3 for antibody 2551 (IGKV3D-20)
QQYGSSPYT

SEQ ID NO: 5102 - protein, 14 aa, Homo sapiens
  Heavy chain CDR3 for antibody 2551 (IGHV3-33)
AREGYSSGWDYFDH

SEQ ID NO: 5103 - protein, 9 aa, Homo sapiens
  Light chain CDR3 for antibody 2552 (IGKV3-20)
QQYGSSPYT

SEQ ID NO: 5104 - protein, 18 aa, Homo sapiens
  Heavy chain CDR3 for antibody 2552 (IGHV1-8)
AREGAAAGSYYYYNGMDV

SEQ ID NO: 5105 - protein, 9 aa, Homo sapiens
  Light chain CDR3 for antibody 2553 (IGKV5-2)
LQHDNFPYT

SEQ ID NO: 5106 - protein, 14 aa, Homo sapiens
  Heavy chain CDR3 for antibody 2553 (IGHV3-33)
ARRGYSGYDWYFDY

SEQ ID NO: 5107 - protein, 9 aa, Homo sapiens
  Light chain CDR3 for antibody 2554 (IGKV5-2)
LQHDNFPYT

SEQ ID NO: 5108 - protein, 15 aa, Homo sapiens
  Heavy chain CDR3 for antibody 2554 (IGHV3-74)
SRGSGSHYFYYGMDV

SEQ ID NO: 5109 - protein, 9 aa, Homo sapiens
  Light chain CDR3 for antibody 2555 (IGKV3D-7)
QQDYNLPLT

SEQ ID NO: 5110 - protein, 12 aa, Homo sapiens
  Heavy chain CDR3 for antibody 2555 (IGHV1-24)
ASDWAYYYGMDV

SEQ ID NO: 5111 - protein, 9 aa, Homo sapiens
  Light chain CDR3 for antibody 2556 (IGKV1-39)
QQSYSTPLT

SEQ ID NO: 5112 - protein, 13 aa, Homo sapiens
  Heavy chain CDR3 for antibody 2556 (IGHV3-30)
AAPFMVRGDGMDV

SEQ ID NO: 5113 - protein, 9 aa, Homo sapiens
  Light chain CDR3 for antibody 2557 (IGKV6-21)
HQSSSLPYT

SEQ ID NO: 5114 - protein, 18 aa, Homo sapiens
  Heavy chain CDR3 for antibody 2557 (IGHV3-33)
ARKGGYYSGSGSYRHFDF

SEQ ID NO: 5115 - protein, 9 aa, Homo sapiens
  Light chain CDR3 for antibody 2558 (IGKV2-30)
MQGTHWPLT

SEQ ID NO: 5116 - protein, 12 aa, Homo sapiens
  Heavy chain CDR3 for antibody 2558 (IGHV3-33)
TRGYSSKSYFDY

SEQ ID NO: 5117 - protein, 9 aa, Homo sapiens
  Light chain CDR3 for antibody 2559 (IGKV1-39)
QQSYSTPLT

SEQ ID NO: 5118 - protein, 15 aa, Homo sapiens
  Heavy chain CDR3 for antibody 2559 (IGHV3-23)
AKEALRYFDWSGMDV

SEQ ID NO: 5119 - protein, 9 aa, Homo sapiens
  Light chain CDR3 for antibody 2560 (IGKV3-11)
QQRSNWPWT

SEQ ID NO: 5120 - protein, 12 aa, Homo sapiens
  Heavy chain CDR3 for antibody 2560 (IGHV4-39)
ARHGSGSSYFDY

SEQ ID NO: 5121 - protein, 8 aa, Homo sapiens
  Light chain CDR3 for antibody 2561 (IGKV3-20)
QQYGRSFT

SEQ ID NO: 5122 - protein, 18 aa, Homo sapiens
  Heavy chain CDR3 for antibody 2561 (IGHV4-59)
AREGDYVWGSYRPNWFDP

SEQ ID NO: 5123 - protein, 9 aa, Homo sapiens
  Light chain CDR3 for antibody 2562 (IGKV1-9)
QQLNSYPLT

SEQ ID NO: 5124 - protein, 17 aa, Homo sapiens
  Heavy chain CDR3 for antibody 2562 (IGHV3-23)
AKDYDILTGYSHNWFDP

SEQ ID NO: 5125 - protein, 9 aa, Homo sapiens
  Light chain CDR3 for antibody 2563 (IGKV1-9)
QQYNSYPLT

SEQ ID NO: 5126 - protein, 13 aa, Homo sapiens
  Heavy chain CDR3 for antibody 2563 (IGHV1-46)
ARRQVGYYYGMDV

SEQ ID NO: 5127 - protein, 9 aa, Homo sapiens
  Light chain CDR3 for antibody 2564 (IGKV2-30)
MQGTHWPLT

SEQ ID NO: 5128 - protein, 13 aa, Homo sapiens
  Heavy chain CDR3 for antibody 2564 (IGHV3-33)
ARKAYGDYFYFDY

SEQ ID NO: 5129 - protein, 9 aa, Homo sapiens
  Light chain CDR3 for antibody 2565 (IGKV1-17)
LQHNSYPWT

SEQ ID NO: 5130 - protein, 18 aa, Homo sapiens
  Heavy chain CDR3 for antibody 2565 (IGHV3-33)
ARDQGIVVLPGAPWYFDP

SEQ ID NO: 5131 - protein, 9 aa, Homo sapiens
  Light chain CDR3 for antibody 2566 (IGKV1-6)
LQDYKSPFT

SEQ ID NO: 5132 - protein, 13 aa, Homo sapiens
  Heavy chain CDR3 for antibody 2566 (IGHV3-11)
ARDGGAAAGTWDS

SEQ ID NO: 5133 - protein, 9 aa, Homo sapiens
  Light chain CDR3 for antibody 2567 (IGKV6-21)
HQSSSLPLT

SEQ ID NO: 5134 - protein, 12 aa, Homo sapiens
  Heavy chain CDR3 for antibody 2567 (IGHV4-61)
ARVDSSGWFFDY

SEQ ID NO: 5135 - protein, 9 aa, Homo sapiens
  Light chain CDR3 for antibody 2568 (IGKV1-16)
QQYNSYPYT

SEQ ID NO: 5136 - protein, 15 aa, Homo sapiens
  Heavy chain CDR3 for antibody 2568 (IGHV3-33)
ARDRVQLGYYYGMDV

SEQ ID NO: 5137 - protein, 8 aa, Homo sapiens
  Light chain CDR3 for antibody 2569 (IGKV1-5)
QQYNSYYT

SEQ ID NO: 5138 - protein, 13 aa, Homo sapiens
  Heavy chain CDR3 for antibody 2569 (IGHV4-34)
ASNFYYYYYGMDV

SEQ ID NO: 5139 - protein, 9 aa, Homo sapiens
  Light chain CDR3 for antibody 2570 (IGKV1-39)
QQSYRTPLT

SEQ ID NO: 5140 - protein, 14 aa, Homo sapiens
  Heavy chain CDR3 for antibody 2570 (IGHV3-33)
ARRGSPLRPSHLDV

SEQ ID NO: 5141 - protein, 9 aa, Homo sapiens
  Light chain CDR3 for antibody 2571 (IGKV3-20)
QQYGSSPYT

SEQ ID NO: 5142 - protein, 12 aa, Homo sapiens
  Heavy chain CDR3 for antibody 2571 (IGHV4-39)
ARREVILGAFDY

SEQ ID NO: 5143 - protein, 9 aa, Homo sapiens
  Light chain CDR3 for antibody 2572 (IGKV1D-13)
QQFNNYPHT

SEQ ID NO: 5144 - protein, 14 aa, Homo sapiens
  Heavy chain CDR3 for antibody 2572 (IGHV4-39)
ARQDYDILTGLFDY

SEQ ID NO: 5145 - protein, 9 aa, Homo sapiens
  Light chain CDR3 for antibody 2573 (IGKV5-2)
LQHDNFPYT

SEQ ID NO: 5146 - protein, 10 aa, Homo sapiens
  Heavy chain CDR3 for antibody 2573 (IGHV3-33)
AREWFGGFDI

SEQ ID NO: 5147 - protein, 9 aa, Homo sapiens
  Light chain CDR3 for antibody 2574 (IGKV2-30)
MQGTHWPLT

SEQ ID NO: 5148 - protein, 9 aa, Homo sapiens
  Heavy chain CDR3 for antibody 2574 (IGHV3-13)
ARDRWYFDL

SEQ ID NO: 5149 - protein, 9 aa, Homo sapiens
  Light chain CDR3 for antibody 2575 (IGKV1D-16)
QQYNSYPYT

SEQ ID NO: 5150 - protein, 13 aa, Homo sapiens
  Heavy chain CDR3 for antibody 2575 (IGHV3-11)
AREGIAVAGDFDF

SEQ ID NO: 5151 - protein, 9 aa, Homo sapiens
  Light chain CDR3 for antibody 2576 (IGKV1-27)
QKYNSAPYT

SEQ ID NO: 5152 - protein, 13 aa, Homo sapiens
  Heavy chain CDR3 for antibody 2576 (IGHV3-33)
ARVDTMVRGVMAY

SEQ ID NO: 5153 - protein, 9 aa, Homo sapiens
  Light chain CDR3 for antibody 2577 (IGKV1-6)
LQDYNYPYT

SEQ ID NO: 5154 - protein, 14 aa, Homo sapiens
  Heavy chain CDR3 for antibody 2577 (IGHV1-46)
ARAYYAFLTGAFDI

SEQ ID NO: 5155 - protein, 9 aa, Homo sapiens
  Light chain CDR3 for antibody 2578 (IGKV3D-20)
QQYGSSPYT

SEQ ID NO: 5156 - protein, 12 aa, Homo sapiens
  Heavy chain CDR3 for antibody 2578 (IGHV3-33)
ARDGYSSRNFDY

SEQ ID NO: 5157 - protein, 9 aa, Homo sapiens
  Light chain CDR3 for antibody 2579 (IGKV5-2)
LQHDNFPYT

SEQ ID NO: 5158 - protein, 17 aa, Homo sapiens
  Heavy chain CDR3 for antibody 2579 (IGHV3-33)
AREDYDILTGYPFYFDY

SEQ ID NO: 5159 - protein, 9 aa, Homo sapiens
  Light chain CDR3 for antibody 2580 (IGKV5-2)
LQHDNFPYT

SEQ ID NO: 5160 - protein, 24 aa, Homo sapiens
  Heavy chain CDR3 for antibody 2580 (IGHV1-46)
ARDEARGLLTGYYNMREYYYGMDV

SEQ ID NO: 5161 - protein, 8 aa, Homo sapiens
  Light chain CDR3 for antibody 2581 (IGKV3D-7)
QQDYNLLT

SEQ ID NO: 5162 - protein, 13 aa, Homo sapiens
  Heavy chain CDR3 for antibody 2581 (IGHV3-23)
ASPFNWNDGFFDY

SEQ ID NO: 5163 - protein, 9 aa, Homo sapiens
  Light chain CDR3 for antibody 2582 (IGKV1-39)
QQSYSTPLT

SEQ ID NO: 5164 - protein, 13 aa, Homo sapiens
  Heavy chain CDR3 for antibody 2582 (IGHV3-33)
ARGVLWFGELFDY

SEQ ID NO: 5165 - protein, 8 aa, Homo sapiens
  Light chain CDR3 for antibody 2583 (IGKV3D-7)
QQDYNLLT

SEQ ID NO: 5166 - protein, 13 aa, Homo sapiens
  Heavy chain CDR3 for antibody 2583 (IGHV4-39)
ARHVLLWFGEFDP

SEQ ID NO: 5167 - protein, 9 aa, Homo sapiens
  Light chain CDR3 for antibody 2584 (IGKV3-20)
QQYGSSPYT

SEQ ID NO: 5168 - protein, 18 aa, Homo sapiens
  Heavy chain CDR3 for antibody 2584 (IGHV3-33)
ARDQGIVVLPGAPWYFDP

SEQ ID NO: 5169 - protein, 9 aa, Homo sapiens
  Light chain CDR3 for antibody 2585 (IGKV1-17)
LQHNSYPPT

SEQ ID NO: 5170 - protein, 15 aa, Homo sapiens
  Heavy chain CDR3 for antibody 2585 (IGHV3-33)
ARGVDILTGYSSFDY

SEQ ID NO: 5171 - protein, 10 aa, Homo sapiens
  Light chain CDR3 for antibody 2586 (IGKV3-11)
QQRSNWPIFT

SEQ ID NO: 5172 - protein, 18 aa, Homo sapiens
  Heavy chain CDR3 for antibody 2586 (IGHV3-33)
ARREGIVGATTYYYGMDV

SEQ ID NO: 5173 - protein, 9 aa, Homo sapiens
  Light chain CDR3 for antibody 2587 (IGKV5-2)
LQHDNFPYT

SEQ ID NO: 5174 - protein, 17 aa, Homo sapiens
  Heavy chain CDR3 for antibody 2587 (IGHV3-23)
AKDRPVTTLYYYFGMDV

SEQ ID NO: 5175 - protein, 9 aa, Homo sapiens
  Light chain CDR3 for antibody 2588 (IGKV1-17)
LQHNSYPYT

SEQ ID NO: 5176 - protein, 13 aa, Homo sapiens
  Heavy chain CDR3 for antibody 2588 (IGHV4-39)
ARRDVLAPAAFDY

SEQ ID NO: 5177 - protein, 9 aa, Homo sapiens
  Light chain CDR3 for antibody 2589 (IGKV3-20)
QQYGSSPYT

SEQ ID NO: 5178 - protein, 17 aa, Homo sapiens
  Heavy chain CDR3 for antibody 2589 (IGHV3-30)
AREGVRGLIYYYYGMDV

SEQ ID NO: 5179 - protein, 9 aa, Homo sapiens
  Light chain CDR3 for antibody 2590 (IGKV1-39)
QQSYSTPLT

SEQ ID NO: 5180 - protein, 8 aa, Homo sapiens
  Heavy chain CDR3 for antibody 2590 (IGHV3-33)
ARDRGFDY

SEQ ID NO: 5181 - protein, 9 aa, Homo sapiens
  Light chain CDR3 for antibody 2591 (IGKV3-11)
QQRSNWPYT

SEQ ID NO: 5182 - protein, 18 aa, Homo sapiens
  Heavy chain CDR3 for antibody 2591 (IGHV1-46)
ARDGDYVWGSYRSDWFDP

SEQ ID NO: 5183 - protein, 9 aa, Homo sapiens
  Light chain CDR3 for antibody 2592 (IGKV3-11)
QQRSNWPWT

SEQ ID NO: 5184 - protein, 12 aa, Homo sapiens
  Heavy chain CDR3 for antibody 2592 (IGHV4-59)
ARDRSGWAYFDY

SEQ ID NO: 5185 - protein, 9 aa, Homo sapiens
  Light chain CDR3 for antibody 2593 (IGKV6-21)
HQSSSLPYT

SEQ ID NO: 5186 - protein, 18 aa, Homo sapiens
  Heavy chain CDR3 for antibody 2593 (IGHV3-33)
ARDGRISLVRGIIDAFDI

SEQ ID NO: 5187 - protein, 8 aa, Homo sapiens
  Light chain CDR3 for antibody 2594 (IGKV3-11)
QQRSNWLT

SEQ ID NO: 5188 - protein, 13 aa, Homo sapiens
  Heavy chain CDR3 for antibody 2594 (IGHV4-59)
ARDAGYSSSWFDY

SEQ ID NO: 5189 - protein, 9 aa, Homo sapiens
  Light chain CDR3 for antibody 2595 (IGKV1-17)
LQHNSYPYT

SEQ ID NO: 5190 - protein, 12 aa, Homo sapiens
  Heavy chain CDR3 for antibody 2595 (IGHV3-33)
ARGYFTSGSAHY

SEQ ID NO: 5191 - protein, 9 aa, Homo sapiens
  Light chain CDR3 for antibody 2596 (IGKV1D-13)
QQFNNYPYT

SEQ ID NO: 5192 - protein, 7 aa, Homo sapiens
  Heavy chain CDR3 for antibody 2596 (IGHV3-33)
ARELVDY

SEQ ID NO: 5193 - protein, 9 aa, Homo sapiens
  Light chain CDR3 for antibody 2597 (IGKV1-27)
QKYNSAPYT

SEQ ID NO: 5194 - protein, 12 aa, Homo sapiens
  Heavy chain CDR3 for antibody 2597 (IGHV3-33)
ARKGYDMHEFDI

SEQ ID NO: 5195 - protein, 9 aa, Homo sapiens
  Light chain CDR3 for antibody 2598 (IGKV1-9)
QQLNSYPYT

SEQ ID NO: 5196 - protein, 14 aa, Homo sapiens
  Heavy chain CDR3 for antibody 2598 (IGHV3-66)
ARDRDYYYYYGMDV

SEQ ID NO: 5197 - protein, 9 aa, Homo sapiens
  Light chain CDR3 for antibody 2599 (IGKV3-15)
QQYNNWPLT

SEQ ID NO: 5198 - protein, 9 aa, Homo sapiens
  Heavy chain CDR3 for antibody 2599 (IGHV4-59)
AREGGSGSL

SEQ ID NO: 5199 - protein, 9 aa, Homo sapiens
  Light chain CDR3 for antibody 2600 (IGKV1D-16)
QQYNSFPLT

SEQ ID NO: 5200 - protein, 11 aa, Homo sapiens
  Heavy chain CDR3 for antibody 2600 (IGHV4-59)
ARSLRYSFFDY

SEQ ID NO: 5201 - protein, 9 aa, Homo sapiens
  Light chain CDR3 for antibody 2601 (IGKV5-2)
LQHDNFPWT

SEQ ID NO: 5202 - protein, 18 aa, Homo sapiens
  Heavy chain CDR3 for antibody 2601 (IGHV1-8)
AREGAAAGSYYYYNGMDV

SEQ ID NO: 5203 - protein, 8 aa, Homo sapiens
  Light chain CDR3 for antibody 2602 (IGKV3D-7)
QQDYNLLT

SEQ ID NO: 5204 - protein, 14 aa, Homo sapiens
  Heavy chain CDR3 for antibody 2602 (IGHV3-33)
ARDREQQLVRYFDY

SEQ ID NO: 5205 - protein, 8 aa, Homo sapiens
  Light chain CDR3 for antibody 2603 (IGKV1D-13)
QQFNNYPT

SEQ ID NO: 5206 - protein, 12 aa, Homo sapiens
  Heavy chain CDR3 for antibody 2603 (IGHV3-33)
ARGYFGSGYAHF

SEQ ID NO: 5207 - protein, 9 aa, Homo sapiens
  Light chain CDR3 for antibody 2604 (IGKV3-15)
QQYNNWPIT

SEQ ID NO: 5208 - protein, 14 aa, Homo sapiens
  Heavy chain CDR3 for antibody 2604 (IGHV3-13)
AREVSMVRGVIFDY

SEQ ID NO: 5209 - protein, 9 aa, Homo sapiens
  Light chain CDR3 for antibody 2605 (IGKV6-21)
HQSSSLPYT

SEQ ID NO: 5210 - protein, 15 aa, Homo sapiens
  Heavy chain CDR3 for antibody 2605 (IGHV3-33)
ARDGSGSYSLYGMDV

SEQ ID NO: 5211 - protein, 9 aa, Homo sapiens
  Light chain CDR3 for antibody 2606 (IGKV5-2)
LQHDNFPWT

SEQ ID NO: 5212 - protein, 12 aa, Homo sapiens
  Heavy chain CDR3 for antibody 2606 (IGHV4-34)
ARGYSSSWYFDY

SEQ ID NO: 5213 - protein, 9 aa, Homo sapiens
  Light chain CDR3 for antibody 2607 (IGKV1-39)
QQSYSTPLT

SEQ ID NO: 5214 - protein, 9 aa, Homo sapiens
  Heavy chain CDR3 for antibody 2607 (IGHV3-30)
ARDYFHYDY

SEQ ID NO: 5215 - protein, 9 aa, Homo sapiens
  Light chain CDR3 for antibody 2608 (IGKV1-39)
QQSYSTPLT

SEQ ID NO: 5216 - protein, 11 aa, Homo sapiens
  Heavy chain CDR3 for antibody 2608 (IGHV3-33)
ARDILTGFLDH

SEQ ID NO: 5217 - protein, 9 aa, Homo sapiens
  Light chain CDR3 for antibody 2609 (IGKV1D-16)
QQYNSYPYT

SEQ ID NO: 5218 - protein, 17 aa, Homo sapiens
  Heavy chain CDR3 for antibody 2609 (IGHV3-23)
AREGYYDILTDYYGMDV

SEQ ID NO: 5219 - protein, 9 aa, Homo sapiens
  Light chain CDR3 for antibody 2610 (IGKV1-6)
QQEYNYPLT

SEQ ID NO: 5220 - protein, 17 aa, Homo sapiens
  Heavy chain CDR3 for antibody 2610 (IGHV1-18)
ARDEGYDILTGYPHFDY

SEQ ID NO: 5221 - protein, 9 aa, Homo sapiens
  Light chain CDR3 for antibody 2611 (IGKV1D-13)
QQFNNYPYT

SEQ ID NO: 5222 - protein, 17 aa, Homo sapiens
  Heavy chain CDR3 for antibody 2611 (IGHV3-64)
ARERYYGSGSYYNWFDP

SEQ ID NO: 5223 - protein, 8 aa, Homo sapiens
  Light chain CDR3 for antibody 2612 (IGKV1-5)
QQYNSYWT

SEQ ID NO: 5224 - protein, 13 aa, Homo sapiens
  Heavy chain CDR3 for antibody 2612 (IGHV3-33)
ARDWGYSHGYFDY

SEQ ID NO: 5225 - protein, 9 aa, Homo sapiens
  Light chain CDR3 for antibody 2613 (IGKV1-9)
QQLISYPLT

SEQ ID NO: 5226 - protein, 13 aa, Homo sapiens
  Heavy chain CDR3 for antibody 2613 (IGHV3-33)
ARDQRYSSGWYDY

SEQ ID NO: 5227 - protein, 9 aa, Homo sapiens
  Light chain CDR3 for antibody 2614 (IGKV5-2)
LQHDNFPYT

SEQ ID NO: 5228 - protein, 14 aa, Homo sapiens
  Heavy chain CDR3 for antibody 2614 (IGHV3-33)
ARDAYDILTGYYDY

SEQ ID NO: 5229 - protein, 9 aa, Homo sapiens
  Light chain CDR3 for antibody 2615 (IGKV1-27)
QKYNSAPYT

SEQ ID NO: 5230 - protein, 14 aa, Homo sapiens
  Heavy chain CDR3 for antibody 2615 (IGHV3-23)
ANWAYDILTGYLDY

SEQ ID NO: 5231 - protein, 9 aa, Homo sapiens
  Light chain CDR3 for antibody 2616 (IGKV3-20)
QQYGSSPYT

SEQ ID NO: 5232 - protein, 13 aa, Homo sapiens
  Heavy chain CDR3 for antibody 2616 (IGHV3-33)
AREYCSGGSCYDY

SEQ ID NO: 5233 - protein, 9 aa, Homo sapiens
  Light chain CDR3 for antibody 2617 (IGKV3-20)
QQYGSSPYT

SEQ ID NO: 5234 - protein, 17 aa, Homo sapiens
  Heavy chain CDR3 for antibody 2617 (IGHV3-33)
ARQGVLLWFGELYYFDY

SEQ ID NO: 5235 - protein, 9 aa, Homo sapiens
  Light chain CDR3 for antibody 2618 (IGKV1D-13)
QQFNNYPYT

SEQ ID NO: 5236 - protein, 19 aa, Homo sapiens
  Heavy chain CDR3 for antibody 2618 (IGHV3-33)
ARDSGYSGYDYYYYYGMDV

SEQ ID NO: 5237 - protein, 9 aa, Homo sapiens
  Light chain CDR3 for antibody 2619 (IGKV5-2)
LQHDNFPWT

SEQ ID NO: 5238 - protein, 9 aa, Homo sapiens
  Heavy chain CDR3 for antibody 2619 (IGHV4-34)
ARDLYYFDY

SEQ ID NO: 5239 - protein, 9 aa, Homo sapiens
  Light chain CDR3 for antibody 2620 (IGKV6-21)
HQSSSLPYT

SEQ ID NO: 5240 - protein, 16 aa, Homo sapiens
  Heavy chain CDR3 for antibody 2620 (IGHV3-20)
AREGYSSSWFDRNFDY

SEQ ID NO: 5241 - protein, 9 aa, Homo sapiens
  Light chain CDR3 for antibody 2621 (IGKV1-39)
QQSYSTPLT

SEQ ID NO: 5242 - protein, 11 aa, Homo sapiens
  Heavy chain CDR3 for antibody 2621 (IGHV3-23)
AKGLWSYYFDY

SEQ ID NO: 5243 - protein, 9 aa, Homo sapiens
  Light chain CDR3 for antibody 2622 (IGKV3D-20)
QQYGSGPWT

SEQ ID NO: 5244 - protein, 15 aa, Homo sapiens
  Heavy chain CDR3 for antibody 2622 (IGHV3-64)
ARDSRPEITGPPFDY

SEQ ID NO: 5245 - protein, 9 aa, Homo sapiens
  Light chain CDR3 for antibody 2623 (IGKV2-30)
MQGTHWPLT

SEQ ID NO: 5246 - protein, 12 aa, Homo sapiens
  Heavy chain CDR3 for antibody 2623 (IGHV3-13)
AREAGIPDAFDI

SEQ ID NO: 5247 - protein, 11 aa, Homo sapiens
  Light chain CDR3 for antibody 2624 (IGKV3-11)
QQRSNWPPTWT

SEQ ID NO: 5248 - protein, 16 aa, Homo sapiens
  Heavy chain CDR3 for antibody 2624 (IGHV3-23)
AKEGMVLRYFDWLWDY

SEQ ID NO: 5249 - protein, 10 aa, Homo sapiens
  Light chain CDR3 for antibody 2625 (IGKV3-11)
QQRSNWPIFT

SEQ ID NO: 5250 - protein, 13 aa, Homo sapiens
  Heavy chain CDR3 for antibody 2625 (IGHV3-11)
ARDEGYRGYVLDT

SEQ ID NO: 5251 - protein, 9 aa, Homo sapiens
  Light chain CDR3 for antibody 2626 (IGKV1-27)
QKYNSAPYT

SEQ ID NO: 5252 - protein, 14 aa, Homo sapiens
  Heavy chain CDR3 for antibody 2626 (IGHV3-33)
ARDGYDFLTGPFDY

SEQ ID NO: 5253 - protein, 9 aa, Homo sapiens
  Light chain CDR3 for antibody 2627 (IGKV1-6)
LQDYNYPYT

SEQ ID NO: 5254 - protein, 14 aa, Homo sapiens
  Heavy chain CDR3 for antibody 2627 (IGHV3-20)
ARDRGSSFFDAFDI

SEQ ID NO: 5255 - protein, 9 aa, Homo sapiens
  Light chain CDR3 for antibody 2628 (IGKV1-6)
LQDYNYPYT

SEQ ID NO: 5256 - protein, 14 aa, Homo sapiens
  Heavy chain CDR3 for antibody 2628 (IGHV1-46)
ARKGIVGGFDAFDV

SEQ ID NO: 5257 - protein, 8 aa, Homo sapiens
  Light chain CDR3 for antibody 2629 (IGKV3D-7)
QQDYNLLT

SEQ ID NO: 5258 - protein, 17 aa, Homo sapiens
  Heavy chain CDR3 for antibody 2629 (IGHV1-18)
ARDEGYDILTGYPHFDY

SEQ ID NO: 5259 - protein, 9 aa, Homo sapiens
  Light chain CDR3 for antibody 2630 (IGKV1-6)
LQDYNYPYT

SEQ ID NO: 5260 - protein, 19 aa, Homo sapiens
  Heavy chain CDR3 for antibody 2630 (IGHV4-39)
ARQGDVLRYFDWLLGAFDI

SEQ ID NO: 5261 - protein, 9 aa, Homo sapiens
  Light chain CDR3 for antibody 2631 (IGKV1-27)
QKYNSAPYT

SEQ ID NO: 5262 - protein, 14 aa, Homo sapiens
  Heavy chain CDR3 for antibody 2631 (IGHV3-33)
ARRGSPLRPSHLDV

SEQ ID NO: 5263 - protein, 10 aa, Homo sapiens
  Light chain CDR3 for antibody 2632 (IGKV3-15)
QQYNNWPPLT

SEQ ID NO: 5264 - protein, 11 aa, Homo sapiens
  Heavy chain CDR3 for antibody 2632 (IGHV3-33)
ARDRSSGPFDY

SEQ ID NO: 5265 - protein, 9 aa, Homo sapiens
  Light chain CDR3 for antibody 2633 (IGKV1-17)
LQHNSYPRT

SEQ ID NO: 5266 - protein, 9 aa, Homo sapiens
  Heavy chain CDR3 for antibody 2633 (IGHV3-33)
VGPYSGYEY

SEQ ID NO: 5267 - protein, 9 aa, Homo sapiens
  Light chain CDR3 for antibody 2634 (IGKV2-30)
MQGTHWPLT

SEQ ID NO: 5268 - protein, 18 aa, Homo sapiens
  Heavy chain CDR3 for antibody 2634 (IGHV4-59)
AREGHYYTSGSYYKAFDY

SEQ ID NO: 5269 - protein, 9 aa, Homo sapiens
  Light chain CDR3 for antibody 2635 (IGKV1-27)
QKYNSAPYT

SEQ ID NO: 5270 - protein, 18 aa, Homo sapiens
  Heavy chain CDR3 for antibody 2635 (IGHV3-33)
ARGGYSSGWDYYYYGMDV

SEQ ID NO: 5271 - protein, 9 aa, Homo sapiens
  Light chain CDR3 for antibody 2636 (IGKV3-11)
QQRSNWPLT

SEQ ID NO: 5272 - protein, 13 aa, Homo sapiens
  Heavy chain CDR3 for antibody 2636 (IGHV3-23)
ASTGDSYYYGMDV

SEQ ID NO: 5273 - protein, 9 aa, Homo sapiens
  Light chain CDR3 for antibody 2637 (IGKV1-16)
QQYNSYPYT

SEQ ID NO: 5274 - protein, 10 aa, Homo sapiens
  Heavy chain CDR3 for antibody 2637 (IGHV1-46)
AREWELLFDY

SEQ ID NO: 5275 - protein, 8 aa, Homo sapiens
  Light chain CDR3 for antibody 2638 (IGKV3-20)
QQYGSSLT

SEQ ID NO: 5276 - protein, 13 aa, Homo sapiens
  Heavy chain CDR3 for antibody 2638 (IGHV3-11)
ARDGGAAAGTWDS

SEQ ID NO: 5277 - protein, 9 aa, Homo sapiens
  Light chain CDR3 for antibody 2639 (IGKV3D-7)
QQDYNLPYT

SEQ ID NO: 5278 - protein, 13 aa, Homo sapiens
  Heavy chain CDR3 for antibody 2639 (IGHV4-61)
ASRYSSGWYPFDY

SEQ ID NO: 5279 - protein, 9 aa, Homo sapiens
  Light chain CDR3 for antibody 2640 (IGKV1-6)
LQDYNYPYT

SEQ ID NO: 5280 - protein, 14 aa, Homo sapiens
  Heavy chain CDR3 for antibody 2640 (IGHV3-33)
ARWELPFYYSGMDV

SEQ ID NO: 5281 - protein, 9 aa, Homo sapiens
  Light chain CDR3 for antibody 2641 (IGKV1-27)
QKYNSAPYT

SEQ ID NO: 5282 - protein, 14 aa, Homo sapiens
  Heavy chain CDR3 for antibody 2641 (IGHV4-39)
ARQDYDILTGLFDY

SEQ ID NO: 5283 - protein, 8 aa, Homo sapiens
  Light chain CDR3 for antibody 2642 (IGKV3D-7)
QQDYNLLT

SEQ ID NO: 5284 - protein, 18 aa, Homo sapiens
  Heavy chain CDR3 for antibody 2642 (IGHV4-59)
AREGHYYTSGSYYKAFDY

SEQ ID NO: 5285 - protein, 9 aa, Homo sapiens
  Light chain CDR3 for antibody 2643 (IGKV3D-7)
QQDYSFPLT

SEQ ID NO: 5286 - protein, 12 aa, Homo sapiens
  Heavy chain CDR3 for antibody 2643 (IGHV4-61)
ARVDSSGWYFDY

SEQ ID NO: 5287 - protein, 9 aa, Homo sapiens
  Light chain CDR3 for antibody 2644 (IGKV5-2)
LQHDNFPYT

SEQ ID NO: 5288 - protein, 17 aa, Homo sapiens
  Heavy chain CDR3 for antibody 2644 (IGHV3-33)
ARQGVLLWFGELYYFDY

SEQ ID NO: 5289 - protein, 9 aa, Homo sapiens
  Light chain CDR3 for antibody 2645 (IGKV1-17)
LQHNSYPYT

SEQ ID NO: 5290 - protein, 6 aa, Homo sapiens
  Heavy chain CDR3 for antibody 2645 (IGHV1-8)
AREGTY

SEQ ID NO: 5291 - protein, 9 aa, Homo sapiens
  Light chain CDR3 for antibody 2646 (IGKV3D-7)
QQDYNLPLT

SEQ ID NO: 5292 - protein, 18 aa, Homo sapiens
  Heavy chain CDR3 for antibody 2646 (IGHV3-23)
AKEGNYYGSGSYWGYFDP

SEQ ID NO: 5293 - protein, 9 aa, Homo sapiens
  Light chain CDR3 for antibody 2647 (IGKV5-2)
LQHDNFPYT

SEQ ID NO: 5294 - protein, 17 aa, Homo sapiens
  Heavy chain CDR3 for antibody 2647 (IGHV3-30)
AREGVRGLIYYYYGMDV

SEQ ID NO: 5295 - protein, 9 aa, Homo sapiens
  Light chain CDR3 for antibody 2648 (IGKV1D-13)
QQFNNYPYT

SEQ ID NO: 5296 - protein, 12 aa, Homo sapiens
  Heavy chain CDR3 for antibody 2648 (IGHV1-46)
AREDYDIDGMDV

SEQ ID NO: 5297 - protein, 9 aa, Homo sapiens
  Light chain CDR3 for antibody 2649 (IGKV1-9)
QQLNSYPLT

SEQ ID NO: 5298 - protein, 14 aa, Homo sapiens
  Heavy chain CDR3 for antibody 2649 (IGHV3-33)
VRDAMGATTAWFDP

SEQ ID NO: 5299 - protein, 9 aa, Homo sapiens
  Light chain CDR3 for antibody 2650 (IGKV1-39)
QQSYRTPLT

SEQ ID NO: 5300 - protein, 19 aa, Homo sapiens
  Heavy chain CDR3 for antibody 2650 (IGHV3-30)
ARRFSGYSGYDHYYYGMDV

SEQ ID NO: 5301 - protein, 9 aa, Homo sapiens
  Light chain CDR3 for antibody 2651 (IGKV6-21)
HQSSSLPYT

SEQ ID NO: 5302 - protein, 19 aa, Homo sapiens
  Heavy chain CDR3 for antibody 2651 (IGHV1-24)
ATAGLQWFGEKIGYYGMDV

SEQ ID NO: 5303 - protein, 9 aa, Homo sapiens
  Light chain CDR3 for antibody 2652 (IGKV1-39)
QQSYSTPLT

SEQ ID NO: 5304 - protein, 18 aa, Homo sapiens
  Heavy chain CDR3 for antibody 2652 (IGHV1-18)
ARDRYYYDSGSYYYGMDV

SEQ ID NO: 5305 - protein, 9 aa, Homo sapiens
  Light chain CDR3 for antibody 2653 (IGKV3D-7)
QQDYNLPLT

SEQ ID NO: 5306 - protein, 10 aa, Homo sapiens
  Heavy chain CDR3 for antibody 2653 (IGHV3-33)
ARDVVVYFDY

SEQ ID NO: 5307 - protein, 9 aa, Homo sapiens
  Light chain CDR3 for antibody 2654 (IGKV6-21)
HQSSSLPYT

SEQ ID NO: 5308 - protein, 8 aa, Homo sapiens
  Heavy chain CDR3 for antibody 2654 (IGHV4-39)
ARRGGLDY

SEQ ID NO: 5309 - protein, 9 aa, Homo sapiens
  Light chain CDR3 for antibody 2655 (IGKV3D-7)
QQDYNLPLT

SEQ ID NO: 5310 - protein, 13 aa, Homo sapiens
  Heavy chain CDR3 for antibody 2655 (IGHV3-53)
ARSGSYWGYYFDY

SEQ ID NO: 5311 - protein, 9 aa, Homo sapiens
  Light chain CDR3 for antibody 2656 (IGKV1-27)
QKYNSAPYT

SEQ ID NO: 5312 - protein, 14 aa, Homo sapiens
  Heavy chain CDR3 for antibody 2656 (IGHV4-39)
ARDSGYDYYYGMDV

SEQ ID NO: 5313 - protein, 9 aa, Homo sapiens
  Light chain CDR3 for antibody 2657 (IGKV1-39)
QQSYSTPLT

SEQ ID NO: 5314 - protein, 14 aa, Homo sapiens
  Heavy chain CDR3 for antibody 2657 (IGHV3-20)
ARDGGSTCYDWFDP

SEQ ID NO: 5315 - protein, 9 aa, Homo sapiens
  Light chain CDR3 for antibody 2658 (IGKV3-11)
QQYSNWPLT

SEQ ID NO: 5316 - protein, 10 aa, Homo sapiens
  Heavy chain CDR3 for antibody 2658 (IGHV3-33)
ARENSTPLDY

SEQ ID NO: 5317 - protein, 9 aa, Homo sapiens
  Light chain CDR3 for antibody 2659 (IGKV1-39)
QQSYRTPLT

SEQ ID NO: 5318 - protein, 15 aa, Homo sapiens
  Heavy chain CDR3 for antibody 2659 (IGHV3-33)
VCVLYDYGDYVGFDY

SEQ ID NO: 5319 - protein, 9 aa, Homo sapiens
  Light chain CDR3 for antibody 2660 (IGKV2-30)
MQGTHWPLT

SEQ ID NO: 5320 - protein, 12 aa, Homo sapiens
  Heavy chain CDR3 for antibody 2660 (IGHV3-33)
ARDLVGATPFDY

SEQ ID NO: 5321 - protein, 9 aa, Homo sapiens
  Light chain CDR3 for antibody 2661 (IGKV1-17)
LQHNSYPYT

SEQ ID NO: 5322 - protein, 12 aa, Homo sapiens
  Heavy chain CDR3 for antibody 2661 (IGHV4-34)
ARGYSSSWYFDY

SEQ ID NO: 5323 - protein, 9 aa, Homo sapiens
  Light chain CDR3 for antibody 2662 (IGKV1D-13)
QQFNNYPHT

SEQ ID NO: 5324 - protein, 10 aa, Homo sapiens
  Heavy chain CDR3 for antibody 2662 (IGHV3-33)
ARDGSGSQPI

SEQ ID NO: 5325 - protein, 9 aa, Homo sapiens
  Light chain CDR3 for antibody 2663 (IGKV6-21)
HQSSSLPYT

SEQ ID NO: 5326 - protein, 12 aa, Homo sapiens
  Heavy chain CDR3 for antibody 2663 (IGHV3-33)
AKDPGWQQLAEY

SEQ ID NO: 5327 - protein, 9 aa, Homo sapiens
  Light chain CDR3 for antibody 2664 (IGKV1D-16)
QQYNSYPYT

SEQ ID NO: 5328 - protein, 22 aa, Homo sapiens
  Heavy chain CDR3 for antibody 2664 (IGHV3-23)
AKDDLPYYDILTHSTTTGGMDV

SEQ ID NO: 5329 - protein, 9 aa, Homo sapiens
  Light chain CDR3 for antibody 2665 (IGKV1-39)
QQSYSTPYT

SEQ ID NO: 5330 - protein, 16 aa, Homo sapiens
  Heavy chain CDR3 for antibody 2665 (IGHV1-18)
ARYFDWLLRDYYGMDV

SEQ ID NO: 5331 - protein, 9 aa, Homo sapiens
  Light chain CDR3 for antibody 2666 (IGKV6-21)
HQSSSLPYT

SEQ ID NO: 5332 - protein, 18 aa, Homo sapiens
  Heavy chain CDR3 for antibody 2666 (IGHV3-33)
ARDRGDILTGYYKGWFDP

SEQ ID NO: 5333 - protein, 9 aa, Homo sapiens
  Light chain CDR3 for antibody 2667 (IGKV1-27)
QKYNSAPYT

SEQ ID NO: 5334 - protein, 21 aa, Homo sapiens
  Heavy chain CDR3 for antibody 2667 (IGHV3-33)
ARDEYYEIVTGYGYYHYGMDV

SEQ ID NO: 5335 - protein, 9 aa, Homo sapiens
  Light chain CDR3 for antibody 2668 (IGKV3-11)
QQRSNWPPT

SEQ ID NO: 5336 - protein, 15 aa, Homo sapiens
  Heavy chain CDR3 for antibody 2668 (IGHV3-33)
ARRVCSGGSCSLFDY

SEQ ID NO: 5337 - protein, 9 aa, Homo sapiens
  Light chain CDR3 for antibody 2669 (IGKV1D-13)
QQFNNYPYT

SEQ ID NO: 5338 - protein, 12 aa, Homo sapiens
  Heavy chain CDR3 for antibody 2669 (IGHV3-23)
AKEYDILTGYFH

SEQ ID NO: 5339 - protein, 8 aa, Homo sapiens
  Light chain CDR3 for antibody 2670 (IGKV1-5)
QQYNSYST

SEQ ID NO: 5340 - protein, 12 aa, Homo sapiens
  Heavy chain CDR3 for antibody 2670 (IGHV1-18)
ARILFYGDYFDY

SEQ ID NO: 5341 - protein, 9 aa, Homo sapiens
  Light chain CDR3 for antibody 2671 (IGKV5-2)
LQHDNFPWT

SEQ ID NO: 5342 - protein, 18 aa, Homo sapiens
  Heavy chain CDR3 for antibody 2671 (IGHV4-59)
ARDNHYYSSGTYSNWFDP

SEQ ID NO: 5343 - protein, 8 aa, Homo sapiens
  Light chain CDR3 for antibody 2672 (IGKV1D-13)
QQFNNYPT

SEQ ID NO: 5344 - protein, 18 aa, Homo sapiens
  Heavy chain CDR3 for antibody 2672 (IGHV1-46)
ARDGDYVWGSYRSDWFDP

SEQ ID NO: 5345 - protein, 9 aa, Homo sapiens
  Light chain CDR3 for antibody 2673 (IGKV1-33)
QQYDNLPFT

SEQ ID NO: 5346 - protein, 13 aa, Homo sapiens
  Heavy chain CDR3 for antibody 2673 (IGHV3-33)
ARDYCGGDCYLDY

SEQ ID NO: 5347 - protein, 9 aa, Homo sapiens
  Light chain CDR3 for antibody 2674 (IGKV2-30)
MQGTHWPLT

SEQ ID NO: 5348 - protein, 18 aa, Homo sapiens
  Heavy chain CDR3 for antibody 2674 (IGHV1-46)
ARDGDYVWGSYRSDWFDP

SEQ ID NO: 5349 - protein, 9 aa, Homo sapiens
  Light chain CDR3 for antibody 2675 (IGKV5-2)
LQHDNFPYT

SEQ ID NO: 5350 - protein, 18 aa, Homo sapiens
  Heavy chain CDR3 for antibody 2675 (IGHV3-23)
AKVGDFFASGNYWDYFDY

SEQ ID NO: 5351 - protein, 9 aa, Homo sapiens
  Light chain CDR3 for antibody 2676 (IGKV1D-16)
QQYNSYPLT

SEQ ID NO: 5352 - protein, 12 aa, Homo sapiens
  Heavy chain CDR3 for antibody 2676 (IGHV3-33)
ARDYISTYGMDV

SEQ ID NO: 5353 - protein, 9 aa, Homo sapiens
  Light chain CDR3 for antibody 2677 (IGKV1-27)
QKYNSAPYT

SEQ ID NO: 5354 - protein, 13 aa, Homo sapiens
  Heavy chain CDR3 for antibody 2677 (IGHV3-33)
ARQSSGWFDAFDI

SEQ ID NO: 5355 - protein, 9 aa, Homo sapiens
  Light chain CDR3 for antibody 2678 (IGKV3-20)
QQYGSSPWT

SEQ ID NO: 5356 - protein, 11 aa, Homo sapiens
  Heavy chain CDR3 for antibody 2678 (IGHV4-59)
ARSLRYSFFDY

SEQ ID NO: 5357 - protein, 9 aa, Homo sapiens
  Light chain CDR3 for antibody 2679 (IGKV3-20)
QQYGSSPYT

SEQ ID NO: 5358 - protein, 15 aa, Homo sapiens
  Heavy chain CDR3 for antibody 2679 (IGHV3-11)
ARDRAVAGTIHAFDI

SEQ ID NO: 5359 - protein, 9 aa, Homo sapiens
  Light chain CDR3 for antibody 2680 (IGKV3-11)
QQRSNWPLT

SEQ ID NO: 5360 - protein, 18 aa, Homo sapiens
  Heavy chain CDR3 for antibody 2680 (IGHV3-33)
ARGYYGSGNFYKDSGMDV

SEQ ID NO: 5361 - protein, 10 aa, Homo sapiens
  Light chain CDR3 for antibody 2681 (IGKV3-11)
QQRSNWPIFT

SEQ ID NO: 5362 - protein, 9 aa, Homo sapiens
  Heavy chain CDR3 for antibody 2681 (IGHV3-30)
ARDNWGFDY

SEQ ID NO: 5363 - protein, 9 aa, Homo sapiens
  Light chain CDR3 for antibody 2682 (IGKV2-30)
MQGTHWPLT

SEQ ID NO: 5364 - protein, 15 aa, Homo sapiens
  Heavy chain CDR3 for antibody 2682 (IGHV3-33)
ARDTGYSSSWNWFDP

SEQ ID NO: 5365 - protein, 9 aa, Homo sapiens
  Light chain CDR3 for antibody 2683 (IGKV1-6)
LQDYNYPYT

SEQ ID NO: 5366 - protein, 18 aa, Homo sapiens
  Heavy chain CDR3 for antibody 2683 (IGHV1-18)
ARDGYYGSGSFYYYGMDV

SEQ ID NO: 5367 - protein, 9 aa, Homo sapiens
  Light chain CDR3 for antibody 2684 (IGKV1D-13)
QQFNNYPYT

SEQ ID NO: 5368 - protein, 16 aa, Homo sapiens
  Heavy chain CDR3 for antibody 2684 (IGHV3-13)
ARDRSYESYYYYGMDV

SEQ ID NO: 5369 - protein, 8 aa, Homo sapiens
  Light chain CDR3 for antibody 2685 (IGKV3D-7)
QQDYNLLT

SEQ ID NO: 5370 - protein, 12 aa, Homo sapiens
  Heavy chain CDR3 for antibody 2685 (IGHV4-59)
ARDRSGWAYFDY

SEQ ID NO: 5371 - protein, 9 aa, Homo sapiens
  Light chain CDR3 for antibody 2686 (IGKV5-2)
LQHDNFPYT

SEQ ID NO: 5372 - protein, 16 aa, Homo sapiens
  Heavy chain CDR3 for antibody 2686 (IGHV3-20)
AREGYSSSWFDRNFDY

SEQ ID NO: 5373 - protein, 9 aa, Homo sapiens
  Light chain CDR3 for antibody 2687 (IGKV3D-7)
QQDYDLPYT

SEQ ID NO: 5374 - protein, 14 aa, Homo sapiens
  Heavy chain CDR3 for antibody 2687 (IGHV3-33)
ARDGSGSYPLYFDY

SEQ ID NO: 5375 - protein, 8 aa, Homo sapiens
  Light chain CDR3 for antibody 2688 (IGKV1D-13)
QQFNNYPT

SEQ ID NO: 5376 - protein, 12 aa, Homo sapiens
  Heavy chain CDR3 for antibody 2688 (IGHV1-18)
ARILFYGDYFDY

SEQ ID NO: 5377 - protein, 9 aa, Homo sapiens
  Light chain CDR3 for antibody 2689 (IGKV3-20)
QQYGSSPYT

SEQ ID NO: 5378 - protein, 15 aa, Homo sapiens
  Heavy chain CDR3 for antibody 2689 (IGHV3-33)
AREGLRYFHYYGMDV

SEQ ID NO: 5379 - protein, 9 aa, Homo sapiens
  Light chain CDR3 for antibody 2690 (IGKV3D-7)
QQDYNLPLT

SEQ ID NO: 5380 - protein, 13 aa, Homo sapiens
  Heavy chain CDR3 for antibody 2690 (IGHV3-33)
ARRATLVRGVFDP

SEQ ID NO: 5381 - protein, 9 aa, Homo sapiens
  Light chain CDR3 for antibody 2691 (IGKV6-21)
HQSSSLPYT

SEQ ID NO: 5382 - protein, 23 aa, Homo sapiens
  Heavy chain CDR3 for antibody 2691 (IGHV4-59)
ARERTYSDILPGYYEDYYYGMDV

SEQ ID NO: 5383 - protein, 9 aa, Homo sapiens
  Light chain CDR3 for antibody 2692 (IGKV1-6)
LQDYNYPWT

SEQ ID NO: 5384 - protein, 12 aa, Homo sapiens
  Heavy chain CDR3 for antibody 2692 (IGHV3-33)
AREMGGSYEVDY

SEQ ID NO: 5385 - protein, 9 aa, Homo sapiens
  Light chain CDR3 for antibody 2693 (IGKV3D-7)
QQDYNLPYT

SEQ ID NO: 5386 - protein, 18 aa, Homo sapiens
  Heavy chain CDR3 for antibody 2693 (IGHV3-33)
ARDGYSGYDYYYYYGMDV

SEQ ID NO: 5387 - protein, 9 aa, Homo sapiens
  Light chain CDR3 for antibody 2694 (IGKV6-21)
HQSSSLPYT

SEQ ID NO: 5388 - protein, 12 aa, Homo sapiens
  Heavy chain CDR3 for antibody 2694 (IGHV3-33)
ARGYFTSGSAHY

SEQ ID NO: 5389 - protein, 9 aa, Homo sapiens
  Light chain CDR3 for antibody 2695 (IGKV3D-7)
QQDYNLPLT

SEQ ID NO: 5390 - protein, 18 aa, Homo sapiens
  Heavy chain CDR3 for antibody 2695 (IGHV3-33)
ARGYYGSGNFYKDSGMDV

SEQ ID NO: 5391 - protein, 8 aa, Homo sapiens
  Light chain CDR3 for antibody 2696 (IGKV3D-7)
QQDYNLLT

SEQ ID NO: 5392 - protein, 13 aa, Homo sapiens
  Heavy chain CDR3 for antibody 2696 (IGHV3-23)
ASTGDSYYYGMDV

SEQ ID NO: 5393 - protein, 8 aa, Homo sapiens
  Light chain CDR3 for antibody 2697 (IGKV1D-13)
QQFNNYPT

SEQ ID NO: 5394 - protein, 13 aa, Homo sapiens
  Heavy chain CDR3 for antibody 2697 (IGHV3-33)
ARDWGYSHGYFDY

SEQ ID NO: 5395 - protein, 9 aa, Homo sapiens
  Light chain CDR3 for antibody 2698 (IGKV3-20)
QQYGSSPYT

SEQ ID NO: 5396 - protein, 17 aa, Homo sapiens
  Heavy chain CDR3 for antibody 2698 (IGHV3-33)
ARCGYSSSWYDPYYFDY

SEQ ID NO: 5397 - protein, 9 aa, Homo sapiens
  Light chain CDR3 for antibody 2699 (IGKV1-39)
QQSYSTPLT

SEQ ID NO: 5398 - protein, 16 aa, Homo sapiens
  Heavy chain CDR3 for antibody 2699 (IGHV3-33)
ARAVYYGSGSSLIMDV

SEQ ID NO: 5399 - protein, 9 aa, Homo sapiens
  Light chain CDR3 for antibody 2700 (IGKV1-9)
QQLISYPLT

SEQ ID NO: 5400 - protein, 12 aa, Homo sapiens
  Heavy chain CDR3 for antibody 2700 (IGHV3-33)
ARESGGSYSFDY

SEQ ID NO: 5401 - protein, 10 aa, Homo sapiens
  Light chain CDR3 for antibody 2701 (IGKV3-11)
QQRSNWPIFT

SEQ ID NO: 5402 - protein, 7 aa, Homo sapiens
  Heavy chain CDR3 for antibody 2701 (IGHV3-33)
ARELVDY

SEQ ID NO: 5403 - protein, 9 aa, Homo sapiens
  Light chain CDR3 for antibody 2702 (IGKV6-21)
HQSSSLPYT

SEQ ID NO: 5404 - protein, 17 aa, Homo sapiens
  Heavy chain CDR3 for antibody 2702 (IGHV3-23)
AKQDYYGSGTYSWFFDL

SEQ ID NO: 5405 - protein, 9 aa, Homo sapiens
  Light chain CDR3 for antibody 2703 (IGKV1D-16)
QQYNSYPYT

SEQ ID NO: 5406 - protein, 12 aa, Homo sapiens
  Heavy chain CDR3 for antibody 2703 (IGHV3-33)
AREEAVAEAFDI

SEQ ID NO: 5407 - protein, 8 aa, Homo sapiens
  Light chain CDR3 for antibody 2704 (IGKV1D-13)
QQFNNYPT

SEQ ID NO: 5408 - protein, 14 aa, Homo sapiens
  Heavy chain CDR3 for antibody 2704 (IGHV3-23)
AKSRIVGALYYFDY

SEQ ID NO: 5409 - protein, 9 aa, Homo sapiens
  Light chain CDR3 for antibody 2705 (IGKV1-17)
LQHNSYPYT

SEQ ID NO: 5410 - protein, 9 aa, Homo sapiens
  Heavy chain CDR3 for antibody 2705 (IGHV3-20)
ASIRGYFDY

SEQ ID NO: 5411 - protein, 9 aa, Homo sapiens
  Light chain CDR3 for antibody 2706 (IGKV1-39)
QQSYSTPLT

SEQ ID NO: 5412 - protein, 14 aa, Homo sapiens
  Heavy chain CDR3 for antibody 2706 (IGHV3-33)
ARQYSYGYPYYFDY

SEQ ID NO: 5413 - protein, 9 aa, Homo sapiens
  Light chain CDR3 for antibody 2707 (IGKV5-2)
LQHDNFPYT

SEQ ID NO: 5414 - protein, 15 aa, Homo sapiens
  Heavy chain CDR3 for antibody 2707 (IGHV3-33)
AKDRNSGYDWGGFDY

SEQ ID NO: 5415 - protein, 9 aa, Homo sapiens
  Light chain CDR3 for antibody 2708 (IGKV1-17)
LQHNSYPWT

SEQ ID NO: 5416 - protein, 18 aa, Homo sapiens
  Heavy chain CDR3 for antibody 2708 (IGHV3-33)
ARDYDSLTTYPEDYGMDV

SEQ ID NO: 5417 - protein, 9 aa, Homo sapiens
  Light chain CDR3 for antibody 2709 (IGKV1-39)
QQSYSTPLT

SEQ ID NO: 5418 - protein, 12 aa, Homo sapiens
  Heavy chain CDR3 for antibody 2709 (IGHV3-23)
AKEYDILTGYFH

SEQ ID NO: 5419 - protein, 9 aa, Homo sapiens
  Light chain CDR3 for antibody 2710 (IGKV1-39)
QQSYRTPLT

SEQ ID NO: 5420 - protein, 13 aa, Homo sapiens
  Heavy chain CDR3 for antibody 2710 (IGHV4-61)
ASRYSSGWYPFDY

SEQ ID NO: 5421 - protein, 9 aa, Homo sapiens
  Light chain CDR3 for antibody 2711 (IGKV6-21)
HQSSSLPYT

SEQ ID NO: 5422 - protein, 17 aa, Homo sapiens
  Heavy chain CDR3 for antibody 2711 (IGHV3-23)
AKDTITMVRGALFGMDV

SEQ ID NO: 5423 - protein, 9 aa, Homo sapiens
  Light chain CDR3 for antibody 2712 (IGKV1-27)
QKYNSAPYT

SEQ ID NO: 5424 - protein, 13 aa, Homo sapiens
  Heavy chain CDR3 for antibody 2712 (IGHV3-33)
AKEDGDYHHYFDY

SEQ ID NO: 5425 - protein, 9 aa, Homo sapiens
  Light chain CDR3 for antibody 2713 (IGKV1-16)
QQYNRYPYT

SEQ ID NO: 5426 - protein, 11 aa, Homo sapiens
  Heavy chain CDR3 for antibody 2713 (IGHV4-59)
AREMGHDTFDI

SEQ ID NO: 5427 - protein, 9 aa, Homo sapiens
  Light chain CDR3 for antibody 2714 (IGKV5-2)
LQHDNFPYT

SEQ ID NO: 5428 - protein, 10 aa, Homo sapiens
  Heavy chain CDR3 for antibody 2714 (IGHV3-23)
AKDHWGDFDY

SEQ ID NO: 5429 - protein, 9 aa, Homo sapiens
  Light chain CDR3 for antibody 2715 (IGKV5-2)
LQHDNFPYT

SEQ ID NO: 5430 - protein, 10 aa, Homo sapiens
  Heavy chain CDR3 for antibody 2715 (IGHV3-33)
ARDLGWSFDH

SEQ ID NO: 5431 - protein, 8 aa, Homo sapiens
  Light chain CDR3 for antibody 2716 (IGKV3D-7)
QQDYNLLT

SEQ ID NO: 5432 - protein, 9 aa, Homo sapiens
  Heavy chain CDR3 for antibody 2716 (IGHV1-18)
ARGKDWFDP

SEQ ID NO: 5433 - protein, 9 aa, Homo sapiens
  Light chain CDR3 for antibody 2717 (IGKV6-21)
HQSSSLPYT

SEQ ID NO: 5434 - protein, 18 aa, Homo sapiens
  Heavy chain CDR3 for antibody 2717 (IGHV3-33)
AREGYDILTGDYRLGFDY

SEQ ID NO: 5435 - protein, 9 aa, Homo sapiens
  Light chain CDR3 for antibody 2718 (IGKV1-17)
LQHNSYPYT

SEQ ID NO: 5436 - protein, 18 aa, Homo sapiens
  Heavy chain CDR3 for antibody 2718 (IGHV3-23)
AKPDYYGSGSYYNVPFDY

SEQ ID NO: 5437 - protein, 10 aa, Homo sapiens
  Light chain CDR3 for antibody 2719 (IGKV1-17)
LQHNSYPMYT

SEQ ID NO: 5438 - protein, 18 aa, Homo sapiens
  Heavy chain CDR3 for antibody 2719 (IGHV3-23)
AKDRITGTTYGYYSGLDV

SEQ ID NO: 5439 - protein, 9 aa, Homo sapiens
  Light chain CDR3 for antibody 2720 (IGKV2-30)
MQGTHWPLT

SEQ ID NO: 5440 - protein, 11 aa, Homo sapiens
  Heavy chain CDR3 for antibody 2720 (IGHV3-33)
ARDRVLTPFDY

SEQ ID NO: 5441 - protein, 9 aa, Homo sapiens
  Light chain CDR3 for antibody 2721 (IGKV1D-16)
QQYNYFPLT

SEQ ID NO: 5442 - protein, 16 aa, Homo sapiens
  Heavy chain CDR3 for antibody 2721 (IGHV4-59)
ARGRYFDWLLGDVFDI

SEQ ID NO: 5443 - protein, 8 aa, Homo sapiens
  Light chain CDR3 for antibody 2722 (IGKV3D-7)
QQDYNLLT

SEQ ID NO: 5444 - protein, 11 aa, Homo sapiens
  Heavy chain CDR3 for antibody 2722 (IGHV3-33)
ARDKSSGWSDY

SEQ ID NO: 5445 - protein, 8 aa, Homo sapiens
  Light chain CDR3 for antibody 2723 (IGKV3-20)
QQYGRSFT

SEQ ID NO: 5446 - protein, 14 aa, Homo sapiens
  Heavy chain CDR3 for antibody 2723 (IGHV4-39)
ARQDYDILTGLFDY

SEQ ID NO: 5447 - protein, 10 aa, Homo sapiens
  Light chain CDR3 for antibody 2724 (IGKV3-11)
QQRSNWPIFT

SEQ ID NO: 5448 - protein, 12 aa, Homo sapiens
  Heavy chain CDR3 for antibody 2724 (IGHV3-33)
ARESGGSYSFDY

SEQ ID NO: 5449 - protein, 10 aa, Homo sapiens
  Light chain CDR3 for antibody 2725 (IGKV1-39)
QQSYSTPMYT

SEQ ID NO: 5450 - protein, 17 aa, Homo sapiens
  Heavy chain CDR3 for antibody 2725 (IGHV3-33)
ARGYCSRTSCYLYYFDY

SEQ ID NO: 5451 - protein, 9 aa, Homo sapiens
  Light chain CDR3 for antibody 2726 (IGKV1-27)
QKYNSAPYT

SEQ ID NO: 5452 - protein, 20 aa, Homo sapiens
  Heavy chain CDR3 for antibody 2726 (IGHV3-33)
ARDNDSSGYYDYYYYYGMDV

SEQ ID NO: 5453 - protein, 9 aa, Homo sapiens
  Light chain CDR3 for antibody 2727 (IGKV6-21)
HQSSSLPYT

SEQ ID NO: 5454 - protein, 8 aa, Homo sapiens
  Heavy chain CDR3 for antibody 2727 (IGHV3-33)
ARDRGFDY

SEQ ID NO: 5455 - protein, 10 aa, Homo sapiens
  Light chain CDR3 for antibody 2728 (IGKV1-39)
QQSYSTPMYT

SEQ ID NO: 5456 - protein, 14 aa, Homo sapiens
  Heavy chain CDR3 for antibody 2728 (IGHV3-33)
ARDRIAAASSDFDC

SEQ ID NO: 5457 - protein, 9 aa, Homo sapiens
  Light chain CDR3 for antibody 2729 (IGKV1-9)
QQLISYPLT

SEQ ID NO: 5458 - protein, 12 aa, Homo sapiens
  Heavy chain CDR3 for antibody 2729 (IGHV3-33)
ARVDTAAPYFDY

SEQ ID NO: 5459 - protein, 9 aa, Homo sapiens
  Light chain CDR3 for antibody 2730 (IGKV6-21)
HQSSSLPYT

SEQ ID NO: 5460 - protein, 10 aa, Homo sapiens
  Heavy chain CDR3 for antibody 2730 (IGHV3-33)
AREGLRYFDH

SEQ ID NO: 5461 - protein, 9 aa, Homo sapiens
  Light chain CDR3 for antibody 2731 (IGKV1-39)
QQSYSTPLT

SEQ ID NO: 5462 - protein, 13 aa, Homo sapiens
  Heavy chain CDR3 for antibody 2731 (IGHV3-33)
ARVDTMVRGVMAY

SEQ ID NO: 5463 - protein, 9 aa, Homo sapiens
  Light chain CDR3 for antibody 2732 (IGKV1D-16)
QQYNSYPYT

SEQ ID NO: 5464 - protein, 18 aa, Homo sapiens
  Heavy chain CDR3 for antibody 2732 (IGHV3-33)
ARDHYDILTGYYKGWFDP

SEQ ID NO: 5465 - protein, 9 aa, Homo sapiens
  Light chain CDR3 for antibody 2733 (IGKV1-27)
QKYNSAPYT

SEQ ID NO: 5466 - protein, 12 aa, Homo sapiens
  Heavy chain CDR3 for antibody 2733 (IGHV3-33)
ARDGYSSRNFDY

SEQ ID NO: 5467 - protein, 9 aa, Homo sapiens
  Light chain CDR3 for antibody 2734 (IGKV5-2)
LQHDNFPYT

SEQ ID NO: 5468 - protein, 17 aa, Homo sapiens
  Heavy chain CDR3 for antibody 2734 (IGHV3-33)
ARSGIVGATDYYYGLDV

SEQ ID NO: 5469 - protein, 9 aa, Homo sapiens
  Light chain CDR3 for antibody 2735 (IGKV3-20)
QQYGSSPYT

SEQ ID NO: 5470 - protein, 11 aa, Homo sapiens
  Heavy chain CDR3 for antibody 2735 (IGHV4-59)
VRERGYYGMDV

SEQ ID NO: 5471 - protein, 10 aa, Homo sapiens
  Light chain CDR3 for antibody 2736 (IGKV1-39)
QQSYSTPMYT

SEQ ID NO: 5472 - protein, 18 aa, Homo sapiens
  Heavy chain CDR3 for antibody 2736 (IGHV4-59)
AREGDYVWGSYRPNWFDP

SEQ ID NO: 5473 - protein, 9 aa, Homo sapiens
  Light chain CDR3 for antibody 2737 (IGKV3D-7)
QQDYNLPLT

SEQ ID NO: 5474 - protein, 15 aa, Homo sapiens
  Heavy chain CDR3 for antibody 2737 (IGHV3-33)
ARDTGYSSSWNWFDP

SEQ ID NO: 5475 - protein, 9 aa, Homo sapiens
  Light chain CDR3 for antibody 2738 (IGKV1-6)
LQDYNYPRT

SEQ ID NO: 5476 - protein, 13 aa, Homo sapiens
  Heavy chain CDR3 for antibody 2738 (IGHV3-33)
ARVDYYNYYGLDV

SEQ ID NO: 5477 - protein, 9 aa, Homo sapiens
  Light chain CDR3 for antibody 2739 (IGKV1-6)
LQDYNYPYT

SEQ ID NO: 5478 - protein, 16 aa, Homo sapiens
  Heavy chain CDR3 for antibody 2739 (IGHV3-33)
AREGGLIAAAGTGFDY

SEQ ID NO: 5479 - protein, 9 aa, Homo sapiens
  Light chain CDR3 for antibody 2740 (IGKV1-17)
LQHNSYPYT

SEQ ID NO: 5480 - protein, 19 aa, Homo sapiens
  Heavy chain CDR3 for antibody 2740 (IGHV1-18)
ARGGHIGVVTAFHGYGMDV

SEQ ID NO: 5481 - protein, 9 aa, Homo sapiens
  Light chain CDR3 for antibody 2741 (IGKV1-6)
LQDYNYPRT

SEQ ID NO: 5482 - protein, 18 aa, Homo sapiens
  Heavy chain CDR3 for antibody 2741 (IGHV3-33)
ARDGYSGYDYYYYYGMDV

SEQ ID NO: 5483 - protein, 9 aa, Homo sapiens
  Light chain CDR3 for antibody 2742 (IGKV1-27)
QKYNSAPYT

SEQ ID NO: 5484 - protein, 13 aa, Homo sapiens
  Heavy chain CDR3 for antibody 2742 (IGHV4-39)
ARREVVGGRGFDY

SEQ ID NO: 5485 - protein, 9 aa, Homo sapiens
  Light chain CDR3 for antibody 2743 (IGKV1-6)
LQDYNYPYT

SEQ ID NO: 5486 - protein, 18 aa, Homo sapiens
  Heavy chain CDR3 for antibody 2743 (IGHV3-23)
AKDGDYFGSGSYWGYFDL

SEQ ID NO: 5487 - protein, 9 aa, Homo sapiens
  Light chain CDR3 for antibody 2744 (IGKV2-30)
MQGTHWPLT

SEQ ID NO: 5488 - protein, 13 aa, Homo sapiens
  Heavy chain CDR3 for antibody 2744 (IGHV4-39)
ARREVVGGRGFDY

SEQ ID NO: 5489 - protein, 9 aa, Homo sapiens
  Light chain CDR3 for antibody 2745 (IGKV1-39)
QQSYRTPLT

SEQ ID NO: 5490 - protein, 14 aa, Homo sapiens
  Heavy chain CDR3 for antibody 2745 (IGHV3-33)
ARGGYSGYRYYFDY

SEQ ID NO: 5491 - protein, 9 aa, Homo sapiens
  Light chain CDR3 for antibody 2746 (IGKV1-13)
QQYNSYPFT

SEQ ID NO: 5492 - protein, 13 aa, Homo sapiens
  Heavy chain CDR3 for antibody 2746 (IGHV4-59)
ARDAGYSSSWFDY

SEQ ID NO: 5493 - protein, 9 aa, Homo sapiens
  Light chain CDR3 for antibody 2747 (IGKV1-27)
QKYNSAPYT

SEQ ID NO: 5494 - protein, 11 aa, Homo sapiens
  Heavy chain CDR3 for antibody 2747 (IGHV3-33)
ARDRVLTPFDY

SEQ ID NO: 5495 - protein, 9 aa, Homo sapiens
  Light chain CDR3 for antibody 2748 (IGKV1-39)
QQSYSTPLT

SEQ ID NO: 5496 - protein, 21 aa, Homo sapiens
  Heavy chain CDR3 for antibody 2748 (IGHV3-33)
ARDEYYEIVTGYGYYHYGMDV

SEQ ID NO: 5497 - protein, 9 aa, Homo sapiens
  Light chain CDR3 for antibody 2749 (IGKV1-6)
LQDYNYPYT

SEQ ID NO: 5498 - protein, 17 aa, Homo sapiens
  Heavy chain CDR3 for antibody 2749 (IGHV3-33)
ARENDILTGSYYYGMDV

SEQ ID NO: 5499 - protein, 9 aa, Homo sapiens
  Light chain CDR3 for antibody 2750 (IGKV1-17)
LQHNSYPYT

SEQ ID NO: 5500 - protein, 14 aa, Homo sapiens
  Heavy chain CDR3 for antibody 2750 (IGHV3-33)
ARDLDIMATSPFAY

SEQ ID NO: 5501 - protein, 9 aa, Homo sapiens
  Light chain CDR3 for antibody 2751 (IGKV5-2)
LQHDNFPYT

SEQ ID NO: 5502 - protein, 11 aa, Homo sapiens
  Heavy chain CDR3 for antibody 2751 (IGHV3-33)
ARDQGGSSFDY

SEQ ID NO: 5503 - protein, 9 aa, Homo sapiens
  Light chain CDR3 for antibody 2752 (IGKV3-20)
QQYGSSPYT

SEQ ID NO: 5504 - protein, 13 aa, Homo sapiens
  Heavy chain CDR3 for antibody 2752 (IGHV3-15)
TTDRLLLFGAFDY

SEQ ID NO: 5505 - protein, 9 aa, Homo sapiens
  Light chain CDR3 for antibody 2753 (IGKV1-39)
QQSYSTPLT

SEQ ID NO: 5506 - protein, 13 aa, Homo sapiens
  Heavy chain CDR3 for antibody 2753 (IGHV3-23)
AKDRGGSYSYFDF

SEQ ID NO: 5507 - protein, 9 aa, Homo sapiens
  Light chain CDR3 for antibody 2754 (IGKV3-20)
QQYGSSPYT

SEQ ID NO: 5508 - protein, 15 aa, Homo sapiens
  Heavy chain CDR3 for antibody 2754 (IGHV3-33)
ARDALAVTGTGWFDP

SEQ ID NO: 5509 - protein, 9 aa, Homo sapiens
  Light chain CDR3 for antibody 2755 (IGKV1-33)
QQYDNLPFT

SEQ ID NO: 5510 - protein, 13 aa, Homo sapiens
  Heavy chain CDR3 for antibody 2755 (IGHV3-11)
ARDGGAAAGTWDS

SEQ ID NO: 5511 - protein, 9 aa, Homo sapiens
  Light chain CDR3 for antibody 2756 (IGKV1-9)
QQLNSYPLT

SEQ ID NO: 5512 - protein, 20 aa, Homo sapiens
  Heavy chain CDR3 for antibody 2756 (IGHV1-f)
ATHYDILTGSPYYYYCALDV

SEQ ID NO: 5513 - protein, 9 aa, Homo sapiens
  Light chain CDR3 for antibody 2757 (IGKV1-17)
LQHNSYPYT

SEQ ID NO: 5514 - protein, 13 aa, Homo sapiens
  Heavy chain CDR3 for antibody 2757 (IGHV4-39)
ARRDGGYYGYFDY

SEQ ID NO: 5515 - protein, 9 aa, Homo sapiens
  Light chain CDR3 for antibody 2758 (IGKV5-2)
LQHDNFPYT

SEQ ID NO: 5516 - protein, 18 aa, Homo sapiens
  Heavy chain CDR3 for antibody 2758 (IGHV3-13)
ARDYYGSGSLYYYYGMDV

SEQ ID NO: 5517 - protein, 9 aa, Homo sapiens
  Light chain CDR3 for antibody 2759 (IGKV3-15)
QQYNNWPLT

SEQ ID NO: 5518 - protein, 18 aa, Homo sapiens
  Heavy chain CDR3 for antibody 2759 (IGHV4-59)
AREGHYYTSGSYYKAFDY

SEQ ID NO: 5519 - protein, 9 aa, Homo sapiens
  Light chain CDR3 for antibody 2760 (IGKV1D-13)
QQFNNYPHT

SEQ ID NO: 5520 - protein, 13 aa, Homo sapiens
  Heavy chain CDR3 for antibody 2760 (IGHV3-33)
ARGDNWNDGGFDY

SEQ ID NO: 5521 - protein, 9 aa, Homo sapiens
  Light chain CDR3 for antibody 2761 (IGKV6-21)
HQSSSLPYT

SEQ ID NO: 5522 - protein, 17 aa, Homo sapiens
  Heavy chain CDR3 for antibody 2761 (IGHV3-33)
ARDPARGNVRSFYGLDV

SEQ ID NO: 5523 - protein, 9 aa, Homo sapiens
  Light chain CDR3 for antibody 2762 (IGKV1-39)
QQSYSTPLT

SEQ ID NO: 5524 - protein, 9 aa, Homo sapiens
  Heavy chain CDR3 for antibody 2762 (IGHV3-23)
ARIWWLKDY

SEQ ID NO: 5525 - protein, 9 aa, Homo sapiens
  Light chain CDR3 for antibody 2763 (IGKV5-2)
LQHDNFPWT

SEQ ID NO: 5526 - protein, 14 aa, Homo sapiens
  Heavy chain CDR3 for antibody 2763 (IGHV1-46)
ARKGIVGGFDAFDV

SEQ ID NO: 5527 - protein, 9 aa, Homo sapiens
  Light chain CDR3 for antibody 2764 (IGKV1-9)
QQLISYPLT

SEQ ID NO: 5528 - protein, 14 aa, Homo sapiens
  Heavy chain CDR3 for antibody 2764 (IGHV3-33)
ARDRIAAASSDFDC

SEQ ID NO: 5529 - protein, 9 aa, Homo sapiens
  Light chain CDR3 for antibody 2765 (IGKV1-27)
QKYNSAPYT

SEQ ID NO: 5530 - protein, 11 aa, Homo sapiens
  Heavy chain CDR3 for antibody 2765 (IGHV4-59)
ARSLRYSVFDY

SEQ ID NO: 5531 - protein, 9 aa, Homo sapiens
  Light chain CDR3 for antibody 2766 (IGKV1-9)
QQLKSYLYT

SEQ ID NO: 5532 - protein, 15 aa, Homo sapiens
  Heavy chain CDR3 for antibody 2766 (IGHV3-30)
ARGAMVRGVDYGMDV

SEQ ID NO: 5533 - protein, 9 aa, Homo sapiens
  Light chain CDR3 for antibody 2767 (IGKV6-21)
HQSSSLPYT

SEQ ID NO: 5534 - protein, 19 aa, Homo sapiens
  Heavy chain CDR3 for antibody 2767 (IGHV3-33)
AREDYYGSGSYYNEDWFDP

SEQ ID NO: 5535 - protein, 9 aa, Homo sapiens
  Light chain CDR3 for antibody 2768 (IGKV1-27)
QKYNSAPYT

SEQ ID NO: 5536 - protein, 12 aa, Homo sapiens
  Heavy chain CDR3 for antibody 2768 (IGHV3-33)
ARVDTAAPYFDY

SEQ ID NO: 5537 - protein, 9 aa, Homo sapiens
  Light chain CDR3 for antibody 2769 (IGKV1-39)
QQSYRTPLT

SEQ ID NO: 5538 - protein, 12 aa, Homo sapiens
  Heavy chain CDR3 for antibody 2769 (IGHV3-33)
AREGTRWVYFDY

SEQ ID NO: 5539 - protein, 9 aa, Homo sapiens
  Light chain CDR3 for antibody 2770 (IGKV5-2)
LQHDKFPYT

SEQ ID NO: 5540 - protein, 13 aa, Homo sapiens
  Heavy chain CDR3 for antibody 2770 (IGHV3-33)
ARDYCGGDCYLDY

SEQ ID NO: 5541 - protein, 8 aa, Homo sapiens
  Light chain CDR3 for antibody 2771 (IGKV3D-7)
QQDYNLVT

SEQ ID NO: 5542 - protein, 14 aa, Homo sapiens
  Heavy chain CDR3 for antibody 2771 (IGHV4-39)
ARQDYDILTGLFDY

SEQ ID NO: 5543 - protein, 9 aa, Homo sapiens
  Light chain CDR3 for antibody 2772 (IGKV1D-13)
QQFNNYPHT

SEQ ID NO: 5544 - protein, 14 aa, Homo sapiens
  Heavy chain CDR3 for antibody 2772 (IGHV3-33)
ARDRRDFYYYGMDV

SEQ ID NO: 5545 - protein, 10 aa, Homo sapiens
  Light chain CDR3 for antibody 2773 (IGKV1-17)
LQHNSYPMYT

SEQ ID NO: 5546 - protein, 18 aa, Homo sapiens
  Heavy chain CDR3 for antibody 2773 (IGHV4-59)
AREGDYVWGSYRPNWFDP

SEQ ID NO: 5547 - protein, 9 aa, Homo sapiens
  Light chain CDR3 for antibody 2774 (IGKV3-20)
QQYGSSPYT

SEQ ID NO: 5548 - protein, 10 aa, Homo sapiens
  Heavy chain CDR3 for antibody 2774 (IGHV3-33)
ARDLGWSFDH

SEQ ID NO: 5549 - protein, 9 aa, Homo sapiens
  Light chain CDR3 for antibody 2775 (IGKV1-6)
QQYNSYPYT

SEQ ID NO: 5550 - protein, 14 aa, Homo sapiens
  Heavy chain CDR3 for antibody 2775 (IGHV4-39)
ARQGGWYLYWYFDL

SEQ ID NO: 5551 - protein, 9 aa, Homo sapiens
  Light chain CDR3 for antibody 2776 (IGKV5-2)
LQHDNFPYT

SEQ ID NO: 5552 - protein, 10 aa, Homo sapiens
  Heavy chain CDR3 for antibody 2776 (IGHV1-18)
AREQRLGFDY

SEQ ID NO: 5553 - protein, 9 aa, Homo sapiens
  Light chain CDR3 for antibody 2777 (IGKV1-17)
LQHNSYPYT

SEQ ID NO: 5554 - protein, 11 aa, Homo sapiens
  Heavy chain CDR3 for antibody 2777 (IGHV4-59)
TRDRGLGSFDY

SEQ ID NO: 5555 - protein, 9 aa, Homo sapiens
  Light chain CDR3 for antibody 2778 (IGKV1-27)
QKYNSAPYT

SEQ ID NO: 5556 - protein, 12 aa, Homo sapiens
  Heavy chain CDR3 for antibody 2778 (IGHV3-23)
AKEYDILTGYFH

SEQ ID NO: 5557 - protein, 8 aa, Homo sapiens
  Light chain CDR3 for antibody 2779 (IGKV1D-13)
QQFNNYPT

SEQ ID NO: 5558 - protein, 14 aa, Homo sapiens
  Heavy chain CDR3 for antibody 2779 (IGHV3-33)
ARDRIAAASSDFDC

SEQ ID NO: 5559 - protein, 9 aa, Homo sapiens
  Light chain CDR3 for antibody 2780 (IGKV2-30)
MQGTHWPLT

SEQ ID NO: 5560 - protein, 9 aa, Homo sapiens
  Heavy chain CDR3 for antibody 2780 (IGHV3-30)
ARDYFHYDY

SEQ ID NO: 5561 - protein, 9 aa, Homo sapiens
  Light chain CDR3 for antibody 2781 (IGKV5-2)
LQHDNFPYT

SEQ ID NO: 5562 - protein, 15 aa, Homo sapiens
  Heavy chain CDR3 for antibody 2781 (IGHV3-33)
ARHSSGFYYYYGMDV

SEQ ID NO: 5563 - protein, 9 aa, Homo sapiens
  Light chain CDR3 for antibody 2782 (IGKV5-2)
LQHDNFPYT

SEQ ID NO: 5564 - protein, 17 aa, Homo sapiens
  Heavy chain CDR3 for antibody 2782 (IGHV3-33)
ARCGYSSSWYDPYYFDY

SEQ ID NO: 5565 - protein, 9 aa, Homo sapiens
  Light chain CDR3 for antibody 2783 (IGKV1-17)
LQQNSYPWT

SEQ ID NO: 5566 - protein, 16 aa, Homo sapiens
  Heavy chain CDR3 for antibody 2783 (IGHV4-59)
ARGRYFDWLLGDVFDI

SEQ ID NO: 5567 - protein, 9 aa, Homo sapiens
  Light chain CDR3 for antibody 2784 (IGKV3-11)
QQRSNWPLT

SEQ ID NO: 5568 - protein, 15 aa, Homo sapiens
  Heavy chain CDR3 for antibody 2784 (IGHV3-30)
ARRGYGSGSPDAFDL

SEQ ID NO: 5569 - protein, 8 aa, Homo sapiens
  Light chain CDR3 for antibody 2785 (IGKV1D-13)
QQFNNYPT

SEQ ID NO: 5570 - protein, 12 aa, Homo sapiens
  Heavy chain CDR3 for antibody 2785 (IGHV3-33)
TRGYSSKSYFDY

SEQ ID NO: 5571 - protein, 9 aa, Homo sapiens
  Light chain CDR3 for antibody 2786 (IGKV6-21)
HQSSSLPQT

SEQ ID NO: 5572 - protein, 14 aa, Homo sapiens
  Heavy chain CDR3 for antibody 2786 (IGHV3-20)
ARDRGSVWHDAFDI

SEQ ID NO: 5573 - protein, 9 aa, Homo sapiens
  Light chain CDR3 for antibody 2787 (IGKV1-27)
QKYNSAPYT

SEQ ID NO: 5574 - protein, 18 aa, Homo sapiens
  Heavy chain CDR3 for antibody 2787 (IGHV3-33)
ARERDYYGSGSYPDAFDI

SEQ ID NO: 5575 - protein, 10 aa, Homo sapiens
  Light chain CDR3 for antibody 2788 (IGKV3-15)
QQYNNWPPLT

SEQ ID NO: 5576 - protein, 13 aa, Homo sapiens
  Heavy chain CDR3 for antibody 2788 (IGHV3-33)
ARDYCGGDCYLDY

SEQ ID NO: 5577 - protein, 9 aa, Homo sapiens
  Light chain CDR3 for antibody 2789 (IGKV1-27)
QKYNSAPYT

SEQ ID NO: 5578 - protein, 11 aa, Homo sapiens
  Heavy chain CDR3 for antibody 2789 (IGHV3-33)
ARAGIAAVFDY

SEQ ID NO: 5579 - protein, 9 aa, Homo sapiens
  Light chain CDR3 for antibody 2790 (IGKV6-21)
HQSSSLPYT

SEQ ID NO: 5580 - protein, 12 aa, Homo sapiens
  Heavy chain CDR3 for antibody 2790 (IGHV3-23)
AKEGLGSDYEPY

SEQ ID NO: 5581 - protein, 9 aa, Homo sapiens
  Light chain CDR3 for antibody 2791 (IGKV1-6)
LQDYNYPWT

SEQ ID NO: 5582 - protein, 16 aa, Homo sapiens
  Heavy chain CDR3 for antibody 2791 (IGHV3-23)
ARDVGIAAAGSGWFDT

SEQ ID NO: 5583 - protein, 9 aa, Homo sapiens
  Light chain CDR3 for antibody 2792 (IGKV1-39)
QQSYSTPLT

SEQ ID NO: 5584 - protein, 17 aa, Homo sapiens
  Heavy chain CDR3 for antibody 2792 (IGHV3-33)
ARVRGVIEGYYYYGMDV

SEQ ID NO: 5585 - protein, 9 aa, Homo sapiens
  Light chain CDR3 for antibody 2793 (IGKV3D-7)
QQDYNLPLT

SEQ ID NO: 5586 - protein, 17 aa, Homo sapiens
  Heavy chain CDR3 for antibody 2793 (IGHV3-33)
ARESLKLGIYYYYGMDV

SEQ ID NO: 5587 - protein, 9 aa, Homo sapiens
  Light chain CDR3 for antibody 2794 (IGKV1-6)
LQDYNYPWT

SEQ ID NO: 5588 - protein, 18 aa, Homo sapiens
  Heavy chain CDR3 for antibody 2794 (IGHV3-64)
ARDEYYYGSGSYYNYFDW

SEQ ID NO: 5589 - protein, 9 aa, Homo sapiens
  Light chain CDR3 for antibody 2795 (IGKV1D-16)
QQYNSYPYT

SEQ ID NO: 5590 - protein, 13 aa, Homo sapiens
  Heavy chain CDR3 for antibody 2795 (IGHV4-59)
ARSWFGELLYFDY

SEQ ID NO: 5591 - protein, 9 aa, Homo sapiens
  Light chain CDR3 for antibody 2796 (IGKV1-17)
LQHNSYPYT

SEQ ID NO: 5592 - protein, 14 aa, Homo sapiens
  Heavy chain CDR3 for antibody 2796 (IGHV3-23)
AKCDYDILTGILDY

SEQ ID NO: 5593 - protein, 9 aa, Homo sapiens
  Light chain CDR3 for antibody 2797 (IGKV1-17)
LQHNSYPYT

SEQ ID NO: 5594 - protein, 13 aa, Homo sapiens
  Heavy chain CDR3 for antibody 2797 (IGHV4-39)
ARHHYGSGSLRDY

SEQ ID NO: 5595 - protein, 8 aa, Homo sapiens
  Light chain CDR3 for antibody 2798 (IGKV3D-7)
QQDYNLLT

SEQ ID NO: 5596 - protein, 17 aa, Homo sapiens
  Heavy chain CDR3 for antibody 2798 (IGHV3-33)
ARVYYDILTGYSPAFDI

SEQ ID NO: 5597 - protein, 9 aa, Homo sapiens
  Light chain CDR3 for antibody 2799 (IGKV6-21)
HQSSSLPYT

SEQ ID NO: 5598 - protein, 18 aa, Homo sapiens
  Heavy chain CDR3 for antibody 2799 (IGHV3-13)
ARDYYGSGSLYYYYGMDV

SEQ ID NO: 5599 - protein, 10 aa, Homo sapiens
  Light chain CDR3 for antibody 2800 (IGKV1-39)
QQSYSTPMYT

SEQ ID NO: 5600 - protein, 14 aa, Homo sapiens
  Heavy chain CDR3 for antibody 2800 (IGHV3-33)
ARDWNDVYYYGMDV

SEQ ID NO: 5601 - protein, 9 aa, Homo sapiens
  Light chain CDR3 for antibody 2801 (IGKV1D-13)
QQFNNYPHT

SEQ ID NO: 5602 - protein, 12 aa, Homo sapiens
  Heavy chain CDR3 for antibody 2801 (IGHV3-33)
ARDSSGWSHFDY

SEQ ID NO: 5603 - protein, 9 aa, Homo sapiens
  Light chain CDR3 for antibody 2802 (IGKV3-20)
QQYGSSPLT

SEQ ID NO: 5604 - protein, 13 aa, Homo sapiens
  Heavy chain CDR3 for antibody 2802 (IGHV1-18)
ARSYYGSGSPFDY

SEQ ID NO: 5605 - protein, 8 aa, Homo sapiens
  Light chain CDR3 for antibody 2803 (IGKV3D-7)
QQDYNLLT

SEQ ID NO: 5606 - protein, 15 aa, Homo sapiens
  Heavy chain CDR3 for antibody 2803 (IGHV3-33)
ARDHLTGYYYYGMDV

SEQ ID NO: 5607 - protein, 8 aa, Homo sapiens
  Light chain CDR3 for antibody 2804 (IGKV3-11)
QQRSNWLT

SEQ ID NO: 5608 - protein, 12 aa, Homo sapiens
  Heavy chain CDR3 for antibody 2804 (IGHV1-18)
ARILFYGDYFDY

SEQ ID NO: 5609 - protein, 11 aa, Homo sapiens
  Light chain CDR3 for antibody 2805 (IGKV3-11)
QQRSNWPPTWT

SEQ ID NO: 5610 - protein, 14 aa, Homo sapiens
  Heavy chain CDR3 for antibody 2805 (IGHV4-39)
ARDSGYDYYYGMDV

SEQ ID NO: 5611 - protein, 9 aa, Homo sapiens
  Light chain CDR3 for antibody 2806 (IGKV1-17)
LQHNSYPWT

SEQ ID NO: 5612 - protein, 19 aa, Homo sapiens
  Heavy chain CDR3 for antibody 2806 (IGHV1-24)
ATAGLQWFGEKIGYYGMDV

SEQ ID NO: 5613 - protein, 8 aa, Homo sapiens
  Light chain CDR3 for antibody 2807 (IGKV3D-7)
QQDYNLLT

SEQ ID NO: 5614 - protein, 13 aa, Homo sapiens
  Heavy chain CDR3 for antibody 2807 (IGHV3-33)
ARTDYYFYYGLDV

SEQ ID NO: 5615 - protein, 9 aa, Homo sapiens
  Light chain CDR3 for antibody 2808 (IGKV6-21)
HQSSSLPYT

SEQ ID NO: 5616 - protein, 16 aa, Homo sapiens
  Heavy chain CDR3 for antibody 2808 (IGHV3-33)
ARDRGGMTMVRGGFDY

SEQ ID NO: 5617 - protein, 8 aa, Homo sapiens
  Light chain CDR3 for antibody 2809 (IGKV3D-7)
QQDYNLLT

SEQ ID NO: 5618 - protein, 14 aa, Homo sapiens
  Heavy chain CDR3 for antibody 2809 (IGHV3-23)
AKSRIVGALYYFDY

SEQ ID NO: 5619 - protein, 9 aa, Homo sapiens
  Light chain CDR3 for antibody 2810 (IGKV3D-7)
QQDYNLPYT

SEQ ID NO: 5620 - protein, 13 aa, Homo sapiens
  Heavy chain CDR3 for antibody 2810 (IGHV4-39)
ARHEVMIRGVFDY

SEQ ID NO: 5621 - protein, 10 aa, Homo sapiens
  Light chain CDR3 for antibody 2811 (IGKV1-39)
QQSYSTPMYT

SEQ ID NO: 5622 - protein, 14 aa, Homo sapiens
  Heavy chain CDR3 for antibody 2811 (IGHV3-33)
ARGAAAGNFYGLDV

SEQ ID NO: 5623 - protein, 9 aa, Homo sapiens
  Light chain CDR3 for antibody 2812 (IGKV1-9)
QQLKSYLYT

SEQ ID NO: 5624 - protein, 14 aa, Homo sapiens
  Heavy chain CDR3 for antibody 2812 (IGHV3-33)
ARGAAAGNFYGLDV

SEQ ID NO: 5625 - protein, 9 aa, Homo sapiens
  Light chain CDR3 for antibody 2813 (IGKV1-17)
LQHNSYPWT

SEQ ID NO: 5626 - protein, 17 aa, Homo sapiens
  Heavy chain CDR3 for antibody 2813 (IGHV3-33)
ARDPARGNVRSFYGLDV

SEQ ID NO: 5627 - protein, 9 aa, Homo sapiens
  Light chain CDR3 for antibody 2814 (IGKV1-17)
LQHNSYPFT

SEQ ID NO: 5628 - protein, 10 aa, Homo sapiens
  Heavy chain CDR3 for antibody 2814 (IGHV3-33)
ARDSSGWLDY

SEQ ID NO: 5629 - protein, 11 aa, Homo sapiens
  Light chain CDR3 for antibody 2815 (IGKV3-11)
QQRSNWPPTWT

SEQ ID NO: 5630 - protein, 12 aa, Homo sapiens
  Heavy chain CDR3 for antibody 2815 (IGHV1-18)
ARILFYGDYFDY

SEQ ID NO: 5631 - protein, 9 aa, Homo sapiens
  Light chain CDR3 for antibody 2816 (IGKV1-17)
LQHNSYPWT

SEQ ID NO: 5632 - protein, 12 aa, Homo sapiens
  Heavy chain CDR3 for antibody 2816 (IGHV4-61)
ARVDSSGWFFDY

SEQ ID NO: 5633 - protein, 9 aa, Homo sapiens
  Light chain CDR3 for antibody 2817 (IGKV6-21)
HQSSSLPHT

SEQ ID NO: 5634 - protein, 16 aa, Homo sapiens
  Heavy chain CDR3 for antibody 2817 (IGHV4-39)
ASLRSGSYSLGWYFDL

SEQ ID NO: 5635 - protein, 9 aa, Homo sapiens
  Light chain CDR3 for antibody 2818 (IGKV3-20)
QQYGSSPYT

SEQ ID NO: 5636 - protein, 13 aa, Homo sapiens
  Heavy chain CDR3 for antibody 2818 (IGHV1-24)
ATGYSINWYEFDY

SEQ ID NO: 5637 - protein, 9 aa, Homo sapiens
  Light chain CDR3 for antibody 2819 (IGKV6-21)
HQSSSLPYT

SEQ ID NO: 5638 - protein, 13 aa, Homo sapiens
  Heavy chain CDR3 for antibody 2819 (IGHV3-33)
ARDSSSWYHWFDP

SEQ ID NO: 5639 - protein, 10 aa, Homo sapiens
  Light chain CDR3 for antibody 2820 (IGKV3-11)
QQRSNWPIFT

SEQ ID NO: 5640 - protein, 10 aa, Homo sapiens
  Heavy chain CDR3 for antibody 2820 (IGHV3-23)
AKEQWLVLDY

SEQ ID NO: 5641 - protein, 9 aa, Homo sapiens
  Light chain CDR3 for antibody 2821 (IGKV1-39)
QQSYSTPLT

SEQ ID NO: 5642 - protein, 12 aa, Homo sapiens
  Heavy chain CDR3 for antibody 2821 (IGHV3-h)
AREDYYYYGMDV

SEQ ID NO: 5643 - protein, 10 aa, Homo sapiens
  Light chain CDR3 for antibody 2822 (IGKV3-11)
QQRSNWPIFT

SEQ ID NO: 5644 - protein, 15 aa, Homo sapiens
  Heavy chain CDR3 for antibody 2822 (IGHV4-59)
ARDLGHYYGSVSIDY

SEQ ID NO: 5645 - protein, 9 aa, Homo sapiens
  Light chain CDR3 for antibody 2823 (IGKV1-9)
QQLNSYPWT

SEQ ID NO: 5646 - protein, 19 aa, Homo sapiens
  Heavy chain CDR3 for antibody 2823 (IGHV3-20)
ARDLCSSTSCYGYYYGMDV

SEQ ID NO: 5647 - protein, 9 aa, Homo sapiens
  Light chain CDR3 for antibody 2824 (IGKV1-27)
QKYNSAPYT

SEQ ID NO: 5648 - protein, 17 aa, Homo sapiens
  Heavy chain CDR3 for antibody 2824 (IGHV3-33)
ARVRGVIEGYYYYGMDV

SEQ ID NO: 5649 - protein, 9 aa, Homo sapiens
  Light chain CDR3 for antibody 2825 (IGKV1D-16)
QQYNSYPYT

SEQ ID NO: 5650 - protein, 16 aa, Homo sapiens
  Heavy chain CDR3 for antibody 2825 (IGHV3-33)
ARAYYYGSGSYPHFQH

SEQ ID NO: 5651 - protein, 9 aa, Homo sapiens
  Light chain CDR3 for antibody 2826 (IGKV1-5)
QQYNTYSRT

SEQ ID NO: 5652 - protein, 13 aa, Homo sapiens
  Heavy chain CDR3 for antibody 2826 (IGHV3-33)
ARDYCGGDCYLDY

SEQ ID NO: 5653 - protein, 9 aa, Homo sapiens
  Light chain CDR3 for antibody 2827 (IGKV5-2)
LQHDNFPYT

SEQ ID NO: 5654 - protein, 14 aa, Homo sapiens
  Heavy chain CDR3 for antibody 2827 (IGHV3-20)
ARDEGSGGYDVFDI

SEQ ID NO: 5655 - protein, 9 aa, Homo sapiens
  Light chain CDR3 for antibody 2828 (IGKV1-9)
QQLNSYPPT

SEQ ID NO: 5656 - protein, 11 aa, Homo sapiens
  Heavy chain CDR3 for antibody 2828 (IGHV3-33)
ARAERGGYFDY

SEQ ID NO: 5657 - protein, 10 aa, Homo sapiens
  Light chain CDR3 for antibody 2829 (IGKV3-11)
QQRSNWPIFT

SEQ ID NO: 5658 - protein, 20 aa, Homo sapiens
  Heavy chain CDR3 for antibody 2829 (IGHV3-20)
ARDLCSSTSCYGYYYYGMDV

SEQ ID NO: 5659 - protein, 9 aa, Homo sapiens
  Light chain CDR3 for antibody 2830 (IGKV1-39)
QQGFSTPWT

SEQ ID NO: 5660 - protein, 13 aa, Homo sapiens
  Heavy chain CDR3 for antibody 2830 (IGHV4-59)
ARDAGYSSSWFDY

SEQ ID NO: 5661 - protein, 9 aa, Homo sapiens
  Light chain CDR3 for antibody 2831 (IGKV3-20)
QQYGSSPRT

SEQ ID NO: 5662 - protein, 15 aa, Homo sapiens
  Heavy chain CDR3 for antibody 2831 (IGHV1-18)
ARRSPNWGHYYGMDV

SEQ ID NO: 5663 - protein, 9 aa, Homo sapiens
  Light chain CDR3 for antibody 2832 (IGKV3-11)
QQRSNWPPT

SEQ ID NO: 5664 - protein, 13 aa, Homo sapiens
  Heavy chain CDR3 for antibody 2832 (IGHV3-33)
AKEDGDYHHYFDY

SEQ ID NO: 5665 - protein, 9 aa, Homo sapiens
  Light chain CDR3 for antibody 2833 (IGKV3D-7)
QQDYNLPLT

SEQ ID NO: 5666 - protein, 14 aa, Homo sapiens
  Heavy chain CDR3 for antibody 2833 (IGHV3-33)
ARDRIAAASSDFDC

SEQ ID NO: 5667 - protein, 9 aa, Homo sapiens
  Light chain CDR3 for antibody 2834 (IGKV5-2)
LQHDNFPWT

SEQ ID NO: 5668 - protein, 12 aa, Homo sapiens
  Heavy chain CDR3 for antibody 2834 (IGHV3-33)
AREGTGGNWFDP

SEQ ID NO: 5669 - protein, 9 aa, Homo sapiens
  Light chain CDR3 for antibody 2835 (IGKV1D-16)
QQYNSYPYT

SEQ ID NO: 5670 - protein, 15 aa, Homo sapiens
  Heavy chain CDR3 for antibody 2835 (IGHV4-39)
ARRSKYTSAWYPFDY

SEQ ID NO: 5671 - protein, 10 aa, Homo sapiens
  Light chain CDR3 for antibody 2836 (IGKV3-11)
QQRSNWPIFT

SEQ ID NO: 5672 - protein, 9 aa, Homo sapiens
  Heavy chain CDR3 for antibody 2836 (IGHV1-18)
ARGKDWFDP

SEQ ID NO: 5673 - protein, 9 aa, Homo sapiens
  Light chain CDR3 for antibody 2837 (IGKV6-21)
HQSSSLPYT

SEQ ID NO: 5674 - protein, 14 aa, Homo sapiens
  Heavy chain CDR3 for antibody 2837 (IGHV3-64)
ARDHAAGGYSHSDY

SEQ ID NO: 5675 - protein, 8 aa, Homo sapiens
  Light chain CDR3 for antibody 2838 (IGKV3D-7)
QQDYNLLT

SEQ ID NO: 5676 - protein, 15 aa, Homo sapiens
  Heavy chain CDR3 for antibody 2838 (IGHV3-33)
ARDTGYSSSWNWFDP

SEQ ID NO: 5677 - protein, 9 aa, Homo sapiens
  Light chain CDR3 for antibody 2839 (IGKV6-21)
HQSSSLPYT

SEQ ID NO: 5678 - protein, 14 aa, Homo sapiens
  Heavy chain CDR3 for antibody 2839 (IGHV3-33)
ARDGYDILTGPMDV

SEQ ID NO: 5679 - protein, 9 aa, Homo sapiens
  Light chain CDR3 for antibody 2840 (IGKV3D-7)
QQDYNLPLT

SEQ ID NO: 5680 - protein, 14 aa, Homo sapiens
  Heavy chain CDR3 for antibody 2840 (IGHV3-33)
VRDAMGATTAWFDP

SEQ ID NO: 5681 - protein, 9 aa, Homo sapiens
  Light chain CDR3 for antibody 2841 (IGKV1-27)
QKYNSAPYT

SEQ ID NO: 5682 - protein, 12 aa, Homo sapiens
  Heavy chain CDR3 for antibody 2841 (IGHV1-46)
AREDYDIDGMDV

SEQ ID NO: 5683 - protein, 9 aa, Homo sapiens
  Light chain CDR3 for antibody 2842 (IGKV3-11)
QQRSSWPPT

SEQ ID NO: 5684 - protein, 16 aa, Homo sapiens
  Heavy chain CDR3 for antibody 2842 (IGHV3-23)
AKEGMVLRYFDWLWDY

SEQ ID NO: 5685 - protein, 9 aa, Homo sapiens
  Light chain CDR3 for antibody 2843 (IGKV6-21)
HQSSSLPLT

SEQ ID NO: 5686 - protein, 13 aa, Homo sapiens
  Heavy chain CDR3 for antibody 2843 (IGHV3-33)
ANTGDSYYYDMDV

SEQ ID NO: 5687 - protein, 9 aa, Homo sapiens
  Light chain CDR3 for antibody 2844 (IGKV1-27)
QKYNSAPYT

SEQ ID NO: 5688 - protein, 17 aa, Homo sapiens
  Heavy chain CDR3 for antibody 2844 (IGHV3-33)
ARGGAAAGPYLYYGLDV

SEQ ID NO: 5689 - protein, 8 aa, Homo sapiens
  Light chain CDR3 for antibody 2845 (IGKV6-21)
HQSSSFHT

SEQ ID NO: 5690 - protein, 12 aa, Homo sapiens
  Heavy chain CDR3 for antibody 2845 (IGHV3-20)
AREGWELRPFDY

SEQ ID NO: 5691 - protein, 9 aa, Homo sapiens
  Light chain CDR3 for antibody 2846 (IGKV1-39)
QQSYRTPLT

SEQ ID NO: 5692 - protein, 18 aa, Homo sapiens
  Heavy chain CDR3 for antibody 2846 (IGHV3-33)
ARDGYSGYDYYYYYGMDV

SEQ ID NO: 5693 - protein, 9 aa, Homo sapiens
  Light chain CDR3 for antibody 2847 (IGKV5-2)
LQHDNFPYT

SEQ ID NO: 5694 - protein, 15 aa, Homo sapiens
  Heavy chain CDR3 for antibody 2847 (IGHV3-66)
ARDRDYYYYYYGMDV

SEQ ID NO: 5695 - protein, 9 aa, Homo sapiens
  Light chain CDR3 for antibody 2848 (IGKV1D-13)
QQFNNYPHT

SEQ ID NO: 5696 - protein, 16 aa, Homo sapiens
  Heavy chain CDR3 for antibody 2848 (IGHV1-24)
ATEDSSSTYYYYGLDV

SEQ ID NO: 5697 - protein, 8 aa, Homo sapiens
  Light chain CDR3 for antibody 2849 (IGKV1-5)
QQYNSYWT

SEQ ID NO: 5698 - protein, 12 aa, Homo sapiens
  Heavy chain CDR3 for antibody 2849 (IGHV3-33)
TRGYSSKSYFDY

SEQ ID NO: 5699 - protein, 8 aa, Homo sapiens
  Light chain CDR3 for antibody 2850 (IGKV3D-7)
QQDYNLLT

SEQ ID NO: 5700 - protein, 13 aa, Homo sapiens
  Heavy chain CDR3 for antibody 2850 (IGHV3-53)
ARSGSYWGYYFDY

SEQ ID NO: 5701 - protein, 9 aa, Homo sapiens
  Light chain CDR3 for antibody 2851 (IGKV1-6)
LQDHNYPYT

SEQ ID NO: 5702 - protein, 14 aa, Homo sapiens
  Heavy chain CDR3 for antibody 2851 (IGHV3-33)
ARASSGSSYWYFDL

SEQ ID NO: 5703 - protein, 9 aa, Homo sapiens
  Light chain CDR3 for antibody 2852 (IGKV1-17)
LQHNSYPYT

SEQ ID NO: 5704 - protein, 15 aa, Homo sapiens
  Heavy chain CDR3 for antibody 2852 (IGHV3-33)
ARGGTGYYSYWYFDL

SEQ ID NO: 5705 - protein, 9 aa, Homo sapiens
  Light chain CDR3 for antibody 2853 (IGKV1-9)
QQYNSYPLT

SEQ ID NO: 5706 - protein, 11 aa, Homo sapiens
  Heavy chain CDR3 for antibody 2853 (IGHV4-59)
ARESFYGSGNL

SEQ ID NO: 5707 - protein, 10 aa, Homo sapiens
  Light chain CDR3 for antibody 2854 (IGKV3-11)
QQRSNWPIFT

SEQ ID NO: 5708 - protein, 18 aa, Homo sapiens
  Heavy chain CDR3 for antibody 2854 (IGHV4-59)
AREGHYYTSGSYYKAFDY

SEQ ID NO: 5709 - protein, 9 aa, Homo sapiens
  Light chain CDR3 for antibody 2855 (IGKV1-39)
QQSYRTPLT

SEQ ID NO: 5710 - protein, 11 aa, Homo sapiens
  Heavy chain CDR3 for antibody 2855 (IGHV3-74)
ARDRGNWGFDY

SEQ ID NO: 5711 - protein, 8 aa, Homo sapiens
  Light chain CDR3 for antibody 2856 (IGKV3D-7)
QQDYNLLT

SEQ ID NO: 5712 - protein, 13 aa, Homo sapiens
  Heavy chain CDR3 for antibody 2856 (IGHV4-39)
ARQWPSGYWYFDL

SEQ ID NO: 5713 - protein, 9 aa, Homo sapiens
  Light chain CDR3 for antibody 2857 (IGKV5-2)
LQHDNFPWT

SEQ ID NO: 5714 - protein, 16 aa, Homo sapiens
  Heavy chain CDR3 for antibody 2857 (IGHV4-39)
ARHPLILTGYPNWFDP

SEQ ID NO: 5715 - protein, 9 aa, Homo sapiens
  Light chain CDR3 for antibody 2858 (IGKV3-11)
QQRSNWPPT

SEQ ID NO: 5716 - protein, 9 aa, Homo sapiens
  Heavy chain CDR3 for antibody 2858 (IGHV3-13)
ARDRWYFDL

SEQ ID NO: 5717 - protein, 8 aa, Homo sapiens
  Light chain CDR3 for antibody 2859 (IGKV3D-7)
QQDYNLVT

SEQ ID NO: 5718 - protein, 17 aa, Homo sapiens
  Heavy chain CDR3 for antibody 2859 (IGHV4-59)
ARDFLVRGEGSYYGMDV

SEQ ID NO: 5719 - protein, 10 aa, Homo sapiens
  Light chain CDR3 for antibody 2860 (IGKV3-11)
QQRSNWPIFT

SEQ ID NO: 5720 - protein, 12 aa, Homo sapiens
  Heavy chain CDR3 for antibody 2860 (IGHV3-23)
AKEYDILTGYFH

SEQ ID NO: 5721 - protein, 10 aa, Homo sapiens
  Light chain CDR3 for antibody 2861 (IGKV3-11)
QQRSNWPIFT

SEQ ID NO: 5722 - protein, 17 aa, Homo sapiens
  Heavy chain CDR3 for antibody 2861 (IGHV1-18)
ARDEGYDILTGYPHFDY

SEQ ID NO: 5723 - protein, 9 aa, Homo sapiens
  Light chain CDR3 for antibody 2862 (IGKV1-17)
LQHNGYPLT

SEQ ID NO: 5724 - protein, 12 aa, Homo sapiens
  Heavy chain CDR3 for antibody 2862 (IGHV3-33)
ARESGGSYSFDY

SEQ ID NO: 5725 - protein, 10 aa, Homo sapiens
  Light chain CDR3 for antibody 2863 (IGKV3-11)
QQRSNWPIFT

SEQ ID NO: 5726 - protein, 12 aa, Homo sapiens
  Heavy chain CDR3 for antibody 2863 (IGHV3-33)
TRGYSSKSYFDY

SEQ ID NO: 5727 - protein, 9 aa, Homo sapiens
  Light chain CDR3 for antibody 2864 (IGKV1-5)
QQYNTYSRT

SEQ ID NO: 5728 - protein, 11 aa, Homo sapiens
  Heavy chain CDR3 for antibody 2864 (IGHV3-33)
ARDRSSGPFDY

SEQ ID NO: 5729 - protein, 9 aa, Homo sapiens
  Light chain CDR3 for antibody 2865 (IGKV1D-13)
QQFNNYPHT

SEQ ID NO: 5730 - protein, 15 aa, Homo sapiens
  Heavy chain CDR3 for antibody 2865 (IGHV3-33)
ARDSRPEIIGPPFDY

SEQ ID NO: 5731 - protein, 10 aa, Homo sapiens
  Light chain CDR3 for antibody 2866 (IGKV1-9)
QQLDSYPMYT

SEQ ID NO: 5732 - protein, 13 aa, Homo sapiens
  Heavy chain CDR3 for antibody 2866 (IGHV4-59)
ARDAGYSSSWFDY

SEQ ID NO: 5733 - protein, 9 aa, Homo sapiens
  Light chain CDR3 for antibody 2867 (IGKV1-6)
LQDYNYPYT

SEQ ID NO: 5734 - protein, 13 aa, Homo sapiens
  Heavy chain CDR3 for antibody 2867 (IGHV4-59)
ARESPGPYDAFDI

SEQ ID NO: 5735 - protein, 9 aa, Homo sapiens
  Light chain CDR3 for antibody 2868 (IGKV3D-7)
QQDYNLPLT

SEQ ID NO: 5736 - protein, 17 aa, Homo sapiens
  Heavy chain CDR3 for antibody 2868 (IGHV4-34)
AGLRFFDWLFDYYGMDV

SEQ ID NO: 5737 - protein, 10 aa, Homo sapiens
  Light chain CDR3 for antibody 2869 (IGKV1-17)
LQHNSYPMYT

SEQ ID NO: 5738 - protein, 15 aa, Homo sapiens
  Heavy chain CDR3 for antibody 2869 (IGHV3-23)
AKDGSYYDYYYGMDV

SEQ ID NO: 5739 - protein, 10 aa, Homo sapiens
  Light chain CDR3 for antibody 2870 (IGKV1-17)
LQHNSYPMYT

SEQ ID NO: 5740 - protein, 15 aa, Homo sapiens
  Heavy chain CDR3 for antibody 2870 (IGHV3-20)
ARDRGSSGWRDWFDP

SEQ ID NO: 5741 - protein, 8 aa, Homo sapiens
  Light chain CDR3 for antibody 2871 (IGKV3-20)
QQYGRSFT

SEQ ID NO: 5742 - protein, 12 aa, Homo sapiens
  Heavy chain CDR3 for antibody 2871 (IGHV1-18)
ARILFYGDYFDY

SEQ ID NO: 5743 - protein, 8 aa, Homo sapiens
  Light chain CDR3 for antibody 2872 (IGKV3D-7)
QQDYNLLT

SEQ ID NO: 5744 - protein, 17 aa, Homo sapiens
  Heavy chain CDR3 for antibody 2872 (IGHV3-33)
ARGYCSRTSCYLYYFDY

SEQ ID NO: 5745 - protein, 9 aa, Homo sapiens
  Light chain CDR3 for antibody 2873 (IGKV1D-13)
QQFNNYPHT

SEQ ID NO: 5746 - protein, 9 aa, Homo sapiens
  Heavy chain CDR3 for antibody 2873 (IGHV3-33)
AREYKEFDY

SEQ ID NO: 5747 - protein, 9 aa, Homo sapiens
  Light chain CDR3 for antibody 2874 (IGKV3D-7)
QQDYNLPWT

SEQ ID NO: 5748 - protein, 14 aa, Homo sapiens
  Heavy chain CDR3 for antibody 2874 (IGHV4-39)
ARQDYDILTGLFDY

SEQ ID NO: 5749 - protein, 9 aa, Homo sapiens
  Light chain CDR3 for antibody 2875 (IGKV1-17)
LQHNSYPYT

SEQ ID NO: 5750 - protein, 12 aa, Homo sapiens
  Heavy chain CDR3 for antibody 2875 (IGHV3-33)
ARDYISTYGMDV

SEQ ID NO: 5751 - protein, 9 aa, Homo sapiens
  Light chain CDR3 for antibody 2876 (IGKV5-2)
LQHDNFPYT

SEQ ID NO: 5752 - protein, 16 aa, Homo sapiens
  Heavy chain CDR3 for antibody 2876 (IGHV3-33)
ARDQGILTGYYTALDY

SEQ ID NO: 5753 - protein, 9 aa, Homo sapiens
  Light chain CDR3 for antibody 2877 (IGKV2-30)
MQGTHWPLT

SEQ ID NO: 5754 - protein, 14 aa, Homo sapiens
  Heavy chain CDR3 for antibody 2877 (IGHV3-33)
ARDKTYPLSYGMDV

SEQ ID NO: 5755 - protein, 9 aa, Homo sapiens
  Light chain CDR3 for antibody 2878 (IGKV3-11)
QQRSNWPWT

SEQ ID NO: 5756 - protein, 13 aa, Homo sapiens
  Heavy chain CDR3 for antibody 2878 (IGHV4-39)
ARHVLLWFGEFDP

SEQ ID NO: 5757 - protein, 10 aa, Homo sapiens
  Light chain CDR3 for antibody 2879 (IGKV1-9)
QQLDSYPMYT

SEQ ID NO: 5758 - protein, 11 aa, Homo sapiens
  Heavy chain CDR3 for antibody 2879 (IGHV3-33)
ARDRSSGPFDY

SEQ ID NO: 5759 - protein, 10 aa, Homo sapiens
  Light chain CDR3 for antibody 2880 (IGKV3-11)
QQRSNWPIFT

SEQ ID NO: 5760 - protein, 13 aa, Homo sapiens
  Heavy chain CDR3 for antibody 2880 (IGHV3-33)
ARRYRSGWYPFDY

SEQ ID NO: 5761 - protein, 9 aa, Homo sapiens
  Light chain CDR3 for antibody 2881 (IGKV3-11)
QQRSNWPLT

SEQ ID NO: 5762 - protein, 14 aa, Homo sapiens
  Heavy chain CDR3 for antibody 2881 (IGHV3-33)
ARDKTYPLSYGMDV

SEQ ID NO: 5763 - protein, 9 aa, Homo sapiens
  Light chain CDR3 for antibody 2882 (IGKV1-39)
QQSYSTPLT

SEQ ID NO: 5764 - protein, 15 aa, Homo sapiens
  Heavy chain CDR3 for antibody 2882 (IGHV3-30)
ARRGYGSGSPDAFDL

SEQ ID NO: 5765 - protein, 9 aa, Homo sapiens
  Light chain CDR3 for antibody 2883 (IGKV1D-16)
QQYNSYPLT

SEQ ID NO: 5766 - protein, 16 aa, Homo sapiens
  Heavy chain CDR3 for antibody 2883 (IGHV3-64)
ARGRYFDWLLGDWFDP

SEQ ID NO: 5767 - protein, 9 aa, Homo sapiens
  Light chain CDR3 for antibody 2884 (IGKV1D-13)
QQFNNYPYT

SEQ ID NO: 5768 - protein, 13 aa, Homo sapiens
  Heavy chain CDR3 for antibody 2884 (IGHV3-23)
AKDRGYSSTSTAY

SEQ ID NO: 5769 - protein, 9 aa, Homo sapiens
  Light chain CDR3 for antibody 2885 (IGKV1-27)
QKYNSAPYT

SEQ ID NO: 5770 - protein, 12 aa, Homo sapiens
  Heavy chain CDR3 for antibody 2885 (IGHV3-33)
AREGTGGNWFDP

SEQ ID NO: 5771 - protein, 9 aa, Homo sapiens
  Light chain CDR3 for antibody 2886 (IGKV5-2)
LQHDNFPWT

SEQ ID NO: 5772 - protein, 13 aa, Homo sapiens
  Heavy chain CDR3 for antibody 2886 (IGHV1-2)
ARDGVRGSFGMDV

SEQ ID NO: 5773 - protein, 9 aa, Homo sapiens
  Light chain CDR3 for antibody 2887 (IGKV5-2)
LQHDNFPYT

SEQ ID NO: 5774 - protein, 14 aa, Homo sapiens
  Heavy chain CDR3 for antibody 2887 (IGHV3-33)
ARDTVAAGFNGMDV

SEQ ID NO: 5775 - protein, 9 aa, Homo sapiens
  Light chain CDR3 for antibody 2888 (IGKV1-9)
QQLISYPLT

SEQ ID NO: 5776 - protein, 18 aa, Homo sapiens
  Heavy chain CDR3 for antibody 2888 (IGHV3-33)
ARDRYYDILTGYYMGFDY

SEQ ID NO: 5777 - protein, 9 aa, Homo sapiens
  Light chain CDR3 for antibody 2889 (IGKV2-30)
MQGTHWPLT

SEQ ID NO: 5778 - protein, 8 aa, Homo sapiens
  Heavy chain CDR3 for antibody 2889 (IGHV3-23)
AKETGNNY

SEQ ID NO: 5779 - protein, 9 aa, Homo sapiens
  Light chain CDR3 for antibody 2890 (IGKV1-16)
QQYNSYPYT

SEQ ID NO: 5780 - protein, 10 aa, Homo sapiens
  Heavy chain CDR3 for antibody 2890 (IGHV3-33)
ARDLRADFDY

SEQ ID NO: 5781 - protein, 9 aa, Homo sapiens
  Light chain CDR3 for antibody 2891 (IGKV3-15)
QQYNNWPLT

SEQ ID NO: 5782 - protein, 11 aa, Homo sapiens
  Heavy chain CDR3 for antibody 2891 (IGHV3-33)
ARDRVLTPFDY

SEQ ID NO: 5783 - protein, 9 aa, Homo sapiens
  Light chain CDR3 for antibody 2892 (IGKV3-20)
QQYGSSPLT

SEQ ID NO: 5784 - protein, 12 aa, Homo sapiens
  Heavy chain CDR3 for antibody 2892 (IGHV3-23)
AKESLYTPTDDY

SEQ ID NO: 5785 - protein, 11 aa, Homo sapiens
  Light chain CDR3 for antibody 2893 (IGKV3-11)
QQRSNWPPTWT

SEQ ID NO: 5786 - protein, 11 aa, Homo sapiens
  Heavy chain CDR3 for antibody 2893 (IGHV4-59)
ARSLRYSVFDY

SEQ ID NO: 5787 - protein, 9 aa, Homo sapiens
  Light chain CDR3 for antibody 2894 (IGKV6-21)
HQSSSLPYT

SEQ ID NO: 5788 - protein, 17 aa, Homo sapiens
  Heavy chain CDR3 for antibody 2894 (IGHV3-33)
ARDSYDILTGYYKPFDY

SEQ ID NO: 5789 - protein, 9 aa, Homo sapiens
  Light chain CDR3 for antibody 2895 (IGKV1-6)
LQDYNYPYT

SEQ ID NO: 5790 - protein, 14 aa, Homo sapiens
  Heavy chain CDR3 for antibody 2895 (IGHV3-33)
ARKPDYYGSGYFDY

SEQ ID NO: 5791 - protein, 9 aa, Homo sapiens
  Light chain CDR3 for antibody 2896 (IGKV1-39)
QQSYSTPLT

SEQ ID NO: 5792 - protein, 18 aa, Homo sapiens
  Heavy chain CDR3 for antibody 2896 (IGHV3-33)
ARERDYYGSGSYPDAFDI

SEQ ID NO: 5793 - protein, 9 aa, Homo sapiens
  Light chain CDR3 for antibody 2897 (IGKV1-6)
LQDYKSPFT

SEQ ID NO: 5794 - protein, 14 aa, Homo sapiens
  Heavy chain CDR3 for antibody 2897 (IGHV3-23)
AKSRIVGALYYFDY

SEQ ID NO: 5795 - protein, 9 aa, Homo sapiens
  Light chain CDR3 for antibody 2898 (IGKV5-2)
LQHDNFPWT

SEQ ID NO: 5796 - protein, 17 aa, Homo sapiens
  Heavy chain CDR3 for antibody 2898 (IGHV1-24)
ATHYGSGSHYKGYGMDV

SEQ ID NO: 5797 - protein, 9 aa, Homo sapiens
  Light chain CDR3 for antibody 2899 (IGKV2-30)
MQGTHWPLT

SEQ ID NO: 5798 - protein, 14 aa, Homo sapiens
  Heavy chain CDR3 for antibody 2899 (IGHV4-39)
ARQDYDILTGLFDY

SEQ ID NO: 5799 - protein, 9 aa, Homo sapiens
  Light chain CDR3 for antibody 2900 (IGKV1D-16)
QQYNSYPLT

SEQ ID NO: 5800 - protein, 20 aa, Homo sapiens
  Heavy chain CDR3 for antibody 2900 (IGHV3-33)
ARDLGWATMVRGVIRAPFDY

SEQ ID NO: 5801 - protein, 9 aa, Homo sapiens
  Light chain CDR3 for antibody 2901 (IGKV3-20)
QQYGSSPYT

SEQ ID NO: 5802 - protein, 18 aa, Homo sapiens
  Heavy chain CDR3 for antibody 2901 (IGHV3-33)
ARDGRISLVRGIIDAFDI

SEQ ID NO: 5803 - protein, 8 aa, Homo sapiens
  Light chain CDR3 for antibody 2902 (IGKV3D-7)
QQDYNLLT

SEQ ID NO: 5804 - protein, 14 aa, Homo sapiens
  Heavy chain CDR3 for antibody 2902 (IGHV3-33)
ARDWNDVYYYGMDV

SEQ ID NO: 5805 - protein, 11 aa, Homo sapiens
  Light chain CDR3 for antibody 2903 (IGKV3-11)
QQRSNWPPTWT

SEQ ID NO: 5806 - protein, 17 aa, Homo sapiens
  Heavy chain CDR3 for antibody 2903 (IGHV4-59)
ARDFLVRGEGSYYGMDV

SEQ ID NO: 5807 - protein, 8 aa, Homo sapiens
  Light chain CDR3 for antibody 2904 (IGKV6-21)
HQSSSLPT

SEQ ID NO: 5808 - protein, 13 aa, Homo sapiens
  Heavy chain CDR3 for antibody 2904 (IGHV4-59)
ARDAGYSSSWFDY

SEQ ID NO: 5809 - protein, 9 aa, Homo sapiens
  Light chain CDR3 for antibody 2905 (IGKV1D-13)
QQFNNYPHT

SEQ ID NO: 5810 - protein, 16 aa, Homo sapiens
  Heavy chain CDR3 for antibody 2905 (IGHV4-59)
ARYSGSYYGDYYGMDV

SEQ ID NO: 5811 - protein, 9 aa, Homo sapiens
  Light chain CDR3 for antibody 2906 (IGKV5-2)
LQHDNFPYT

SEQ ID NO: 5812 - protein, 11 aa, Homo sapiens
  Heavy chain CDR3 for antibody 2906 (IGHV3-23)
AKAGIVGCLDV

SEQ ID NO: 5813 - protein, 9 aa, Homo sapiens
  Light chain CDR3 for antibody 2907 (IGKV5-2)
LQHDKFPYT

SEQ ID NO: 5814 - protein, 13 aa, Homo sapiens
  Heavy chain CDR3 for antibody 2907 (IGHV3-33)
ARAFIMVRGVIDY

SEQ ID NO: 5815 - protein, 9 aa, Homo sapiens
  Light chain CDR3 for antibody 2908 (IGKV1D-16)
QQYNSYPLT

SEQ ID NO: 5816 - protein, 15 aa, Homo sapiens
  Heavy chain CDR3 for antibody 2908 (IGHV3-33)
ARDALAVTGTGWFDP

SEQ ID NO: 5817 - protein, 9 aa, Homo sapiens
  Light chain CDR3 for antibody 2909 (IGKV1-27)
QKYNSAPYT

SEQ ID NO: 5818 - protein, 18 aa, Homo sapiens
  Heavy chain CDR3 for antibody 2909 (IGHV3-33)
ARDGYSGYDYYYYYGMDV

SEQ ID NO: 5819 - protein, 9 aa, Homo sapiens
  Light chain CDR3 for antibody 2910 (IGKV3-20)
QQYGSSPYT

SEQ ID NO: 5820 - protein, 16 aa, Homo sapiens
  Heavy chain CDR3 for antibody 2910 (IGHV3-33)
ARDQGILTGYYTALDY

SEQ ID NO: 5821 - protein, 9 aa, Homo sapiens
  Light chain CDR3 for antibody 2911 (IGKV1-6)
LQDYNYPYT

SEQ ID NO: 5822 - protein, 16 aa, Homo sapiens
  Heavy chain CDR3 for antibody 2911 (IGHV3-23)
ARNDILTASGYYGMDV

SEQ ID NO: 5823 - protein, 9 aa, Homo sapiens
  Light chain CDR3 for antibody 2912 (IGKV5-2)
LQHDNFPYT

SEQ ID NO: 5824 - protein, 17 aa, Homo sapiens
  Heavy chain CDR3 for antibody 2912 (IGHV3-23)
AKDYDILTGYSHNWFDP

SEQ ID NO: 5825 - protein, 9 aa, Homo sapiens
  Light chain CDR3 for antibody 2913 (IGKV1-27)
QKYNSAPYT

SEQ ID NO: 5826 - protein, 13 aa, Homo sapiens
  Heavy chain CDR3 for antibody 2913 (IGHV3-33)
AREYCSGGSCYDY

SEQ ID NO: 5827 - protein, 9 aa, Homo sapiens
  Light chain CDR3 for antibody 2914 (IGKV6-21)
HQSSSLPYT

SEQ ID NO: 5828 - protein, 14 aa, Homo sapiens
  Heavy chain CDR3 for antibody 2914 (IGHV3-33)
ARGYGSGSYYSFDY

SEQ ID NO: 5829 - protein, 9 aa, Homo sapiens
  Light chain CDR3 for antibody 2915 (IGKV6-21)
HQSSSLPYT

SEQ ID NO: 5830 - protein, 15 aa, Homo sapiens
  Heavy chain CDR3 for antibody 2915 (IGHV4-39)
ARHSGYSSGWYPFDY

SEQ ID NO: 5831 - protein, 9 aa, Homo sapiens
  Light chain CDR3 for antibody 2916 (IGKV6-21)
HQSSSLPYT

SEQ ID NO: 5832 - protein, 17 aa, Homo sapiens
  Heavy chain CDR3 for antibody 2916 (IGHV3-33)
ARSPYDILTGYSYYFDY

SEQ ID NO: 5833 - protein, 9 aa, Homo sapiens
  Light chain CDR3 for antibody 2917 (IGKV3D-7)
QQDYNLPLT

SEQ ID NO: 5834 - protein, 18 aa, Homo sapiens
  Heavy chain CDR3 for antibody 2917 (IGHV1-46)
ARDLTGRTENYYYYGMDV

SEQ ID NO: 5835 - protein, 9 aa, Homo sapiens
  Light chain CDR3 for antibody 2918 (IGKV3-11)
QQRSNWPPT

SEQ ID NO: 5836 - protein, 13 aa, Homo sapiens
  Heavy chain CDR3 for antibody 2918 (IGHV3-11)
ARDEGYRGYVLDT

SEQ ID NO: 5837 - protein, 9 aa, Homo sapiens
  Light chain CDR3 for antibody 2919 (IGKV5-2)
LQHDNFPYT

SEQ ID NO: 5838 - protein, 12 aa, Homo sapiens
  Heavy chain CDR3 for antibody 2919 (IGHV3-33)
ARGYFTSGSAHY

SEQ ID NO: 5839 - protein, 9 aa, Homo sapiens
  Light chain CDR3 for antibody 2920 (IGKV5-2)
LQHDNFPWT

SEQ ID NO: 5840 - protein, 17 aa, Homo sapiens
  Heavy chain CDR3 for antibody 2920 (IGHV1-24)
ATEGYDILPGYYNVLDY

SEQ ID NO: 5841 - protein, 9 aa, Homo sapiens
  Light chain CDR3 for antibody 2921 (IGKV1-6)
LQDYNYPRT

SEQ ID NO: 5842 - protein, 15 aa, Homo sapiens
  Heavy chain CDR3 for antibody 2921 (IGHV3-23)
AKDRNYDFLTGPFDP

SEQ ID NO: 5843 - protein, 9 aa, Homo sapiens
  Light chain CDR3 for antibody 2922 (IGKV1-27)
QKYNSAPYT

SEQ ID NO: 5844 - protein, 17 aa, Homo sapiens
  Heavy chain CDR3 for antibody 2922 (IGHV3-64)
ARERYYGSGSYYNWFDP

SEQ ID NO: 5845 - protein, 8 aa, Homo sapiens
  Light chain CDR3 for antibody 2923 (IGKV1-6)
LQDYNYYT

SEQ ID NO: 5846 - protein, 17 aa, Homo sapiens
  Heavy chain CDR3 for antibody 2923 (IGHV3-7)
ARDKAVAVYQFYYGLDV

SEQ ID NO: 5847 - protein, 9 aa, Homo sapiens
  Light chain CDR3 for antibody 2924 (IGKV6-21)
HQSSSLPYT

SEQ ID NO: 5848 - protein, 11 aa, Homo sapiens
  Heavy chain CDR3 for antibody 2924 (IGHV3-23)
AKEGTYFDIPH

SEQ ID NO: 5849 - protein, 8 aa, Homo sapiens
  Light chain CDR3 for antibody 2925 (IGKV1D-13)
QQFNNYPT

SEQ ID NO: 5850 - protein, 13 aa, Homo sapiens
  Heavy chain CDR3 for antibody 2925 (IGHV3-11)
ARDGGAAAGTWDS

SEQ ID NO: 5851 - protein, 9 aa, Homo sapiens
  Light chain CDR3 for antibody 2926 (IGKV1-27)
QKYNSAPYT

SEQ ID NO: 5852 - protein, 15 aa, Homo sapiens
  Heavy chain CDR3 for antibody 2926 (IGHV4-59)
ARDLGHYYGSVSIDY

SEQ ID NO: 5853 - protein, 9 aa, Homo sapiens
  Light chain CDR3 for antibody 2927 (IGKV1D-13)
QQFNNYPYT

SEQ ID NO: 5854 - protein, 19 aa, Homo sapiens
  Heavy chain CDR3 for antibody 2927 (IGHV3-30)
ARRFSGYSGYDHYYYGMDV

SEQ ID NO: 5855 - protein, 9 aa, Homo sapiens
  Light chain CDR3 for antibody 2928 (IGKV2-30)
MQGTHWPLT

SEQ ID NO: 5856 - protein, 12 aa, Homo sapiens
  Heavy chain CDR3 for antibody 2928 (IGHV3-33)
ARDRAYRGSLDY

SEQ ID NO: 5857 - protein, 9 aa, Homo sapiens
  Light chain CDR3 for antibody 2929 (IGKV6-21)
HQSSSLPYT

SEQ ID NO: 5858 - protein, 16 aa, Homo sapiens
  Heavy chain CDR3 for antibody 2929 (IGHV3-33)
AREVAGSYYYYYGIDV

SEQ ID NO: 5859 - protein, 10 aa, Homo sapiens
  Light chain CDR3 for antibody 2930 (IGKV1-17)
LQHNSYPMYT

SEQ ID NO: 5860 - protein, 12 aa, Homo sapiens
  Heavy chain CDR3 for antibody 2930 (IGHV1-46)
ARGLTGDHAVDI

SEQ ID NO: 5861 - protein, 9 aa, Homo sapiens
  Light chain CDR3 for antibody 2931 (IGKV1-39)
QQSYSTPLT

SEQ ID NO: 5862 - protein, 16 aa, Homo sapiens
  Heavy chain CDR3 for antibody 2931 (IGHV3-13)
ARDRSYESYYYYGMDV

SEQ ID NO: 5863 - protein, 9 aa, Homo sapiens
  Light chain CDR3 for antibody 2932 (IGKV1-9)
QQLNNYLFT

SEQ ID NO: 5864 - protein, 13 aa, Homo sapiens
  Heavy chain CDR3 for antibody 2932 (IGHV4-59)
ARDAGYSSSWFDY

SEQ ID NO: 5865 - protein, 9 aa, Homo sapiens
  Light chain CDR3 for antibody 2933 (IGKV1-27)
QKYNSAPYT

SEQ ID NO: 5866 - protein, 10 aa, Homo sapiens
  Heavy chain CDR3 for antibody 2933 (IGHV3-23)
AKEQWLVLDY

SEQ ID NO: 5867 - protein, 8 aa, Homo sapiens
  Light chain CDR3 for antibody 2934 (IGKV1-5)
QQYNSYWT

SEQ ID NO: 5868 - protein, 12 aa, Homo sapiens
  Heavy chain CDR3 for antibody 2934 (IGHV3-13)
AREAGIPDAFDI

SEQ ID NO: 5869 - protein, 9 aa, Homo sapiens
  Light chain CDR3 for antibody 2935 (IGKV1-9)
QQLHIYPWT

SEQ ID NO: 5870 - protein, 11 aa, Homo sapiens
  Heavy chain CDR3 for antibody 2935 (IGHV3-33)
ARDRSSGPFDY

SEQ ID NO: 5871 - protein, 9 aa, Homo sapiens
  Light chain CDR3 for antibody 2936 (IGKV1-6)
LQDYNYPYT

SEQ ID NO: 5872 - protein, 15 aa, Homo sapiens
  Heavy chain CDR3 for antibody 2936 (IGHV3-33)
VRGYYYGSGSYPLNY

SEQ ID NO: 5873 - protein, 9 aa, Homo sapiens
  Light chain CDR3 for antibody 2937 (IGKV1-39)
QQSYSTPLT

SEQ ID NO: 5874 - protein, 16 aa, Homo sapiens
  Heavy chain CDR3 for antibody 2937 (IGHV3-33)
ARGGRSDWLYYYGMDV

SEQ ID NO: 5875 - protein, 9 aa, Homo sapiens
  Light chain CDR3 for antibody 2938 (IGKV3D-20)
QQYGSSPYT

SEQ ID NO: 5876 - protein, 19 aa, Homo sapiens
  Heavy chain CDR3 for antibody 2938 (IGHV3-33)
ARGRGSYYYGPGSHYGMDV

SEQ ID NO: 5877 - protein, 9 aa, Homo sapiens
  Light chain CDR3 for antibody 2939 (IGKV1-9)
QQLNSYPYT

SEQ ID NO: 5878 - protein, 9 aa, Homo sapiens
  Heavy chain CDR3 for antibody 2939 (IGHV3-30)
ARDYFHFDY

SEQ ID NO: 5879 - protein, 10 aa, Homo sapiens
  Light chain CDR3 for antibody 2940 (IGKV1-39)
QQSYSTPMYT

SEQ ID NO: 5880 - protein, 12 aa, Homo sapiens
  Heavy chain CDR3 for antibody 2940 (IGHV3-33)
ARGYFGSGYAHF

SEQ ID NO: 5881 - protein, 9 aa, Homo sapiens
  Light chain CDR3 for antibody 2941 (IGKV1D-13)
QRFNNYLYT

SEQ ID NO: 5882 - protein, 16 aa, Homo sapiens
  Heavy chain CDR3 for antibody 2941 (IGHV3-23)
AKEGMVLRYFDWLWDY

SEQ ID NO: 5883 - protein, 9 aa, Homo sapiens
  Light chain CDR3 for antibody 2942 (IGKV6-21)
HQSSSLPYT

SEQ ID NO: 5884 - protein, 18 aa, Homo sapiens
  Heavy chain CDR3 for antibody 2942 (IGHV3-33)
ARGGVLYDILTGFYGMDV

SEQ ID NO: 5885 - protein, 9 aa, Homo sapiens
  Light chain CDR3 for antibody 2943 (IGKV2-30)
MQGTHWPLT

SEQ ID NO: 5886 - protein, 7 aa, Homo sapiens
  Heavy chain CDR3 for antibody 2943 (IGHV1-46)
AREGGDY

SEQ ID NO: 5887 - protein, 9 aa, Homo sapiens
  Light chain CDR3 for antibody 2944 (IGKV1-27)
QKYNSAPYT

SEQ ID NO: 5888 - protein, 12 aa, Homo sapiens
  Heavy chain CDR3 for antibody 2944 (IGHV3-33)
AREKGGSYSFDY

SEQ ID NO: 5889 - protein, 9 aa, Homo sapiens
  Light chain CDR3 for antibody 2945 (IGKV1-39)
QQSYSTPLT

SEQ ID NO: 5890 - protein, 24 aa, Homo sapiens
  Heavy chain CDR3 for antibody 2945 (IGHV3-20)
ARGRITMVRGVIINPLDYYNGMDV

SEQ ID NO: 5891 - protein, 9 aa, Homo sapiens
  Light chain CDR3 for antibody 2946 (IGKV6-21)
HQSSSLPYT

SEQ ID NO: 5892 - protein, 14 aa, Homo sapiens
  Heavy chain CDR3 for antibody 2946 (IGHV3-33)
ARDRRDFYYYGMDV

SEQ ID NO: 5893 - protein, 9 aa, Homo sapiens
  Light chain CDR3 for antibody 2947 (IGKV2-30)
MQGTHWPLT

SEQ ID NO: 5894 - protein, 14 aa, Homo sapiens
  Heavy chain CDR3 for antibody 2947 (IGHV3-33)
AREGYSSNWYDFDY

SEQ ID NO: 5895 - protein, 9 aa, Homo sapiens
  Light chain CDR3 for antibody 2948 (IGKV3D-7)
QQDYNLPLT

SEQ ID NO: 5896 - protein, 20 aa, Homo sapiens
  Heavy chain CDR3 for antibody 2948 (IGHV1-18)
AREVGIAVAGTLYYYYGMDV

SEQ ID NO: 5897 - protein, 9 aa, Homo sapiens
  Light chain CDR3 for antibody 2949 (IGKV5-2)
LQHDKFPYT

SEQ ID NO: 5898 - protein, 18 aa, Homo sapiens
  Heavy chain CDR3 for antibody 2949 (IGHV1-46)
ARDGDYVWGSYRSNWFDP

SEQ ID NO: 5899 - protein, 9 aa, Homo sapiens
  Light chain CDR3 for antibody 2950 (IGKV1-9)
QQGNTYSRT

SEQ ID NO: 5900 - protein, 13 aa, Homo sapiens
  Heavy chain CDR3 for antibody 2950 (IGHV4-34)
ASNFYYYYYGMDV

SEQ ID NO: 5901 - protein, 9 aa, Homo sapiens
  Light chain CDR3 for antibody 2951 (IGKV3-20)
QQYGSSPYT

SEQ ID NO: 5902 - protein, 9 aa, Homo sapiens
  Heavy chain CDR3 for antibody 2951 (IGHV3-20)
ASIRGYFDY

SEQ ID NO: 5903 - protein, 9 aa, Homo sapiens
  Light chain CDR3 for antibody 2952 (IGKV1-6)
LQDYNYPRT

SEQ ID NO: 5904 - protein, 17 aa, Homo sapiens
  Heavy chain CDR3 for antibody 2952 (IGHV3-33)
ARELRYFDWLLSDAFDI

SEQ ID NO: 5905 - protein, 9 aa, Homo sapiens
  Light chain CDR3 for antibody 2953 (IGKV1-17)
LQHNGYPLT

SEQ ID NO: 5906 - protein, 12 aa, Homo sapiens
  Heavy chain CDR3 for antibody 2953 (IGHV3-13)
VREAGIPDAFDI

SEQ ID NO: 5907 - protein, 9 aa, Homo sapiens
  Light chain CDR3 for antibody 2954 (IGKV5-2)
LQHDNFPYT

SEQ ID NO: 5908 - protein, 14 aa, Homo sapiens
  Heavy chain CDR3 for antibody 2954 (IGHV3-33)
ARDRDIMATSYFDY

SEQ ID NO: 5909 - protein, 8 aa, Homo sapiens
  Light chain CDR3 for antibody 2955 (IGKV1-5)
QQYNSYWT

SEQ ID NO: 5910 - protein, 13 aa, Homo sapiens
  Heavy chain CDR3 for antibody 2955 (IGHV3-33)
ARKAYGDYFYFDY

SEQ ID NO: 5911 - protein, 8 aa, Homo sapiens
  Light chain CDR3 for antibody 2956 (IGKV1D-13)
QQFNNYPT

SEQ ID NO: 5912 - protein, 18 aa, Homo sapiens
  Heavy chain CDR3 for antibody 2956 (IGHV3-33)
ARREGIVGATTYYYGMDV

SEQ ID NO: 5913 - protein, 9 aa, Homo sapiens
  Light chain CDR3 for antibody 2957 (IGKV1D-16)
QQYNSYPYT

SEQ ID NO: 5914 - protein, 13 aa, Homo sapiens
  Heavy chain CDR3 for antibody 2957 (IGHV3-33)
ARVDYYNYYGLDV

SEQ ID NO: 5915 - protein, 9 aa, Homo sapiens
  Light chain CDR3 for antibody 2958 (IGKV5-2)
LQHDNFPWT

SEQ ID NO: 5916 - protein, 18 aa, Homo sapiens
  Heavy chain CDR3 for antibody 2958 (IGHV3-33)
ARDRGDILTGYYKGWFDP

SEQ ID NO: 5917 - protein, 9 aa, Homo sapiens
  Light chain CDR3 for antibody 2959 (IGKV1D-13)
QQFNNYPHT

SEQ ID NO: 5918 - protein, 14 aa, Homo sapiens
  Heavy chain CDR3 for antibody 2959 (IGHV3-23)
ANWAYDILTGYLDY

SEQ ID NO: 5919 - protein, 9 aa, Homo sapiens
  Light chain CDR3 for antibody 2960 (IGKV1-9)
QQLNSYPWT

SEQ ID NO: 5920 - protein, 9 aa, Homo sapiens
  Heavy chain CDR3 for antibody 2960 (IGHV3-30)
VRDNWGFDY

SEQ ID NO: 5921 - protein, 9 aa, Homo sapiens
  Light chain CDR3 for antibody 2961 (IGKV1-16)
QQYNSYPLT

SEQ ID NO: 5922 - protein, 12 aa, Homo sapiens
  Heavy chain CDR3 for antibody 2961 (IGHV3-33)
ARKGYGLYVLDV

SEQ ID NO: 5923 - protein, 9 aa, Homo sapiens
  Light chain CDR3 for antibody 2962 (IGKV5-2)
LQHDNFPWT

SEQ ID NO: 5924 - protein, 19 aa, Homo sapiens
  Heavy chain CDR3 for antibody 2962 (IGHV3-33)
ARDRYYDILTGYSSYYFDY

SEQ ID NO: 5925 - protein, 9 aa, Homo sapiens
  Light chain CDR3 for antibody 2963 (IGKV1-9)
QQLNSYPYT

SEQ ID NO: 5926 - protein, 13 aa, Homo sapiens
  Heavy chain CDR3 for antibody 2963 (IGHV3-33)
ARTDYYSYYGLDV

SEQ ID NO: 5927 - protein, 9 aa, Homo sapiens
  Light chain CDR3 for antibody 2964 (IGKV5-2)
LQHDNFPYT

SEQ ID NO: 5928 - protein, 12 aa, Homo sapiens
  Heavy chain CDR3 for antibody 2964 (IGHV3-33)
ARAGMGAPYFDY

SEQ ID NO: 5929 - protein, 9 aa, Homo sapiens
  Light chain CDR3 for antibody 2965 (IGKV3D-20)
QQYGSSPYT

SEQ ID NO: 5930 - protein, 15 aa, Homo sapiens
  Heavy chain CDR3 for antibody 2965 (IGHV3-23)
AKVFTMVRGMGYFDL

SEQ ID NO: 5931 - protein, 9 aa, Homo sapiens
  Light chain CDR3 for antibody 2966 (IGKV1-9)
QQLKSYLYT

SEQ ID NO: 5932 - protein, 20 aa, Homo sapiens
  Heavy chain CDR3 for antibody 2966 (IGHV1-18)
AREVGIAVAGTLYYYYGMDV

SEQ ID NO: 5933 - protein, 9 aa, Homo sapiens
  Light chain CDR3 for antibody 2967 (IGKV3-15)
QQYNNWPLT

SEQ ID NO: 5934 - protein, 15 aa, Homo sapiens
  Heavy chain CDR3 for antibody 2967 (IGHV3-66)
ARDSRPEIIGPPFDY

SEQ ID NO: 5935 - protein, 9 aa, Homo sapiens
  Light chain CDR3 for antibody 2968 (IGKV1-6)
LQDYNYPWT

SEQ ID NO: 5936 - protein, 24 aa, Homo sapiens
  Heavy chain CDR3 for antibody 2968 (IGHV3-11)
ARDGEIITPRTIVIPPYYYYGMDV

SEQ ID NO: 5937 - protein, 8 aa, Homo sapiens
  Light chain CDR3 for antibody 2969 (IGKV1D-13)
QQFNNYPT

SEQ ID NO: 5938 - protein, 12 aa, Homo sapiens
  Heavy chain CDR3 for antibody 2969 (IGHV3-33)
ARESGGSYSFDY

SEQ ID NO: 5939 - protein, 9 aa, Homo sapiens
  Light chain CDR3 for antibody 2970 (IGKV5-2)
LQHDNFPYT

SEQ ID NO: 5940 - protein, 10 aa, Homo sapiens
  Heavy chain CDR3 for antibody 2970 (IGHV3-33)
ARNILTPLDY

SEQ ID NO: 5941 - protein, 9 aa, Homo sapiens
  Light chain CDR3 for antibody 2971 (IGKV6-21)
HQSSSLPYT

SEQ ID NO: 5942 - protein, 15 aa, Homo sapiens
  Heavy chain CDR3 for antibody 2971 (IGHV3-23)
AKDRYFDWLSDAFDI

SEQ ID NO: 5943 - protein, 9 aa, Homo sapiens
  Light chain CDR3 for antibody 2972 (IGKV3D-7)
QQDYNLPLT

SEQ ID NO: 5944 - protein, 13 aa, Homo sapiens
  Heavy chain CDR3 for antibody 2972 (IGHV3-33)
ARVDTMVRGVMAY

SEQ ID NO: 5945 - protein, 9 aa, Homo sapiens
  Light chain CDR3 for antibody 2973 (IGKV6-21)
HQSSSLPYT

SEQ ID NO: 5946 - protein, 13 aa, Homo sapiens
  Heavy chain CDR3 for antibody 2973 (IGHV1-18)
ARSITMVRGVIGY

SEQ ID NO: 5947 - protein, 9 aa, Homo sapiens
  Light chain CDR3 for antibody 2974 (IGKV3-20)
QQYGSSPYT

SEQ ID NO: 5948 - protein, 12 aa, Homo sapiens
  Heavy chain CDR3 for antibody 2974 (IGHV3-33)
ARKQWLVQAFDI

SEQ ID NO: 5949 - protein, 9 aa, Homo sapiens
  Light chain CDR3 for antibody 2975 (IGKV1-39)
QQSYSTPLT

SEQ ID NO: 5950 - protein, 13 aa, Homo sapiens
  Heavy chain CDR3 for antibody 2975 (IGHV4-39)
ARHHYGSGSLRDY

SEQ ID NO: 5951 - protein, 9 aa, Homo sapiens
  Light chain CDR3 for antibody 2976 (IGKV4-1)
QQYYSTPLT

SEQ ID NO: 5952 - protein, 12 aa, Homo sapiens
  Heavy chain CDR3 for antibody 2976 (IGHV1-18)
ARVLFDGDYFDY

SEQ ID NO: 5953 - protein, 9 aa, Homo sapiens
  Light chain CDR3 for antibody 2977 (IGKV2-30)
MQGTHWPLT

SEQ ID NO: 5954 - protein, 18 aa, Homo sapiens
  Heavy chain CDR3 for antibody 2977 (IGHV3-33)
ARGYYGSGNFYKDSGMDV

SEQ ID NO: 5955 - protein, 9 aa, Homo sapiens
  Light chain CDR3 for antibody 2978 (IGKV1-16)
QQYNSYPYT

SEQ ID NO: 5956 - protein, 16 aa, Homo sapiens
  Heavy chain CDR3 for antibody 2978 (IGHV3-20)
ARLLRYFDWPLGAFDI

SEQ ID NO: 5957 - protein, 9 aa, Homo sapiens
  Light chain CDR3 for antibody 2979 (IGKV1-9)
QQLNSYPLT

SEQ ID NO: 5958 - protein, 13 aa, Homo sapiens
  Heavy chain CDR3 for antibody 2979 (IGHV3-33)
ARGYFDWLLPLDY

SEQ ID NO: 5959 - protein, 9 aa, Homo sapiens
  Light chain CDR3 for antibody 2980 (IGKV6-21)
HQSSSLPFT

SEQ ID NO: 5960 - protein, 11 aa, Homo sapiens
  Heavy chain CDR3 for antibody 2980 (IGHV4-59)
ARDGVRGVFDI

SEQ ID NO: 5961 - protein, 9 aa, Homo sapiens
  Light chain CDR3 for antibody 2981 (IGKV1-39)
QQGFSTPWT

SEQ ID NO: 5962 - protein, 18 aa, Homo sapiens
  Heavy chain CDR3 for antibody 2981 (IGHV4-59)
AREGDYVWGSYRPNWFDP

SEQ ID NO: 5963 - protein, 10 aa, Homo sapiens
  Light chain CDR3 for antibody 2982 (IGKV3-11)
QQRSNWPIFT

SEQ ID NO: 5964 - protein, 17 aa, Homo sapiens
  Heavy chain CDR3 for antibody 2982 (IGHV4-59)
ARDFLVRGEGSYYGMDV

SEQ ID NO: 5965 - protein, 9 aa, Homo sapiens
  Light chain CDR3 for antibody 2983 (IGKV3-11)
QQRSNWPLT

SEQ ID NO: 5966 - protein, 14 aa, Homo sapiens
  Heavy chain CDR3 for antibody 2983 (IGHV3-33)
ARTTAAAGPRDFQH

SEQ ID NO: 5967 - protein, 9 aa, Homo sapiens
  Light chain CDR3 for antibody 2984 (IGKV3D-7)
QQDYNLPYT

SEQ ID NO: 5968 - protein, 11 aa, Homo sapiens
  Heavy chain CDR3 for antibody 2984 (IGHV4-59)
AREMGHDTFDI

SEQ ID NO: 5969 - protein, 9 aa, Homo sapiens
  Light chain CDR3 for antibody 2985 (IGKV1D-13)
QQFNNYPHT

SEQ ID NO: 5970 - protein, 15 aa, Homo sapiens
  Heavy chain CDR3 for antibody 2985 (IGHV3-33)
ARRGYNDYDPYGMDV

SEQ ID NO: 5971 - protein, 9 aa, Homo sapiens
  Light chain CDR3 for antibody 2986 (IGKV6-21)
HQSSSLPYT

SEQ ID NO: 5972 - protein, 12 aa, Homo sapiens
  Heavy chain CDR3 for antibody 2986 (IGHV3-33)
ARAGMGAPYFDY

SEQ ID NO: 5973 - protein, 9 aa, Homo sapiens
  Light chain CDR3 for antibody 2987 (IGKV5-2)
LQHDNFPYT

SEQ ID NO: 5974 - protein, 15 aa, Homo sapiens
  Heavy chain CDR3 for antibody 2987 (IGHV3-23)
AKDGFYYGSGSSFDH

SEQ ID NO: 5975 - protein, 10 aa, Homo sapiens
  Light chain CDR3 for antibody 2988 (IGKV3-15)
QQYNNWPPYT

SEQ ID NO: 5976 - protein, 18 aa, Homo sapiens
  Heavy chain CDR3 for antibody 2988 (IGHV3-33)
ARGSYSSGWNDYHYGMDV

SEQ ID NO: 5977 - protein, 9 aa, Homo sapiens
  Light chain CDR3 for antibody 2989 (IGKV5-2)
LQHDNFPWT

SEQ ID NO: 5978 - protein, 9 aa, Homo sapiens
  Heavy chain CDR3 for antibody 2989 (IGHV4-59)
ARSGSGIYT

SEQ ID NO: 5979 - protein, 9 aa, Homo sapiens
  Light chain CDR3 for antibody 2990 (IGKV5-2)
LQHDNFPWT

SEQ ID NO: 5980 - protein, 12 aa, Homo sapiens
  Heavy chain CDR3 for antibody 2990 (IGHV4-28)
ARKDSGYDWFDY

SEQ ID NO: 5981 - protein, 9 aa, Homo sapiens
  Light chain CDR3 for antibody 2991 (IGKV1-9)
QQLKSYLYT

SEQ ID NO: 5982 - protein, 11 aa, Homo sapiens
  Heavy chain CDR3 for antibody 2991 (IGHV4-59)
AREMGHDTFDI

SEQ ID NO: 5983 - protein, 9 aa, Homo sapiens
  Light chain CDR3 for antibody 2992 (IGKV6-21)
HQSSSLPHT

SEQ ID NO: 5984 - protein, 18 aa, Homo sapiens
  Heavy chain CDR3 for antibody 2992 (IGHV3-33)
ARDQYSGYDFYYYYGMDV

SEQ ID NO: 5985 - protein, 9 aa, Homo sapiens
  Light chain CDR3 for antibody 2993 (IGKV1D-16)
QQYNSYPLT

SEQ ID NO: 5986 - protein, 17 aa, Homo sapiens
  Heavy chain CDR3 for antibody 2993 (IGHV3-23)
AKDTITMVRGALFGMDV

SEQ ID NO: 5987 - protein, 9 aa, Homo sapiens
  Light chain CDR3 for antibody 2994 (IGKV1-16)
QQYNRYPYT

SEQ ID NO: 5988 - protein, 11 aa, Homo sapiens
  Heavy chain CDR3 for antibody 2994 (IGHV4-4)
AREAYYYGLDV

SEQ ID NO: 5989 - protein, 9 aa, Homo sapiens
  Light chain CDR3 for antibody 2995 (IGKV3-20)
QQYGSSPRT

SEQ ID NO: 5990 - protein, 23 aa, Homo sapiens
  Heavy chain CDR3 for antibody 2995 (IGHV1-18)
ARNLHYDILTGYFPYYFYYGMDV

SEQ ID NO: 5991 - protein, 9 aa, Homo sapiens
  Light chain CDR3 for antibody 2996 (IGKV1-17)
LQQNSYPWT

SEQ ID NO: 5992 - protein, 18 aa, Homo sapiens
  Heavy chain CDR3 for antibody 2996 (IGHV1-46)
ARDGDYVWGSYRSDWFDP

SEQ ID NO: 5993 - protein, 9 aa, Homo sapiens
  Light chain CDR3 for antibody 2997 (IGKV1D-13)
QQFNNYPHT

SEQ ID NO: 5994 - protein, 24 aa, Homo sapiens
  Heavy chain CDR3 for antibody 2997 (IGHV3-20)
ARGRITMVRGVIINPLDYYNGMDV

SEQ ID NO: 5995 - protein, 9 aa, Homo sapiens
  Light chain CDR3 for antibody 2998 (IGKV4-1)
QQYYSTPWT

SEQ ID NO: 5996 - protein, 11 aa, Homo sapiens
  Heavy chain CDR3 for antibody 2998 (IGHV3-33)
ARDRSSGPFDY

SEQ ID NO: 5997 - protein, 8 aa, Homo sapiens
  Light chain CDR3 for antibody 2999 (IGKV3D-7)
QQDYNLLT

SEQ ID NO: 5998 - protein, 12 aa, Homo sapiens
  Heavy chain CDR3 for antibody 2999 (IGHV3-33)
AREKGGSYSFDY

SEQ ID NO: 5999 - protein, 9 aa, Homo sapiens
  Light chain CDR3 for antibody 3000 (IGKV1-6)
LQDYNYPYT

SEQ ID NO: 6000 - protein, 13 aa, Homo sapiens
  Heavy chain CDR3 for antibody 3000 (IGHV4-39)
ARRGVVAPAAFDY

SEQ ID NO: 6001 - protein, 8 aa, Homo sapiens
  Light chain CDR3 for antibody 3001 (IGKV6-21)
HQSSSLPT

SEQ ID NO: 6002 - protein, 13 aa, Homo sapiens
  Heavy chain CDR3 for antibody 3001 (IGHV3-33)
ARDYCGGDCYLDY

SEQ ID NO: 6003 - protein, 9 aa, Homo sapiens
  Light chain CDR3 for antibody 3002 (IGKV3-15)
QQYNNWPLT

SEQ ID NO: 6004 - protein, 17 aa, Homo sapiens
  Heavy chain CDR3 for antibody 3002 (IGHV1-18)
ARDRAFTMVRGVPPFDY

SEQ ID NO: 6005 - protein, 9 aa, Homo sapiens
  Light chain CDR3 for antibody 3003 (IGKV1-17)
LQHNSYPYT

SEQ ID NO: 6006 - protein, 16 aa, Homo sapiens
  Heavy chain CDR3 for antibody 3003 (IGHV3-11)
ARDSELRYFDWFGMDV

SEQ ID NO: 6007 - protein, 9 aa, Homo sapiens
  Light chain CDR3 for antibody 3004 (IGKV3D-7)
QQDYNLPLT

SEQ ID NO: 6008 - protein, 11 aa, Homo sapiens
  Heavy chain CDR3 for antibody 3004 (IGHV3-33)
ARARYTTGLDY

SEQ ID NO: 6009 - protein, 9 aa, Homo sapiens
  Light chain CDR3 for antibody 3005 (IGKV1-6)
QQEYNYPLT

SEQ ID NO: 6010 - protein, 13 aa, Homo sapiens
  Heavy chain CDR3 for antibody 3005 (IGHV4-59)
ARDAGYSSSWFDY

SEQ ID NO: 6011 - protein, 9 aa, Homo sapiens
  Light chain CDR3 for antibody 3006 (IGKV1D-16)
QQYNSYPLT

SEQ ID NO: 6012 - protein, 10 aa, Homo sapiens
  Heavy chain CDR3 for antibody 3006 (IGHV3-33)
ARDGLRYFDW

SEQ ID NO: 6013 - protein, 10 aa, Homo sapiens
  Light chain CDR3 for antibody 3007 (IGKV1-17)
LQHNSYPMYT

SEQ ID NO: 6014 - protein, 13 aa, Homo sapiens
  Heavy chain CDR3 for antibody 3007 (IGHV3-23)
ASPFNWNDGFFDY

SEQ ID NO: 6015 - protein, 9 aa, Homo sapiens
  Light chain CDR3 for antibody 3008 (IGKV3-20)
QQYGSSPYT

SEQ ID NO: 6016 - protein, 18 aa, Homo sapiens
  Heavy chain CDR3 for antibody 3008 (IGHV3-33)
AREGYDILTGDYRLGFDY

SEQ ID NO: 6017 - protein, 9 aa, Homo sapiens
  Light chain CDR3 for antibody 3009 (IGKV1-6)
LQDYNYPYT

SEQ ID NO: 6018 - protein, 14 aa, Homo sapiens
  Heavy chain CDR3 for antibody 3009 (IGHV1-18)
AREGGSYFYYGVDV

SEQ ID NO: 6019 - protein, 9 aa, Homo sapiens
  Light chain CDR3 for antibody 3010 (IGKV1-9)
QQLNSYPLT

SEQ ID NO: 6020 - protein, 17 aa, Homo sapiens
  Heavy chain CDR3 for antibody 3010 (IGHV3-33)
TRDSGMVRGIIIYGMDV

SEQ ID NO: 6021 - protein, 9 aa, Homo sapiens
  Light chain CDR3 for antibody 3011 (IGKV1-6)
QQLNSYPYT

SEQ ID NO: 6022 - protein, 14 aa, Homo sapiens
  Heavy chain CDR3 for antibody 3011 (IGHV1-46)
ARKGIVGAFDAFDI

SEQ ID NO: 6023 - protein, 9 aa, Homo sapiens
  Light chain CDR3 for antibody 3012 (IGKV2-30)
MQGTHWPLT

SEQ ID NO: 6024 - protein, 14 aa, Homo sapiens
  Heavy chain CDR3 for antibody 3012 (IGHV3-33)
ARTTAAAGPRDFQH

SEQ ID NO: 6025 - protein, 10 aa, Homo sapiens
  Light chain CDR3 for antibody 3013 (IGKV1-39)
QQSYSTPMYT

SEQ ID NO: 6026 - protein, 13 aa, Homo sapiens
  Heavy chain CDR3 for antibody 3013 (IGHV4-34)
ASNFYYYYYGMDV

SEQ ID NO: 6027 - protein, 9 aa, Homo sapiens
  Light chain CDR3 for antibody 3014 (IGKV1-39)
QQSYSTPLT

SEQ ID NO: 6028 - protein, 20 aa, Homo sapiens
  Heavy chain CDR3 for antibody 3014 (IGHV1-18)
AREVGIAVAGTLYYYYGMDV

SEQ ID NO: 6029 - protein, 9 aa, Homo sapiens
  Light chain CDR3 for antibody 3015 (IGKV1-6)
LQDYKSPFT

SEQ ID NO: 6030 - protein, 18 aa, Homo sapiens
  Heavy chain CDR3 for antibody 3015 (IGHV4-59)
AREGDYVWGSYRPNWFDP

SEQ ID NO: 6031 - protein, 9 aa, Homo sapiens
  Light chain CDR3 for antibody 3016 (IGKV1-27)
QKYNSAPYT

SEQ ID NO: 6032 - protein, 12 aa, Homo sapiens
  Heavy chain CDR3 for antibody 3016 (IGHV3-33)
AREGTRWVYFDY

SEQ ID NO: 6033 - protein, 9 aa, Homo sapiens
  Light chain CDR3 for antibody 3017 (IGKV5-2)
LQHDNFPYT

SEQ ID NO: 6034 - protein, 10 aa, Homo sapiens
  Heavy chain CDR3 for antibody 3017 (IGHV3-23)
AKENWNDFDY

SEQ ID NO: 6035 - protein, 9 aa, Homo sapiens
  Light chain CDR3 for antibody 3018 (IGKV1-39)
QQSYSTPLT

SEQ ID NO: 6036 - protein, 17 aa, Homo sapiens
  Heavy chain CDR3 for antibody 3018 (IGHV4-39)
ARQGWYYGSGSSLLFDY

SEQ ID NO: 6037 - protein, 9 aa, Homo sapiens
  Light chain CDR3 for antibody 3019 (IGKV3-20)
QQYGSSPLT

SEQ ID NO: 6038 - protein, 17 aa, Homo sapiens
  Heavy chain CDR3 for antibody 3019 (IGHV3-64)
ARERYYGSGSYYNWFDP

SEQ ID NO: 6039 - protein, 9 aa, Homo sapiens
  Light chain CDR3 for antibody 3020 (IGKV2-30)
MQGTHWPLT

SEQ ID NO: 6040 - protein, 17 aa, Homo sapiens
  Heavy chain CDR3 for antibody 3020 (IGHV4-59)
ARDFLVRGEGSYYGMDV

SEQ ID NO: 6041 - protein, 9 aa, Homo sapiens
  Light chain CDR3 for antibody 3021 (IGKV1-6)
LQDYNYPYT

SEQ ID NO: 6042 - protein, 15 aa, Homo sapiens
  Heavy chain CDR3 for antibody 3021 (IGHV3-13)
ARDRSYESYYYGMDV

SEQ ID NO: 6043 - protein, 9 aa, Homo sapiens
  Light chain CDR3 for antibody 3022 (IGKV1-27)
QKYNSAPYT

SEQ ID NO: 6044 - protein, 17 aa, Homo sapiens
  Heavy chain CDR3 for antibody 3022 (IGHV3-30)
AREGVRGLIYYYYGMDV

SEQ ID NO: 6045 - protein, 9 aa, Homo sapiens
  Light chain CDR3 for antibody 3023 (IGKV3D-20)
QQYGSSPYT

SEQ ID NO: 6046 - protein, 11 aa, Homo sapiens
  Heavy chain CDR3 for antibody 3023 (IGHV3-33)
ARDRGYSYFDY

SEQ ID NO: 6047 - protein, 9 aa, Homo sapiens
  Light chain CDR3 for antibody 3024 (IGKV1-27)
QKYNSAPYT

SEQ ID NO: 6048 - protein, 15 aa, Homo sapiens
  Heavy chain CDR3 for antibody 3024 (IGHV3-30)
ARRGYGSGSPDAFDL

SEQ ID NO: 6049 - protein, 8 aa, Homo sapiens
  Light chain CDR3 for antibody 3025 (IGKV1D-13)
QQFNNYPT

SEQ ID NO: 6050 - protein, 18 aa, Homo sapiens
  Heavy chain CDR3 for antibody 3025 (IGHV4-59)
AREGDYVWGSYRPNWFDP

SEQ ID NO: 6051 - protein, 8 aa, Homo sapiens
  Light chain CDR3 for antibody 3026 (IGKV1D-13)
QQFNNYPT

SEQ ID NO: 6052 - protein, 17 aa, Homo sapiens
  Heavy chain CDR3 for antibody 3026 (IGHV3-33)
ARGYCSRTSCYLYYFDY

SEQ ID NO: 6053 - protein, 9 aa, Homo sapiens
  Light chain CDR3 for antibody 3027 (IGKV3-11)
QQRSNWPPT

SEQ ID NO: 6054 - protein, 12 aa, Homo sapiens
  Heavy chain CDR3 for antibody 3027 (IGHV3-33)
AREGDILTGYSL

SEQ ID NO: 6055 - protein, 10 aa, Homo sapiens
  Light chain CDR3 for antibody 3028 (IGKV1-17)
LQHNSYPMYT

SEQ ID NO: 6056 - protein, 12 aa, Homo sapiens
  Heavy chain CDR3 for antibody 3028 (IGHV3-33)
ARESGGSYSFDY

SEQ ID NO: 6057 - protein, 9 aa, Homo sapiens
  Light chain CDR3 for antibody 3029 (IGKV2D-28)
MQALQTPPT

SEQ ID NO: 6058 - protein, 13 aa, Homo sapiens
  Heavy chain CDR3 for antibody 3029 (IGHV3-33)
ARDYCGGDCYLDY

SEQ ID NO: 6059 - protein, 9 aa, Homo sapiens
  Light chain CDR3 for antibody 3030 (IGKV3-11)
QQRSNWPPT

SEQ ID NO: 6060 - protein, 17 aa, Homo sapiens
  Heavy chain CDR3 for antibody 3030 (IGHV3-33)
ARGFSGYDGYYYYGMDV

SEQ ID NO: 6061 - protein, 9 aa, Homo sapiens
  Light chain CDR3 for antibody 3031 (IGKV5-2)
LQHDNFPWT

SEQ ID NO: 6062 - protein, 11 aa, Homo sapiens
  Heavy chain CDR3 for antibody 3031 (IGHV4-59)
AREDYGVPFDY

SEQ ID NO: 6063 - protein, 9 aa, Homo sapiens
  Light chain CDR3 for antibody 3032 (IGKV5-2)
LQHDNFPYT

SEQ ID NO: 6064 - protein, 15 aa, Homo sapiens
  Heavy chain CDR3 for antibody 3032 (IGHV3-33)
ARRSILTGSYWYFDL

SEQ ID NO: 6065 - protein, 9 aa, Homo sapiens
  Light chain CDR3 for antibody 3033 (IGKV5-2)
LQHDNFPWT

SEQ ID NO: 6066 - protein, 14 aa, Homo sapiens
  Heavy chain CDR3 for antibody 3033 (IGHV3-20)
ARDGGSTSFDWFDP

SEQ ID NO: 6067 - protein, 9 aa, Homo sapiens
  Light chain CDR3 for antibody 3034 (IGKV6-21)
HQSSSLPYT

SEQ ID NO: 6068 - protein, 17 aa, Homo sapiens
  Heavy chain CDR3 for antibody 3034 (IGHV3-33)
ARDWFGELSDYYYGMDV

SEQ ID NO: 6069 - protein, 8 aa, Homo sapiens
  Light chain CDR3 for antibody 3035 (IGKV3D-7)
QQDYNLLT

SEQ ID NO: 6070 - protein, 8 aa, Homo sapiens
  Heavy chain CDR3 for antibody 3035 (IGHV3-23)
AKETGNNY

SEQ ID NO: 6071 - protein, 9 aa, Homo sapiens
  Light chain CDR3 for antibody 3036 (IGKV1-17)
LQHNSYPYT

SEQ ID NO: 6072 - protein, 12 aa, Homo sapiens
  Heavy chain CDR3 for antibody 3036 (IGHV3-33)
ARNYDILDYFDY

SEQ ID NO: 6073 - protein, 9 aa, Homo sapiens
  Light chain CDR3 for antibody 3037 (IGKV6-21)
HQSSSLPYT

SEQ ID NO: 6074 - protein, 11 aa, Homo sapiens
  Heavy chain CDR3 for antibody 3037 (IGHV4-59)
VRERGYYGMDV

SEQ ID NO: 6075 - protein, 9 aa, Homo sapiens
  Light chain CDR3 for antibody 3038 (IGKV5-2)
LQHDNFPWT

SEQ ID NO: 6076 - protein, 21 aa, Homo sapiens
  Heavy chain CDR3 for antibody 3038 (IGHV1-18)
ASGVLIWFGELLSEDYYDMDV

SEQ ID NO: 6077 - protein, 9 aa, Homo sapiens
  Light chain CDR3 for antibody 3039 (IGKV1-6)
LQDYKSPFT

SEQ ID NO: 6078 - protein, 14 aa, Homo sapiens
  Heavy chain CDR3 for antibody 3039 (IGHV3-33)
ARGAAAGNFYGLDV

SEQ ID NO: 6079 - protein, 9 aa, Homo sapiens
  Light chain CDR3 for antibody 3040 (IGKV1-27)
QKYNSAPYT

SEQ ID NO: 6080 - protein, 7 aa, Homo sapiens
  Heavy chain CDR3 for antibody 3040 (IGHV3-33)
ARELFDY

SEQ ID NO: 6081 - protein, 9 aa, Homo sapiens
  Light chain CDR3 for antibody 3041 (IGKV3-15)
QQYNNWPRT

SEQ ID NO: 6082 - protein, 14 aa, Homo sapiens
  Heavy chain CDR3 for antibody 3041 (IGHV3-33)
ARDWNDVYYYGMDV

SEQ ID NO: 6083 - protein, 9 aa, Homo sapiens
  Light chain CDR3 for antibody 3042 (IGKV6-21)
HQSSSLPYT

SEQ ID NO: 6084 - protein, 18 aa, Homo sapiens
  Heavy chain CDR3 for antibody 3042 (IGHV3-33)
VRDRERYGSGSYPDAFDI

SEQ ID NO: 6085 - protein, 8 aa, Homo sapiens
  Light chain CDR3 for antibody 3043 (IGKV1D-13)
QQFNNYPT

SEQ ID NO: 6086 - protein, 13 aa, Homo sapiens
  Heavy chain CDR3 for antibody 3043 (IGHV3-33)
ARAFTMVRGVIDY

SEQ ID NO: 6087 - protein, 8 aa, Homo sapiens
  Light chain CDR3 for antibody 3044 (IGKV1-5)
QQYNSYWT

SEQ ID NO: 6088 - protein, 18 aa, Homo sapiens
  Heavy chain CDR3 for antibody 3044 (IGHV3-33)
ARREGIVGATTYYYGMDV

SEQ ID NO: 6089 - protein, 9 aa, Homo sapiens
  Light chain CDR3 for antibody 3045 (IGKV5-2)
LQHDNFPWT

SEQ ID NO: 6090 - protein, 15 aa, Homo sapiens
  Heavy chain CDR3 for antibody 3045 (IGHV1-18)
ARRSPNWGHYYGMDV

SEQ ID NO: 6091 - protein, 9 aa, Homo sapiens
  Light chain CDR3 for antibody 3046 (IGKV3D-7)
QQDYNLPLT

SEQ ID NO: 6092 - protein, 14 aa, Homo sapiens
  Heavy chain CDR3 for antibody 3046 (IGHV3-33)
ARTTAAAGPRDFQH

SEQ ID NO: 6093 - protein, 9 aa, Homo sapiens
  Light chain CDR3 for antibody 3047 (IGKV6-21)
HQSSSLPYT

SEQ ID NO: 6094 - protein, 12 aa, Homo sapiens
  Heavy chain CDR3 for antibody 3047 (IGHV3-33)
AREGTGGNWFDP

SEQ ID NO: 6095 - protein, 9 aa, Homo sapiens
  Light chain CDR3 for antibody 3048 (IGKV3-15)
QQYNNWPLT

SEQ ID NO: 6096 - protein, 9 aa, Homo sapiens
  Heavy chain CDR3 for antibody 3048 (IGHV4-59)
AGGSWDFDY

SEQ ID NO: 6097 - protein, 9 aa, Homo sapiens
  Light chain CDR3 for antibody 3049 (IGKV3D-7)
QQDYNLPLT

SEQ ID NO: 6098 - protein, 12 aa, Homo sapiens
  Heavy chain CDR3 for antibody 3049 (IGHV1-46)
AREDYDIDGMDV

SEQ ID NO: 6099 - protein, 9 aa, Homo sapiens
  Light chain CDR3 for antibody 3050 (IGKV1-6)
LQDYNYPRT

SEQ ID NO: 6100 - protein, 17 aa, Homo sapiens
  Heavy chain CDR3 for antibody 3050 (IGHV4-34)
ARDGSGSYTHYYYGMDV

SEQ ID NO: 6101 - protein, 9 aa, Homo sapiens
  Light chain CDR3 for antibody 3051 (IGKV3D-7)
QQDYNLPWT

SEQ ID NO: 6102 - protein, 14 aa, Homo sapiens
  Heavy chain CDR3 for antibody 3051 (IGHV3-33)
ARDWNDVYYYGMDV

SEQ ID NO: 6103 - protein, 9 aa, Homo sapiens
  Light chain CDR3 for antibody 3052 (IGKV5-2)
LQHDNFPYT

SEQ ID NO: 6104 - protein, 17 aa, Homo sapiens
  Heavy chain CDR3 for antibody 3052 (IGHV3-33)
ARGGGYENDHYYYGMDV

SEQ ID NO: 6105 - protein, 9 aa, Homo sapiens
  Light chain CDR3 for antibody 3053 (IGKV1-27)
QKYNSAPYT

SEQ ID NO: 6106 - protein, 19 aa, Homo sapiens
  Heavy chain CDR3 for antibody 3053 (IGHV3-30)
ARRFSGYSGYDHYYYGMDV

SEQ ID NO: 6107 - protein, 9 aa, Homo sapiens
  Light chain CDR3 for antibody 3054 (IGKV1-27)
QKYNSAPYT

SEQ ID NO: 6108 - protein, 16 aa, Homo sapiens
  Heavy chain CDR3 for antibody 3054 (IGHV3-33)
ARDGSMVRRIHDAFDF

SEQ ID NO: 6109 - protein, 9 aa, Homo sapiens
  Light chain CDR3 for antibody 3055 (IGKV1-16)
QQYNSYPYT

SEQ ID NO: 6110 - protein, 12 aa, Homo sapiens
  Heavy chain CDR3 for antibody 3055 (IGHV1-46)
ARGLTGDHAFDI

SEQ ID NO: 6111 - protein, 9 aa, Homo sapiens
  Light chain CDR3 for antibody 3056 (IGKV1-6)
LQDYNYPYT

SEQ ID NO: 6112 - protein, 14 aa, Homo sapiens
  Heavy chain CDR3 for antibody 3056 (IGHV1-24)
ATWLPLYYYYGMDV

SEQ ID NO: 6113 - protein, 9 aa, Homo sapiens
  Light chain CDR3 for antibody 3057 (IGKV1-5)
LQYDSYPWT

SEQ ID NO: 6114 - protein, 10 aa, Homo sapiens
  Heavy chain CDR3 for antibody 3057 (IGHV3-72)
CRDREGFGDV

SEQ ID NO: 6115 - protein, 9 aa, Homo sapiens
  Light chain CDR3 for antibody 3058 (IGKV6-21)
HQSSSLPFT

SEQ ID NO: 6116 - protein, 14 aa, Homo sapiens
  Heavy chain CDR3 for antibody 3058 (IGHV3-23)
AKGGDILTGYYTDY

SEQ ID NO: 6117 - protein, 9 aa, Homo sapiens
  Light chain CDR3 for antibody 3059 (IGKV6-21)
HQSSSLPYT

SEQ ID NO: 6118 - protein, 17 aa, Homo sapiens
  Heavy chain CDR3 for antibody 3059 (IGHV4-59)
ARRITMVREIIITAFDY

SEQ ID NO: 6119 - protein, 9 aa, Homo sapiens
  Light chain CDR3 for antibody 3060 (IGKV1-17)
LQHNSYPYT

SEQ ID NO: 6120 - protein, 9 aa, Homo sapiens
  Heavy chain CDR3 for antibody 3060 (IGHV3-33)
AANSYGLDY

SEQ ID NO: 6121 - protein, 9 aa, Homo sapiens
  Light chain CDR3 for antibody 3061 (IGKV3D-7)
QQDYTLPLT

SEQ ID NO: 6122 - protein, 14 aa, Homo sapiens
  Heavy chain CDR3 for antibody 3061 (IGHV4-39)
ARDSGYDYYYGMDV

SEQ ID NO: 6123 - protein, 9 aa, Homo sapiens
  Light chain CDR3 for antibody 3062 (IGKV6-21)
HQSSSLPYT

SEQ ID NO: 6124 - protein, 15 aa, Homo sapiens
  Heavy chain CDR3 for antibody 3062 (IGHV3-33)
ARAYDLPHYYYGMDV

SEQ ID NO: 6125 - protein, 9 aa, Homo sapiens
  Light chain CDR3 for antibody 3063 (IGKV3-20)
QQYGSSPYT

SEQ ID NO: 6126 - protein, 10 aa, Homo sapiens
  Heavy chain CDR3 for antibody 3063 (IGHV4-59)
ARQLGNWFDP

SEQ ID NO: 6127 - protein, 8 aa, Homo sapiens
  Light chain CDR3 for antibody 3064 (IGKV1-5)
QQYNSYWT

SEQ ID NO: 6128 - protein, 12 aa, Homo sapiens
  Heavy chain CDR3 for antibody 3064 (IGHV3-33)
ARDPGYYYGLDV

SEQ ID NO: 6129 - protein, 9 aa, Homo sapiens
  Light chain CDR3 for antibody 3065 (IGKV1D-13)
QQFNNYPHT

SEQ ID NO: 6130 - protein, 19 aa, Homo sapiens
  Heavy chain CDR3 for antibody 3065 (IGHV3-33)
ARGVRLRYFDPYYYYGMDV

SEQ ID NO: 6131 - protein, 9 aa, Homo sapiens
  Light chain CDR3 for antibody 3066 (IGKV5-2)
LQHDNFPYT

SEQ ID NO: 6132 - protein, 20 aa, Homo sapiens
  Heavy chain CDR3 for antibody 3066 (IGHV3-33)
ARDWMVRGVIITDYYYGMDV

SEQ ID NO: 6133 - protein, 9 aa, Homo sapiens
  Light chain CDR3 for antibody 3067 (IGKV6-21)
HQSSSLPYT

SEQ ID NO: 6134 - protein, 17 aa, Homo sapiens
  Heavy chain CDR3 for antibody 3067 (IGHV4-59)
AREGADSGIYYHWYFDL

SEQ ID NO: 6135 - protein, 8 aa, Homo sapiens
  Light chain CDR3 for antibody 3068 (IGKV1D-13)
QQFNNYPT

SEQ ID NO: 6136 - protein, 18 aa, Homo sapiens
  Heavy chain CDR3 for antibody 3068 (IGHV4-59)
AREGHYYTSGSYYKAFDY

SEQ ID NO: 6137 - protein, 9 aa, Homo sapiens
  Light chain CDR3 for antibody 3069 (IGKV1-6)
LQDYNYPYT

SEQ ID NO: 6138 - protein, 22 aa, Homo sapiens
  Heavy chain CDR3 for antibody 3069 (IGHV3-11)
AREAYYDILTGYYTGYYYGMDV

SEQ ID NO: 6139 - protein, 9 aa, Homo sapiens
  Light chain CDR3 for antibody 3070 (IGKV1-9)
QQLNSYPLT

SEQ ID NO: 6140 - protein, 20 aa, Homo sapiens
  Heavy chain CDR3 for antibody 3070 (IGHV4-59)
ARDRGYDILTGYYGYYGMDV

SEQ ID NO: 6141 - protein, 10 aa, Homo sapiens
  Light chain CDR3 for antibody 3071 (IGKV1-39)
QQSYSAPLFT

SEQ ID NO: 6142 - protein, 10 aa, Homo sapiens
  Heavy chain CDR3 for antibody 3071 (IGHV3-21)
ARETWWRFDP

SEQ ID NO: 6143 - protein, 9 aa, Homo sapiens
  Light chain CDR3 for antibody 3072 (IGKV1-9)
QQYNSYPFT

SEQ ID NO: 6144 - protein, 13 aa, Homo sapiens
  Heavy chain CDR3 for antibody 3072 (IGHV4-39)
ARRDGGYYGYFDY

SEQ ID NO: 6145 - protein, 9 aa, Homo sapiens
  Light chain CDR3 for antibody 3073 (IGKV1-6)
LQDYKSPFT

SEQ ID NO: 6146 - protein, 13 aa, Homo sapiens
  Heavy chain CDR3 for antibody 3073 (IGHV3-33)
ARDYCGGDCYLDY

SEQ ID NO: 6147 - protein, 9 aa, Homo sapiens
  Light chain CDR3 for antibody 3074 (IGKV2-30)
MQGTHWPLT

SEQ ID NO: 6148 - protein, 13 aa, Homo sapiens
  Heavy chain CDR3 for antibody 3074 (IGHV3-23)
ASTGDSYYYGMDV

SEQ ID NO: 6149 - protein, 9 aa, Homo sapiens
  Light chain CDR3 for antibody 3075 (IGKV1-6)
LQDYNYPYT

SEQ ID NO: 6150 - protein, 12 aa, Homo sapiens
  Heavy chain CDR3 for antibody 3075 (IGHV3-33)
ARDGPVAGLFDY

SEQ ID NO: 6151 - protein, 8 aa, Homo sapiens
  Light chain CDR3 for antibody 3076 (IGKV1-5)
QQYNSYWT

SEQ ID NO: 6152 - protein, 15 aa, Homo sapiens
  Heavy chain CDR3 for antibody 3076 (IGHV3-33)
ARDTGYSSSWNWFDP

SEQ ID NO: 6153 - protein, 10 aa, Homo sapiens
  Light chain CDR3 for antibody 3077 (IGKV3-11)
QQRSNWPIFT

SEQ ID NO: 6154 - protein, 14 aa, Homo sapiens
  Heavy chain CDR3 for antibody 3077 (IGHV3-33)
ARDKSYPLSYGMDV

SEQ ID NO: 6155 - protein, 9 aa, Homo sapiens
  Light chain CDR3 for antibody 3078 (IGKV5-2)
LQHDNFPWT

SEQ ID NO: 6156 - protein, 17 aa, Homo sapiens
  Heavy chain CDR3 for antibody 3078 (IGHV3-33)
ARSPYDILTGYSYYFDY

SEQ ID NO: 6157 - protein, 9 aa, Homo sapiens
  Light chain CDR3 for antibody 3079 (IGKV1-6)
LQDYNYPRT

SEQ ID NO: 6158 - protein, 12 aa, Homo sapiens
  Heavy chain CDR3 for antibody 3079 (IGHV4-34)
ARGYSSSWYFDY

SEQ ID NO: 6159 - protein, 8 aa, Homo sapiens
  Light chain CDR3 for antibody 3080 (IGKV3D-7)
QQDYNLLT

SEQ ID NO: 6160 - protein, 14 aa, Homo sapiens
  Heavy chain CDR3 for antibody 3080 (IGHV3-33)
ARDRIAAASSDFDC

SEQ ID NO: 6161 - protein, 9 aa, Homo sapiens
  Light chain CDR3 for antibody 3081 (IGKV2-30)
MQGTHWPLT

SEQ ID NO: 6162 - protein, 15 aa, Homo sapiens
  Heavy chain CDR3 for antibody 3081 (IGHV3-23)
AKDGSYYDYYYGMDV

SEQ ID NO: 6163 - protein, 9 aa, Homo sapiens
  Light chain CDR3 for antibody 3082 (IGKV2-30)
MQGTHWPLT

SEQ ID NO: 6164 - protein, 8 aa, Homo sapiens
  Heavy chain CDR3 for antibody 3082 (IGHV3-23)
EKSAGEDV

SEQ ID NO: 6165 - protein, 9 aa, Homo sapiens
  Light chain CDR3 for antibody 3083 (IGKV3-11)
QQRSNWPYT

SEQ ID NO: 6166 - protein, 12 aa, Homo sapiens
  Heavy chain CDR3 for antibody 3083 (IGHV3-23)
AKDGWFGESLDY

SEQ ID NO: 6167 - protein, 9 aa, Homo sapiens
  Light chain CDR3 for antibody 3084 (IGKV1-17)
LQHNSYPYT

SEQ ID NO: 6168 - protein, 22 aa, Homo sapiens
  Heavy chain CDR3 for antibody 3084 (IGHV3-11)
AREAYYDILTGYYTGYYYGMDV

SEQ ID NO: 6169 - protein, 9 aa, Homo sapiens
  Light chain CDR3 for antibody 3085 (IGKV5-2)
LQHDNFPWT

SEQ ID NO: 6170 - protein, 18 aa, Homo sapiens
  Heavy chain CDR3 for antibody 3085 (IGHV3-33)
ARDQYSGYDFYYYYGMDV

SEQ ID NO: 6171 - protein, 9 aa, Homo sapiens
  Light chain CDR3 for antibody 3086 (IGKV6-21)
HQSSSLPYT

SEQ ID NO: 6172 - protein, 18 aa, Homo sapiens
  Heavy chain CDR3 for antibody 3086 (IGHV1-8)
ARSRIAAAGIYYYYGMDV

SEQ ID NO: 6173 - protein, 9 aa, Homo sapiens
  Light chain CDR3 for antibody 3087 (IGKV1-27)
QKYNSAPYT

SEQ ID NO: 6174 - protein, 19 aa, Homo sapiens
  Heavy chain CDR3 for antibody 3087 (IGHV3-33)
ARGVRLRYFDPYYYYGMDV

SEQ ID NO: 6175 - protein, 9 aa, Homo sapiens
  Light chain CDR3 for antibody 3088 (IGKV3D-7)
QQDYNLPLT

SEQ ID NO: 6176 - protein, 11 aa, Homo sapiens
  Heavy chain CDR3 for antibody 3088 (IGHV3-33)
ARDKSSGWSDY

SEQ ID NO: 6177 - protein, 9 aa, Homo sapiens
  Light chain CDR3 for antibody 3089 (IGKV1-17)
LQHNSYPYT

SEQ ID NO: 6178 - protein, 17 aa, Homo sapiens
  Heavy chain CDR3 for antibody 3089 (IGHV3-33)
AREGTMVRGYYYYGMDV

SEQ ID NO: 6179 - protein, 9 aa, Homo sapiens
  Light chain CDR3 for antibody 3090 (IGKV6-21)
HQSTSLPFT

SEQ ID NO: 6180 - protein, 13 aa, Homo sapiens
  Heavy chain CDR3 for antibody 3090 (IGHV4-61)
ASRYSSGWYPFDY

SEQ ID NO: 6181 - protein, 9 aa, Homo sapiens
  Light chain CDR3 for antibody 3091 (IGKV3-11)
QQRSNWPLT

SEQ ID NO: 6182 - protein, 18 aa, Homo sapiens
  Heavy chain CDR3 for antibody 3091 (IGHV1-8)
ARSRIAAAGIYYYYGMDV

SEQ ID NO: 6183 - protein, 9 aa, Homo sapiens
  Light chain CDR3 for antibody 3092 (IGKV2-30)
MQGTHWPLT

SEQ ID NO: 6184 - protein, 15 aa, Homo sapiens
  Heavy chain CDR3 for antibody 3092 (IGHV3-33)
ARDRGWKAPGYGMDV

SEQ ID NO: 6185 - protein, 9 aa, Homo sapiens
  Light chain CDR3 for antibody 3093 (IGKV1-39)
QQSYSTPLT

SEQ ID NO: 6186 - protein, 17 aa, Homo sapiens
  Heavy chain CDR3 for antibody 3093 (IGHV3-33)
ARGGAAAGPYLYYGLDV

SEQ ID NO: 6187 - protein, 9 aa, Homo sapiens
  Light chain CDR3 for antibody 3094 (IGKV1-16)
QHYNDYPFT

SEQ ID NO: 6188 - protein, 14 aa, Homo sapiens
  Heavy chain CDR3 for antibody 3094 (IGHV3-33)
ARGAAAGNFYGLDV

SEQ ID NO: 6189 - protein, 9 aa, Homo sapiens
  Light chain CDR3 for antibody 3095 (IGKV1-6)
LQDYKSPFT

SEQ ID NO: 6190 - protein, 13 aa, Homo sapiens
  Heavy chain CDR3 for antibody 3095 (IGHV3-23)
ASPFNWNDGFFDY

SEQ ID NO: 6191 - protein, 9 aa, Homo sapiens
  Light chain CDR3 for antibody 3096 (IGKV3D-20)
QQYGSSPYT

SEQ ID NO: 6192 - protein, 15 aa, Homo sapiens
  Heavy chain CDR3 for antibody 3096 (IGHV3-33)
ARAYDLPHYYYGMDV

SEQ ID NO: 6193 - protein, 9 aa, Homo sapiens
  Light chain CDR3 for antibody 3097 (IGKV2-30)
MQGTHWPLT

SEQ ID NO: 6194 - protein, 17 aa, Homo sapiens
  Heavy chain CDR3 for antibody 3097 (IGHV3-33)
ARGFSGYDGYYYYGMDV

SEQ ID NO: 6195 - protein, 9 aa, Homo sapiens
  Light chain CDR3 for antibody 3098 (IGKV3D-7)
QQDYNLPFT

SEQ ID NO: 6196 - protein, 18 aa, Homo sapiens
  Heavy chain CDR3 for antibody 3098 (IGHV3-33)
ARDHCSGGSCYYYYGMDV

SEQ ID NO: 6197 - protein, 9 aa, Homo sapiens
  Light chain CDR3 for antibody 3099 (IGKV3-11)
QQRSNWPYT

SEQ ID NO: 6198 - protein, 11 aa, Homo sapiens
  Heavy chain CDR3 for antibody 3099 (IGHV3-33)
ARARYTTGLDY

SEQ ID NO: 6199 - protein, 9 aa, Homo sapiens
  Light chain CDR3 for antibody 3100 (IGKV1-17)
LQHNSYPYT

SEQ ID NO: 6200 - protein, 14 aa, Homo sapiens
  Heavy chain CDR3 for antibody 3100 (IGHV3-33)
ARDAMGTSTAWFDP

SEQ ID NO: 6201 - protein, 9 aa, Homo sapiens
  Light chain CDR3 for antibody 3101 (IGKV6-21)
HQSSSLPYT

SEQ ID NO: 6202 - protein, 17 aa, Homo sapiens
  Heavy chain CDR3 for antibody 3101 (IGHV3-33)
ARSGIVGATDYYYGLDV

SEQ ID NO: 6203 - protein, 9 aa, Homo sapiens
  Light chain CDR3 for antibody 3102 (IGKV5-2)
LQHDNFPYT

SEQ ID NO: 6204 - protein, 15 aa, Homo sapiens
  Heavy chain CDR3 for antibody 3102 (IGHV3-33)
ARAYDLPHYYYGMDV

SEQ ID NO: 6205 - protein, 8 aa, Homo sapiens
  Light chain CDR3 for antibody 3103 (IGKV1D-13)
QQFNNYPT

SEQ ID NO: 6206 - protein, 17 aa, Homo sapiens
  Heavy chain CDR3 for antibody 3103 (IGHV1-18)
ARDRAFTMVRGVPPFDY

SEQ ID NO: 6207 - protein, 9 aa, Homo sapiens
  Light chain CDR3 for antibody 3104 (IGKV1-39)
QQSYRTPLT

SEQ ID NO: 6208 - protein, 19 aa, Homo sapiens
  Heavy chain CDR3 for antibody 3104 (IGHV3-33)
ARDSGYSGYDYYYYYGMDV

SEQ ID NO: 6209 - protein, 9 aa, Homo sapiens
  Light chain CDR3 for antibody 3105 (IGKV3-15)
QQYNNWPLT

SEQ ID NO: 6210 - protein, 12 aa, Homo sapiens
  Heavy chain CDR3 for antibody 3105 (IGHV4-39)
ARQMVREGWFDP

SEQ ID NO: 6211 - protein, 9 aa, Homo sapiens
  Light chain CDR3 for antibody 3106 (IGKV1-39)
QQSYSTPFT

SEQ ID NO: 6212 - protein, 14 aa, Homo sapiens
  Heavy chain CDR3 for antibody 3106 (IGHV4-39)
ARRGVVVPPGGMDV

SEQ ID NO: 6213 - protein, 9 aa, Homo sapiens
  Light chain CDR3 for antibody 3107 (IGKV3D-7)
QQDYNLPLT

SEQ ID NO: 6214 - protein, 14 aa, Homo sapiens
  Heavy chain CDR3 for antibody 3107 (IGHV3-33)
ARDNILTAYYLFDY

SEQ ID NO: 6215 - protein, 9 aa, Homo sapiens
  Light chain CDR3 for antibody 3108 (IGKV1-9)
QQLNSYPYT

SEQ ID NO: 6216 - protein, 18 aa, Homo sapiens
  Heavy chain CDR3 for antibody 3108 (IGHV3-33)
ARERYYYGSGSYPDAFDI

SEQ ID NO: 6217 - protein, 9 aa, Homo sapiens
  Light chain CDR3 for antibody 3109 (IGKV3-11)
QQRSNWPWT

SEQ ID NO: 6218 - protein, 17 aa, Homo sapiens
  Heavy chain CDR3 for antibody 3109 (IGHV4-59)
ARDFLVRGEGSYYGMDV

SEQ ID NO: 6219 - protein, 9 aa, Homo sapiens
  Light chain CDR3 for antibody 3110 (IGKV5-2)
LQHDNFPWT

SEQ ID NO: 6220 - protein, 13 aa, Homo sapiens
  Heavy chain CDR3 for antibody 3110 (IGHV4-4)
ARERGIAAAGPDY

SEQ ID NO: 6221 - protein, 8 aa, Homo sapiens
  Light chain CDR3 for antibody 3111 (IGKV3D-7)
QQDYNLLT

SEQ ID NO: 6222 - protein, 12 aa, Homo sapiens
  Heavy chain CDR3 for antibody 3111 (IGHV1-46)
ARGLTGDHAVDI

SEQ ID NO: 6223 - protein, 9 aa, Homo sapiens
  Light chain CDR3 for antibody 3112 (IGKV5-2)
LQHDNFPWT

SEQ ID NO: 6224 - protein, 14 aa, Homo sapiens
  Heavy chain CDR3 for antibody 3112 (IGHV3-33)
AREDYYGPLNWFDP

SEQ ID NO: 6225 - protein, 8 aa, Homo sapiens
  Light chain CDR3 for antibody 3113 (IGKV3D-7)
QQDYNLLT

SEQ ID NO: 6226 - protein, 13 aa, Homo sapiens
  Heavy chain CDR3 for antibody 3113 (IGHV4-59)
ARTMVRGVAPFDY

SEQ ID NO: 6227 - protein, 9 aa, Homo sapiens
  Light chain CDR3 for antibody 3114 (IGKV1-17)
LQHNSYPYT

SEQ ID NO: 6228 - protein, 14 aa, Homo sapiens
  Heavy chain CDR3 for antibody 3114 (IGHV3-33)
AREEDYYYHYDMDV

SEQ ID NO: 6229 - protein, 9 aa, Homo sapiens
  Light chain CDR3 for antibody 3115 (IGKV6-21)
HQSTSLPFT

SEQ ID NO: 6230 - protein, 16 aa, Homo sapiens
  Heavy chain CDR3 for antibody 3115 (IGHV4-59)
ARGRYFDWLLGDVFDI

SEQ ID NO: 6231 - protein, 9 aa, Homo sapiens
  Light chain CDR3 for antibody 3116 (IGKV3-15)
QQYNNWPLT

SEQ ID NO: 6232 - protein, 13 aa, Homo sapiens
  Heavy chain CDR3 for antibody 3116 (IGHV4-59)
ARTMVRGVAPFDY

SEQ ID NO: 6233 - protein, 9 aa, Homo sapiens
  Light chain CDR3 for antibody 3117 (IGKV1D-13)
QQFNNYPYT

SEQ ID NO: 6234 - protein, 17 aa, Homo sapiens
  Heavy chain CDR3 for antibody 3117 (IGHV3-33)
ARQGVLLWFGELYYFDY

SEQ ID NO: 6235 - protein, 10 aa, Homo sapiens
  Light chain CDR3 for antibody 3118 (IGKV3-11)
QQRSNWPIFT

SEQ ID NO: 6236 - protein, 11 aa, Homo sapiens
  Heavy chain CDR3 for antibody 3118 (IGHV3-13)
AREAIIGPFDY

SEQ ID NO: 6237 - protein, 8 aa, Homo sapiens
  Light chain CDR3 for antibody 3119 (IGKV3-20)
QQYGRSFT

SEQ ID NO: 6238 - protein, 17 aa, Homo sapiens
  Heavy chain CDR3 for antibody 3119 (IGHV4-59)
ARDFLVRGEGSYYGMDV

SEQ ID NO: 6239 - protein, 9 aa, Homo sapiens
  Light chain CDR3 for antibody 3120 (IGKV2-30)
MQGTHWPLT

SEQ ID NO: 6240 - protein, 9 aa, Homo sapiens
  Heavy chain CDR3 for antibody 3120 (IGHV3-30)
ARDNWGFDY

SEQ ID NO: 6241 - protein, 9 aa, Homo sapiens
  Light chain CDR3 for antibody 3121 (IGKV1-6)
LQDFHYPWT

SEQ ID NO: 6242 - protein, 13 aa, Homo sapiens
  Heavy chain CDR3 for antibody 3121 (IGHV4-59)
ARDAGYSSSWFDY

SEQ ID NO: 6243 - protein, 9 aa, Homo sapiens
  Light chain CDR3 for antibody 3122 (IGKV1-39)
QQSYSTPLT

SEQ ID NO: 6244 - protein, 16 aa, Homo sapiens
  Heavy chain CDR3 for antibody 3122 (IGHV3-33)
ARDNFGSGSYYSHFHY

SEQ ID NO: 6245 - protein, 9 aa, Homo sapiens
  Light chain CDR3 for antibody 3123 (IGKV1D-13)
QQFNNYPHT

SEQ ID NO: 6246 - protein, 11 aa, Homo sapiens
  Heavy chain CDR3 for antibody 3123 (IGHV3-33)
AREGAVARFDY

SEQ ID NO: 6247 - protein, 8 aa, Homo sapiens
  Light chain CDR3 for antibody 3124 (IGKV1D-13)
QQFNNYPT

SEQ ID NO: 6248 - protein, 15 aa, Homo sapiens
  Heavy chain CDR3 for antibody 3124 (IGHV3-33)
ARDTGYSSSWNWFDP

SEQ ID NO: 6249 - protein, 10 aa, Homo sapiens
  Light chain CDR3 for antibody 3125 (IGKV1-39)
QQSYSTPMYT

SEQ ID NO: 6250 - protein, 13 aa, Homo sapiens
  Heavy chain CDR3 for antibody 3125 (IGHV3-33)
ARDQRYSSGWYDY

SEQ ID NO: 6251 - protein, 9 aa, Homo sapiens
  Light chain CDR3 for antibody 3126 (IGKV1-39)
QQSYSTPLT

SEQ ID NO: 6252 - protein, 18 aa, Homo sapiens
  Heavy chain CDR3 for antibody 3126 (IGHV3-13)
ARDYYGSGSLYYYYGMDV

SEQ ID NO: 6253 - protein, 9 aa, Homo sapiens
  Light chain CDR3 for antibody 3127 (IGKV2-30)
MQGTHWPLT

SEQ ID NO: 6254 - protein, 17 aa, Homo sapiens
  Heavy chain CDR3 for antibody 3127 (IGHV3-33)
ARGEQWLGYYYYYGMDV

SEQ ID NO: 6255 - protein, 9 aa, Homo sapiens
  Light chain CDR3 for antibody 3128 (IGKV1-39)
QQSYSTPLT

SEQ ID NO: 6256 - protein, 17 aa, Homo sapiens
  Heavy chain CDR3 for antibody 3128 (IGHV3-33)
ARDLIGPLSSSWYPFDY

SEQ ID NO: 6257 - protein, 9 aa, Homo sapiens
  Light chain CDR3 for antibody 3129 (IGKV1-39)
QQSYSTPFT

SEQ ID NO: 6258 - protein, 12 aa, Homo sapiens
  Heavy chain CDR3 for antibody 3129 (IGHV4-59)
ARDSGSYYFFDY

SEQ ID NO: 6259 - protein, 8 aa, Homo sapiens
  Light chain CDR3 for antibody 3130 (IGKV1-5)
QQYNSYWT

SEQ ID NO: 6260 - protein, 18 aa, Homo sapiens
  Heavy chain CDR3 for antibody 3130 (IGHV1-46)
ARDGDYVWGSYRSNWFDP

SEQ ID NO: 6261 - protein, 9 aa, Homo sapiens
  Light chain CDR3 for antibody 3131 (IGKV3-15)
QQYNNWPLT

SEQ ID NO: 6262 - protein, 18 aa, Homo sapiens
  Heavy chain CDR3 for antibody 3131 (IGHV4-39)
ARQYYFGSGNYYRGWFDP

SEQ ID NO: 6263 - protein, 9 aa, Homo sapiens
  Light chain CDR3 for antibody 3132 (IGKV3D-20)
QQYGSSPYT

SEQ ID NO: 6264 - protein, 11 aa, Homo sapiens
  Heavy chain CDR3 for antibody 3132 (IGHV3-23)
AKKVYDYGSDY

SEQ ID NO: 6265 - protein, 9 aa, Homo sapiens
  Light chain CDR3 for antibody 3133 (IGKV1-9)
QQLNGYPFT

SEQ ID NO: 6266 - protein, 16 aa, Homo sapiens
  Heavy chain CDR3 for antibody 3133 (IGHV4-59)
ARGRYFEWLLGDVFDI

SEQ ID NO: 6267 - protein, 9 aa, Homo sapiens
  Light chain CDR3 for antibody 3134 (IGKV1-17)
LQHNSYPYT

SEQ ID NO: 6268 - protein, 10 aa, Homo sapiens
  Heavy chain CDR3 for antibody 3134 (IGHV3-33)
ARKGMNAFDI

SEQ ID NO: 6269 - protein, 8 aa, Homo sapiens
  Light chain CDR3 for antibody 3135 (IGKV3D-7)
QQDYNLLT

SEQ ID NO: 6270 - protein, 15 aa, Homo sapiens
  Heavy chain CDR3 for antibody 3135 (IGHV3-33)
ARDSRPEIIGPPFDY

SEQ ID NO: 6271 - protein, 9 aa, Homo sapiens
  Light chain CDR3 for antibody 3136 (IGKV6-21)
HQSSSLPYT

SEQ ID NO: 6272 - protein, 24 aa, Homo sapiens
  Heavy chain CDR3 for antibody 3136 (IGHV1-46)
ARDEARGLLTGYYNMREYYYGMDV

SEQ ID NO: 6273 - protein, 10 aa, Homo sapiens
  Light chain CDR3 for antibody 3137 (IGKV3-11)
QQRSNWPIFT

SEQ ID NO: 6274 - protein, 15 aa, Homo sapiens
  Heavy chain CDR3 for antibody 3137 (IGHV3-33)
ARDTGYSSSWNWFDP

SEQ ID NO: 6275 - protein, 9 aa, Homo sapiens
  Light chain CDR3 for antibody 3138 (IGKV1-27)
QKYNSAPYT

SEQ ID NO: 6276 - protein, 12 aa, Homo sapiens
  Heavy chain CDR3 for antibody 3138 (IGHV4-59)
ARDRSGWAYFDY

SEQ ID NO: 6277 - protein, 9 aa, Homo sapiens
  Light chain CDR3 for antibody 3139 (IGKV1-17)
LQHNSYPYT

SEQ ID NO: 6278 - protein, 13 aa, Homo sapiens
  Heavy chain CDR3 for antibody 3139 (IGHV3-33)
ARDYGDYLNWFDP

SEQ ID NO: 6279 - protein, 9 aa, Homo sapiens
  Light chain CDR3 for antibody 3140 (IGKV5-2)
LQHDNFPYT

SEQ ID NO: 6280 - protein, 14 aa, Homo sapiens
  Heavy chain CDR3 for antibody 3140 (IGHV3-33)
ARSTLVRGANWFDP

SEQ ID NO: 6281 - protein, 9 aa, Homo sapiens
  Light chain CDR3 for antibody 3141 (IGKV1-39)
QQSYSTPLT

SEQ ID NO: 6282 - protein, 9 aa, Homo sapiens
  Heavy chain CDR3 for antibody 3141 (IGHV3-20)
AREYKEFDY

SEQ ID NO: 6283 - protein, 9 aa, Homo sapiens
  Light chain CDR3 for antibody 3142 (IGKV1-27)
QKYNSAPYT

SEQ ID NO: 6284 - protein, 19 aa, Homo sapiens
  Heavy chain CDR3 for antibody 3142 (IGHV1-18)
ARDDILTGYSLYYYYGMDV

SEQ ID NO: 6285 - protein, 9 aa, Homo sapiens
  Light chain CDR3 for antibody 3143 (IGKV1-6)
LQDYNYPYT

SEQ ID NO: 6286 - protein, 12 aa, Homo sapiens
  Heavy chain CDR3 for antibody 3143 (IGHV3-11)
ARVLLWFGETDY

SEQ ID NO: 6287 - protein, 9 aa, Homo sapiens
  Light chain CDR3 for antibody 3144 (IGKV3-11)
QQRSNWPPT

SEQ ID NO: 6288 - protein, 15 aa, Homo sapiens
  Heavy chain CDR3 for antibody 3144 (IGHV3-33)
ARDRGWKAPGYGMDV

SEQ ID NO: 6289 - protein, 9 aa, Homo sapiens
  Light chain CDR3 for antibody 3145 (IGKV1-6)
LQDFHYPWT

SEQ ID NO: 6290 - protein, 13 aa, Homo sapiens
  Heavy chain CDR3 for antibody 3145 (IGHV3-33)
ARDYCGGDCYLDY

SEQ ID NO: 6291 - protein, 8 aa, Homo sapiens
  Light chain CDR3 for antibody 3146 (IGKV1D-13)
QQFNNYPT

SEQ ID NO: 6292 - protein, 13 aa, Homo sapiens
  Heavy chain CDR3 for antibody 3146 (IGHV3-33)
ASTGDSYYYGMDV

SEQ ID NO: 6293 - protein, 9 aa, Homo sapiens
  Light chain CDR3 for antibody 3147 (IGKV5-2)
LQHDNFPYT

SEQ ID NO: 6294 - protein, 22 aa, Homo sapiens
  Heavy chain CDR3 for antibody 3147 (IGHV3-23)
AKDDLPYYDILTHSTTTGGMDV

SEQ ID NO: 6295 - protein, 9 aa, Homo sapiens
  Light chain CDR3 for antibody 3148 (IGKV1-27)
QKYNSAPYT

SEQ ID NO: 6296 - protein, 18 aa, Homo sapiens
  Heavy chain CDR3 for antibody 3148 (IGHV3-33)
VRDRERYGSGSYPDAFDI

SEQ ID NO: 6297 - protein, 9 aa, Homo sapiens
  Light chain CDR3 for antibody 3149 (IGKV1-27)
QKYNSAPYT

SEQ ID NO: 6298 - protein, 13 aa, Homo sapiens
  Heavy chain CDR3 for antibody 3149 (IGHV4-39)
ARHEVMVRGVFDY

SEQ ID NO: 6299 - protein, 9 aa, Homo sapiens
  Light chain CDR3 for antibody 3150 (IGKV6-21)
HQSSSLPYT

SEQ ID NO: 6300 - protein, 14 aa, Homo sapiens
  Heavy chain CDR3 for antibody 3150 (IGHV3-33)
ARDAYDILTGYYDY

SEQ ID NO: 6301 - protein, 9 aa, Homo sapiens
  Light chain CDR3 for antibody 3151 (IGKV1-6)
LQDYNYPWT

SEQ ID NO: 6302 - protein, 9 aa, Homo sapiens
  Heavy chain CDR3 for antibody 3151 (IGHV4-59)
ARSGSGIYT

SEQ ID NO: 6303 - protein, 9 aa, Homo sapiens
  Light chain CDR3 for antibody 3152 (IGKV5-2)
LQHDNFPYT

SEQ ID NO: 6304 - protein, 13 aa, Homo sapiens
  Heavy chain CDR3 for antibody 3152 (IGHV3-66)
ANTGDSYYYGFYV

SEQ ID NO: 6305 - protein, 9 aa, Homo sapiens
  Light chain CDR3 for antibody 3153 (IGKV1-9)
QQLNSYPLT

SEQ ID NO: 6306 - protein, 20 aa, Homo sapiens
  Heavy chain CDR3 for antibody 3153 (IGHV1-8)
ARGDGTMVRGIYYYYYGMDV

SEQ ID NO: 6307 - protein, 9 aa, Homo sapiens
  Light chain CDR3 for antibody 3154 (IGKV3-20)
QQYGRSPRT

SEQ ID NO: 6308 - protein, 18 aa, Homo sapiens
  Heavy chain CDR3 for antibody 3154 (IGHV1-46)
ARDGDYVWGSYRSNWFDP

SEQ ID NO: 6309 - protein, 8 aa, Homo sapiens
  Light chain CDR3 for antibody 3155 (IGKV1-5)
QQYNSYYT

SEQ ID NO: 6310 - protein, 11 aa, Homo sapiens
  Heavy chain CDR3 for antibody 3155 (IGHV4-59)
AREMGHDTFDI

SEQ ID NO: 6311 - protein, 9 aa, Homo sapiens
  Light chain CDR3 for antibody 3156 (IGKV2-30)
MQGTHWPLT

SEQ ID NO: 6312 - protein, 15 aa, Homo sapiens
  Heavy chain CDR3 for antibody 3156 (IGHV3-33)
ARDSRPEIIGPPFDY

SEQ ID NO: 6313 - protein, 8 aa, Homo sapiens
  Light chain CDR3 for antibody 3157 (IGKV1-5)
QQYNSYWT

SEQ ID NO: 6314 - protein, 14 aa, Homo sapiens
  Heavy chain CDR3 for antibody 3157 (IGHV3-33)
AREGYSSNWYDFDY

SEQ ID NO: 6315 - protein, 9 aa, Homo sapiens
  Light chain CDR3 for antibody 3158 (IGKV1-39)
QQSYSTPLT

SEQ ID NO: 6316 - protein, 18 aa, Homo sapiens
  Heavy chain CDR3 for antibody 3158 (IGHV4-59)
ARERGNWNDVDYYYGMDV

SEQ ID NO: 6317 - protein, 9 aa, Homo sapiens
  Light chain CDR3 for antibody 3159 (IGKV3D-20)
QQYGSSPYT

SEQ ID NO: 6318 - protein, 18 aa, Homo sapiens
  Heavy chain CDR3 for antibody 3159 (IGHV3-53)
AKAGDYYVSGSYWGYFDL

SEQ ID NO: 6319 - protein, 9 aa, Homo sapiens
  Light chain CDR3 for antibody 3160 (IGKV1D-16)
QQYNSFPLT

SEQ ID NO: 6320 - protein, 13 aa, Homo sapiens
  Heavy chain CDR3 for antibody 3160 (IGHV4-39)
ARHPPSRDYGMDV

SEQ ID NO: 6321 - protein, 9 aa, Homo sapiens
  Light chain CDR3 for antibody 3161 (IGKV1D-16)
QQYNSYPLT

SEQ ID NO: 6322 - protein, 16 aa, Homo sapiens
  Heavy chain CDR3 for antibody 3161 (IGHV3-33)
AREGGLIAAAGTGFDY

SEQ ID NO: 6323 - protein, 9 aa, Homo sapiens
  Light chain CDR3 for antibody 3162 (IGKV4-1)
QQYYTTPPT

SEQ ID NO: 6324 - protein, 16 aa, Homo sapiens
  Heavy chain CDR3 for antibody 3162 (IGHV3-23)
AKEGMVLRYFDWLWDY

SEQ ID NO: 6325 - protein, 9 aa, Homo sapiens
  Light chain CDR3 for antibody 3163 (IGKV1-6)
LQDFHYPWT

SEQ ID NO: 6326 - protein, 11 aa, Homo sapiens
  Heavy chain CDR3 for antibody 3163 (IGHV3-33)
ARDRSSGPFDY

SEQ ID NO: 6327 - protein, 9 aa, Homo sapiens
  Light chain CDR3 for antibody 3164 (IGKV3D-7)
QQDYNLPLT

SEQ ID NO: 6328 - protein, 13 aa, Homo sapiens
  Heavy chain CDR3 for antibody 3164 (IGHV3-33)
ARRYRSGWYPFDY

SEQ ID NO: 6329 - protein, 9 aa, Homo sapiens
  Light chain CDR3 for antibody 3165 (IGKV1-17)
LQHNSYPWT

SEQ ID NO: 6330 - protein, 24 aa, Homo sapiens
  Heavy chain CDR3 for antibody 3165 (IGHV1-46)
ARDEARGLLTGYYNMREYYYGMDV

SEQ ID NO: 6331 - protein, 8 aa, Homo sapiens
  Light chain CDR3 for antibody 3166 (IGKV3D-7)
QQDYNLLT

SEQ ID NO: 6332 - protein, 10 aa, Homo sapiens
  Heavy chain CDR3 for antibody 3166 (IGHV3-23)
AKEQWLVLDY

SEQ ID NO: 6333 - protein, 9 aa, Homo sapiens
  Light chain CDR3 for antibody 3167 (IGKV3D-7)
QQDYNLPLT

SEQ ID NO: 6334 - protein, 16 aa, Homo sapiens
  Heavy chain CDR3 for antibody 3167 (IGHV4-59)
ARYSGSYYGDYYGMDV

SEQ ID NO: 6335 - protein, 9 aa, Homo sapiens
  Light chain CDR3 for antibody 3168 (IGKV5-2)
LQHDNFPYT

SEQ ID NO: 6336 - protein, 14 aa, Homo sapiens
  Heavy chain CDR3 for antibody 3168 (IGHV3-33)
AREGYSSGWDYFDH

SEQ ID NO: 6337 - protein, 9 aa, Homo sapiens
  Light chain CDR3 for antibody 3169 (IGKV3-20)
QQYGSSPRT

SEQ ID NO: 6338 - protein, 18 aa, Homo sapiens
  Heavy chain CDR3 for antibody 3169 (IGHV3-11)
ARDGYSSGWNYYYFGLDV

SEQ ID NO: 6339 - protein, 9 aa, Homo sapiens
  Light chain CDR3 for antibody 3170 (IGKV1-6)
LQDYNYPWT

SEQ ID NO: 6340 - protein, 10 aa, Homo sapiens
  Heavy chain CDR3 for antibody 3170 (IGHV3-33)
AREGLRYFDH

SEQ ID NO: 6341 - protein, 9 aa, Homo sapiens
  Light chain CDR3 for antibody 3171 (IGKV3D-7)
QQDYNLPLT

SEQ ID NO: 6342 - protein, 9 aa, Homo sapiens
  Heavy chain CDR3 for antibody 3171 (IGHV4-59)
AGGSWDFDY

SEQ ID NO: 6343 - protein, 9 aa, Homo sapiens
  Light chain CDR3 for antibody 3172 (IGKV1-27)
QKYNSAPYT

SEQ ID NO: 6344 - protein, 18 aa, Homo sapiens
  Heavy chain CDR3 for antibody 3172 (IGHV3-23)
AKEGNYYGSGSYWGYFDP

SEQ ID NO: 6345 - protein, 9 aa, Homo sapiens
  Light chain CDR3 for antibody 3173 (IGKV3-11)
QQRSNWPLT

SEQ ID NO: 6346 - protein, 17 aa, Homo sapiens
  Heavy chain CDR3 for antibody 3173 (IGHV3-23)
AKDGSFYSSGWYDAFDI

SEQ ID NO: 6347 - protein, 9 aa, Homo sapiens
  Light chain CDR3 for antibody 3174 (IGKV3D-7)
QQDYNLPLT

SEQ ID NO: 6348 - protein, 13 aa, Homo sapiens
  Heavy chain CDR3 for antibody 3174 (IGHV3-33)
ARIDYYSYYGMDV

SEQ ID NO: 6349 - protein, 9 aa, Homo sapiens
  Light chain CDR3 for antibody 3175 (IGKV3-20)
QQYGSSPYT

SEQ ID NO: 6350 - protein, 8 aa, Homo sapiens
  Heavy chain CDR3 for antibody 3175 (IGHV3-20)
APHWIFDY

SEQ ID NO: 6351 - protein, 9 aa, Homo sapiens
  Light chain CDR3 for antibody 3176 (IGKV1-39)
QQSYSTPLT

SEQ ID NO: 6352 - protein, 14 aa, Homo sapiens
  Heavy chain CDR3 for antibody 3176 (IGHV1-18)
ARCFGSGSYGWFDP

SEQ ID NO: 6353 - protein, 8 aa, Homo sapiens
  Light chain CDR3 for antibody 3177 (IGKV1D-13)
QQFNNYPT

SEQ ID NO: 6354 - protein, 17 aa, Homo sapiens
  Heavy chain CDR3 for antibody 3177 (IGHV3-33)
ARGFSGYDGYYYYGMDV

SEQ ID NO: 6355 - protein, 10 aa, Homo sapiens
  Light chain CDR3 for antibody 3178 (IGKV1-9)
QQLNSFLMYT

SEQ ID NO: 6356 - protein, 13 aa, Homo sapiens
  Heavy chain CDR3 for antibody 3178 (IGHV4-59)
ARDAGYSSSWFDY

SEQ ID NO: 6357 - protein, 9 aa, Homo sapiens
  Light chain CDR3 for antibody 3179 (IGKV1-9)
QQLNSYPLT

SEQ ID NO: 6358 - protein, 12 aa, Homo sapiens
  Heavy chain CDR3 for antibody 3179 (IGHV1-18)
ARVLFDGDYFDY

SEQ ID NO: 6359 - protein, 8 aa, Homo sapiens
  Light chain CDR3 for antibody 3180 (IGKV3D-7)
QQDYNLLT

SEQ ID NO: 6360 - protein, 13 aa, Homo sapiens
  Heavy chain CDR3 for antibody 3180 (IGHV3-33)
ARRATLVRGVFDP

SEQ ID NO: 6361 - protein, 9 aa, Homo sapiens
  Light chain CDR3 for antibody 3181 (IGKV2-30)
MQGTHWPLT

SEQ ID NO: 6362 - protein, 17 aa, Homo sapiens
  Heavy chain CDR3 for antibody 3181 (IGHV1-18)
ARDRAFTMVRGVPPFDY

SEQ ID NO: 6363 - protein, 9 aa, Homo sapiens
  Light chain CDR3 for antibody 3182 (IGKV1-17)
LQHNSYPYT

SEQ ID NO: 6364 - protein, 17 aa, Homo sapiens
  Heavy chain CDR3 for antibody 3182 (IGHV3-33)
ARGYSGYVGYYYYGMDV

SEQ ID NO: 6365 - protein, 11 aa, Homo sapiens
  Light chain CDR3 for antibody 3183 (IGKV3-11)
QQRSNWPPTWT

SEQ ID NO: 6366 - protein, 12 aa, Homo sapiens
  Heavy chain CDR3 for antibody 3183 (IGHV4-59)
ARDRSGWAYFDY

SEQ ID NO: 6367 - protein, 8 aa, Homo sapiens
  Light chain CDR3 for antibody 3184 (IGKV3D-7)
QQDYNLVT

SEQ ID NO: 6368 - protein, 13 aa, Homo sapiens
  Heavy chain CDR3 for antibody 3184 (IGHV4-39)
ARREVVGGRGFDY

SEQ ID NO: 6369 - protein, 9 aa, Homo sapiens
  Light chain CDR3 for antibody 3185 (IGKV1-17)
QQHNSYPYT

SEQ ID NO: 6370 - protein, 9 aa, Homo sapiens
  Heavy chain CDR3 for antibody 3185 (IGHV3-33)
ARGSGWSDY

SEQ ID NO: 6371 - protein, 9 aa, Homo sapiens
  Light chain CDR3 for antibody 3186 (IGKV5-2)
LQHDNFPYT

SEQ ID NO: 6372 - protein, 23 aa, Homo sapiens
  Heavy chain CDR3 for antibody 3186 (IGHV1-18)
ARNLHYDILTGYFPYYFYYGMDV

SEQ ID NO: 6373 - protein, 9 aa, Homo sapiens
  Light chain CDR3 for antibody 3187 (IGKV1-9)
QQLNGYPFT

SEQ ID NO: 6374 - protein, 13 aa, Homo sapiens
  Heavy chain CDR3 for antibody 3187 (IGHV4-39)
ARQWPSGYWYFDL

SEQ ID NO: 6375 - protein, 9 aa, Homo sapiens
  Light chain CDR3 for antibody 3188 (IGKV1-39)
QQYNSYPLT

SEQ ID NO: 6376 - protein, 15 aa, Homo sapiens
  Heavy chain CDR3 for antibody 3188 (IGHV3-23)
AKDGFYYGSGSSFDH

SEQ ID NO: 6377 - protein, 9 aa, Homo sapiens
  Light chain CDR3 for antibody 3189 (IGKV5-2)
LQHDNFPYT

SEQ ID NO: 6378 - protein, 11 aa, Homo sapiens
  Heavy chain CDR3 for antibody 3189 (IGHV3-23)
AKKVYDYGSDY

SEQ ID NO: 6379 - protein, 9 aa, Homo sapiens
  Light chain CDR3 for antibody 3190 (IGKV5-2)
LQHDNFPYT

SEQ ID NO: 6380 - protein, 17 aa, Homo sapiens
  Heavy chain CDR3 for antibody 3190 (IGHV3-23)
AKEGSSSSWYGGLYFDY

SEQ ID NO: 6381 - protein, 10 aa, Homo sapiens
  Light chain CDR3 for antibody 3191 (IGKV1-39)
QQSYSTPMYT

SEQ ID NO: 6382 - protein, 15 aa, Homo sapiens
  Heavy chain CDR3 for antibody 3191 (IGHV3-33)
ARDHLTGYYYYGMDV

SEQ ID NO: 6383 - protein, 9 aa, Homo sapiens
  Light chain CDR3 for antibody 3192 (IGKV3D-7)
QQDYEFPLT

SEQ ID NO: 6384 - protein, 13 aa, Homo sapiens
  Heavy chain CDR3 for antibody 3192 (IGHV4-39)
ARHVLLWFGEFDP

SEQ ID NO: 6385 - protein, 9 aa, Homo sapiens
  Light chain CDR3 for antibody 3193 (IGKV1-6)
LQDYKSPFT

SEQ ID NO: 6386 - protein, 13 aa, Homo sapiens
  Heavy chain CDR3 for antibody 3193 (IGHV4-34)
ASNFYYYYYGMDV

SEQ ID NO: 6387 - protein, 9 aa, Homo sapiens
  Light chain CDR3 for antibody 3194 (IGKV1-39)
QQSYSTPLT

SEQ ID NO: 6388 - protein, 11 aa, Homo sapiens
  Heavy chain CDR3 for antibody 3194 (IGHV1-24)
ATELGLYYFDY

SEQ ID NO: 6389 - protein, 8 aa, Homo sapiens
  Light chain CDR3 for antibody 3195 (IGKV3D-7)
QQDYNLLT

SEQ ID NO: 6390 - protein, 13 aa, Homo sapiens
  Heavy chain CDR3 for antibody 3195 (IGHV3-33)
ARRYRSGWYPFDY

SEQ ID NO: 6391 - protein, 9 aa, Homo sapiens
  Light chain CDR3 for antibody 3196 (IGKV2-30)
MQGTHWPLT

SEQ ID NO: 6392 - protein, 14 aa, Homo sapiens
  Heavy chain CDR3 for antibody 3196 (IGHV3-33)
ARAISGSSYWYFDL

SEQ ID NO: 6393 - protein, 9 aa, Homo sapiens
  Light chain CDR3 for antibody 3197 (IGKV3-20)
QQYGSSPYT

SEQ ID NO: 6394 - protein, 15 aa, Homo sapiens
  Heavy chain CDR3 for antibody 3197 (IGHV3-33)
ARRSILTGSYWYFDL

SEQ ID NO: 6395 - protein, 8 aa, Homo sapiens
  Light chain CDR3 for antibody 3198 (IGKV3D-7)
QQDYNLLT

SEQ ID NO: 6396 - protein, 12 aa, Homo sapiens
  Heavy chain CDR3 for antibody 3198 (IGHV3-33)
TRGYSSKSYFDY

SEQ ID NO: 6397 - protein, 9 aa, Homo sapiens
  Light chain CDR3 for antibody 3199 (IGKV1-9)
QQLNTYPYT

SEQ ID NO: 6398 - protein, 18 aa, Homo sapiens
  Heavy chain CDR3 for antibody 3199 (IGHV3-23)
AKDRITGTTYGYYSGLDV

SEQ ID NO: 6399 - protein, 9 aa, Homo sapiens
  Light chain CDR3 for antibody 3200 (IGKV3-11)
QQRSNWPYT

SEQ ID NO: 6400 - protein, 17 aa, Homo sapiens
  Heavy chain CDR3 for antibody 3200 (IGHV3-23)
AKDGIGELSYYYYGMDV

SEQ ID NO: 6401 - protein, 9 aa, Homo sapiens
  Light chain CDR3 for antibody 3201 (IGKV1-39)
QQSYRTPLT

SEQ ID NO: 6402 - protein, 23 aa, Homo sapiens
  Heavy chain CDR3 for antibody 3201 (IGHV3-11)
ARDEGVTMVRGVISYYYYYGMDV

SEQ ID NO: 6403 - protein, 9 aa, Homo sapiens
  Light chain CDR3 for antibody 3202 (IGKV1-6)
LQDYNYPWT

SEQ ID NO: 6404 - protein, 14 aa, Homo sapiens
  Heavy chain CDR3 for antibody 3202 (IGHV3-20)
ARGGSSGWYDWFDP

SEQ ID NO: 6405 - protein, 9 aa, Homo sapiens
  Light chain CDR3 for antibody 3203 (IGKV3-20)
QQYGSSPLT

SEQ ID NO: 6406 - protein, 18 aa, Homo sapiens
  Heavy chain CDR3 for antibody 3203 (IGHV3-33)
ARDQYSGYDFYYYYGMDV

SEQ ID NO: 6407 - protein, 9 aa, Homo sapiens
  Light chain CDR3 for antibody 3204 (IGKV1D-13)
QQFNNYPYT

SEQ ID NO: 6408 - protein, 15 aa, Homo sapiens
  Heavy chain CDR3 for antibody 3204 (IGHV3-23)
AKEFTMVRGVITPDY

SEQ ID NO: 6409 - protein, 9 aa, Homo sapiens
  Light chain CDR3 for antibody 3205 (IGKV1-9)
QQLISYPLT

SEQ ID NO: 6410 - protein, 10 aa, Homo sapiens
  Heavy chain CDR3 for antibody 3205 (IGHV3-33)
ARENSTPLDY

SEQ ID NO: 6411 - protein, 9 aa, Homo sapiens
  Light chain CDR3 for antibody 3206 (IGKV5-2)
LQHDNFPYT

SEQ ID NO: 6412 - protein, 17 aa, Homo sapiens
  Heavy chain CDR3 for antibody 3206 (IGHV3-33)
ARDPARGNVRSFYGLDV

SEQ ID NO: 6413 - protein, 9 aa, Homo sapiens
  Light chain CDR3 for antibody 3207 (IGKV3-20)
QQYGSSPYT

SEQ ID NO: 6414 - protein, 12 aa, Homo sapiens
  Heavy chain CDR3 for antibody 3207 (IGHV3-33)
AKDPGWQQLAEY

SEQ ID NO: 6415 - protein, 9 aa, Homo sapiens
  Light chain CDR3 for antibody 3208 (IGKV6-21)
HQSSSLPYT

SEQ ID NO: 6416 - protein, 17 aa, Homo sapiens
  Heavy chain CDR3 for antibody 3208 (IGHV3-23)
AKEGSSSSWYGGLYFDY

SEQ ID NO: 6417 - protein, 8 aa, Homo sapiens
  Light chain CDR3 for antibody 3209 (IGKV3-11)
QQRSNWLT

SEQ ID NO: 6418 - protein, 16 aa, Homo sapiens
  Heavy chain CDR3 for antibody 3209 (IGHV3-23)
AKEGMVLRYFDWLWDY

SEQ ID NO: 6419 - protein, 9 aa, Homo sapiens
  Light chain CDR3 for antibody 3210 (IGKV3-20)
QQYGSSPLT

SEQ ID NO: 6420 - protein, 22 aa, Homo sapiens
  Heavy chain CDR3 for antibody 3210 (IGHV1-18)
ARDRYNNQSKYRNRDYYYGLDV

SEQ ID NO: 6421 - protein, 8 aa, Homo sapiens
  Light chain CDR3 for antibody 3211 (IGKV3D-7)
QQDYNLLT

SEQ ID NO: 6422 - protein, 8 aa, Homo sapiens
  Heavy chain CDR3 for antibody 3211 (IGHV3-23)
EKSAGEDV

SEQ ID NO: 6423 - protein, 9 aa, Homo sapiens
  Light chain CDR3 for antibody 3212 (IGKV1D-16)
QQYNSYPLT

SEQ ID NO: 6424 - protein, 16 aa, Homo sapiens
  Heavy chain CDR3 for antibody 3212 (IGHV4-39)
ARRVPYYDILTGYLDY

SEQ ID NO: 6425 - protein, 9 aa, Homo sapiens
  Light chain CDR3 for antibody 3213 (IGKV1-17)
LQHNSYPYT

SEQ ID NO: 6426 - protein, 12 aa, Homo sapiens
  Heavy chain CDR3 for antibody 3213 (IGHV3-33)
ARDIVGTSYFDY

SEQ ID NO: 6427 - protein, 9 aa, Homo sapiens
  Light chain CDR3 for antibody 3214 (IGKV1-17)
LQHNSYPRT

SEQ ID NO: 6428 - protein, 13 aa, Homo sapiens
  Heavy chain CDR3 for antibody 3214 (IGHV3-23)
AREYCSSTSCYDH

SEQ ID NO: 6429 - protein, 9 aa, Homo sapiens
  Light chain CDR3 for antibody 3215 (IGKV6-21)
HQSSSLPYT

SEQ ID NO: 6430 - protein, 17 aa, Homo sapiens
  Heavy chain CDR3 for antibody 3215 (IGHV3-33)
ARCGYSSSWYDPYYFDY

SEQ ID NO: 6431 - protein, 9 aa, Homo sapiens
  Light chain CDR3 for antibody 3216 (IGKV1D-13)
QQFNNYPHT

SEQ ID NO: 6432 - protein, 13 aa, Homo sapiens
  Heavy chain CDR3 for antibody 3216 (IGHV3-33)
ARDYTMVRGVMNY

SEQ ID NO: 6433 - protein, 9 aa, Homo sapiens
  Light chain CDR3 for antibody 3217 (IGKV1-39)
QQSYSTPIT

SEQ ID NO: 6434 - protein, 12 aa, Homo sapiens
  Heavy chain CDR3 for antibody 3217 (IGHV1-46)
ARGLIGDHAVDI

SEQ ID NO: 6435 - protein, 9 aa, Homo sapiens
  Light chain CDR3 for antibody 3218 (IGKV1D-13)
QQFNNYPHT

SEQ ID NO: 6436 - protein, 18 aa, Homo sapiens
  Heavy chain CDR3 for antibody 3218 (IGHV3-33)
AREGDYYGSGGFPNWFDP

SEQ ID NO: 6437 - protein, 9 aa, Homo sapiens
  Light chain CDR3 for antibody 3219 (IGKV5-2)
LQHDNFPYT

SEQ ID NO: 6438 - protein, 16 aa, Homo sapiens
  Heavy chain CDR3 for antibody 3219 (IGHV3-20)
ARDSSSLDYYYYGMDV

SEQ ID NO: 6439 - protein, 9 aa, Homo sapiens
  Light chain CDR3 for antibody 3220 (IGKV1-27)
QKYNSAPYT

SEQ ID NO: 6440 - protein, 10 aa, Homo sapiens
  Heavy chain CDR3 for antibody 3220 (IGHV3-33)
ARDLGWSFDF

SEQ ID NO: 6441 - protein, 9 aa, Homo sapiens
  Light chain CDR3 for antibody 3221 (IGKV1-16)
QQYNRYPYT

SEQ ID NO: 6442 - protein, 13 aa, Homo sapiens
  Heavy chain CDR3 for antibody 3221 (IGHV4-39)
ARHVLLWFGEFDP

SEQ ID NO: 6443 - protein, 9 aa, Homo sapiens
  Light chain CDR3 for antibody 3222 (IGKV2-30)
MQGTHWPLT

SEQ ID NO: 6444 - protein, 12 aa, Homo sapiens
  Heavy chain CDR3 for antibody 3222 (IGHV3-33)
ARESGGSYSFDY

SEQ ID NO: 6445 - protein, 9 aa, Homo sapiens
  Light chain CDR3 for antibody 3223 (IGKV1D-13)
QQFFNYPYT

SEQ ID NO: 6446 - protein, 11 aa, Homo sapiens
  Heavy chain CDR3 for antibody 3223 (IGHV3-33)
ARDPRIAGFDC

SEQ ID NO: 6447 - protein, 8 aa, Homo sapiens
  Light chain CDR3 for antibody 3224 (IGKV1-5)
QQYNSYWT

SEQ ID NO: 6448 - protein, 18 aa, Homo sapiens
  Heavy chain CDR3 for antibody 3224 (IGHV3-33)
ARDGYSGYDYYYYYGMDV

SEQ ID NO: 6449 - protein, 9 aa, Homo sapiens
  Light chain CDR3 for antibody 3225 (IGKV5-2)
LQHDNFPYT

SEQ ID NO: 6450 - protein, 15 aa, Homo sapiens
  Heavy chain CDR3 for antibody 3225 (IGHV3-7)
ARDRAVAGTIHAFDI

SEQ ID NO: 6451 - protein, 10 aa, Homo sapiens
  Light chain CDR3 for antibody 3226 (IGKV3-15)
QQYNNWPPLT

SEQ ID NO: 6452 - protein, 12 aa, Homo sapiens
  Heavy chain CDR3 for antibody 3226 (IGHV1-46)
ARGLTGDHAVDI

SEQ ID NO: 6453 - protein, 9 aa, Homo sapiens
  Light chain CDR3 for antibody 3227 (IGKV5-2)
LQHDNFPWT

SEQ ID NO: 6454 - protein, 14 aa, Homo sapiens
  Heavy chain CDR3 for antibody 3227 (IGHV3-33)
ARDLNYDILNGGGY

SEQ ID NO: 6455 - protein, 9 aa, Homo sapiens
  Light chain CDR3 for antibody 3228 (IGKV1-9)
QQLISYPLT

SEQ ID NO: 6456 - protein, 14 aa, Homo sapiens
  Heavy chain CDR3 for antibody 3228 (IGHV3-33)
AREGYSSNWYDFDY

SEQ ID NO: 6457 - protein, 9 aa, Homo sapiens
  Light chain CDR3 for antibody 3229 (IGKV1D-13)
QQFNNYPHT

SEQ ID NO: 6458 - protein, 12 aa, Homo sapiens
  Heavy chain CDR3 for antibody 3229 (IGHV4-59)
ARDRSGWAYFDY

SEQ ID NO: 6459 - protein, 9 aa, Homo sapiens
  Light chain CDR3 for antibody 3230 (IGKV5-2)
LQHDNFPYT

SEQ ID NO: 6460 - protein, 15 aa, Homo sapiens
  Heavy chain CDR3 for antibody 3230 (IGHV3-64)
ARDGLRYFDWLFPWY

SEQ ID NO: 6461 - protein, 9 aa, Homo sapiens
  Light chain CDR3 for antibody 3231 (IGKV2D-28)
MQALQTPPT

SEQ ID NO: 6462 - protein, 11 aa, Homo sapiens
  Heavy chain CDR3 for antibody 3231 (IGHV3-33)
ARDRSSGPFDY

SEQ ID NO: 6463 - protein, 9 aa, Homo sapiens
  Light chain CDR3 for antibody 3232 (IGKV6-21)
HQSTSLPFT

SEQ ID NO: 6464 - protein, 18 aa, Homo sapiens
  Heavy chain CDR3 for antibody 3232 (IGHV4-59)
AREGDYVWGSYRSNWFDP

SEQ ID NO: 6465 - protein, 9 aa, Homo sapiens
  Light chain CDR3 for antibody 3233 (IGKV3-15)
QQYNNWPFT

SEQ ID NO: 6466 - protein, 9 aa, Homo sapiens
  Heavy chain CDR3 for antibody 3233 (IGHV1-8)
ARGRLDFDY

SEQ ID NO: 6467 - protein, 9 aa, Homo sapiens
  Light chain CDR3 for antibody 3234 (IGKV2-30)
MQGTHWPLT

SEQ ID NO: 6468 - protein, 15 aa, Homo sapiens
  Heavy chain CDR3 for antibody 3234 (IGHV3-33)
ARRICSGGSCSLFDY

SEQ ID NO: 6469 - protein, 9 aa, Homo sapiens
  Light chain CDR3 for antibody 3235 (IGKV2-30)
MQGTHWPLT

SEQ ID NO: 6470 - protein, 13 aa, Homo sapiens
  Heavy chain CDR3 for antibody 3235 (IGHV3-33)
ARTDYYFYYGLDV

SEQ ID NO: 6471 - protein, 9 aa, Homo sapiens
  Light chain CDR3 for antibody 3236 (IGKV5-2)
LQHDNFPYT

SEQ ID NO: 6472 - protein, 14 aa, Homo sapiens
  Heavy chain CDR3 for antibody 3236 (IGHV3-23)
AKDDIVRATGAFDI

SEQ ID NO: 6473 - protein, 9 aa, Homo sapiens
  Light chain CDR3 for antibody 3237 (IGKV1-6)
LQDYNYPRT

SEQ ID NO: 6474 - protein, 18 aa, Homo sapiens
  Heavy chain CDR3 for antibody 3237 (IGHV1-24)
ATGLRYFDWPIISNLFDY

SEQ ID NO: 6475 - protein, 9 aa, Homo sapiens
  Light chain CDR3 for antibody 3238 (IGKV1-6)
LQDYNYPYT

SEQ ID NO: 6476 - protein, 16 aa, Homo sapiens
  Heavy chain CDR3 for antibody 3238 (IGHV3-11)
ARYHYGSGSYYNVGDY

SEQ ID NO: 6477 - protein, 9 aa, Homo sapiens
  Light chain CDR3 for antibody 3239 (IGKV1-39)
QQSYSTPLT

SEQ ID NO: 6478 - protein, 18 aa, Homo sapiens
  Heavy chain CDR3 for antibody 3239 (IGHV6-1)
ARDQYSYGPYYYYYGMDV

SEQ ID NO: 6479 - protein, 9 aa, Homo sapiens
  Light chain CDR3 for antibody 3240 (IGKV3-11)
QQRSNWPLT

SEQ ID NO: 6480 - protein, 13 aa, Homo sapiens
  Heavy chain CDR3 for antibody 3240 (IGHV4-39)
APFRVMVRGVLDY

SEQ ID NO: 6481 - protein, 9 aa, Homo sapiens
  Light chain CDR3 for antibody 3241 (IGKV1-27)
QKYNSAPYT

SEQ ID NO: 6482 - protein, 11 aa, Homo sapiens
  Heavy chain CDR3 for antibody 3241 (IGHV1-24)
ATELGLYYFDY

SEQ ID NO: 6483 - protein, 9 aa, Homo sapiens
  Light chain CDR3 for antibody 3242 (IGKV1-6)
LQDYNYPYT

SEQ ID NO: 6484 - protein, 19 aa, Homo sapiens
  Heavy chain CDR3 for antibody 3242 (IGHV3-20)
ARDLCSSTSCYGYYYGMDV

SEQ ID NO: 6485 - protein, 9 aa, Homo sapiens
  Light chain CDR3 for antibody 3243 (IGKV3-11)
QQRSNWPLT

SEQ ID NO: 6486 - protein, 9 aa, Homo sapiens
  Heavy chain CDR3 for antibody 3243 (IGHV3-30)
ARDYFHYDY

SEQ ID NO: 6487 - protein, 9 aa, Homo sapiens
  Light chain CDR3 for antibody 3244 (IGKV3D-7)
QQDYNLPLT

SEQ ID NO: 6488 - protein, 12 aa, Homo sapiens
  Heavy chain CDR3 for antibody 3244 (IGHV3-33)
ARGYFGSGYAHF

SEQ ID NO: 6489 - protein, 9 aa, Homo sapiens
  Light chain CDR3 for antibody 3245 (IGKV1-9)
QQLNSYPLT

SEQ ID NO: 6490 - protein, 18 aa, Homo sapiens
  Heavy chain CDR3 for antibody 3245 (IGHV3-23)
AKVGDFFASGNYWDYFDY

SEQ ID NO: 6491 - protein, 9 aa, Homo sapiens
  Light chain CDR3 for antibody 3246 (IGKV3-15)
QQYNNWPLT

SEQ ID NO: 6492 - protein, 7 aa, Homo sapiens
  Heavy chain CDR3 for antibody 3246 (IGHV1-46)
AREGGDY

SEQ ID NO: 6493 - protein, 9 aa, Homo sapiens
  Light chain CDR3 for antibody 3247 (IGKV1-6)
LQDYNYPWT

SEQ ID NO: 6494 - protein, 14 aa, Homo sapiens
  Heavy chain CDR3 for antibody 3247 (IGHV3-33)
ARDAMGTSTAWFDP

SEQ ID NO: 6495 - protein, 9 aa, Homo sapiens
  Light chain CDR3 for antibody 3248 (IGKV5-2)
LQHDNFPWT

SEQ ID NO: 6496 - protein, 15 aa, Homo sapiens
  Heavy chain CDR3 for antibody 3248 (IGHV1-2)
ARDLGYYGSGSRMDV

SEQ ID NO: 6497 - protein, 8 aa, Homo sapiens
  Light chain CDR3 for antibody 3249 (IGKV2D-28)
MQALQTPT

SEQ ID NO: 6498 - protein, 11 aa, Homo sapiens
  Heavy chain CDR3 for antibody 3249 (IGHV3-33)
ARDRSSGPFDY

SEQ ID NO: 6499 - protein, 10 aa, Homo sapiens
  Light chain CDR3 for antibody 3250 (IGKV1-39)
QQSYSTPMYT

SEQ ID NO: 6500 - protein, 18 aa, Homo sapiens
  Heavy chain CDR3 for antibody 3250 (IGHV3-33)
ARDGYSGYDYYYYYGMDV

SEQ ID NO: 6501 - protein, 8 aa, Homo sapiens
  Light chain CDR3 for antibody 3251 (IGKV1-5)
QQYNSYYT

SEQ ID NO: 6502 - protein, 14 aa, Homo sapiens
  Heavy chain CDR3 for antibody 3251 (IGHV3-33)
ARDRIAAASSDFDC

SEQ ID NO: 6503 - protein, 10 aa, Homo sapiens
  Light chain CDR3 for antibody 3252 (IGKV3-11)
QQRSNWPIFT

SEQ ID NO: 6504 - protein, 11 aa, Homo sapiens
  Heavy chain CDR3 for antibody 3252 (IGHV3-33)
ARDKSSGWSDY

SEQ ID NO: 6505 - protein, 9 aa, Homo sapiens
  Light chain CDR3 for antibody 3253 (IGKV6-21)
HQSSSLPYT

SEQ ID NO: 6506 - protein, 14 aa, Homo sapiens
  Heavy chain CDR3 for antibody 3253 (IGHV3-33)
ARDRDIMATSYFDY

SEQ ID NO: 6507 - protein, 9 aa, Homo sapiens
  Light chain CDR3 for antibody 3254 (IGKV1-27)
QKYNSAPYT

SEQ ID NO: 6508 - protein, 16 aa, Homo sapiens
  Heavy chain CDR3 for antibody 3254 (IGHV3-30)
ARDIAVAGHVYYGMDV

SEQ ID NO: 6509 - protein, 10 aa, Homo sapiens
  Light chain CDR3 for antibody 3255 (IGKV1-17)
LQHNSYPMYT

SEQ ID NO: 6510 - protein, 11 aa, Homo sapiens
  Heavy chain CDR3 for antibody 3255 (IGHV4-59)
AREMGHDTFDI

SEQ ID NO: 6511 - protein, 9 aa, Homo sapiens
  Light chain CDR3 for antibody 3256 (IGKV1-9)
QQLNTYPWT

SEQ ID NO: 6512 - protein, 15 aa, Homo sapiens
  Heavy chain CDR3 for antibody 3256 (IGHV3-30)
ARGAMVRGVDYGMDV

SEQ ID NO: 6513 - protein, 9 aa, Homo sapiens
  Light chain CDR3 for antibody 3257 (IGKV1-6)
LQDYNYPYT

SEQ ID NO: 6514 - protein, 17 aa, Homo sapiens
  Heavy chain CDR3 for antibody 3257 (IGHV3-66)
ARVQYDILTGYSPYFDN

SEQ ID NO: 6515 - protein, 9 aa, Homo sapiens
  Light chain CDR3 for antibody 3258 (IGKV1-39)
QQSYSTPLT

SEQ ID NO: 6516 - protein, 10 aa, Homo sapiens
  Heavy chain CDR3 for antibody 3258 (IGHV3-74)
ARENWGGFDY

SEQ ID NO: 6517 - protein, 9 aa, Homo sapiens
  Light chain CDR3 for antibody 3259 (IGKV1-6)
QQYNSYPLT

SEQ ID NO: 6518 - protein, 16 aa, Homo sapiens
  Heavy chain CDR3 for antibody 3259 (IGHV3-33)
ARDAGYPNYDYYGMDV

SEQ ID NO: 6519 - protein, 9 aa, Homo sapiens
  Light chain CDR3 for antibody 3260 (IGKV1D-13)
QHFNNYMYT

SEQ ID NO: 6520 - protein, 18 aa, Homo sapiens
  Heavy chain CDR3 for antibody 3260 (IGHV4-59)
AREGDYVWGSYRPNWFDP

SEQ ID NO: 6521 - protein, 9 aa, Homo sapiens
  Light chain CDR3 for antibody 3261 (IGKV3D-7)
QQDYNLPLT

SEQ ID NO: 6522 - protein, 10 aa, Homo sapiens
  Heavy chain CDR3 for antibody 3261 (IGHV3-33)
AREWFGGFDI

SEQ ID NO: 6523 - protein, 9 aa, Homo sapiens
  Light chain CDR3 for antibody 3262 (IGKV1-9)
QQLNSYPLT

SEQ ID NO: 6524 - protein, 9 aa, Homo sapiens
  Heavy chain CDR3 for antibody 3262 (IGHV4-59)
ARSGSGIYT

SEQ ID NO: 6525 - protein, 9 aa, Homo sapiens
  Light chain CDR3 for antibody 3263 (IGKV5-2)
LQHDNFPWT

SEQ ID NO: 6526 - protein, 10 aa, Homo sapiens
  Heavy chain CDR3 for antibody 3263 (IGHV4-39)
ASSNWNDGPL

SEQ ID NO: 6527 - protein, 9 aa, Homo sapiens
  Light chain CDR3 for antibody 3264 (IGKV1-6)
LQDYNYPWT

SEQ ID NO: 6528 - protein, 15 aa, Homo sapiens
  Heavy chain CDR3 for antibody 3264 (IGHV3-33)
ARRVCSGGSCSLFDY

SEQ ID NO: 6529 - protein, 9 aa, Homo sapiens
  Light chain CDR3 for antibody 3265 (IGKV1-9)
QQLNSYPWT

SEQ ID NO: 6530 - protein, 13 aa, Homo sapiens
  Heavy chain CDR3 for antibody 3265 (IGHV3-33)
ARAFIMVRGVIDY

SEQ ID NO: 6531 - protein, 9 aa, Homo sapiens
  Light chain CDR3 for antibody 3266 (IGKV5-2)
LQHDNFPWT

SEQ ID NO: 6532 - protein, 12 aa, Homo sapiens
  Heavy chain CDR3 for antibody 3266 (IGHV1-18)
ARRDGSGTSFDY

SEQ ID NO: 6533 - protein, 9 aa, Homo sapiens
  Light chain CDR3 for antibody 3267 (IGKV1-39)
QQSYSTPLT

SEQ ID NO: 6534 - protein, 20 aa, Homo sapiens
  Heavy chain CDR3 for antibody 3267 (IGHV3-33)
AREDYYGSGSYYPAYNWFDP

SEQ ID NO: 6535 - protein, 9 aa, Homo sapiens
  Light chain CDR3 for antibody 3268 (IGKV6-21)
HQSSSLPYT

SEQ ID NO: 6536 - protein, 15 aa, Homo sapiens
  Heavy chain CDR3 for antibody 3268 (IGHV1-24)
ATHWDLRYYYYGMDV

SEQ ID NO: 6537 - protein, 9 aa, Homo sapiens
  Light chain CDR3 for antibody 3269 (IGKV3-11)
QQRSNWPPT

SEQ ID NO: 6538 - protein, 17 aa, Homo sapiens
  Heavy chain CDR3 for antibody 3269 (IGHV3-33)
VREGGLLWVGELSLFDY

SEQ ID NO: 6539 - protein, 9 aa, Homo sapiens
  Light chain CDR3 for antibody 3270 (IGKV5-2)
LQHDNFPYT

SEQ ID NO: 6540 - protein, 16 aa, Homo sapiens
  Heavy chain CDR3 for antibody 3270 (IGHV3-33)
ARDGSMVRRIHDAFDF

SEQ ID NO: 6541 - protein, 8 aa, Homo sapiens
  Light chain CDR3 for antibody 3271 (IGKV3-11)
QQRSNWLT

SEQ ID NO: 6542 - protein, 9 aa, Homo sapiens
  Heavy chain CDR3 for antibody 3271 (IGHV1-18)
ARGKDWFDP

SEQ ID NO: 6543 - protein, 9 aa, Homo sapiens
  Light chain CDR3 for antibody 3272 (IGKV1D-13)
QQFNNYPYT

SEQ ID NO: 6544 - protein, 17 aa, Homo sapiens
  Heavy chain CDR3 for antibody 3272 (IGHV3-30)
ARDGVGATSYYYYGMDV

SEQ ID NO: 6545 - protein, 9 aa, Homo sapiens
  Light chain CDR3 for antibody 3273 (IGKV2-30)
MQGTHWPLT

SEQ ID NO: 6546 - protein, 10 aa, Homo sapiens
  Heavy chain CDR3 for antibody 3273 (IGHV3-33)
ARENSTPLDY

SEQ ID NO: 6547 - protein, 9 aa, Homo sapiens
  Light chain CDR3 for antibody 3274 (IGKV6-21)
HQSSSLPYT

SEQ ID NO: 6548 - protein, 18 aa, Homo sapiens
  Heavy chain CDR3 for antibody 3274 (IGHV3-33)
ARGGYDILTGYYRTGMDV

SEQ ID NO: 6549 - protein, 8 aa, Homo sapiens
  Light chain CDR3 for antibody 3275 (IGKV1D-13)
QQFNNYPT

SEQ ID NO: 6550 - protein, 13 aa, Homo sapiens
  Heavy chain CDR3 for antibody 3275 (IGHV3-23)
ASPFNWNDGFFDY

SEQ ID NO: 6551 - protein, 11 aa, Homo sapiens
  Light chain CDR3 for antibody 3276 (IGKV3-11)
QQRSNWPPTWT

SEQ ID NO: 6552 - protein, 13 aa, Homo sapiens
  Heavy chain CDR3 for antibody 3276 (IGHV3-33)
ARDYCGGDCYLDY

SEQ ID NO: 6553 - protein, 9 aa, Homo sapiens
  Light chain CDR3 for antibody 3277 (IGKV5-2)
LQHDNFPYT

SEQ ID NO: 6554 - protein, 13 aa, Homo sapiens
  Heavy chain CDR3 for antibody 3277 (IGHV3-33)
ARDSSSWYHWFDP

SEQ ID NO: 6555 - protein, 8 aa, Homo sapiens
  Light chain CDR3 for antibody 3278 (IGKV6-21)
QQSSSLST

SEQ ID NO: 6556 - protein, 15 aa, Homo sapiens
  Heavy chain CDR3 for antibody 3278 (IGHV3-20)
ARDRGSSGWYDAFDI

SEQ ID NO: 6557 - protein, 9 aa, Homo sapiens
  Light chain CDR3 for antibody 3279 (IGKV1-17)
LQHNSYPYT

SEQ ID NO: 6558 - protein, 14 aa, Homo sapiens
  Heavy chain CDR3 for antibody 3279 (IGHV1-24)
ATWLPLYYYYGMDV

SEQ ID NO: 6559 - protein, 9 aa, Homo sapiens
  Light chain CDR3 for antibody 3280 (IGKV5-2)
LQHDNFPWT

SEQ ID NO: 6560 - protein, 8 aa, Homo sapiens
  Heavy chain CDR3 for antibody 3280 (IGHV3-20)
APHWIFDY

SEQ ID NO: 6561 - protein, 9 aa, Homo sapiens
  Light chain CDR3 for antibody 3281 (IGKV1D-16)
QQYNSYPYT

SEQ ID NO: 6562 - protein, 14 aa, Homo sapiens
  Heavy chain CDR3 for antibody 3281 (IGHV1-18)
ARDQPTVPSGYFDY

SEQ ID NO: 6563 - protein, 9 aa, Homo sapiens
  Light chain CDR3 for antibody 3282 (IGKV3-20)
QQYGSSPYT

SEQ ID NO: 6564 - protein, 18 aa, Homo sapiens
  Heavy chain CDR3 for antibody 3282 (IGHV3-33)
ARGGVLYDILTGFYGMDV

SEQ ID NO: 6565 - protein, 9 aa, Homo sapiens
  Light chain CDR3 for antibody 3283 (IGKV1-39)
QQSYSTPLT

SEQ ID NO: 6566 - protein, 12 aa, Homo sapiens
  Heavy chain CDR3 for antibody 3283 (IGHV3-23)
AKEGLGSDYEPY

SEQ ID NO: 6567 - protein, 9 aa, Homo sapiens
  Light chain CDR3 for antibody 3284 (IGKV5-2)
LQHDNFPYT

SEQ ID NO: 6568 - protein, 14 aa, Homo sapiens
  Heavy chain CDR3 for antibody 3284 (IGHV3-33)
ARDGYDILTGPMDV

SEQ ID NO: 6569 - protein, 9 aa, Homo sapiens
  Light chain CDR3 for antibody 3285 (IGKV1-39)
QQSYRTPLT

SEQ ID NO: 6570 - protein, 15 aa, Homo sapiens
  Heavy chain CDR3 for antibody 3285 (IGHV3-74)
ARGSGSHYHYYGMDV

SEQ ID NO: 6571 - protein, 9 aa, Homo sapiens
  Light chain CDR3 for antibody 3286 (IGKV2-30)
MQGTHWPLT

SEQ ID NO: 6572 - protein, 9 aa, Homo sapiens
  Heavy chain CDR3 for antibody 3286 (IGHV4-59)
AREGGSGSL

SEQ ID NO: 6573 - protein, 10 aa, Homo sapiens
  Light chain CDR3 for antibody 3287 (IGKV3-11)
QQRSNWPIFT

SEQ ID NO: 6574 - protein, 14 aa, Homo sapiens
  Heavy chain CDR3 for antibody 3287 (IGHV3-33)
ARDNILTAYYLFDY

SEQ ID NO: 6575 - protein, 10 aa, Homo sapiens
  Light chain CDR3 for antibody 3288 (IGKV3-11)
QQRSNWPIFT

SEQ ID NO: 6576 - protein, 13 aa, Homo sapiens
  Heavy chain CDR3 for antibody 3288 (IGHV3-53)
ARSGSYWGYYFDY

SEQ ID NO: 6577 - protein, 9 aa, Homo sapiens
  Light chain CDR3 for antibody 3289 (IGKV1-33)
QQYDNLPFT

SEQ ID NO: 6578 - protein, 12 aa, Homo sapiens
  Heavy chain CDR3 for antibody 3289 (IGHV3-33)
ARGYFGSGYAHF

SEQ ID NO: 6579 - protein, 10 aa, Homo sapiens
  Light chain CDR3 for antibody 3290 (IGKV1-39)
QQSYSTPMYT

SEQ ID NO: 6580 - protein, 12 aa, Homo sapiens
  Heavy chain CDR3 for antibody 3290 (IGHV3-13)
AREAGIPDAFDI

SEQ ID NO: 6581 - protein, 9 aa, Homo sapiens
  Light chain CDR3 for antibody 3291 (IGKV1-33)
QQYDNLPFT

SEQ ID NO: 6582 - protein, 14 aa, Homo sapiens
  Heavy chain CDR3 for antibody 3291 (IGHV3-33)
ARGAAAGNFYGLDV

SEQ ID NO: 6583 - protein, 9 aa, Homo sapiens
  Light chain CDR3 for antibody 3292 (IGKV3-20)
QQYGSSPYT

SEQ ID NO: 6584 - protein, 10 aa, Homo sapiens
  Heavy chain CDR3 for antibody 3292 (IGHV3-30)
ARVVDTAMAY

SEQ ID NO: 6585 - protein, 11 aa, Homo sapiens
  Light chain CDR3 for antibody 3293 (IGKV3-11)
QQRSNWPPTWT

SEQ ID NO: 6586 - protein, 12 aa, Homo sapiens
  Heavy chain CDR3 for antibody 3293 (IGHV4-61)
ARVYSSGWLFDY

SEQ ID NO: 6587 - protein, 9 aa, Homo sapiens
  Light chain CDR3 for antibody 3294 (IGKV1-9)
QQLNSYPLT

SEQ ID NO: 6588 - protein, 17 aa, Homo sapiens
  Heavy chain CDR3 for antibody 3294 (IGHV3-33)
ARDSYDILTGYYKPFDY

SEQ ID NO: 6589 - protein, 9 aa, Homo sapiens
  Light chain CDR3 for antibody 3295 (IGKV1-17)
LQHNSYPYT

SEQ ID NO: 6590 - protein, 18 aa, Homo sapiens
  Heavy chain CDR3 for antibody 3295 (IGHV3-33)
AREGYFGSGSYYRNWFDP

SEQ ID NO: 6591 - protein, 9 aa, Homo sapiens
  Light chain CDR3 for antibody 3296 (IGKV1D-13)
QQFNNYPYT

SEQ ID NO: 6592 - protein, 18 aa, Homo sapiens
  Heavy chain CDR3 for antibody 3296 (IGHV3-13)
ARDYYGSGSLYYYYGMDV

SEQ ID NO: 6593 - protein, 8 aa, Homo sapiens
  Light chain CDR3 for antibody 3297 (IGKV3D-7)
QQDYNLLT

SEQ ID NO: 6594 - protein, 13 aa, Homo sapiens
  Heavy chain CDR3 for antibody 3297 (IGHV3-33)
ARKAYGDYFYFDY

SEQ ID NO: 6595 - protein, 9 aa, Homo sapiens
  Light chain CDR3 for antibody 3298 (IGKV1-27)
QKYNSAPYT

SEQ ID NO: 6596 - protein, 21 aa, Homo sapiens
  Heavy chain CDR3 for antibody 3298 (IGHV3-23)
AKDIDYYGSGSYPLYYYGMDV

SEQ ID NO: 6597 - protein, 9 aa, Homo sapiens
  Light chain CDR3 for antibody 3299 (IGKV1D-13)
QRFNNYLYT

SEQ ID NO: 6598 - protein, 13 aa, Homo sapiens
  Heavy chain CDR3 for antibody 3299 (IGHV3-33)
ARDQRYSSGWYDY

SEQ ID NO: 6599 - protein, 9 aa, Homo sapiens
  Light chain CDR3 for antibody 3300 (IGKV1-17)
LQHNSYPYT

SEQ ID NO: 6600 - protein, 17 aa, Homo sapiens
  Heavy chain CDR3 for antibody 3300 (IGHV3-23)
AKGDYYGSGSYSTFFDY

SEQ ID NO: 6601 - protein, 9 aa, Homo sapiens
  Light chain CDR3 for antibody 3301 (IGKV1D-13)
QQFNNYPHT

SEQ ID NO: 6602 - protein, 23 aa, Homo sapiens
  Heavy chain CDR3 for antibody 3301 (IGHV3-11)
ARDEGVTMVRGVISYYYYYGMDV

SEQ ID NO: 6603 - protein, 9 aa, Homo sapiens
  Light chain CDR3 for antibody 3302 (IGKV1-6)
LQDYNYPYT

SEQ ID NO: 6604 - protein, 10 aa, Homo sapiens
  Heavy chain CDR3 for antibody 3302 (IGHV4-31)
ARHGVAGTNY

SEQ ID NO: 6605 - protein, 9 aa, Homo sapiens
  Light chain CDR3 for antibody 3303 (IGKV2-30)
MQGTHWPLT

SEQ ID NO: 6606 - protein, 11 aa, Homo sapiens
  Heavy chain CDR3 for antibody 3303 (IGHV3-33)
AREAANWGFDY

SEQ ID NO: 6607 - protein, 9 aa, Homo sapiens
  Light chain CDR3 for antibody 3304 (IGKV3D-20)
QQYGSSPYT

SEQ ID NO: 6608 - protein, 11 aa, Homo sapiens
  Heavy chain CDR3 for antibody 3304 (IGHV3-23)
AKAGIVGCLDV

SEQ ID NO: 6609 - protein, 8 aa, Homo sapiens
  Light chain CDR3 for antibody 3305 (IGKV1-5)
QQYNSYYT

SEQ ID NO: 6610 - protein, 15 aa, Homo sapiens
  Heavy chain CDR3 for antibody 3305 (IGHV1-18)
ARGYCSSTSCYYFDY

SEQ ID NO: 6611 - protein, 10 aa, Homo sapiens
  Light chain CDR3 for antibody 3306 (IGKV1-17)
LQHNSYPMYT

SEQ ID NO: 6612 - protein, 13 aa, Homo sapiens
  Heavy chain CDR3 for antibody 3306 (IGHV3-11)
ARDGGAAAGTWDS

SEQ ID NO: 6613 - protein, 9 aa, Homo sapiens
  Light chain CDR3 for antibody 3307 (IGKV2-30)
MQGTHWPLT

SEQ ID NO: 6614 - protein, 13 aa, Homo sapiens
  Heavy chain CDR3 for antibody 3307 (IGHV3-53)
ARSGSYWGYYFDY

SEQ ID NO: 6615 - protein, 9 aa, Homo sapiens
  Light chain CDR3 for antibody 3308 (IGKV1D-16)
QQYNSYPLT

SEQ ID NO: 6616 - protein, 16 aa, Homo sapiens
  Heavy chain CDR3 for antibody 3308 (IGHV4-61)
ARGRYFEWLLGDVLDI

SEQ ID NO: 6617 - protein, 9 aa, Homo sapiens
  Light chain CDR3 for antibody 3309 (IGKV1-39)
QQSYRTPLT

SEQ ID NO: 6618 - protein, 15 aa, Homo sapiens
  Heavy chain CDR3 for antibody 3309 (IGHV3-23)
AKDGGWNYYYYGMDV

SEQ ID NO: 6619 - protein, 9 aa, Homo sapiens
  Light chain CDR3 for antibody 3310 (IGKV2-30)
MQGTHWPLT

SEQ ID NO: 6620 - protein, 9 aa, Homo sapiens
  Heavy chain CDR3 for antibody 3310 (IGHV3-33)
ARATVGVDY

SEQ ID NO: 6621 - protein, 9 aa, Homo sapiens
  Light chain CDR3 for antibody 3311 (IGKV3D-7)
QQDYNLPLT

SEQ ID NO: 6622 - protein, 16 aa, Homo sapiens
  Heavy chain CDR3 for antibody 3311 (IGHV3-33)
ARAVYYGSGSSLIMDV

SEQ ID NO: 6623 - protein, 9 aa, Homo sapiens
  Light chain CDR3 for antibody 3312 (IGKV3-15)
QQYNNWPLT

SEQ ID NO: 6624 - protein, 17 aa, Homo sapiens
  Heavy chain CDR3 for antibody 3312 (IGHV4-59)
ARRITMVREIIITAFDY

SEQ ID NO: 6625 - protein, 9 aa, Homo sapiens
  Light chain CDR3 for antibody 3313 (IGKV1-39)
QQSYSTPLT

SEQ ID NO: 6626 - protein, 17 aa, Homo sapiens
  Heavy chain CDR3 for antibody 3313 (IGHV3-33)
ARCGYSSSWYDPYYFDY

SEQ ID NO: 6627 - protein, 9 aa, Homo sapiens
  Light chain CDR3 for antibody 3314 (IGKV1-6)
LQDYKSPFT

SEQ ID NO: 6628 - protein, 18 aa, Homo sapiens
  Heavy chain CDR3 for antibody 3314 (IGHV3-33)
ARDGYSGYDYYYYYGMDV

SEQ ID NO: 6629 - protein, 9 aa, Homo sapiens
  Light chain CDR3 for antibody 3315 (IGKV5-2)
LQHDNFPYT

SEQ ID NO: 6630 - protein, 12 aa, Homo sapiens
  Heavy chain CDR3 for antibody 3315 (IGHV3-33)
VRKWFGELYFDY

SEQ ID NO: 6631 - protein, 8 aa, Homo sapiens
  Light chain CDR3 for antibody 3316 (IGKV1D-13)
QQFNNYPT

SEQ ID NO: 6632 - protein, 14 aa, Homo sapiens
  Heavy chain CDR3 for antibody 3316 (IGHV3-33)
ARDWNDVYYYGMDV

SEQ ID NO: 6633 - protein, 9 aa, Homo sapiens
  Light chain CDR3 for antibody 3317 (IGKV5-2)
LQHDNFPYT

SEQ ID NO: 6634 - protein, 14 aa, Homo sapiens
  Heavy chain CDR3 for antibody 3317 (IGHV3-33)
ARDLDIMATSPFAY

SEQ ID NO: 6635 - protein, 9 aa, Homo sapiens
  Light chain CDR3 for antibody 3318 (IGKV1-9)
QQLNSYPLT

SEQ ID NO: 6636 - protein, 18 aa, Homo sapiens
  Heavy chain CDR3 for antibody 3318 (IGHV1-24)
ATGLRYFDWPIISNLFDY

SEQ ID NO: 6637 - protein, 10 aa, Homo sapiens
  Light chain CDR3 for antibody 3319 (IGKV1-27)
QKYNSAPMYT

SEQ ID NO: 6638 - protein, 18 aa, Homo sapiens
  Heavy chain CDR3 for antibody 3319 (IGHV4-59)
AREGDYVWGSYRPNWFDP

SEQ ID NO: 6639 - protein, 9 aa, Homo sapiens
  Light chain CDR3 for antibody 3320 (IGKV1-6)
LQDYNYPYT

SEQ ID NO: 6640 - protein, 18 aa, Homo sapiens
  Heavy chain CDR3 for antibody 3320 (IGHV3-11)
ARDGYFSGWNYYYFGMDV

SEQ ID NO: 6641 - protein, 9 aa, Homo sapiens
  Light chain CDR3 for antibody 3321 (IGKV3-15)
QQYNNWPRT

SEQ ID NO: 6642 - protein, 14 aa, Homo sapiens
  Heavy chain CDR3 for antibody 3321 (IGHV3-33)
ARAISGSSYWYFDL

SEQ ID NO: 6643 - protein, 9 aa, Homo sapiens
  Light chain CDR3 for antibody 3322 (IGKV3-20)
QQYGSSPYT

SEQ ID NO: 6644 - protein, 19 aa, Homo sapiens
  Heavy chain CDR3 for antibody 3322 (IGHV3-23)
AKDGRSGSYDYYYYYGMDV

SEQ ID NO: 6645 - protein, 9 aa, Homo sapiens
  Light chain CDR3 for antibody 3323 (IGKV5-2)
LQHDNFPWT

SEQ ID NO: 6646 - protein, 11 aa, Homo sapiens
  Heavy chain CDR3 for antibody 3323 (IGHV1-46)
AREEDLGAFDI

SEQ ID NO: 6647 - protein, 10 aa, Homo sapiens
  Light chain CDR3 for antibody 3324 (IGKV1-39)
QQSYSSPMYT

SEQ ID NO: 6648 - protein, 11 aa, Homo sapiens
  Heavy chain CDR3 for antibody 3324 (IGHV3-33)
ARDRVLAPFDF

SEQ ID NO: 6649 - protein, 8 aa, Homo sapiens
  Light chain CDR3 for antibody 3325 (IGKV3D-7)
QQDYNLLT

SEQ ID NO: 6650 - protein, 13 aa, Homo sapiens
  Heavy chain CDR3 for antibody 3325 (IGHV3-11)
ARDEGYRGYVLDT

SEQ ID NO: 6651 - protein, 9 aa, Homo sapiens
  Light chain CDR3 for antibody 3326 (IGKV1D-13)
QQFNNYPHT

SEQ ID NO: 6652 - protein, 17 aa, Homo sapiens
  Heavy chain CDR3 for antibody 3326 (IGHV3-33)
ARDLIGPLSSSWYPFDY

SEQ ID NO: 6653 - protein, 9 aa, Homo sapiens
  Light chain CDR3 for antibody 3327 (IGKV5-2)
LQHDNFPYT

SEQ ID NO: 6654 - protein, 16 aa, Homo sapiens
  Heavy chain CDR3 for antibody 3327 (IGHV3-33)
ARAYYYGSGSYPHFQH

SEQ ID NO: 6655 - protein, 10 aa, Homo sapiens
  Light chain CDR3 for antibody 3328 (IGKV3-11)
QQRSNWPIFT

SEQ ID NO: 6656 - protein, 12 aa, Homo sapiens
  Heavy chain CDR3 for antibody 3328 (IGHV4-39)
ARHGSGSSYFDY

SEQ ID NO: 6657 - protein, 8 aa, Homo sapiens
  Light chain CDR3 for antibody 3329 (IGKV3D-7)
QQDYNLLT

SEQ ID NO: 6658 - protein, 14 aa, Homo sapiens
  Heavy chain CDR3 for antibody 3329 (IGHV3-33)
ARDKTYPLSYGMDV

SEQ ID NO: 6659 - protein, 9 aa, Homo sapiens
  Light chain CDR3 for antibody 3330 (IGKV1-37)
QRTYNAPFT

SEQ ID NO: 6660 - protein, 11 aa, Homo sapiens
  Heavy chain CDR3 for antibody 3330 (IGHV3-33)
ARDRSSGPFDY

SEQ ID NO: 6661 - protein, 9 aa, Homo sapiens
  Light chain CDR3 for antibody 3331 (IGKV1-39)
QQSYSTPLT

SEQ ID NO: 6662 - protein, 17 aa, Homo sapiens
  Heavy chain CDR3 for antibody 3331 (IGHV3-64)
ARERYYGSGSYYNWFDP

SEQ ID NO: 6663 - protein, 9 aa, Homo sapiens
  Light chain CDR3 for antibody 3332 (IGKV1-17)
LQHNSYPYT

SEQ ID NO: 6664 - protein, 10 aa, Homo sapiens
  Heavy chain CDR3 for antibody 3332 (IGHV3-33)
ARDGLRYFDW

SEQ ID NO: 6665 - protein, 8 aa, Homo sapiens
  Light chain CDR3 for antibody 3333 (IGKV3D-7)
QQDYNLLT

SEQ ID NO: 6666 - protein, 17 aa, Homo sapiens
  Heavy chain CDR3 for antibody 3333 (IGHV3-33)
VREGGLLWVGELSLFDY

SEQ ID NO: 6667 - protein, 9 aa, Homo sapiens
  Light chain CDR3 for antibody 3334 (IGKV1-6)
LQDYNYPYT

SEQ ID NO: 6668 - protein, 19 aa, Homo sapiens
  Heavy chain CDR3 for antibody 3334 (IGHV4-39)
ARLDYDFLTDYYRPYFFAY

SEQ ID NO: 6669 - protein, 9 aa, Homo sapiens
  Light chain CDR3 for antibody 3335 (IGKV1-9)
QQLISYPLT

SEQ ID NO: 6670 - protein, 13 aa, Homo sapiens
  Heavy chain CDR3 for antibody 3335 (IGHV3-33)
ARKAYGDYFYFDY

SEQ ID NO: 6671 - protein, 9 aa, Homo sapiens
  Light chain CDR3 for antibody 3336 (IGKV1-17)
LQHNSYPRT

SEQ ID NO: 6672 - protein, 14 aa, Homo sapiens
  Heavy chain CDR3 for antibody 3336 (IGHV3-33)
VSAISGSSYWYFAL

SEQ ID NO: 6673 - protein, 8 aa, Homo sapiens
  Light chain CDR3 for antibody 3337 (IGKV1D-13)
QQFNNYPT

SEQ ID NO: 6674 - protein, 13 aa, Homo sapiens
  Heavy chain CDR3 for antibody 3337 (IGHV3-53)
ARSGSYWGYYFDY

SEQ ID NO: 6675 - protein, 9 aa, Homo sapiens
  Light chain CDR3 for antibody 3338 (IGKV6-21)
HQSSSLPYT

SEQ ID NO: 6676 - protein, 15 aa, Homo sapiens
  Heavy chain CDR3 for antibody 3338 (IGHV4-39)
ARRDYDILTGYLFDY

SEQ ID NO: 6677 - protein, 10 aa, Homo sapiens
  Light chain CDR3 for antibody 3339 (IGKV1-39)
QQSYSTPMYT

SEQ ID NO: 6678 - protein, 12 aa, Homo sapiens
  Heavy chain CDR3 for antibody 3339 (IGHV1-46)
ARGLTGDHAVDI

SEQ ID NO: 6679 - protein, 9 aa, Homo sapiens
  Light chain CDR3 for antibody 3340 (IGKV2D-28)
MQVLQTPFT

SEQ ID NO: 6680 - protein, 16 aa, Homo sapiens
  Heavy chain CDR3 for antibody 3340 (IGHV4-59)
ARGRYFEWLLGDVFDI

SEQ ID NO: 6681 - protein, 9 aa, Homo sapiens
  Light chain CDR3 for antibody 3341 (IGKV1D-13)
QQFNNYPYT

SEQ ID NO: 6682 - protein, 16 aa, Homo sapiens
  Heavy chain CDR3 for antibody 3341 (IGHV1-24)
ATEDSSSYYYYYGMDV

SEQ ID NO: 6683 - protein, 9 aa, Homo sapiens
  Light chain CDR3 for antibody 3342 (IGKV1D-13)
QQFNNYPHT

SEQ ID NO: 6684 - protein, 17 aa, Homo sapiens
  Heavy chain CDR3 for antibody 3342 (IGHV3-23)
AKDGIGELSYYYYGMDV

SEQ ID NO: 6685 - protein, 9 aa, Homo sapiens
  Light chain CDR3 for antibody 3343 (IGKV1-9)
QQLISYPLT

SEQ ID NO: 6686 - protein, 14 aa, Homo sapiens
  Heavy chain CDR3 for antibody 3343 (IGHV3-33)
ARAGSGYDRDWFDP

SEQ ID NO: 6687 - protein, 9 aa, Homo sapiens
  Light chain CDR3 for antibody 3344 (IGKV3-11)
QQRSNWPYT

SEQ ID NO: 6688 - protein, 9 aa, Homo sapiens
  Heavy chain CDR3 for antibody 3344 (IGHV3-33)
ARATVGVDY

SEQ ID NO: 6689 - protein, 9 aa, Homo sapiens
  Light chain CDR3 for antibody 3345 (IGKV1-6)
LQDYNYPYT

SEQ ID NO: 6690 - protein, 16 aa, Homo sapiens
  Heavy chain CDR3 for antibody 3345 (IGHV4-39)
ARHPLILTGYPNWFDP

SEQ ID NO: 6691 - protein, 9 aa, Homo sapiens
  Light chain CDR3 for antibody 3346 (IGKV1-6)
LQDYNYPYT

SEQ ID NO: 6692 - protein, 17 aa, Homo sapiens
  Heavy chain CDR3 for antibody 3346 (IGHV3-33)
ARDPWIYSGYGGGWFDP

SEQ ID NO: 6693 - protein, 9 aa, Homo sapiens
  Light chain CDR3 for antibody 3347 (IGKV6-21)
HQSSSLPYT

SEQ ID NO: 6694 - protein, 17 aa, Homo sapiens
  Heavy chain CDR3 for antibody 3347 (IGHV3-23)
AKDRDWKDGYYYFGMDV

SEQ ID NO: 6695 - protein, 9 aa, Homo sapiens
  Light chain CDR3 for antibody 3348 (IGKV3D-20)
QQYGSSPYT

SEQ ID NO: 6696 - protein, 15 aa, Homo sapiens
  Heavy chain CDR3 for antibody 3348 (IGHV3-23)
AKDPRGYYYYYGMDV

SEQ ID NO: 6697 - protein, 9 aa, Homo sapiens
  Light chain CDR3 for antibody 3349 (IGKV1D-16)
QQYNSYPLT

SEQ ID NO: 6698 - protein, 17 aa, Homo sapiens
  Heavy chain CDR3 for antibody 3349 (IGHV3-33)
VRCGYSSSWYDPYYFDY

SEQ ID NO: 6699 - protein, 10 aa, Homo sapiens
  Light chain CDR3 for antibody 3350 (IGKV3-11)
QQRSNWPIFT

SEQ ID NO: 6700 - protein, 12 aa, Homo sapiens
  Heavy chain CDR3 for antibody 3350 (IGHV3-33)
ARDRAYRGSLDY

SEQ ID NO: 6701 - protein, 9 aa, Homo sapiens
  Light chain CDR3 for antibody 3351 (IGKV1-39)
QQSYSTPLT

SEQ ID NO: 6702 - protein, 10 aa, Homo sapiens
  Heavy chain CDR3 for antibody 3351 (IGHV3-33)
AREWFGGFDI

SEQ ID NO: 6703 - protein, 9 aa, Homo sapiens
  Light chain CDR3 for antibody 3352 (IGKV1-39)
QQSYSTPLT

SEQ ID NO: 6704 - protein, 23 aa, Homo sapiens
  Heavy chain CDR3 for antibody 3352 (IGHV4-59)
ARERTYSDILPGYYEDYYYGMDV

SEQ ID NO: 6705 - protein, 9 aa, Homo sapiens
  Light chain CDR3 for antibody 3353 (IGKV3D-7)
QQDYNLPYT

SEQ ID NO: 6706 - protein, 14 aa, Homo sapiens
  Heavy chain CDR3 for antibody 3353 (IGHV3-33)
ARDKTYPLSYGMDV

SEQ ID NO: 6707 - protein, 9 aa, Homo sapiens
  Light chain CDR3 for antibody 3354 (IGKV1-17)
LQHNSYPYT

SEQ ID NO: 6708 - protein, 13 aa, Homo sapiens
  Heavy chain CDR3 for antibody 3354 (IGHV3-33)
AKRYSSGWYPFDF

SEQ ID NO: 6709 - protein, 9 aa, Homo sapiens
  Light chain CDR3 for antibody 3355 (IGKV1-9)
QQLKSYLYT

SEQ ID NO: 6710 - protein, 17 aa, Homo sapiens
  Heavy chain CDR3 for antibody 3355 (IGHV4-59)
ARDFLVRGEGSYYGMDV

SEQ ID NO: 6711 - protein, 9 aa, Homo sapiens
  Light chain CDR3 for antibody 3356 (IGKV3D-20)
QQYGSSPYT

SEQ ID NO: 6712 - protein, 19 aa, Homo sapiens
  Heavy chain CDR3 for antibody 3356 (IGHV3-33)
ARDRYYDILTGYSSYYFDY

SEQ ID NO: 6713 - protein, 9 aa, Homo sapiens
  Light chain CDR3 for antibody 3357 (IGKV1-39)
QQSYRTPLT

SEQ ID NO: 6714 - protein, 11 aa, Homo sapiens
  Heavy chain CDR3 for antibody 3357 (IGHV3-33)
AREGAVARFDY

SEQ ID NO: 6715 - protein, 9 aa, Homo sapiens
  Light chain CDR3 for antibody 3358 (IGKV5-2)
LQHDNFPYT

SEQ ID NO: 6716 - protein, 16 aa, Homo sapiens
  Heavy chain CDR3 for antibody 3358 (IGHV3-33)
ARDRGGMTMVRGGFDY

SEQ ID NO: 6717 - protein, 10 aa, Homo sapiens
  Light chain CDR3 for antibody 3359 (IGKV1-39)
QQSYSTPMYT

SEQ ID NO: 6718 - protein, 12 aa, Homo sapiens
  Heavy chain CDR3 for antibody 3359 (IGHV3-33)
ARESGGSYSFDY

SEQ ID NO: 6719 - protein, 9 aa, Homo sapiens
  Light chain CDR3 for antibody 3360 (IGKV1-9)
QQLISYPLT

SEQ ID NO: 6720 - protein, 13 aa, Homo sapiens
  Heavy chain CDR3 for antibody 3360 (IGHV3-23)
ARAFFMVRGVIDF

SEQ ID NO: 6721 - protein, 9 aa, Homo sapiens
  Light chain CDR3 for antibody 3361 (IGKV2-30)
MQGTHWPLT

SEQ ID NO: 6722 - protein, 10 aa, Homo sapiens
  Heavy chain CDR3 for antibody 3361 (IGHV3-23)
AKDHYGDYPY

SEQ ID NO: 6723 - protein, 8 aa, Homo sapiens
  Light chain CDR3 for antibody 3362 (IGKV3-11)
QQRSNWLT

SEQ ID NO: 6724 - protein, 11 aa, Homo sapiens
  Heavy chain CDR3 for antibody 3362 (IGHV3-33)
ARDRSSGPFDY

SEQ ID NO: 6725 - protein, 9 aa, Homo sapiens
  Light chain CDR3 for antibody 3363 (IGKV1-9)
QQLNSYPYT

SEQ ID NO: 6726 - protein, 15 aa, Homo sapiens
  Heavy chain CDR3 for antibody 3363 (IGHV3-74)
SRGSGSHYFYYGMDV

SEQ ID NO: 6727 - protein, 9 aa, Homo sapiens
  Light chain CDR3 for antibody 3364 (IGKV1-6)
LQDYNYPYT

SEQ ID NO: 6728 - protein, 10 aa, Homo sapiens
  Heavy chain CDR3 for antibody 3364 (IGHV3-33)
ARDHGYYFDY

SEQ ID NO: 6729 - protein, 9 aa, Homo sapiens
  Light chain CDR3 for antibody 3365 (IGKV3D-20)
QQYGSSPYT

SEQ ID NO: 6730 - protein, 15 aa, Homo sapiens
  Heavy chain CDR3 for antibody 3365 (IGHV3-33)
ARGGTGYYSYWYFDL

SEQ ID NO: 6731 - protein, 9 aa, Homo sapiens
  Light chain CDR3 for antibody 3366 (IGKV3-20)
QQYGSSPYT

SEQ ID NO: 6732 - protein, 18 aa, Homo sapiens
  Heavy chain CDR3 for antibody 3366 (IGHV3-33)
ARERGYYGSDIYPAAFDI

SEQ ID NO: 6733 - protein, 9 aa, Homo sapiens
  Light chain CDR3 for antibody 3367 (IGKV3-11)
QQRSNWPPT

SEQ ID NO: 6734 - protein, 11 aa, Homo sapiens
  Heavy chain CDR3 for antibody 3367 (IGHV3-33)
ARDILTGFLDH

SEQ ID NO: 6735 - protein, 9 aa, Homo sapiens
  Light chain CDR3 for antibody 3368 (IGKV6-21)
HQSSSLPYT

SEQ ID NO: 6736 - protein, 18 aa, Homo sapiens
  Heavy chain CDR3 for antibody 3368 (IGHV3-33)
VREGGYYGSGSYPDAFDI

SEQ ID NO: 6737 - protein, 10 aa, Homo sapiens
  Light chain CDR3 for antibody 3369 (IGKV3-11)
QQRSNWPMFT

SEQ ID NO: 6738 - protein, 12 aa, Homo sapiens
  Heavy chain CDR3 for antibody 3369 (IGHV1-24)
ASDWAYYYGMDV

SEQ ID NO: 6739 - protein, 9 aa, Homo sapiens
  Light chain CDR3 for antibody 3370 (IGKV1-17)
LQHNSYPYT

SEQ ID NO: 6740 - protein, 11 aa, Homo sapiens
  Heavy chain CDR3 for antibody 3370 (IGHV3-33)
ARDRATAGLDY

SEQ ID NO: 6741 - protein, 9 aa, Homo sapiens
  Light chain CDR3 for antibody 3371 (IGKV5-2)
LQHDNFPYT

SEQ ID NO: 6742 - protein, 15 aa, Homo sapiens
  Heavy chain CDR3 for antibody 3371 (IGHV3-23)
AKDLSSGWYAYFFDY

SEQ ID NO: 6743 - protein, 9 aa, Homo sapiens
  Light chain CDR3 for antibody 3372 (IGKV1-27)
QKYNSAPYT

SEQ ID NO: 6744 - protein, 15 aa, Homo sapiens
  Heavy chain CDR3 for antibody 3372 (IGHV3-74)
ARGSGSHYHYYGMDV

SEQ ID NO: 6745 - protein, 10 aa, Homo sapiens
  Light chain CDR3 for antibody 3373 (IGKV1-17)
LQHNSYPMYT

SEQ ID NO: 6746 - protein, 8 aa, Homo sapiens
  Heavy chain CDR3 for antibody 3373 (IGHV3-23)
AKETGNNY

SEQ ID NO: 6747 - protein, 9 aa, Homo sapiens
  Light chain CDR3 for antibody 3374 (IGKV1-6)
LQDYNYPYT

SEQ ID NO: 6748 - protein, 12 aa, Homo sapiens
  Heavy chain CDR3 for antibody 3374 (IGHV1-46)
ARRMVATNWFDP

SEQ ID NO: 6749 - protein, 9 aa, Homo sapiens
  Light chain CDR3 for antibody 3375 (IGKV6-21)
HQSSSLPYT

SEQ ID NO: 6750 - protein, 12 aa, Homo sapiens
  Heavy chain CDR3 for antibody 3375 (IGHV3-33)
ARDYGSGSFFDY

SEQ ID NO: 6751 - protein, 9 aa, Homo sapiens
  Light chain CDR3 for antibody 3376 (IGKV1D-16)
QQYNSYPYT

SEQ ID NO: 6752 - protein, 20 aa, Homo sapiens
  Heavy chain CDR3 for antibody 3376 (IGHV3-23)
TKDRYSDSSGYYLYYNDMDV

SEQ ID NO: 6753 - protein, 9 aa, Homo sapiens
  Light chain CDR3 for antibody 3377 (IGKV1-17)
LQHNSYPYT

SEQ ID NO: 6754 - protein, 13 aa, Homo sapiens
  Heavy chain CDR3 for antibody 3377 (IGHV1-18)
ARGGGVRGAPLDY

SEQ ID NO: 6755 - protein, 9 aa, Homo sapiens
  Light chain CDR3 for antibody 3378 (IGKV6-21)
HQSSSLPFT

SEQ ID NO: 6756 - protein, 19 aa, Homo sapiens
  Heavy chain CDR3 for antibody 3378 (IGHV4-39)
ARQGDVLRYFDWLLGAFDI

SEQ ID NO: 6757 - protein, 9 aa, Homo sapiens
  Light chain CDR3 for antibody 3379 (IGKV1-6)
LQDYNYPRT

SEQ ID NO: 6758 - protein, 13 aa, Homo sapiens
  Heavy chain CDR3 for antibody 3379 (IGHV4-39)
ARRDGSYYGYFGY

SEQ ID NO: 6759 - protein, 9 aa, Homo sapiens
  Light chain CDR3 for antibody 3380 (IGKV1-6)
LQDYKSPFT

SEQ ID NO: 6760 - protein, 12 aa, Homo sapiens
  Heavy chain CDR3 for antibody 3380 (IGHV3-33)
ARESGGSYSFDY

SEQ ID NO: 6761 - protein, 9 aa, Homo sapiens
  Light chain CDR3 for antibody 3381 (IGKV3-20)
QQYGSSPYT

SEQ ID NO: 6762 - protein, 13 aa, Homo sapiens
  Heavy chain CDR3 for antibody 3381 (IGHV3-21)
ARDSTLVRGVFPY

SEQ ID NO: 6763 - protein, 8 aa, Homo sapiens
  Light chain CDR3 for antibody 3382 (IGKV1-5)
QQYNSYWT

SEQ ID NO: 6764 - protein, 12 aa, Homo sapiens
  Heavy chain CDR3 for antibody 3382 (IGHV3-33)
AREKGGSYSFDY

SEQ ID NO: 6765 - protein, 9 aa, Homo sapiens
  Light chain CDR3 for antibody 3383 (IGKV5-2)
LQHDNFPWT

SEQ ID NO: 6766 - protein, 18 aa, Homo sapiens
  Heavy chain CDR3 for antibody 3383 (IGHV1-18)
ARDPNYYGSGSYYNYFDY

SEQ ID NO: 6767 - protein, 9 aa, Homo sapiens
  Light chain CDR3 for antibody 3384 (IGKV3-15)
QQYNNWPRT

SEQ ID NO: 6768 - protein, 12 aa, Homo sapiens
  Heavy chain CDR3 for antibody 3384 (IGHV3-13)
AREAGIPDAFDI

SEQ ID NO: 6769 - protein, 9 aa, Homo sapiens
  Light chain CDR3 for antibody 3385 (IGKV1-39)
QQSYSTPLT

SEQ ID NO: 6770 - protein, 18 aa, Homo sapiens
  Heavy chain CDR3 for antibody 3385 (IGHV3-33)
ARDEYYGSGIYYNYGMDV

SEQ ID NO: 6771 - protein, 9 aa, Homo sapiens
  Light chain CDR3 for antibody 3386 (IGKV1-33)
QQYDNLPFT

SEQ ID NO: 6772 - protein, 12 aa, Homo sapiens
  Heavy chain CDR3 for antibody 3386 (IGHV3-13)
VREAGIPDAFDI

SEQ ID NO: 6773 - protein, 9 aa, Homo sapiens
  Light chain CDR3 for antibody 3387 (IGKV1-6)
LQDYNYPWT

SEQ ID NO: 6774 - protein, 13 aa, Homo sapiens
  Heavy chain CDR3 for antibody 3387 (IGHV3-33)
ARDYGDYLNWFDP

SEQ ID NO: 6775 - protein, 10 aa, Homo sapiens
  Light chain CDR3 for antibody 3388 (IGKV1-17)
LQHNSYPMYT

SEQ ID NO: 6776 - protein, 12 aa, Homo sapiens
  Heavy chain CDR3 for antibody 3388 (IGHV3-33)
ARGYFGSGYAHF

SEQ ID NO: 6777 - protein, 9 aa, Homo sapiens
  Light chain CDR3 for antibody 3389 (IGKV1D-13)
QHFNNYMYT

SEQ ID NO: 6778 - protein, 14 aa, Homo sapiens
  Heavy chain CDR3 for antibody 3389 (IGHV4-39)
ARDSGYDYYYGMDV

SEQ ID NO: 6779 - protein, 9 aa, Homo sapiens
  Light chain CDR3 for antibody 3390 (IGKV1D-16)
QQYNSYPLT

SEQ ID NO: 6780 - protein, 15 aa, Homo sapiens
  Heavy chain CDR3 for antibody 3390 (IGHV3-23)
AKDRDYDFLSGPFDY

SEQ ID NO: 6781 - protein, 9 aa, Homo sapiens
  Light chain CDR3 for antibody 3391 (IGKV3-15)
QQYNNWPLT

SEQ ID NO: 6782 - protein, 13 aa, Homo sapiens
  Heavy chain CDR3 for antibody 3391 (IGHV3-11)
ARDEGYRGYVLDT

SEQ ID NO: 6783 - protein, 8 aa, Homo sapiens
  Light chain CDR3 for antibody 3392 (IGKV1-5)
QQYNSYWT

SEQ ID NO: 6784 - protein, 13 aa, Homo sapiens
  Heavy chain CDR3 for antibody 3392 (IGHV3-23)
ASTGDSYYYGMDV

SEQ ID NO: 6785 - protein, 9 aa, Homo sapiens
  Light chain CDR3 for antibody 3393 (IGKV3-11)
QQRSNWPPT

SEQ ID NO: 6786 - protein, 10 aa, Homo sapiens
  Heavy chain CDR3 for antibody 3393 (IGHV3-23)
AKDHYGDYPY

SEQ ID NO: 6787 - protein, 9 aa, Homo sapiens
  Light chain CDR3 for antibody 3394 (IGKV1-16)
QHYNDYPFT

SEQ ID NO: 6788 - protein, 15 aa, Homo sapiens
  Heavy chain CDR3 for antibody 3394 (IGHV3-30)
ARGAMVRGVDYGMDV

SEQ ID NO: 6789 - protein, 9 aa, Homo sapiens
  Light chain CDR3 for antibody 3395 (IGKV1-27)
QKYNSAPYT

SEQ ID NO: 6790 - protein, 9 aa, Homo sapiens
  Heavy chain CDR3 for antibody 3395 (IGHV4-59)
AREGGSGSL

SEQ ID NO: 6791 - protein, 9 aa, Homo sapiens
  Light chain CDR3 for antibody 3396 (IGKV5-2)
LQHDNFPYT

SEQ ID NO: 6792 - protein, 18 aa, Homo sapiens
  Heavy chain CDR3 for antibody 3396 (IGHV3-33)
ARGGYDILTGYYRTGMDV

SEQ ID NO: 6793 - protein, 10 aa, Homo sapiens
  Light chain CDR3 for antibody 3397 (IGKV1-39)
QQSYSTPMYT

SEQ ID NO: 6794 - protein, 13 aa, Homo sapiens
  Heavy chain CDR3 for antibody 3397 (IGHV3-53)
ARSGSYWGYYFDY

SEQ ID NO: 6795 - protein, 9 aa, Homo sapiens
  Light chain CDR3 for antibody 3398 (IGKV6-21)
HQSSSLPYT

SEQ ID NO: 6796 - protein, 14 aa, Homo sapiens
  Heavy chain CDR3 for antibody 3398 (IGHV4-59)
AKGGSGSYYNWFDP

SEQ ID NO: 6797 - protein, 9 aa, Homo sapiens
  Light chain CDR3 for antibody 3399 (IGKV1-6)
LQDYNYPRT

SEQ ID NO: 6798 - protein, 10 aa, Homo sapiens
  Heavy chain CDR3 for antibody 3399 (IGHV4-59)
VSSGTSLLAY

SEQ ID NO: 6799 - protein, 9 aa, Homo sapiens
  Light chain CDR3 for antibody 3400 (IGKV1-27)
QKYNSAPYT

SEQ ID NO: 6800 - protein, 10 aa, Homo sapiens
  Heavy chain CDR3 for antibody 3400 (IGHV3-30)
ARDGLESFDY

SEQ ID NO: 6801 - protein, 9 aa, Homo sapiens
  Light chain CDR3 for antibody 3401 (IGKV1-9)
QQLKSYLYT

SEQ ID NO: 6802 - protein, 13 aa, Homo sapiens
  Heavy chain CDR3 for antibody 3401 (IGHV4-34)
ASNFYYYYYGMDV

SEQ ID NO: 6803 - protein, 9 aa, Homo sapiens
  Light chain CDR3 for antibody 3402 (IGKV1-17)
LQHNSYPWT

SEQ ID NO: 6804 - protein, 14 aa, Homo sapiens
  Heavy chain CDR3 for antibody 3402 (IGHV3-33)
ARDAYDILTGYYDY

SEQ ID NO: 6805 - protein, 9 aa, Homo sapiens
  Light chain CDR3 for antibody 3403 (IGKV1D-16)
QQYNSYPYT

SEQ ID NO: 6806 - protein, 18 aa, Homo sapiens
  Heavy chain CDR3 for antibody 3403 (IGHV3-23)
AKDGDYFGSGSYWGYFDL

SEQ ID NO: 6807 - protein, 9 aa, Homo sapiens
  Light chain CDR3 for antibody 3404 (IGKV1-17)
LQHNSYPYT

SEQ ID NO: 6808 - protein, 15 aa, Homo sapiens
  Heavy chain CDR3 for antibody 3404 (IGHV3-33)
ARERYSSAWSSGMDV

SEQ ID NO: 6809 - protein, 9 aa, Homo sapiens
  Light chain CDR3 for antibody 3405 (IGKV5-2)
LQHDNFPWT

SEQ ID NO: 6810 - protein, 20 aa, Homo sapiens
  Heavy chain CDR3 for antibody 3405 (IGHV4-59)
ARDRGYDILTGYYGYYGMDV

SEQ ID NO: 6811 - protein, 9 aa, Homo sapiens
  Light chain CDR3 for antibody 3406 (IGKV1-39)
QQSYSTPLT

SEQ ID NO: 6812 - protein, 12 aa, Homo sapiens
  Heavy chain CDR3 for antibody 3406 (IGHV3-13)
ARDRGYSGYFDY

SEQ ID NO: 6813 - protein, 10 aa, Homo sapiens
  Light chain CDR3 for antibody 3407 (IGKV1-9)
QQLDSYPMYT

SEQ ID NO: 6814 - protein, 12 aa, Homo sapiens
  Heavy chain CDR3 for antibody 3407 (IGHV3-13)
AREAGIPDAFDI

SEQ ID NO: 6815 - protein, 9 aa, Homo sapiens
  Light chain CDR3 for antibody 3408 (IGKV3-20)
QQYGSSPYT

SEQ ID NO: 6816 - protein, 18 aa, Homo sapiens
  Heavy chain CDR3 for antibody 3408 (IGHV1-46)
ARDGDYVWGSYRSNWFDP

SEQ ID NO: 6817 - protein, 8 aa, Homo sapiens
  Light chain CDR3 for antibody 3409 (IGKV3D-7)
QQDYNLLT

SEQ ID NO: 6818 - protein, 12 aa, Homo sapiens
  Heavy chain CDR3 for antibody 3409 (IGHV3-33)
ARDLVGATPFDY

SEQ ID NO: 6819 - protein, 9 aa, Homo sapiens
  Light chain CDR3 for antibody 3410 (IGKV1-17)
LQHNSYPYT

SEQ ID NO: 6820 - protein, 16 aa, Homo sapiens
  Heavy chain CDR3 for antibody 3410 (IGHV3-33)
ARGANYYGSGIPNFEY

SEQ ID NO: 6821 - protein, 9 aa, Homo sapiens
  Light chain CDR3 for antibody 3411 (IGKV1-6)
LQDFNYPRT

SEQ ID NO: 6822 - protein, 13 aa, Homo sapiens
  Heavy chain CDR3 for antibody 3411 (IGHV4-59)
ARDAGYSSSWFDY

SEQ ID NO: 6823 - protein, 9 aa, Homo sapiens
  Light chain CDR3 for antibody 3412 (IGKV1-17)
LQHNSYPYT

SEQ ID NO: 6824 - protein, 9 aa, Homo sapiens
  Heavy chain CDR3 for antibody 3412 (IGHV3-30)
VRDDYGVDV

SEQ ID NO: 6825 - protein, 9 aa, Homo sapiens
  Light chain CDR3 for antibody 3413 (IGKV1-9)
QQLISYPLT

SEQ ID NO: 6826 - protein, 15 aa, Homo sapiens
  Heavy chain CDR3 for antibody 3413 (IGHV3-20)
ARDRGSSGWRDWFDP

SEQ ID NO: 6827 - protein, 9 aa, Homo sapiens
  Light chain CDR3 for antibody 3414 (IGKV6-21)
HQSSSLPYT

SEQ ID NO: 6828 - protein, 13 aa, Homo sapiens
  Heavy chain CDR3 for antibody 3414 (IGHV1-24)
ATGYSINWYEFDY

SEQ ID NO: 6829 - protein, 9 aa, Homo sapiens
  Light chain CDR3 for antibody 3415 (IGKV1D-13)
QQFNNYPYT

SEQ ID NO: 6830 - protein, 26 aa, Homo sapiens
  Heavy chain CDR3 for antibody 3415 (IGHV4-39)
ARQGLLWFGDLKAYDSSGYYYGYFHH

SEQ ID NO: 6831 - protein, 9 aa, Homo sapiens
  Light chain CDR3 for antibody 3416 (IGKV5-2)
LQHDNFPYT

SEQ ID NO: 6832 - protein, 15 aa, Homo sapiens
  Heavy chain CDR3 for antibody 3416 (IGHV3-23)
AKDRNYDFLTGPFDP

SEQ ID NO: 6833 - protein, 9 aa, Homo sapiens
  Light chain CDR3 for antibody 3417 (IGKV3-15)
QQYNNWPLT

SEQ ID NO: 6834 - protein, 13 aa, Homo sapiens
  Heavy chain CDR3 for antibody 3417 (IGHV4-39)
ARHHYGSGSLRDY

SEQ ID NO: 6835 - protein, 9 aa, Homo sapiens
  Light chain CDR3 for antibody 3418 (IGKV1D-16)
QQYNSYPLT

SEQ ID NO: 6836 - protein, 17 aa, Homo sapiens
  Heavy chain CDR3 for antibody 3418 (IGHV3-15)
TTERYPRRYYYYFGMDV

SEQ ID NO: 6837 - protein, 9 aa, Homo sapiens
  Light chain CDR3 for antibody 3419 (IGKV1-6)
LQDYNYPRT

SEQ ID NO: 6838 - protein, 17 aa, Homo sapiens
  Heavy chain CDR3 for antibody 3419 (IGHV3-13)
AREGWFGELWGYYGMDV

SEQ ID NO: 6839 - protein, 9 aa, Homo sapiens
  Light chain CDR3 for antibody 3420 (IGKV1-9)
QQGNTYSRT

SEQ ID NO: 6840 - protein, 11 aa, Homo sapiens
  Heavy chain CDR3 for antibody 3420 (IGHV4-4)
AREMGHDTFDI

SEQ ID NO: 6841 - protein, 9 aa, Homo sapiens
  Light chain CDR3 for antibody 3421 (IGKV1D-16)
QQYNSYPFT

SEQ ID NO: 6842 - protein, 12 aa, Homo sapiens
  Heavy chain CDR3 for antibody 3421 (IGHV1-46)
ARGLIGDHAVDI

SEQ ID NO: 6843 - protein, 9 aa, Homo sapiens
  Light chain CDR3 for antibody 3422 (IGKV1-17)
LQHNSYPWT

SEQ ID NO: 6844 - protein, 17 aa, Homo sapiens
  Heavy chain CDR3 for antibody 3422 (IGHV3-15)
TTERYPRRYYYYFGMDV

SEQ ID NO: 6845 - protein, 9 aa, Homo sapiens
  Light chain CDR3 for antibody 3423 (IGKV1-39)
QQSYSTPFT

SEQ ID NO: 6846 - protein, 14 aa, Homo sapiens
  Heavy chain CDR3 for antibody 3423 (IGHV3-33)
ARASSGSSYWYFDL

SEQ ID NO: 6847 - protein, 9 aa, Homo sapiens
  Light chain CDR3 for antibody 3424 (IGKV2-30)
MQGTHWPLT

SEQ ID NO: 6848 - protein, 15 aa, Homo sapiens
  Heavy chain CDR3 for antibody 3424 (IGHV4-59)
ARDLGHYYGSVSIDY

SEQ ID NO: 6849 - protein, 9 aa, Homo sapiens
  Light chain CDR3 for antibody 3425 (IGKV1-39)
QQSYSTPLT

SEQ ID NO: 6850 - protein, 13 aa, Homo sapiens
  Heavy chain CDR3 for antibody 3425 (IGHV3-33)
ARIDYYSYYGMDV

SEQ ID NO: 6851 - protein, 8 aa, Homo sapiens
  Light chain CDR3 for antibody 3426 (IGKV1-5)
QQYNSYWT

SEQ ID NO: 6852 - protein, 12 aa, Homo sapiens
  Heavy chain CDR3 for antibody 3426 (IGHV3-33)
ARDLVGATPFDY

SEQ ID NO: 6853 - protein, 9 aa, Homo sapiens
  Light chain CDR3 for antibody 3427 (IGKV1-6)
LQDYNYPWT

SEQ ID NO: 6854 - protein, 12 aa, Homo sapiens
  Heavy chain CDR3 for antibody 3427 (IGHV3-21)
AREGFGESSFDY

SEQ ID NO: 6855 - protein, 9 aa, Homo sapiens
  Light chain CDR3 for antibody 3428 (IGKV1D-16)
QQYNSYPLT

SEQ ID NO: 6856 - protein, 10 aa, Homo sapiens
  Heavy chain CDR3 for antibody 3428 (IGHV3-33)
ARDLGWSFDF

SEQ ID NO: 6857 - protein, 9 aa, Homo sapiens
  Light chain CDR3 for antibody 3429 (IGKV1D-13)
QQFNNYPHT

SEQ ID NO: 6858 - protein, 17 aa, Homo sapiens
  Heavy chain CDR3 for antibody 3429 (IGHV3-33)
ARVRGVIEGYYYYGMDV

SEQ ID NO: 6859 - protein, 8 aa, Homo sapiens
  Light chain CDR3 for antibody 3430 (IGKV1-5)
QQYNSYWT

SEQ ID NO: 6860 - protein, 13 aa, Homo sapiens
  Heavy chain CDR3 for antibody 3430 (IGHV3-53)
ARSGSYWGYYFDY

SEQ ID NO: 6861 - protein, 9 aa, Homo sapiens
  Light chain CDR3 for antibody 3431 (IGKV6-21)
HQSYSLPHT

SEQ ID NO: 6862 - protein, 12 aa, Homo sapiens
  Heavy chain CDR3 for antibody 3431 (IGHV3-33)
AREKGGSYSFDY

SEQ ID NO: 6863 - protein, 9 aa, Homo sapiens
  Light chain CDR3 for antibody 3432 (IGKV6-21)
HQSSSLPLT

SEQ ID NO: 6864 - protein, 16 aa, Homo sapiens
  Heavy chain CDR3 for antibody 3432 (IGHV1-24)
ATEDSSSYYYYYGMDV

SEQ ID NO: 6865 - protein, 10 aa, Homo sapiens
  Light chain CDR3 for antibody 3433 (IGKV3-11)
QQRSNWPPFT

SEQ ID NO: 6866 - protein, 13 aa, Homo sapiens
  Heavy chain CDR3 for antibody 3433 (IGHV3-23)
AKEDGDYHHYFDY

SEQ ID NO: 6867 - protein, 9 aa, Homo sapiens
  Light chain CDR3 for antibody 3434 (IGKV1-6)
LQDYNYPYT

SEQ ID NO: 6868 - protein, 10 aa, Homo sapiens
  Heavy chain CDR3 for antibody 3434 (IGHV1-46)
AREWELLFDY

SEQ ID NO: 6869 - protein, 9 aa, Homo sapiens
  Light chain CDR3 for antibody 3435 (IGKV1-39)
QQSYRTPLT

SEQ ID NO: 6870 - protein, 17 aa, Homo sapiens
  Heavy chain CDR3 for antibody 3435 (IGHV3-33)
ARSGIVGATDYYYGLDV

SEQ ID NO: 6871 - protein, 9 aa, Homo sapiens
  Light chain CDR3 for antibody 3436 (IGKV3D-7)
QQDYNLPYT

SEQ ID NO: 6872 - protein, 23 aa, Homo sapiens
  Heavy chain CDR3 for antibody 3436 (IGHV4-59)
ARERTYSDILPGYYEDYYYGMDV

SEQ ID NO: 6873 - protein, 9 aa, Homo sapiens
  Light chain CDR3 for antibody 3437 (IGKV5-2)
LQHDNFPYT

SEQ ID NO: 6874 - protein, 13 aa, Homo sapiens
  Heavy chain CDR3 for antibody 3437 (IGHV3-33)
AREYFDWLLPLDY

SEQ ID NO: 6875 - protein, 8 aa, Homo sapiens
  Light chain CDR3 for antibody 3438 (IGKV3D-7)
QQDYNLLT

SEQ ID NO: 6876 - protein, 13 aa, Homo sapiens
  Heavy chain CDR3 for antibody 3438 (IGHV3-33)
ARGDNWNDGGFDY

SEQ ID NO: 6877 - protein, 9 aa, Homo sapiens
  Light chain CDR3 for antibody 3439 (IGKV1-17)
LQHNSYPWT

SEQ ID NO: 6878 - protein, 17 aa, Homo sapiens
  Heavy chain CDR3 for antibody 3439 (IGHV3-33)
ARENDILTGSYYYGMDV

SEQ ID NO: 6879 - protein, 9 aa, Homo sapiens
  Light chain CDR3 for antibody 3440 (IGKV1-9)
QQLNSYPYT

SEQ ID NO: 6880 - protein, 17 aa, Homo sapiens
  Heavy chain CDR3 for antibody 3440 (IGHV3-23)
SKERNWNDGYYYFGMDA

SEQ ID NO: 6881 - protein, 9 aa, Homo sapiens
  Light chain CDR3 for antibody 3441 (IGKV1D-13)
QQFNNYPHT

SEQ ID NO: 6882 - protein, 8 aa, Homo sapiens
  Heavy chain CDR3 for antibody 3441 (IGHV3-23)
AKESLLDY

SEQ ID NO: 6883 - protein, 9 aa, Homo sapiens
  Light chain CDR3 for antibody 3442 (IGKV3-11)
QQRSNWPYT

SEQ ID NO: 6884 - protein, 16 aa, Homo sapiens
  Heavy chain CDR3 for antibody 3442 (IGHV1-24)
ATEDSSSTYYYYGLDV

SEQ ID NO: 6885 - protein, 9 aa, Homo sapiens
  Light chain CDR3 for antibody 3443 (IGKV1-17)
LQHNSYPYT

SEQ ID NO: 6886 - protein, 18 aa, Homo sapiens
  Heavy chain CDR3 for antibody 3443 (IGHV1-18)
ARDDILTGYSLYYYGMDV

SEQ ID NO: 6887 - protein, 9 aa, Homo sapiens
  Light chain CDR3 for antibody 3444 (IGKV3D-7)
QQDYNLPWT

SEQ ID NO: 6888 - protein, 9 aa, Homo sapiens
  Heavy chain CDR3 for antibody 3444 (IGHV3-13)
ARDRWYFDL

SEQ ID NO: 6889 - protein, 9 aa, Homo sapiens
  Light chain CDR3 for antibody 3445 (IGKV1-39)
QQSYSTPLT

SEQ ID NO: 6890 - protein, 18 aa, Homo sapiens
  Heavy chain CDR3 for antibody 3445 (IGHV3-33)
ARGGYSSGWDYYYYGMDV

SEQ ID NO: 6891 - protein, 9 aa, Homo sapiens
  Light chain CDR3 for antibody 3446 (IGKV3-20)
QQYGSSPYT

SEQ ID NO: 6892 - protein, 16 aa, Homo sapiens
  Heavy chain CDR3 for antibody 3446 (IGHV3-33)
ARDNFGSGSYYSHFHY

SEQ ID NO: 6893 - protein, 10 aa, Homo sapiens
  Light chain CDR3 for antibody 3447 (IGKV1-17)
LQHNSYPMYT

SEQ ID NO: 6894 - protein, 14 aa, Homo sapiens
  Heavy chain CDR3 for antibody 3447 (IGHV3-33)
ARDRIAAASSDFDC

SEQ ID NO: 6895 - protein, 9 aa, Homo sapiens
  Light chain CDR3 for antibody 3448 (IGKV1D-13)
QQFNNYPHT

SEQ ID NO: 6896 - protein, 16 aa, Homo sapiens
  Heavy chain CDR3 for antibody 3448 (IGHV3-30)
ARDIAVAGHVYYGMDV

SEQ ID NO: 6897 - protein, 9 aa, Homo sapiens
  Light chain CDR3 for antibody 3449 (IGKV5-2)
LQHDNFPWT

SEQ ID NO: 6898 - protein, 13 aa, Homo sapiens
  Heavy chain CDR3 for antibody 3449 (IGHV4-39)
ARPGIVAAGWFDP

SEQ ID NO: 6899 - protein, 9 aa, Homo sapiens
  Light chain CDR3 for antibody 3450 (IGKV3D-7)
QQDYNLPLT

SEQ ID NO: 6900 - protein, 17 aa, Homo sapiens
  Heavy chain CDR3 for antibody 3450 (IGHV1-18)
ARERYYGSGNYKYNMDV

SEQ ID NO: 6901 - protein, 9 aa, Homo sapiens
  Light chain CDR3 for antibody 3451 (IGKV2-30)
MQGTHWPLT

SEQ ID NO: 6902 - protein, 10 aa, Homo sapiens
  Heavy chain CDR3 for antibody 3451 (IGHV3-33)
ARDGSGSQPI

SEQ ID NO: 6903 - protein, 9 aa, Homo sapiens
  Light chain CDR3 for antibody 3452 (IGKV1-6)
LQDNNYPWT

SEQ ID NO: 6904 - protein, 11 aa, Homo sapiens
  Heavy chain CDR3 for antibody 3452 (IGHV4-61)
AREMGHDIFDI

SEQ ID NO: 6905 - protein, 9 aa, Homo sapiens
  Light chain CDR3 for antibody 3453 (IGKV1-39)
QQSYSTPLT

SEQ ID NO: 6906 - protein, 17 aa, Homo sapiens
  Heavy chain CDR3 for antibody 3453 (IGHV1-24)
ATEGYDILPGYYNVLDY

SEQ ID NO: 6907 - protein, 9 aa, Homo sapiens
  Light chain CDR3 for antibody 3454 (IGKV1-16)
QQYNSYPYT

SEQ ID NO: 6908 - protein, 8 aa, Homo sapiens
  Heavy chain CDR3 for antibody 3454 (IGHV4-39)
ARRGGLDY

SEQ ID NO: 6909 - protein, 9 aa, Homo sapiens
  Light chain CDR3 for antibody 3455 (IGKV3D-7)
QQDYNLPLT

SEQ ID NO: 6910 - protein, 13 aa, Homo sapiens
  Heavy chain CDR3 for antibody 3455 (IGHV3-33)
ARTDYYFYYGLDV

SEQ ID NO: 6911 - protein, 9 aa, Homo sapiens
  Light chain CDR3 for antibody 3456 (IGKV3D-7)
QQDYEFPLT

SEQ ID NO: 6912 - protein, 17 aa, Homo sapiens
  Heavy chain CDR3 for antibody 3456 (IGHV4-59)
ARRITMVREIIITAFDY

SEQ ID NO: 6913 - protein, 10 aa, Homo sapiens
  Light chain CDR3 for antibody 3457 (IGKV3-11)
QQRSNWPIFT

SEQ ID NO: 6914 - protein, 15 aa, Homo sapiens
  Heavy chain CDR3 for antibody 3457 (IGHV3-33)
ARDHLTGYYYYGMDV

SEQ ID NO: 6915 - protein, 9 aa, Homo sapiens
  Light chain CDR3 for antibody 3458 (IGKV1D-13)
QQFNNYPHT

SEQ ID NO: 6916 - protein, 15 aa, Homo sapiens
  Heavy chain CDR3 for antibody 3458 (IGHV4-39)
ARRDYDILTGYLFDY

SEQ ID NO: 6917 - protein, 9 aa, Homo sapiens
  Light chain CDR3 for antibody 3459 (IGKV1-9)
QQLISYPLT

SEQ ID NO: 6918 - protein, 9 aa, Homo sapiens
  Heavy chain CDR3 for antibody 3459 (IGHV3-30)
ARDYFHYDY

SEQ ID NO: 6919 - protein, 9 aa, Homo sapiens
  Light chain CDR3 for antibody 3460 (IGKV2-30)
MQGTHWPLT

SEQ ID NO: 6920 - protein, 21 aa, Homo sapiens
  Heavy chain CDR3 for antibody 3460 (IGHV3-33)
ARKRLYDILTGYYKAYYGMDV

SEQ ID NO: 6921 - protein, 9 aa, Homo sapiens
  Light chain CDR3 for antibody 3461 (IGKV3-11)
QQRSNWMYT

SEQ ID NO: 6922 - protein, 21 aa, Homo sapiens
  Heavy chain CDR3 for antibody 3461 (IGHV3-23)
AKDIDYYGSGSYPLYYYGMDV

SEQ ID NO: 6923 - protein, 8 aa, Homo sapiens
  Light chain CDR3 for antibody 3462 (IGKV1-5)
QQYNSYYT

SEQ ID NO: 6924 - protein, 11 aa, Homo sapiens
  Heavy chain CDR3 for antibody 3462 (IGHV3-33)
ARDRVLTPFDY

SEQ ID NO: 6925 - protein, 9 aa, Homo sapiens
  Light chain CDR3 for antibody 3463 (IGKV5-2)
LQHDNFPYT

SEQ ID NO: 6926 - protein, 13 aa, Homo sapiens
  Heavy chain CDR3 for antibody 3463 (IGHV3-33)
ARALYSSSWPGDY

SEQ ID NO: 6927 - protein, 9 aa, Homo sapiens
  Light chain CDR3 for antibody 3464 (IGKV6-21)
HQSSSLPYT

SEQ ID NO: 6928 - protein, 8 aa, Homo sapiens
  Heavy chain CDR3 for antibody 3464 (IGHV3-20)
APHWIFDY

SEQ ID NO: 6929 - protein, 9 aa, Homo sapiens
  Light chain CDR3 for antibody 3465 (IGKV1D-16)
QQYNSYPYT

SEQ ID NO: 6930 - protein, 16 aa, Homo sapiens
  Heavy chain CDR3 for antibody 3465 (IGHV3-33)
ARPTYYDILTGYPFDY

SEQ ID NO: 6931 - protein, 9 aa, Homo sapiens
  Light chain CDR3 for antibody 3466 (IGKV6-21)
HQSTSLPFT

SEQ ID NO: 6932 - protein, 11 aa, Homo sapiens
  Heavy chain CDR3 for antibody 3466 (IGHV4-59)
AREMGHDIFDI

SEQ ID NO: 6933 - protein, 9 aa, Homo sapiens
  Light chain CDR3 for antibody 3467 (IGKV6-21)
HQSSSLPLT

SEQ ID NO: 6934 - protein, 13 aa, Homo sapiens
  Heavy chain CDR3 for antibody 3467 (IGHV1-24)
ATPGSGSYYNVDY

SEQ ID NO: 6935 - protein, 9 aa, Homo sapiens
  Light chain CDR3 for antibody 3468 (IGKV1D-13)
QQFNNYPHT

SEQ ID NO: 6936 - protein, 13 aa, Homo sapiens
  Heavy chain CDR3 for antibody 3468 (IGHV4-61)
ASRYSSGWYPFDY

SEQ ID NO: 6937 - protein, 9 aa, Homo sapiens
  Light chain CDR3 for antibody 3469 (IGKV1-5)
QQYNSYPYT

SEQ ID NO: 6938 - protein, 12 aa, Homo sapiens
  Heavy chain CDR3 for antibody 3469 (IGHV4-39)
ARQMVREGWFDP

SEQ ID NO: 6939 - protein, 9 aa, Homo sapiens
  Light chain CDR3 for antibody 3470 (IGKV1-17)
LQHNSYPYT

SEQ ID NO: 6940 - protein, 16 aa, Homo sapiens
  Heavy chain CDR3 for antibody 3470 (IGHV3-33)
ARIAAPGSEYYYGMDV

SEQ ID NO: 6941 - protein, 9 aa, Homo sapiens
  Light chain CDR3 for antibody 3471 (IGKV5-2)
LQHDKFPYT

SEQ ID NO: 6942 - protein, 17 aa, Homo sapiens
  Heavy chain CDR3 for antibody 3471 (IGHV3-33)
ARENDILTGSYYYGMDV

SEQ ID NO: 6943 - protein, 9 aa, Homo sapiens
  Light chain CDR3 for antibody 3472 (IGKV2D-24)
TQATQFPHT

SEQ ID NO: 6944 - protein, 13 aa, Homo sapiens
  Heavy chain CDR3 for antibody 3472 (IGHV4-59)
ARDAGYSSSWFDY

SEQ ID NO: 6945 - protein, 9 aa, Homo sapiens
  Light chain CDR3 for antibody 3473 (IGKV3-15)
QQYNNWPLT

SEQ ID NO: 6946 - protein, 15 aa, Homo sapiens
  Heavy chain CDR3 for antibody 3473 (IGHV3-33)
ARDRGWKAPGYGMDV

SEQ ID NO: 6947 - protein, 9 aa, Homo sapiens
  Light chain CDR3 for antibody 3474 (IGKV1-17)
LQHNSYPLT

SEQ ID NO: 6948 - protein, 12 aa, Homo sapiens
  Heavy chain CDR3 for antibody 3474 (IGHV3-23)
AKEGLGSDYEPY

SEQ ID NO: 6949 - protein, 9 aa, Homo sapiens
  Light chain CDR3 for antibody 3475 (IGKV1D-13)
QQFNNYPYT

SEQ ID NO: 6950 - protein, 18 aa, Homo sapiens
  Heavy chain CDR3 for antibody 3475 (IGHV3-33)
ARDQGIVVLPGAPWYFDL

SEQ ID NO: 6951 - protein, 9 aa, Homo sapiens
  Light chain CDR3 for antibody 3476 (IGKV6-21)
HQSSSLPYT

SEQ ID NO: 6952 - protein, 18 aa, Homo sapiens
  Heavy chain CDR3 for antibody 3476 (IGHV3-23)
AKPDYYGSGSYYNVPFDY

SEQ ID NO: 6953 - protein, 9 aa, Homo sapiens
  Light chain CDR3 for antibody 3477 (IGKV3-15)
QQYNNWPLT

SEQ ID NO: 6954 - protein, 14 aa, Homo sapiens
  Heavy chain CDR3 for antibody 3477 (IGHV3-33)
ARDREQQLVRYFDY

SEQ ID NO: 6955 - protein, 10 aa, Homo sapiens
  Light chain CDR3 for antibody 3478 (IGKV3-11)
QQRSNWPIFT

SEQ ID NO: 6956 - protein, 18 aa, Homo sapiens
  Heavy chain CDR3 for antibody 3478 (IGHV3-33)
ARDGYSGYDYYYYYGMDV

SEQ ID NO: 6957 - protein, 9 aa, Homo sapiens
  Light chain CDR3 for antibody 3479 (IGKV3D-20)
QQYGSSPRT

SEQ ID NO: 6958 - protein, 14 aa, Homo sapiens
  Heavy chain CDR3 for antibody 3479 (IGHV1-24)
ATDRSSYYYYGMDV

SEQ ID NO: 6959 - protein, 8 aa, Homo sapiens
  Light chain CDR3 for antibody 3480 (IGKV3D-7)
QQDYNLLT

SEQ ID NO: 6960 - protein, 18 aa, Homo sapiens
  Heavy chain CDR3 for antibody 3480 (IGHV3-33)
ARDGYSGYDYYYYYGMDV

SEQ ID NO: 6961 - protein, 9 aa, Homo sapiens
  Light chain CDR3 for antibody 3481 (IGKV3-11)
QQRSNWPLT

SEQ ID NO: 6962 - protein, 14 aa, Homo sapiens
  Heavy chain CDR3 for antibody 3481 (IGHV3-33)
ARQYSYGYPYYFDY

SEQ ID NO: 6963 - protein, 8 aa, Homo sapiens
  Light chain CDR3 for antibody 3482 (IGKV3D-7)
QQDYNLLT

SEQ ID NO: 6964 - protein, 13 aa, Homo sapiens
  Heavy chain CDR3 for antibody 3482 (IGHV3-33)
ARVDTMVRGVMAY

SEQ ID NO: 6965 - protein, 9 aa, Homo sapiens
  Light chain CDR3 for antibody 3483 (IGKV1-27)
QKYNSAPYT

SEQ ID NO: 6966 - protein, 18 aa, Homo sapiens
  Heavy chain CDR3 for antibody 3483 (IGHV3-33)
ARDQGIVVLPGAPWYFDP

SEQ ID NO: 6967 - protein, 9 aa, Homo sapiens
  Light chain CDR3 for antibody 3484 (IGKV3-15)
QQYNNWPLT

SEQ ID NO: 6968 - protein, 13 aa, Homo sapiens
  Heavy chain CDR3 for antibody 3484 (IGHV4-28)
ARKGATGYYGMDV

SEQ ID NO: 6969 - protein, 9 aa, Homo sapiens
  Light chain CDR3 for antibody 3485 (IGKV1-17)
LQHNSYPYT

SEQ ID NO: 6970 - protein, 15 aa, Homo sapiens
  Heavy chain CDR3 for antibody 3485 (IGHV3-23)
AKDPRGYYYYYGMDV

SEQ ID NO: 6971 - protein, 9 aa, Homo sapiens
  Light chain CDR3 for antibody 3486 (IGKV1-6)
LQDYNYPWT

SEQ ID NO: 6972 - protein, 16 aa, Homo sapiens
  Heavy chain CDR3 for antibody 3486 (IGHV3-23)
AKYYDILTGYYELLDY

SEQ ID NO: 6973 - protein, 9 aa, Homo sapiens
  Light chain CDR3 for antibody 3487 (IGKV1-39)
QQSYRTPLT

SEQ ID NO: 6974 - protein, 13 aa, Homo sapiens
  Heavy chain CDR3 for antibody 3487 (IGHV3-21)
ARDSTLVRGVFPY

SEQ ID NO: 6975 - protein, 10 aa, Homo sapiens
  Light chain CDR3 for antibody 3488 (IGKV3-11)
QQRSNWPIFT

SEQ ID NO: 6976 - protein, 13 aa, Homo sapiens
  Heavy chain CDR3 for antibody 3488 (IGHV3-33)
ARTDYYFYYGLDV

SEQ ID NO: 6977 - protein, 9 aa, Homo sapiens
  Light chain CDR3 for antibody 3489 (IGKV5-2)
LQHDNFPWT

SEQ ID NO: 6978 - protein, 14 aa, Homo sapiens
  Heavy chain CDR3 for antibody 3489 (IGHV4-39)
ARQGGWYLYWYFDL

SEQ ID NO: 6979 - protein, 9 aa, Homo sapiens
  Light chain CDR3 for antibody 3490 (IGKV1-6)
LQDFNYPRT

SEQ ID NO: 6980 - protein, 12 aa, Homo sapiens
  Heavy chain CDR3 for antibody 3490 (IGHV1-46)
ARGLTGDHAFDI

SEQ ID NO: 6981 - protein, 9 aa, Homo sapiens
  Light chain CDR3 for antibody 3491 (IGKV1-16)
QQYNSYPLT

SEQ ID NO: 6982 - protein, 16 aa, Homo sapiens
  Heavy chain CDR3 for antibody 3491 (IGHV3-33)
AREMAGSYYYYYGMDV

SEQ ID NO: 6983 - protein, 9 aa, Homo sapiens
  Light chain CDR3 for antibody 3492 (IGKV3-15)
QQYNNWPYT

SEQ ID NO: 6984 - protein, 15 aa, Homo sapiens
  Heavy chain CDR3 for antibody 3492 (IGHV3-23)
AKDGSYYDYYYGMDV

SEQ ID NO: 6985 - protein, 9 aa, Homo sapiens
  Light chain CDR3 for antibody 3493 (IGKV6-21)
HQSSSLPYT

SEQ ID NO: 6986 - protein, 18 aa, Homo sapiens
  Heavy chain CDR3 for antibody 3493 (IGHV3-33)
ARGYNQGSGSYYNVCFDY

SEQ ID NO: 6987 - protein, 11 aa, Homo sapiens
  Light chain CDR3 for antibody 3494 (IGKV3-11)
QQRSNWPPTWT

SEQ ID NO: 6988 - protein, 15 aa, Homo sapiens
  Heavy chain CDR3 for antibody 3494 (IGHV4-59)
ARDLGHYYGSVSIDY

SEQ ID NO: 6989 - protein, 9 aa, Homo sapiens
  Light chain CDR3 for antibody 3495 (IGKV5-2)
LQHDNFPYT

SEQ ID NO: 6990 - protein, 14 aa, Homo sapiens
  Heavy chain CDR3 for antibody 3495 (IGHV3-20)
AREGWFGDYYGMDV

SEQ ID NO: 6991 - protein, 9 aa, Homo sapiens
  Light chain CDR3 for antibody 3496 (IGKV3D-7)
QQDYEFPLT

SEQ ID NO: 6992 - protein, 12 aa, Homo sapiens
  Heavy chain CDR3 for antibody 3496 (IGHV4-39)
ARHGSGSSYFDY

SEQ ID NO: 6993 - protein, 9 aa, Homo sapiens
  Light chain CDR3 for antibody 3497 (IGKV1-39)
QQSYSTPLT

SEQ ID NO: 6994 - protein, 17 aa, Homo sapiens
  Heavy chain CDR3 for antibody 3497 (IGHV3-23)
AKEYCSGGSCYVYYFDY

SEQ ID NO: 6995 - protein, 10 aa, Homo sapiens
  Light chain CDR3 for antibody 3498 (IGKV1-39)
QQSYSTPMYT

SEQ ID NO: 6996 - protein, 14 aa, Homo sapiens
  Heavy chain CDR3 for antibody 3498 (IGHV3-33)
ARDKTYPLSYGMDV

SEQ ID NO: 6997 - protein, 9 aa, Homo sapiens
  Light chain CDR3 for antibody 3499 (IGKV2-30)
MQGTHWPLT

SEQ ID NO: 6998 - protein, 14 aa, Homo sapiens
  Heavy chain CDR3 for antibody 3499 (IGHV3-33)
ARRGSPLRPSHLDV

SEQ ID NO: 6999 - protein, 9 aa, Homo sapiens
  Light chain CDR3 for antibody 3500 (IGKV3-15)
QQYNNWPLT

SEQ ID NO: 7000 - protein, 8 aa, Homo sapiens
  Heavy chain CDR3 for antibody 3500 (IGHV3-23)
EKSAGEDV

SEQ ID NO: 7001 - protein, 9 aa, Homo sapiens
  Light chain CDR3 for antibody 3501 (IGKV5-2)
LQHDNFPWT

SEQ ID NO: 7002 - protein, 18 aa, Homo sapiens
  Heavy chain CDR3 for antibody 3501 (IGHV3-33)
AREGDYYGSGGFPNWFDP

SEQ ID NO: 7003 - protein, 9 aa, Homo sapiens
  Light chain CDR3 for antibody 3502 (IGKV3-11)
QQRSNWPPT

SEQ ID NO: 7004 - protein, 18 aa, Homo sapiens
  Heavy chain CDR3 for antibody 3502 (IGHV1-46)
ARDGDYVWGSYRSNWFDP

SEQ ID NO: 7005 - protein, 9 aa, Homo sapiens
  Light chain CDR3 for antibody 3503 (IGKV3-20)
QQYGSSPYT

SEQ ID NO: 7006 - protein, 12 aa, Homo sapiens
  Heavy chain CDR3 for antibody 3503 (IGHV3-33)
ARDLVRGIRMDV

SEQ ID NO: 7007 - protein, 9 aa, Homo sapiens
  Light chain CDR3 for antibody 3504 (IGKV1D-13)
QQFNNYPHT

SEQ ID NO: 7008 - protein, 9 aa, Homo sapiens
  Heavy chain CDR3 for antibody 3504 (IGHV4-59)
AGGSWDFDY

SEQ ID NO: 7009 - protein, 9 aa, Homo sapiens
  Light chain CDR3 for antibody 3505 (IGKV1-33)
QQYDNLPYT

SEQ ID NO: 7010 - protein, 12 aa, Homo sapiens
  Heavy chain CDR3 for antibody 3505 (IGHV4-61)
ARAVAGYWYFDL

SEQ ID NO: 7011 - protein, 8 aa, Homo sapiens
  Light chain CDR3 for antibody 3506 (IGKV1D-13)
QQFNNYPT

SEQ ID NO: 7012 - protein, 15 aa, Homo sapiens
  Heavy chain CDR3 for antibody 3506 (IGHV3-33)
ARDHLTGYYYYGMDV

SEQ ID NO: 7013 - protein, 10 aa, Homo sapiens
  Light chain CDR3 for antibody 3507 (IGKV3-11)
QQRSNWPIFT

SEQ ID NO: 7014 - protein, 13 aa, Homo sapiens
  Heavy chain CDR3 for antibody 3507 (IGHV4-39)
ARQWPSGYWYFDL

SEQ ID NO: 7015 - protein, 9 aa, Homo sapiens
  Light chain CDR3 for antibody 3508 (IGKV1D-13)
QQFNNYPHT

SEQ ID NO: 7016 - protein, 17 aa, Homo sapiens
  Heavy chain CDR3 for antibody 3508 (IGHV3-33)
ARGDGDILTGYYEWFDP

SEQ ID NO: 7017 - protein, 9 aa, Homo sapiens
  Light chain CDR3 for antibody 3509 (IGKV1-16)
QQYNSYPYT

SEQ ID NO: 7018 - protein, 13 aa, Homo sapiens
  Heavy chain CDR3 for antibody 3509 (IGHV3-33)
ARYYCGGDCYLDY

SEQ ID NO: 7019 - protein, 9 aa, Homo sapiens
  Light chain CDR3 for antibody 3510 (IGKV1-9)
QQLNSYPYT

SEQ ID NO: 7020 - protein, 18 aa, Homo sapiens
  Heavy chain CDR3 for antibody 3510 (IGHV1-18)
ARDRGYYYGSGSYSPFDY

SEQ ID NO: 7021 - protein, 9 aa, Homo sapiens
  Light chain CDR3 for antibody 3511 (IGKV5-2)
LQHDNFPYT

SEQ ID NO: 7022 - protein, 18 aa, Homo sapiens
  Heavy chain CDR3 for antibody 3511 (IGHV3-33)
ARDQGIVVLPGAPWYFDP

SEQ ID NO: 7023 - protein, 9 aa, Homo sapiens
  Light chain CDR3 for antibody 3512 (IGKV1-9)
QQLNSYPYT

SEQ ID NO: 7024 - protein, 14 aa, Homo sapiens
  Heavy chain CDR3 for antibody 3512 (IGHV3-33)
ARDGAAAALDAFDI

SEQ ID NO: 7025 - protein, 8 aa, Homo sapiens
  Light chain CDR3 for antibody 3513 (IGKV1-5)
QQYNSYYT

SEQ ID NO: 7026 - protein, 13 aa, Homo sapiens
  Heavy chain CDR3 for antibody 3513 (IGHV4-39)
ARQWPSGYWYFDL

SEQ ID NO: 7027 - protein, 9 aa, Homo sapiens
  Light chain CDR3 for antibody 3514 (IGKV3D-7)
QQDYNLPYT

SEQ ID NO: 7028 - protein, 12 aa, Homo sapiens
  Heavy chain CDR3 for antibody 3514 (IGHV4-39)
ARQMVREGWFDP

SEQ ID NO: 7029 - protein, 9 aa, Homo sapiens
  Light chain CDR3 for antibody 3515 (IGKV1-17)
LQHHSYPYT

SEQ ID NO: 7030 - protein, 20 aa, Homo sapiens
  Heavy chain CDR3 for antibody 3515 (IGHV3-20)
ARDPPRIVGTTYYYYYVMDV

SEQ ID NO: 7031 - protein, 9 aa, Homo sapiens
  Light chain CDR3 for antibody 3516 (IGKV1-39)
QQSYRTPLT

SEQ ID NO: 7032 - protein, 9 aa, Homo sapiens
  Heavy chain CDR3 for antibody 3516 (IGHV3-23)
AKEQQLFDY

SEQ ID NO: 7033 - protein, 9 aa, Homo sapiens
  Light chain CDR3 for antibody 3517 (IGKV6-21)
HQSSSLPYT

SEQ ID NO: 7034 - protein, 15 aa, Homo sapiens
  Heavy chain CDR3 for antibody 3517 (IGHV3-23)
AKAGGRYFDWFPFDY

SEQ ID NO: 7035 - protein, 9 aa, Homo sapiens
  Light chain CDR3 for antibody 3518 (IGKV3-11)
QQRSNWMYT

SEQ ID NO: 7036 - protein, 13 aa, Homo sapiens
  Heavy chain CDR3 for antibody 3518 (IGHV4-34)
ASNFYYYYYGMDV

SEQ ID NO: 7037 - protein, 10 aa, Homo sapiens
  Light chain CDR3 for antibody 3519 (IGKV3-11)
QQRSNWPMYT

SEQ ID NO: 7038 - protein, 13 aa, Homo sapiens
  Heavy chain CDR3 for antibody 3519 (IGHV3-33)
ARDQRYSSGWYDY

SEQ ID NO: 7039 - protein, 9 aa, Homo sapiens
  Light chain CDR3 for antibody 3520 (IGKV1D-16)
QQYNSYPYT

SEQ ID NO: 7040 - protein, 17 aa, Homo sapiens
  Heavy chain CDR3 for antibody 3520 (IGHV3-33)
ARAYYDILTGYYIHCDY

SEQ ID NO: 7041 - protein, 9 aa, Homo sapiens
  Light chain CDR3 for antibody 3521 (IGKV1-17)
LQHNSYPYT

SEQ ID NO: 7042 - protein, 11 aa, Homo sapiens
  Heavy chain CDR3 for antibody 3521 (IGHV3-23)
AKEGTYFDIPH

SEQ ID NO: 7043 - protein, 9 aa, Homo sapiens
  Light chain CDR3 for antibody 3522 (IGKV2-30)
MQGTHWPLT

SEQ ID NO: 7044 - protein, 14 aa, Homo sapiens
  Heavy chain CDR3 for antibody 3522 (IGHV3-33)
ARDRIAAASSDFDC

SEQ ID NO: 7045 - protein, 9 aa, Homo sapiens
  Light chain CDR3 for antibody 3523 (IGKV1-9)
QQLNTYPWT

SEQ ID NO: 7046 - protein, 13 aa, Homo sapiens
  Heavy chain CDR3 for antibody 3523 (IGHV3-11)
ARDGGAAAGTWDS

SEQ ID NO: 7047 - protein, 9 aa, Homo sapiens
  Light chain CDR3 for antibody 3524 (IGKV1-17)
LQHNSYPYT

SEQ ID NO: 7048 - protein, 15 aa, Homo sapiens
  Heavy chain CDR3 for antibody 3524 (IGHV3-23)
AKAGGRYFDWFPFDY

SEQ ID NO: 7049 - protein, 9 aa, Homo sapiens
  Light chain CDR3 for antibody 3525 (IGKV3-11)
QQRSNWPYT

SEQ ID NO: 7050 - protein, 19 aa, Homo sapiens
  Heavy chain CDR3 for antibody 3525 (IGHV5-51)
ARHGEKGKRITMVRGSLDV

SEQ ID NO: 7051 - protein, 10 aa, Homo sapiens
  Light chain CDR3 for antibody 3526 (IGKV3-11)
QQRSNWPIFT

SEQ ID NO: 7052 - protein, 14 aa, Homo sapiens
  Heavy chain CDR3 for antibody 3526 (IGHV3-33)
ARAGSGYDRDWFDP

SEQ ID NO: 7053 - protein, 10 aa, Homo sapiens
  Light chain CDR3 for antibody 3527 (IGKV1-39)
QQSYSTPMYT

SEQ ID NO: 7054 - protein, 18 aa, Homo sapiens
  Heavy chain CDR3 for antibody 3527 (IGHV3-33)
ARREGIVGATTYYYGMDV

SEQ ID NO: 7055 - protein, 9 aa, Homo sapiens
  Light chain CDR3 for antibody 3528 (IGKV6-21)
HQSSSLPYT

SEQ ID NO: 7056 - protein, 14 aa, Homo sapiens
  Heavy chain CDR3 for antibody 3528 (IGHV1-46)
ARKGIVGGFDAFDV

SEQ ID NO: 7057 - protein, 9 aa, Homo sapiens
  Light chain CDR3 for antibody 3529 (IGKV1D-13)
QRFNNYLYT

SEQ ID NO: 7058 - protein, 14 aa, Homo sapiens
  Heavy chain CDR3 for antibody 3529 (IGHV3-33)
ARGAAAGNFYGLDV

SEQ ID NO: 7059 - protein, 9 aa, Homo sapiens
  Light chain CDR3 for antibody 3530 (IGKV1-9)
QQLNGYPFT

SEQ ID NO: 7060 - protein, 9 aa, Homo sapiens
  Heavy chain CDR3 for antibody 3530 (IGHV1-18)
ARGKDWFDP

SEQ ID NO: 7061 - protein, 9 aa, Homo sapiens
  Light chain CDR3 for antibody 3531 (IGKV5-2)
LQHDNFPYT

SEQ ID NO: 7062 - protein, 12 aa, Homo sapiens
  Heavy chain CDR3 for antibody 3531 (IGHV3-33)
ARKQWLVQAFDI

SEQ ID NO: 7063 - protein, 8 aa, Homo sapiens
  Light chain CDR3 for antibody 3532 (IGKV3D-7)
QQDYNLLT

SEQ ID NO: 7064 - protein, 18 aa, Homo sapiens
  Heavy chain CDR3 for antibody 3532 (IGHV3-23)
AKDRITGTTYGYYSGLDV

SEQ ID NO: 7065 - protein, 10 aa, Homo sapiens
  Light chain CDR3 for antibody 3533 (IGKV3-11)
QQRSNWPIFT

SEQ ID NO: 7066 - protein, 13 aa, Homo sapiens
  Heavy chain CDR3 for antibody 3533 (IGHV3-23)
ARAFFMVRGVIDF

SEQ ID NO: 7067 - protein, 9 aa, Homo sapiens
  Light chain CDR3 for antibody 3534 (IGKV1-27)
QKYNSAPYT

SEQ ID NO: 7068 - protein, 13 aa, Homo sapiens
  Heavy chain CDR3 for antibody 3534 (IGHV3-33)
ARGDNWNDGGFDY

SEQ ID NO: 7069 - protein, 9 aa, Homo sapiens
  Light chain CDR3 for antibody 3535 (IGKV5-2)
LQHDNFPYT

SEQ ID NO: 7070 - protein, 12 aa, Homo sapiens
  Heavy chain CDR3 for antibody 3535 (IGHV3-23)
AKESLYTPTDDY

SEQ ID NO: 7071 - protein, 9 aa, Homo sapiens
  Light chain CDR3 for antibody 3536 (IGKV1D-16)
QQYNSYPLT

SEQ ID NO: 7072 - protein, 16 aa, Homo sapiens
  Heavy chain CDR3 for antibody 3536 (IGHV4-59)
AREPLRYFDWPDAFDI

SEQ ID NO: 7073 - protein, 9 aa, Homo sapiens
  Light chain CDR3 for antibody 3537 (IGKV2D-28)
MQALQTPPT

SEQ ID NO: 7074 - protein, 15 aa, Homo sapiens
  Heavy chain CDR3 for antibody 3537 (IGHV3-30)
ARGAMVRGVDYGMDV

SEQ ID NO: 7075 - protein, 9 aa, Homo sapiens
  Light chain CDR3 for antibody 3538 (IGKV1D-13)
QQFNNYPYT

SEQ ID NO: 7076 - protein, 13 aa, Homo sapiens
  Heavy chain CDR3 for antibody 3538 (IGHV3-33)
ARQSSGWFDAFDI

SEQ ID NO: 7077 - protein, 11 aa, Homo sapiens
  Light chain CDR3 for antibody 3539 (IGKV3-11)
QQRSNWPPTWT

SEQ ID NO: 7078 - protein, 12 aa, Homo sapiens
  Heavy chain CDR3 for antibody 3539 (IGHV1-46)
ARGLTGDHAVDI

SEQ ID NO: 7079 - protein, 9 aa, Homo sapiens
  Light chain CDR3 for antibody 3540 (IGKV1-27)
QKYNSAPYT

SEQ ID NO: 7080 - protein, 12 aa, Homo sapiens
  Heavy chain CDR3 for antibody 3540 (IGHV3-h)
AREDYYYYGMDV

SEQ ID NO: 7081 - protein, 9 aa, Homo sapiens
  Light chain CDR3 for antibody 3541 (IGKV1-6)
LQDYNYPWT

SEQ ID NO: 7082 - protein, 15 aa, Homo sapiens
  Heavy chain CDR3 for antibody 3541 (IGHV3-33)
SRDHLTGYNYYGMDV

SEQ ID NO: 7083 - protein, 9 aa, Homo sapiens
  Light chain CDR3 for antibody 3542 (IGKV1D-13)
QQFNNYPRT

SEQ ID NO: 7084 - protein, 14 aa, Homo sapiens
  Heavy chain CDR3 for antibody 3542 (IGHV1-18)
ARCFGSGSYGWFDP

SEQ ID NO: 7085 - protein, 9 aa, Homo sapiens
  Light chain CDR3 for antibody 3543 (IGKV3-20)
QQYGSSPYT

SEQ ID NO: 7086 - protein, 11 aa, Homo sapiens
  Heavy chain CDR3 for antibody 3543 (IGHV3-33)
ARDRSTGWLDY

SEQ ID NO: 7087 - protein, 9 aa, Homo sapiens
  Light chain CDR3 for antibody 3544 (IGKV5-2)
LQHDNFPYT

SEQ ID NO: 7088 - protein, 14 aa, Homo sapiens
  Heavy chain CDR3 for antibody 3544 (IGHV3-64)
ARDHAAGGYSHSDY

SEQ ID NO: 7089 - protein, 9 aa, Homo sapiens
  Light chain CDR3 for antibody 3545 (IGKV6-21)
HQSSSLPYT

SEQ ID NO: 7090 - protein, 15 aa, Homo sapiens
  Heavy chain CDR3 for antibody 3545 (IGHV3-33)
ARRSILTGSYWYFDL

SEQ ID NO: 7091 - protein, 9 aa, Homo sapiens
  Light chain CDR3 for antibody 3546 (IGKV1-39)
QQSYRTPLT

SEQ ID NO: 7092 - protein, 12 aa, Homo sapiens
  Heavy chain CDR3 for antibody 3546 (IGHV3-33)
ARDSSGWSHFDY

SEQ ID NO: 7093 - protein, 9 aa, Homo sapiens
  Light chain CDR3 for antibody 3547 (IGKV1D-16)
QQYNSYPLT

SEQ ID NO: 7094 - protein, 18 aa, Homo sapiens
  Heavy chain CDR3 for antibody 3547 (IGHV3-23)
AKPDYYGSGSYYNVPFDY

SEQ ID NO: 7095 - protein, 9 aa, Homo sapiens
  Light chain CDR3 for antibody 3548 (IGKV1D-16)
QQYNSYPLT

SEQ ID NO: 7096 - protein, 15 aa, Homo sapiens
  Heavy chain CDR3 for antibody 3548 (IGHV3-33)
ARPPIAVAGPEYFQH

SEQ ID NO: 7097 - protein, 9 aa, Homo sapiens
  Light chain CDR3 for antibody 3549 (IGKV3-11)
QQRSNWPLT

SEQ ID NO: 7098 - protein, 20 aa, Homo sapiens
  Heavy chain CDR3 for antibody 3549 (IGHV1-18)
AREVGIAVAGTLYYYYGMDV

SEQ ID NO: 7099 - protein, 9 aa, Homo sapiens
  Light chain CDR3 for antibody 3550 (IGKV1D-13)
QQFNNYPHT

SEQ ID NO: 7100 - protein, 19 aa, Homo sapiens
  Heavy chain CDR3 for antibody 3550 (IGHV5-51)
ARHGEKGKRITMVRGSLDV

SEQ ID NO: 7101 - protein, 9 aa, Homo sapiens
  Light chain CDR3 for antibody 3551 (IGKV1-6)
LQDYNYPYT

SEQ ID NO: 7102 - protein, 12 aa, Homo sapiens
  Heavy chain CDR3 for antibody 3551 (IGHV3-33)
ARDIVGTSYFDY

SEQ ID NO: 7103 - protein, 9 aa, Homo sapiens
  Light chain CDR3 for antibody 3552 (IGKV1D-13)
QQFNNYPYT

SEQ ID NO: 7104 - protein, 12 aa, Homo sapiens
  Heavy chain CDR3 for antibody 3552 (IGHV3-23)
AKESLYTPTDDY

SEQ ID NO: 7105 - protein, 9 aa, Homo sapiens
  Light chain CDR3 for antibody 3553 (IGKV6-21)
HQSSSLPYT

SEQ ID NO: 7106 - protein, 13 aa, Homo sapiens
  Heavy chain CDR3 for antibody 3553 (IGHV4-39)
ARRDGSYYGYFDY

SEQ ID NO: 7107 - protein, 9 aa, Homo sapiens
  Light chain CDR3 for antibody 3554 (IGKV1-17)
LQHNSYPWT

SEQ ID NO: 7108 - protein, 14 aa, Homo sapiens
  Heavy chain CDR3 for antibody 3554 (IGHV3-33)
ARDIYYSGSYYLDY

SEQ ID NO: 7109 - protein, 10 aa, Homo sapiens
  Light chain CDR3 for antibody 3555 (IGKV1-39)
QQSYSTPMYT

SEQ ID NO: 7110 - protein, 13 aa, Homo sapiens
  Heavy chain CDR3 for antibody 3555 (IGHV3-23)
ASTGDSYYYGMDV

SEQ ID NO: 7111 - protein, 9 aa, Homo sapiens
  Light chain CDR3 for antibody 3556 (IGKV2-30)
MQGTHWPLT

SEQ ID NO: 7112 - protein, 11 aa, Homo sapiens
  Heavy chain CDR3 for antibody 3556 (IGHV3-33)
ARDTWDDYFDY

SEQ ID NO: 7113 - protein, 9 aa, Homo sapiens
  Light chain CDR3 for antibody 3557 (IGKV3-20)
QQYGSSPYT

SEQ ID NO: 7114 - protein, 16 aa, Homo sapiens
  Heavy chain CDR3 for antibody 3557 (IGHV3-20)
AREGYSSSWFDRNFDY

SEQ ID NO: 7115 - protein, 9 aa, Homo sapiens
  Light chain CDR3 for antibody 3558 (IGKV1-27)
QKYNSAPYT

SEQ ID NO: 7116 - protein, 17 aa, Homo sapiens
  Heavy chain CDR3 for antibody 3558 (IGHV3-33)
ARDPARGNVRSFYGLDV

SEQ ID NO: 7117 - protein, 9 aa, Homo sapiens
  Light chain CDR3 for antibody 3559 (IGKV2-30)
MQGTHWPLT

SEQ ID NO: 7118 - protein, 19 aa, Homo sapiens
  Heavy chain CDR3 for antibody 3559 (IGHV1-18)
ARDDILTGYSLYYYYGMDV

SEQ ID NO: 7119 - protein, 9 aa, Homo sapiens
  Light chain CDR3 for antibody 3560 (IGKV6-21)
HQSSSLPYT

SEQ ID NO: 7120 - protein, 9 aa, Homo sapiens
  Heavy chain CDR3 for antibody 3560 (IGHV3-20)
ASIRGYFDY

SEQ ID NO: 7121 - protein, 9 aa, Homo sapiens
  Light chain CDR3 for antibody 3561 (IGKV5-2)
LQHDNFPYT

SEQ ID NO: 7122 - protein, 18 aa, Homo sapiens
  Heavy chain CDR3 for antibody 3561 (IGHV3-33)
ARDGRISLVRGIIDAFDI

SEQ ID NO: 7123 - protein, 9 aa, Homo sapiens
  Light chain CDR3 for antibody 3562 (IGKV3D-7)
QQDYNLPLT

SEQ ID NO: 7124 - protein, 13 aa, Homo sapiens
  Heavy chain CDR3 for antibody 3562 (IGHV3-33)
AKEDGDYHHYFDY

SEQ ID NO: 7125 - protein, 9 aa, Homo sapiens
  Light chain CDR3 for antibody 3563 (IGKV1-9)
QQLNSYPRT

SEQ ID NO: 7126 - protein, 15 aa, Homo sapiens
  Heavy chain CDR3 for antibody 3563 (IGHV1-46)
ARGAVDDYYYYGMDV

SEQ ID NO: 7127 - protein, 9 aa, Homo sapiens
  Light chain CDR3 for antibody 3564 (IGKV1-9)
QQLNSYPLT

SEQ ID NO: 7128 - protein, 15 aa, Homo sapiens
  Heavy chain CDR3 for antibody 3564 (IGHV4-59)
ARDGGYSGYPIGMDV

SEQ ID NO: 7129 - protein, 10 aa, Homo sapiens
  Light chain CDR3 for antibody 3565 (IGKV1-39)
QQSYSTPMYT

SEQ ID NO: 7130 - protein, 17 aa, Homo sapiens
  Heavy chain CDR3 for antibody 3565 (IGHV3-33)
ARGFSGYDGYYYYGMDV

SEQ ID NO: 7131 - protein, 9 aa, Homo sapiens
  Light chain CDR3 for antibody 3566 (IGKV3-15)
QQYNNWPLT

SEQ ID NO: 7132 - protein, 13 aa, Homo sapiens
  Heavy chain CDR3 for antibody 3566 (IGHV4-39)
ARHEVMVRGVFDY

SEQ ID NO: 7133 - protein, 9 aa, Homo sapiens
  Light chain CDR3 for antibody 3567 (IGKV5-2)
LQHDNFPWT

SEQ ID NO: 7134 - protein, 17 aa, Homo sapiens
  Heavy chain CDR3 for antibody 3567 (IGHV1-8)
ARGDYYGSGSPYWYFDL

SEQ ID NO: 7135 - protein, 9 aa, Homo sapiens
  Light chain CDR3 for antibody 3568 (IGKV1-27)
QKYNSAPYT

SEQ ID NO: 7136 - protein, 19 aa, Homo sapiens
  Heavy chain CDR3 for antibody 3568 (IGHV3-33)
ARGPYYDILTGYGYYGMDV

SEQ ID NO: 7137 - protein, 9 aa, Homo sapiens
  Light chain CDR3 for antibody 3569 (IGKV2-30)
MQGTHWPLT

SEQ ID NO: 7138 - protein, 10 aa, Homo sapiens
  Heavy chain CDR3 for antibody 3569 (IGHV3-23)
AKGDRWRFDP

SEQ ID NO: 7139 - protein, 9 aa, Homo sapiens
  Light chain CDR3 for antibody 3570 (IGKV3D-7)
QQDYKLPLT

SEQ ID NO: 7140 - protein, 14 aa, Homo sapiens
  Heavy chain CDR3 for antibody 3570 (IGHV1-46)
ARRGIVGALDAFDI

SEQ ID NO: 7141 - protein, 9 aa, Homo sapiens
  Light chain CDR3 for antibody 3571 (IGKV1D-13)
QQFNNYPYT

SEQ ID NO: 7142 - protein, 12 aa, Homo sapiens
  Heavy chain CDR3 for antibody 3571 (IGHV3-33)
ARAGMGAPYFDY

SEQ ID NO: 7143 - protein, 9 aa, Homo sapiens
  Light chain CDR3 for antibody 3572 (IGKV2-30)
MQGTHWPLT

SEQ ID NO: 7144 - protein, 15 aa, Homo sapiens
  Heavy chain CDR3 for antibody 3572 (IGHV3-30)
ARRGYGSGSPDAFDL

SEQ ID NO: 7145 - protein, 9 aa, Homo sapiens
  Light chain CDR3 for antibody 3573 (IGKV5-2)
LQHDKFPYT

SEQ ID NO: 7146 - protein, 12 aa, Homo sapiens
  Heavy chain CDR3 for antibody 3573 (IGHV3-33)
ARDPGYFFGLDV

SEQ ID NO: 7147 - protein, 9 aa, Homo sapiens
  Light chain CDR3 for antibody 3574 (IGKV1-17)
LQHNSYPYT

SEQ ID NO: 7148 - protein, 18 aa, Homo sapiens
  Heavy chain CDR3 for antibody 3574 (IGHV3-64)
ARDEYYYGSGSYYNYFDW

SEQ ID NO: 7149 - protein, 9 aa, Homo sapiens
  Light chain CDR3 for antibody 3575 (IGKV1-16)
QQYNSYPYT

SEQ ID NO: 7150 - protein, 9 aa, Homo sapiens
  Heavy chain CDR3 for antibody 3575 (IGHV3-23)
AKDYGSESP

SEQ ID NO: 7151 - protein, 9 aa, Homo sapiens
  Light chain CDR3 for antibody 3576 (IGKV1-6)
LQDYNYPYT

SEQ ID NO: 7152 - protein, 17 aa, Homo sapiens
  Heavy chain CDR3 for antibody 3576 (IGHV3-33)
AREGTMVRGYYYYGMDV

SEQ ID NO: 7153 - protein, 9 aa, Homo sapiens
  Light chain CDR3 for antibody 3577 (IGKV6-21)
HQSSSLPYT

SEQ ID NO: 7154 - protein, 15 aa, Homo sapiens
  Heavy chain CDR3 for antibody 3577 (IGHV1-46)
ARGAVDDYYYYGMDV

SEQ ID NO: 7155 - protein, 9 aa, Homo sapiens
  Light chain CDR3 for antibody 3578 (IGKV1-6)
LQDYNYPYT

SEQ ID NO: 7156 - protein, 7 aa, Homo sapiens
  Heavy chain CDR3 for antibody 3578 (IGHV3-33)
ARELFNY

SEQ ID NO: 7157 - protein, 9 aa, Homo sapiens
  Light chain CDR3 for antibody 3579 (IGKV1-17)
QQLNSYPYT

SEQ ID NO: 7158 - protein, 14 aa, Homo sapiens
  Heavy chain CDR3 for antibody 3579 (IGHV3-64)
ARKPDYYGSGYFDY

SEQ ID NO: 7159 - protein, 9 aa, Homo sapiens
  Light chain CDR3 for antibody 3580 (IGKV1-9)
QQYNSYPLT

SEQ ID NO: 7160 - protein, 12 aa, Homo sapiens
  Heavy chain CDR3 for antibody 3580 (IGHV3-33)
ARDLVRGIRMDV

SEQ ID NO: 7161 - protein, 9 aa, Homo sapiens
  Light chain CDR3 for antibody 3581 (IGKV1-16)
QQYNRYPYT

SEQ ID NO: 7162 - protein, 11 aa, Homo sapiens
  Heavy chain CDR3 for antibody 3581 (IGHV4-59)
ARSLRYSFFDY

SEQ ID NO: 7163 - protein, 9 aa, Homo sapiens
  Light chain CDR3 for antibody 3582 (IGKV1-33)
QQYDNLPFT

SEQ ID NO: 7164 - protein, 11 aa, Homo sapiens
  Heavy chain CDR3 for antibody 3582 (IGHV3-33)
ARDKSSGWSDY

SEQ ID NO: 7165 - protein, 9 aa, Homo sapiens
  Light chain CDR3 for antibody 3583 (IGKV6-21)
HQSSSLPYT

SEQ ID NO: 7166 - protein, 19 aa, Homo sapiens
  Heavy chain CDR3 for antibody 3583 (IGHV1-18)
ARDTTLVRGLMNYYYGMDV

SEQ ID NO: 7167 - protein, 9 aa, Homo sapiens
  Light chain CDR3 for antibody 3584 (IGKV2-30)
MQGTHWPLT

SEQ ID NO: 7168 - protein, 21 aa, Homo sapiens
  Heavy chain CDR3 for antibody 3584 (IGHV3-23)
AKDIDYYGSGSYPLYYYGMDV

SEQ ID NO: 7169 - protein, 9 aa, Homo sapiens
  Light chain CDR3 for antibody 3585 (IGKV3D-20)
QQYGSSPYT

SEQ ID NO: 7170 - protein, 12 aa, Homo sapiens
  Heavy chain CDR3 for antibody 3585 (IGHV3-33)
ARNYDILDYFDY

SEQ ID NO: 7171 - protein, 9 aa, Homo sapiens
  Light chain CDR3 for antibody 3586 (IGKV3-11)
QQRSNWPYT

SEQ ID NO: 7172 - protein, 17 aa, Homo sapiens
  Heavy chain CDR3 for antibody 3586 (IGHV3-33)
AKSYCSSTTCYNGYFDY

SEQ ID NO: 7173 - protein, 9 aa, Homo sapiens
  Light chain CDR3 for antibody 3587 (IGKV3-15)
QQYNNWPLT

SEQ ID NO: 7174 - protein, 16 aa, Homo sapiens
  Heavy chain CDR3 for antibody 3587 (IGHV1-24)
ATEDSSSTYYYYGLDV

SEQ ID NO: 7175 - protein, 9 aa, Homo sapiens
  Light chain CDR3 for antibody 3588 (IGKV1-17)
LQHNSYPYT

SEQ ID NO: 7176 - protein, 20 aa, Homo sapiens
  Heavy chain CDR3 for antibody 3588 (IGHV3-23)
AKDRMTTVTSYYYYYYGMDV

SEQ ID NO: 7177 - protein, 9 aa, Homo sapiens
  Light chain CDR3 for antibody 3589 (IGKV3D-20)
QQYGSSPYT

SEQ ID NO: 7178 - protein, 22 aa, Homo sapiens
  Heavy chain CDR3 for antibody 3589 (IGHV3-33)
ARMYYDILTGYYKDYYYYGMDV

SEQ ID NO: 7179 - protein, 9 aa, Homo sapiens
  Light chain CDR3 for antibody 3590 (IGKV5-2)
LQHDNFPWT

SEQ ID NO: 7180 - protein, 12 aa, Homo sapiens
  Heavy chain CDR3 for antibody 3590 (IGHV3-33)
ARKGYGLYVLDV

SEQ ID NO: 7181 - protein, 10 aa, Homo sapiens
  Light chain CDR3 for antibody 3591 (IGKV1-17)
LQHNSYPMYT

SEQ ID NO: 7182 - protein, 13 aa, Homo sapiens
  Heavy chain CDR3 for antibody 3591 (IGHV4-34)
ASNFYYYYYGMDV

SEQ ID NO: 7183 - protein, 9 aa, Homo sapiens
  Light chain CDR3 for antibody 3592 (IGKV3-11)
QQRSNWPPT

SEQ ID NO: 7184 - protein, 13 aa, Homo sapiens
  Heavy chain CDR3 for antibody 3592 (IGHV3-53)
ARSGSYWGYYFDY

SEQ ID NO: 7185 - protein, 9 aa, Homo sapiens
  Light chain CDR3 for antibody 3593 (IGKV5-2)
LQHDNFPYT

SEQ ID NO: 7186 - protein, 9 aa, Homo sapiens
  Heavy chain CDR3 for antibody 3593 (IGHV3-20)
ASIRGYFDY

SEQ ID NO: 7187 - protein, 9 aa, Homo sapiens
  Light chain CDR3 for antibody 3594 (IGKV5-2)
LQHDNFPYT

SEQ ID NO: 7188 - protein, 14 aa, Homo sapiens
  Heavy chain CDR3 for antibody 3594 (IGHV3-33)
AREEDYYYYYDMDV

SEQ ID NO: 7189 - protein, 9 aa, Homo sapiens
  Light chain CDR3 for antibody 3595 (IGKV1D-13)
QQFNNYPRT

SEQ ID NO: 7190 - protein, 13 aa, Homo sapiens
  Heavy chain CDR3 for antibody 3595 (IGHV1-2)
ARDGVRGSFGMDV

SEQ ID NO: 7191 - protein, 9 aa, Homo sapiens
  Light chain CDR3 for antibody 3596 (IGKV2-30)
MQGTHWPLT

SEQ ID NO: 7192 - protein, 12 aa, Homo sapiens
  Heavy chain CDR3 for antibody 3596 (IGHV4-61)
ARVYSSGWLFDY

SEQ ID NO: 7193 - protein, 9 aa, Homo sapiens
  Light chain CDR3 for antibody 3597 (IGKV3D-7)
QQDYTLPLT

SEQ ID NO: 7194 - protein, 16 aa, Homo sapiens
  Heavy chain CDR3 for antibody 3597 (IGHV4-59)
ARDTPYYSGSGRPFDS

SEQ ID NO: 7195 - protein, 10 aa, Homo sapiens
  Light chain CDR3 for antibody 3598 (IGKV3-20)
QQYGRSPPVT

SEQ ID NO: 7196 - protein, 14 aa, Homo sapiens
  Heavy chain CDR3 for antibody 3598 (IGHV3-23)
AKSRIVGALYYFDY

SEQ ID NO: 7197 - protein, 9 aa, Homo sapiens
  Light chain CDR3 for antibody 3599 (IGKV1D-13)
QHFNNYMYT

SEQ ID NO: 7198 - protein, 11 aa, Homo sapiens
  Heavy chain CDR3 for antibody 3599 (IGHV4-59)
AREMGHDTFDI

SEQ ID NO: 7199 - protein, 9 aa, Homo sapiens
  Light chain CDR3 for antibody 3600 (IGKV1-39)
QQSYSTPLT

SEQ ID NO: 7200 - protein, 16 aa, Homo sapiens
  Heavy chain CDR3 for antibody 3600 (IGHV3-20)
AREGYSSSWFDRNFDY

SEQ ID NO: 7201 - protein, 10 aa, Homo sapiens
  Light chain CDR3 for antibody 3601 (IGKV3-11)
QQRSNWPIFT

SEQ ID NO: 7202 - protein, 10 aa, Homo sapiens
  Heavy chain CDR3 for antibody 3601 (IGHV3-33)
ARDGSGSQPI

SEQ ID NO: 7203 - protein, 9 aa, Homo sapiens
  Light chain CDR3 for antibody 3602 (IGKV3-11)
QQRSNWMYT

SEQ ID NO: 7204 - protein, 18 aa, Homo sapiens
  Heavy chain CDR3 for antibody 3602 (IGHV3-33)
ARGLLWFGVSYYYYGMDV

SEQ ID NO: 7205 - protein, 9 aa, Homo sapiens
  Light chain CDR3 for antibody 3603 (IGKV3-20)
LQYGSSPYT

SEQ ID NO: 7206 - protein, 12 aa, Homo sapiens
  Heavy chain CDR3 for antibody 3603 (IGHV1-46)
ARGLTGDHASDI

SEQ ID NO: 7207 - protein, 9 aa, Homo sapiens
  Light chain CDR3 for antibody 3604 (IGKV5-2)
LQHDNFPWT

SEQ ID NO: 7208 - protein, 19 aa, Homo sapiens
  Heavy chain CDR3 for antibody 3604 (IGHV1-18)
ARDTTLVRGLMNYYYGMDV

SEQ ID NO: 7209 - protein, 9 aa, Homo sapiens
  Light chain CDR3 for antibody 3605 (IGKV3-15)
QQYNNWPLT

SEQ ID NO: 7210 - protein, 14 aa, Homo sapiens
  Heavy chain CDR3 for antibody 3605 (IGHV3-33)
ARAGSGYDRDWFDP

SEQ ID NO: 7211 - protein, 9 aa, Homo sapiens
  Light chain CDR3 for antibody 3606 (IGKV3-20)
QQYGSSPRT

SEQ ID NO: 7212 - protein, 13 aa, Homo sapiens
  Heavy chain CDR3 for antibody 3606 (IGHV4-39)
ARRGVVAPAAFDY

SEQ ID NO: 7213 - protein, 9 aa, Homo sapiens
  Light chain CDR3 for antibody 3607 (IGKV2-30)
MQGTHWPLT

SEQ ID NO: 7214 - protein, 18 aa, Homo sapiens
  Heavy chain CDR3 for antibody 3607 (IGHV3-23)
AKEGNYYGSGSYWGYFDP

SEQ ID NO: 7215 - protein, 9 aa, Homo sapiens
  Light chain CDR3 for antibody 3608 (IGKV1D-13)
QQFNNYPYT

SEQ ID NO: 7216 - protein, 19 aa, Homo sapiens
  Heavy chain CDR3 for antibody 3608 (IGHV3-23)
AKDGRSGSYDYYYYYGMDV

SEQ ID NO: 7217 - protein, 9 aa, Homo sapiens
  Light chain CDR3 for antibody 3609 (IGKV6-21)
HQSSSLPYT

SEQ ID NO: 7218 - protein, 10 aa, Homo sapiens
  Heavy chain CDR3 for antibody 3609 (IGHV3-30)
ARGSWYGFDY

SEQ ID NO: 7219 - protein, 9 aa, Homo sapiens
  Light chain CDR3 for antibody 3610 (IGKV1D-13)
QHFNNYMYT

SEQ ID NO: 7220 - protein, 12 aa, Homo sapiens
  Heavy chain CDR3 for antibody 3610 (IGHV4-39)
ARHGSGSSYFDY

SEQ ID NO: 7221 - protein, 8 aa, Homo sapiens
  Light chain CDR3 for antibody 3611 (IGKV6-21)
HQSSSLPT

SEQ ID NO: 7222 - protein, 15 aa, Homo sapiens
  Heavy chain CDR3 for antibody 3611 (IGHV3-30)
ARGAMVRGVDYGMDV

SEQ ID NO: 7223 - protein, 9 aa, Homo sapiens
  Light chain CDR3 for antibody 3612 (IGKV3-11)
QQRSNWPLT

SEQ ID NO: 7224 - protein, 19 aa, Homo sapiens
  Heavy chain CDR3 for antibody 3612 (IGHV3-33)
ARGVRLRYFDPYYYYGMDV

SEQ ID NO: 7225 - protein, 9 aa, Homo sapiens
  Light chain CDR3 for antibody 3613 (IGKV1-39)
QQSYSTPLT

SEQ ID NO: 7226 - protein, 16 aa, Homo sapiens
  Heavy chain CDR3 for antibody 3613 (IGHV3-33)
ARGDDILTHQYYGVDV

SEQ ID NO: 7227 - protein, 9 aa, Homo sapiens
  Light chain CDR3 for antibody 3614 (IGKV3-11)
QQRSNWPYT

SEQ ID NO: 7228 - protein, 13 aa, Homo sapiens
  Heavy chain CDR3 for antibody 3614 (IGHV3-33)
ARRATLVRGVFDP

SEQ ID NO: 7229 - protein, 9 aa, Homo sapiens
  Light chain CDR3 for antibody 3615 (IGKV1-9)
QQLNSYPYT

SEQ ID NO: 7230 - protein, 14 aa, Homo sapiens
  Heavy chain CDR3 for antibody 3615 (IGHV3-64)
ARGGGAVTGTNFDY

SEQ ID NO: 7231 - protein, 9 aa, Homo sapiens
  Light chain CDR3 for antibody 3616 (IGKV3-11)
QQRSNWPLT

SEQ ID NO: 7232 - protein, 14 aa, Homo sapiens
  Heavy chain CDR3 for antibody 3616 (IGHV3-33)
ARAISGSSYWYFDL

SEQ ID NO: 7233 - protein, 9 aa, Homo sapiens
  Light chain CDR3 for antibody 3617 (IGKV1-17)
LQHNSYPYT

SEQ ID NO: 7234 - protein, 11 aa, Homo sapiens
  Heavy chain CDR3 for antibody 3617 (IGHV3-23)
AKKVYDYGSDY

SEQ ID NO: 7235 - protein, 9 aa, Homo sapiens
  Light chain CDR3 for antibody 3618 (IGKV2D-28)
MQVLQTPYT

SEQ ID NO: 7236 - protein, 19 aa, Homo sapiens
  Heavy chain CDR3 for antibody 3618 (IGHV3-33)
ARGGVVRGVIEYYYYGMDV

SEQ ID NO: 7237 - protein, 11 aa, Homo sapiens
  Light chain CDR3 for antibody 3619 (IGKV3-11)
QQRSNWPPTWT

SEQ ID NO: 7238 - protein, 13 aa, Homo sapiens
  Heavy chain CDR3 for antibody 3619 (IGHV4-39)
ARHEVMVRGVFDY

SEQ ID NO: 7239 - protein, 10 aa, Homo sapiens
  Light chain CDR3 for antibody 3620 (IGKV3-11)
QQRSNWPALT

SEQ ID NO: 7240 - protein, 14 aa, Homo sapiens
  Heavy chain CDR3 for antibody 3620 (IGHV3-23)
AKDRYRGYEGLFDY

SEQ ID NO: 7241 - protein, 9 aa, Homo sapiens
  Light chain CDR3 for antibody 3621 (IGKV4-1)
QQYYSTPWT

SEQ ID NO: 7242 - protein, 15 aa, Homo sapiens
  Heavy chain CDR3 for antibody 3621 (IGHV3-30)
ARGAMVRGVDYGMDV

SEQ ID NO: 7243 - protein, 9 aa, Homo sapiens
  Light chain CDR3 for antibody 3622 (IGKV2-30)
MQGTHWPLT

SEQ ID NO: 7244 - protein, 20 aa, Homo sapiens
  Heavy chain CDR3 for antibody 3622 (IGHV3-20)
ARDLCSSTSCYGYYYYGMDV

SEQ ID NO: 7245 - protein, 9 aa, Homo sapiens
  Light chain CDR3 for antibody 3623 (IGKV6-21)
HQSTSLPFT

SEQ ID NO: 7246 - protein, 11 aa, Homo sapiens
  Heavy chain CDR3 for antibody 3623 (IGHV4-59)
ARDGSWEPFDY

SEQ ID NO: 7247 - protein, 9 aa, Homo sapiens
  Light chain CDR3 for antibody 3624 (IGKV1-17)
LQHNSYPWT

SEQ ID NO: 7248 - protein, 14 aa, Homo sapiens
  Heavy chain CDR3 for antibody 3624 (IGHV3-23)
AKGGDVLTGYYPDY

SEQ ID NO: 7249 - protein, 8 aa, Homo sapiens
  Light chain CDR3 for antibody 3625 (IGKV1D-13)
QQFNNYPT

SEQ ID NO: 7250 - protein, 9 aa, Homo sapiens
  Heavy chain CDR3 for antibody 3625 (IGHV1-8)
ARGRLDFDY

SEQ ID NO: 7251 - protein, 9 aa, Homo sapiens
  Light chain CDR3 for antibody 3626 (IGKV1-17)
LQHNSYPYT

SEQ ID NO: 7252 - protein, 15 aa, Homo sapiens
  Heavy chain CDR3 for antibody 3626 (IGHV3-23)
AKDRGWYDYYYGMDV

SEQ ID NO: 7253 - protein, 9 aa, Homo sapiens
  Light chain CDR3 for antibody 3627 (IGKV3-15)
QQYNNWPYT

SEQ ID NO: 7254 - protein, 14 aa, Homo sapiens
  Heavy chain CDR3 for antibody 3627 (IGHV4-39)
ARRGVVVPPGGMDV

SEQ ID NO: 7255 - protein, 9 aa, Homo sapiens
  Light chain CDR3 for antibody 3628 (IGKV5-2)
LQHDNFPYT

SEQ ID NO: 7256 - protein, 14 aa, Homo sapiens
  Heavy chain CDR3 for antibody 3628 (IGHV3-33)
VSAISGSSYWYFAL

SEQ ID NO: 7257 - protein, 10 aa, Homo sapiens
  Light chain CDR3 for antibody 3629 (IGKV3-11)
QQRSNWPIFT

SEQ ID NO: 7258 - protein, 9 aa, Homo sapiens
  Heavy chain CDR3 for antibody 3629 (IGHV3-13)
ARDRWYFDL

SEQ ID NO: 7259 - protein, 9 aa, Homo sapiens
  Light chain CDR3 for antibody 3630 (IGKV1-16)
QQYNSYPYT

SEQ ID NO: 7260 - protein, 16 aa, Homo sapiens
  Heavy chain CDR3 for antibody 3630 (IGHV1-46)
ARYHYGSGSYYNVGDY

SEQ ID NO: 7261 - protein, 8 aa, Homo sapiens
  Light chain CDR3 for antibody 3631 (IGKV3-20)
QQYGSSLT

SEQ ID NO: 7262 - protein, 15 aa, Homo sapiens
  Heavy chain CDR3 for antibody 3631 (IGHV3-30)
ARGAMVRGVDYGMDV

SEQ ID NO: 7263 - protein, 9 aa, Homo sapiens
  Light chain CDR3 for antibody 3632 (IGKV3-15)
QQYNNWPLT

SEQ ID NO: 7264 - protein, 13 aa, Homo sapiens
  Heavy chain CDR3 for antibody 3632 (IGHV3-33)
ARIDYYSYYGMDV

SEQ ID NO: 7265 - protein, 9 aa, Homo sapiens
  Light chain CDR3 for antibody 3633 (IGKV3D-7)
QQDYNLPLT

SEQ ID NO: 7266 - protein, 13 aa, Homo sapiens
  Heavy chain CDR3 for antibody 3633 (IGHV1-18)
ARSITMVRGVIGY

SEQ ID NO: 7267 - protein, 9 aa, Homo sapiens
  Light chain CDR3 for antibody 3634 (IGKV5-2)
LQHDNFPYT

SEQ ID NO: 7268 - protein, 13 aa, Homo sapiens
  Heavy chain CDR3 for antibody 3634 (IGHV3-33)
ARGRGYNYGYGDY

SEQ ID NO: 7269 - protein, 9 aa, Homo sapiens
  Light chain CDR3 for antibody 3635 (IGKV3-20)
QQYGSSPYT

SEQ ID NO: 7270 - protein, 17 aa, Homo sapiens
  Heavy chain CDR3 for antibody 3635 (IGHV3-30)
ARDGVGATSYYYYGMDV

SEQ ID NO: 7271 - protein, 9 aa, Homo sapiens
  Light chain CDR3 for antibody 3636 (IGKV1D-13)
QQFNNYPYT

SEQ ID NO: 7272 - protein, 12 aa, Homo sapiens
  Heavy chain CDR3 for antibody 3636 (IGHV3-33)
AKDPGWQQLAEY

SEQ ID NO: 7273 - protein, 10 aa, Homo sapiens
  Light chain CDR3 for antibody 3637 (IGKV3-20)
QQYGRSPPVT

SEQ ID NO: 7274 - protein, 14 aa, Homo sapiens
  Heavy chain CDR3 for antibody 3637 (IGHV3-33)
ARGAAAGNFYGLDV

SEQ ID NO: 7275 - protein, 8 aa, Homo sapiens
  Light chain CDR3 for antibody 3638 (IGKV3-20)
QQYGSSLT

SEQ ID NO: 7276 - protein, 11 aa, Homo sapiens
  Heavy chain CDR3 for antibody 3638 (IGHV3-33)
ARDRSSGPFDY

SEQ ID NO: 7277 - protein, 9 aa, Homo sapiens
  Light chain CDR3 for antibody 3639 (IGKV1-6)
LQDYNYPWT

SEQ ID NO: 7278 - protein, 17 aa, Homo sapiens
  Heavy chain CDR3 for antibody 3639 (IGHV3-33)
ARVYYDILTGYSPAFDI

SEQ ID NO: 7279 - protein, 9 aa, Homo sapiens
  Light chain CDR3 for antibody 3640 (IGKV1D-16)
QQYNSYPPT

SEQ ID NO: 7280 - protein, 14 aa, Homo sapiens
  Heavy chain CDR3 for antibody 3640 (IGHV3-33)
ARDHSGSYFNWFDP

SEQ ID NO: 7281 - protein, 9 aa, Homo sapiens
  Light chain CDR3 for antibody 3641 (IGKV3D-7)
QQDYNLPLT

SEQ ID NO: 7282 - protein, 13 aa, Homo sapiens
  Heavy chain CDR3 for antibody 3641 (IGHV3-33)
ARQSSGWFDAFDI

SEQ ID NO: 7283 - protein, 8 aa, Homo sapiens
  Light chain CDR3 for antibody 3642 (IGKV1D-13)
QQFNNYPT

SEQ ID NO: 7284 - protein, 13 aa, Homo sapiens
  Heavy chain CDR3 for antibody 3642 (IGHV3-33)
ARDQRYSSGWYDY

SEQ ID NO: 7285 - protein, 9 aa, Homo sapiens
  Light chain CDR3 for antibody 3643 (IGKV1-9)
QQLKSYLYT

SEQ ID NO: 7286 - protein, 13 aa, Homo sapiens
  Heavy chain CDR3 for antibody 3643 (IGHV3-11)
ARDGGAAAGTWDS

SEQ ID NO: 7287 - protein, 9 aa, Homo sapiens
  Light chain CDR3 for antibody 3644 (IGKV3D-7)
QQDYEFPLT

SEQ ID NO: 7288 - protein, 18 aa, Homo sapiens
  Heavy chain CDR3 for antibody 3644 (IGHV4-59)
AREGHYYTSGSYYKAFDY

SEQ ID NO: 7289 - protein, 9 aa, Homo sapiens
  Light chain CDR3 for antibody 3645 (IGKV5-2)
LQHDNFPWT

SEQ ID NO: 7290 - protein, 19 aa, Homo sapiens
  Heavy chain CDR3 for antibody 3645 (IGHV4-39)
ARLDYDFLTDYYRPYFFAY

SEQ ID NO: 7291 - protein, 9 aa, Homo sapiens
  Light chain CDR3 for antibody 3646 (IGKV3-15)
QQYNNWPLT

SEQ ID NO: 7292 - protein, 12 aa, Homo sapiens
  Heavy chain CDR3 for antibody 3646 (IGHV1-18)
ARVLFDGDYFDY

SEQ ID NO: 7293 - protein, 9 aa, Homo sapiens
  Light chain CDR3 for antibody 3647 (IGKV1-6)
LQDYNYPYT

SEQ ID NO: 7294 - protein, 13 aa, Homo sapiens
  Heavy chain CDR3 for antibody 3647 (IGHV3-33)
ARAFTMVRGVIDY

SEQ ID NO: 7295 - protein, 8 aa, Homo sapiens
  Light chain CDR3 for antibody 3648 (IGKV3-20)
QQYGRSFT

SEQ ID NO: 7296 - protein, 13 aa, Homo sapiens
  Heavy chain CDR3 for antibody 3648 (IGHV4-39)
ARHVLLWFGEFDP

SEQ ID NO: 7297 - protein, 9 aa, Homo sapiens
  Light chain CDR3 for antibody 3649 (IGKV6-21)
HQSSSLPYT

SEQ ID NO: 7298 - protein, 12 aa, Homo sapiens
  Heavy chain CDR3 for antibody 3649 (IGHV4-39)
ARDSGSYYFFDY

SEQ ID NO: 7299 - protein, 9 aa, Homo sapiens
  Light chain CDR3 for antibody 3650 (IGKV1-33)
QQYDNLPFT

SEQ ID NO: 7300 - protein, 16 aa, Homo sapiens
  Heavy chain CDR3 for antibody 3650 (IGHV3-23)
AKEGMVLRYFDWLWDY

SEQ ID NO: 7301 - protein, 9 aa, Homo sapiens
  Light chain CDR3 for antibody 3651 (IGKV1-6)
LQDYNYPYT

SEQ ID NO: 7302 - protein, 17 aa, Homo sapiens
  Heavy chain CDR3 for antibody 3651 (IGHV3-33)
ARAYYDILTGYYIHCDY

SEQ ID NO: 7303 - protein, 9 aa, Homo sapiens
  Light chain CDR3 for antibody 3652 (IGKV1D-13)
QQFNNYPHT

SEQ ID NO: 7304 - protein, 16 aa, Homo sapiens
  Heavy chain CDR3 for antibody 3652 (IGHV4-59)
ARDTPYYSGSGRPFDS

SEQ ID NO: 7305 - protein, 9 aa, Homo sapiens
  Light chain CDR3 for antibody 3653 (IGKV1-27)
QKYNSAPYT

SEQ ID NO: 7306 - protein, 14 aa, Homo sapiens
  Heavy chain CDR3 for antibody 3653 (IGHV3-33)
ARDRRDFYYYGMDV

SEQ ID NO: 7307 - protein, 9 aa, Homo sapiens
  Light chain CDR3 for antibody 3654 (IGKV3D-20)
QQYGSSPYT

SEQ ID NO: 7308 - protein, 15 aa, Homo sapiens
  Heavy chain CDR3 for antibody 3654 (IGHV3-33)
ARDEHYDILTGYWGY

SEQ ID NO: 7309 - protein, 8 aa, Homo sapiens
  Light chain CDR3 for antibody 3655 (IGKV3D-7)
QQDYNLLT

SEQ ID NO: 7310 - protein, 17 aa, Homo sapiens
  Heavy chain CDR3 for antibody 3655 (IGHV3-33)
ARESLKLGIYYYYGMDV

SEQ ID NO: 7311 - protein, 9 aa, Homo sapiens
  Light chain CDR3 for antibody 3656 (IGKV3D-20)
QQYGSSPYT

SEQ ID NO: 7312 - protein, 13 aa, Homo sapiens
  Heavy chain CDR3 for antibody 3656 (IGHV3-33)
ARDDDYGDYPFDY

SEQ ID NO: 7313 - protein, 9 aa, Homo sapiens
  Light chain CDR3 for antibody 3657 (IGKV1-6)
QQEYNYPLT

SEQ ID NO: 7314 - protein, 14 aa, Homo sapiens
  Heavy chain CDR3 for antibody 3657 (IGHV1-2)
ARDYYGSGNYYMGY

SEQ ID NO: 7315 - protein, 9 aa, Homo sapiens
  Light chain CDR3 for antibody 3658 (IGKV5-2)
LQHDNFPWT

SEQ ID NO: 7316 - protein, 11 aa, Homo sapiens
  Heavy chain CDR3 for antibody 3658 (IGHV1-24)
ATYFGSGSLDY

SEQ ID NO: 7317 - protein, 9 aa, Homo sapiens
  Light chain CDR3 for antibody 3659 (IGKV1-9)
QQLISYPLT

SEQ ID NO: 7318 - protein, 17 aa, Homo sapiens
  Heavy chain CDR3 for antibody 3659 (IGHV1-18)
ARDEGYDILTGYPHFDY

SEQ ID NO: 7319 - protein, 10 aa, Homo sapiens
  Light chain CDR3 for antibody 3660 (IGKV3-15)
QQYNNWPPYT

SEQ ID NO: 7320 - protein, 15 aa, Homo sapiens
  Heavy chain CDR3 for antibody 3660 (IGHV3-30)
ARGAMVRGVDYGMDV

SEQ ID NO: 7321 - protein, 9 aa, Homo sapiens
  Light chain CDR3 for antibody 3661 (IGKV1-6)
LQDYNYPYT

SEQ ID NO: 7322 - protein, 20 aa, Homo sapiens
  Heavy chain CDR3 for antibody 3661 (IGHV3-33)
ARDRCSSTSCYGYYYYGMDV

SEQ ID NO: 7323 - protein, 9 aa, Homo sapiens
  Light chain CDR3 for antibody 3662 (IGKV3-11)
QQRSNWPYT

SEQ ID NO: 7324 - protein, 19 aa, Homo sapiens
  Heavy chain CDR3 for antibody 3662 (IGHV1-18)
ARDDILTGYSLYYYYGMDV

SEQ ID NO: 7325 - protein, 8 aa, Homo sapiens
  Light chain CDR3 for antibody 3663 (IGKV1-5)
QQYNSYYT

SEQ ID NO: 7326 - protein, 14 aa, Homo sapiens
  Heavy chain CDR3 for antibody 3663 (IGHV3-33)
ARDWNDVYYYGMDV

SEQ ID NO: 7327 - protein, 9 aa, Homo sapiens
  Light chain CDR3 for antibody 3664 (IGKV2-30)
MQGTHWPLT

SEQ ID NO: 7328 - protein, 13 aa, Homo sapiens
  Heavy chain CDR3 for antibody 3664 (IGHV4-59)
ARTMVRGVAPFDY

SEQ ID NO: 7329 - protein, 9 aa, Homo sapiens
  Light chain CDR3 for antibody 3665 (IGKV1-39)
QQSYSTPLT

SEQ ID NO: 7330 - protein, 20 aa, Homo sapiens
  Heavy chain CDR3 for antibody 3665 (IGHV3-33)
ARDPAQLERRYYYFYYGMDV

SEQ ID NO: 7331 - protein, 9 aa, Homo sapiens
  Light chain CDR3 for antibody 3666 (IGKV1-33)
QQYDNLPFT

SEQ ID NO: 7332 - protein, 13 aa, Homo sapiens
  Heavy chain CDR3 for antibody 3666 (IGHV4-34)
ASNFYYYYYGMDV

SEQ ID NO: 7333 - protein, 9 aa, Homo sapiens
  Light chain CDR3 for antibody 3667 (IGKV1-17)
LQHNSYPYT

SEQ ID NO: 7334 - protein, 14 aa, Homo sapiens
  Heavy chain CDR3 for antibody 3667 (IGHV1-46)
ARAYYAFLTGALDI

SEQ ID NO: 7335 - protein, 9 aa, Homo sapiens
  Light chain CDR3 for antibody 3668 (IGKV1-39)
QQSYSTPFT

SEQ ID NO: 7336 - protein, 17 aa, Homo sapiens
  Heavy chain CDR3 for antibody 3668 (IGHV3-23)
AKKGILTGYYPSYGMDV

SEQ ID NO: 7337 - protein, 9 aa, Homo sapiens
  Light chain CDR3 for antibody 3669 (IGKV1-17)
LQHNSYPYT

SEQ ID NO: 7338 - protein, 14 aa, Homo sapiens
  Heavy chain CDR3 for antibody 3669 (IGHV3-20)
ARGGSSGWYDWFDP

SEQ ID NO: 7339 - protein, 9 aa, Homo sapiens
  Light chain CDR3 for antibody 3670 (IGKV1D-13)
QQFNNYPHT

SEQ ID NO: 7340 - protein, 17 aa, Homo sapiens
  Heavy chain CDR3 for antibody 3670 (IGHV4-39)
ARVLRYFDWLSHDAFDI

SEQ ID NO: 7341 - protein, 10 aa, Homo sapiens
  Light chain CDR3 for antibody 3671 (IGKV1-39)
QQSYSTPMYT

SEQ ID NO: 7342 - protein, 12 aa, Homo sapiens
  Heavy chain CDR3 for antibody 3671 (IGHV3-33)
TRGYSSKSYFDY

SEQ ID NO: 7343 - protein, 9 aa, Homo sapiens
  Light chain CDR3 for antibody 3672 (IGKV1-39)
QQSYSTPLT

SEQ ID NO: 7344 - protein, 15 aa, Homo sapiens
  Heavy chain CDR3 for antibody 3672 (IGHV3-23)
AKEFTMVRGVITPDY

SEQ ID NO: 7345 - protein, 9 aa, Homo sapiens
  Light chain CDR3 for antibody 3673 (IGKV3D-7)
QQDYNLPLT

SEQ ID NO: 7346 - protein, 18 aa, Homo sapiens
  Heavy chain CDR3 for antibody 3673 (IGHV3-33)
ARDRYYDILTGYYMGFDY

SEQ ID NO: 7347 - protein, 10 aa, Homo sapiens
  Light chain CDR3 for antibody 3674 (IGKV1-17)
LQHNSYPMYT

SEQ ID NO: 7348 - protein, 11 aa, Homo sapiens
  Heavy chain CDR3 for antibody 3674 (IGHV3-33)
ARDKSSGWSDY

SEQ ID NO: 7349 - protein, 9 aa, Homo sapiens
  Light chain CDR3 for antibody 3675 (IGKV3D-7)
QQDYNLPLT

SEQ ID NO: 7350 - protein, 14 aa, Homo sapiens
  Heavy chain CDR3 for antibody 3675 (IGHV3-15)
SIYYYGSGRDFFDY

SEQ ID NO: 7351 - protein, 9 aa, Homo sapiens
  Light chain CDR3 for antibody 3676 (IGKV1D-16)
QQYNSYPLT

SEQ ID NO: 7352 - protein, 17 aa, Homo sapiens
  Heavy chain CDR3 for antibody 3676 (IGHV3-33)
ARKDYGILSGYYSPFDY

SEQ ID NO: 7353 - protein, 9 aa, Homo sapiens
  Light chain CDR3 for antibody 3677 (IGKV5-2)
LQHDNFPYT

SEQ ID NO: 7354 - protein, 12 aa, Homo sapiens
  Heavy chain CDR3 for antibody 3677 (IGHV3-33)
ARDYISTYGMDV

SEQ ID NO: 7355 - protein, 9 aa, Homo sapiens
  Light chain CDR3 for antibody 3678 (IGKV2-30)
MQGTHWPLT

SEQ ID NO: 7356 - protein, 17 aa, Homo sapiens
  Heavy chain CDR3 for antibody 3678 (IGHV1-18)
ARERYYGSGIYKYAMDV

SEQ ID NO: 7357 - protein, 9 aa, Homo sapiens
  Light chain CDR3 for antibody 3679 (IGKV3D-7)
QQDYNLPWT

SEQ ID NO: 7358 - protein, 17 aa, Homo sapiens
  Heavy chain CDR3 for antibody 3679 (IGHV3-66)
ARVQYDILTGYSPYFDN

SEQ ID NO: 7359 - protein, 9 aa, Homo sapiens
  Light chain CDR3 for antibody 3680 (IGKV1-9)
QQLNSYPLT

SEQ ID NO: 7360 - protein, 11 aa, Homo sapiens
  Heavy chain CDR3 for antibody 3680 (IGHV3-23)
AKKVYDYGSDY

SEQ ID NO: 7361 - protein, 9 aa, Homo sapiens
  Light chain CDR3 for antibody 3681 (IGKV1D-13)
QQFNNYPHT

SEQ ID NO: 7362 - protein, 18 aa, Homo sapiens
  Heavy chain CDR3 for antibody 3681 (IGHV3-33)
ARERGYYGSDIYPAAFDI

SEQ ID NO: 7363 - protein, 9 aa, Homo sapiens
  Light chain CDR3 for antibody 3682 (IGKV1D-13)
QQFNNYPYT

SEQ ID NO: 7364 - protein, 18 aa, Homo sapiens
  Heavy chain CDR3 for antibody 3682 (IGHV3-30)
ARDRHHDILTGYSDAFEI

SEQ ID NO: 7365 - protein, 10 aa, Homo sapiens
  Light chain CDR3 for antibody 3683 (IGKV3-11)
QQRSNWPALT

SEQ ID NO: 7366 - protein, 14 aa, Homo sapiens
  Heavy chain CDR3 for antibody 3683 (IGHV3-33)
ARDGYDFLTGPFDY

SEQ ID NO: 7367 - protein, 9 aa, Homo sapiens
  Light chain CDR3 for antibody 3684 (IGKV3D-20)
QQYGSSPYT

SEQ ID NO: 7368 - protein, 14 aa, Homo sapiens
  Heavy chain CDR3 for antibody 3684 (IGHV3-33)
ARDRGRHNYFGMDV

SEQ ID NO: 7369 - protein, 8 aa, Homo sapiens
  Light chain CDR3 for antibody 3685 (IGKV1D-13)
QQFNNYPT

SEQ ID NO: 7370 - protein, 14 aa, Homo sapiens
  Heavy chain CDR3 for antibody 3685 (IGHV3-33)
AREGYSSNWYDFDY

SEQ ID NO: 7371 - protein, 8 aa, Homo sapiens
  Light chain CDR3 for antibody 3686 (IGKV1D-13)
QQFNNYPT

SEQ ID NO: 7372 - protein, 15 aa, Homo sapiens
  Heavy chain CDR3 for antibody 3686 (IGHV1-18)
ARGYCSSTSCYYFDY

SEQ ID NO: 7373 - protein, 9 aa, Homo sapiens
  Light chain CDR3 for antibody 3687 (IGKV5-2)
LQHDKFPYT

SEQ ID NO: 7374 - protein, 20 aa, Homo sapiens
  Heavy chain CDR3 for antibody 3687 (IGHV3-33)
ARDLGWATMVRGVIRAPFDY

SEQ ID NO: 7375 - protein, 9 aa, Homo sapiens
  Light chain CDR3 for antibody 3688 (IGKV3D-7)
QQDYNLPYT

SEQ ID NO: 7376 - protein, 12 aa, Homo sapiens
  Heavy chain CDR3 for antibody 3688 (IGHV3-33)
AREGDILTGYSL

SEQ ID NO: 7377 - protein, 9 aa, Homo sapiens
  Light chain CDR3 for antibody 3689 (IGKV6-21)
HQSSSLPYT

SEQ ID NO: 7378 - protein, 12 aa, Homo sapiens
  Heavy chain CDR3 for antibody 3689 (IGHV3-33)
AREEAVAEAFDI

SEQ ID NO: 7379 - protein, 9 aa, Homo sapiens
  Light chain CDR3 for antibody 3690 (IGKV1-17)
LQHNSYPYT

SEQ ID NO: 7380 - protein, 17 aa, Homo sapiens
  Heavy chain CDR3 for antibody 3690 (IGHV3-33)
ARGEQWLGYYYYYGMDV

SEQ ID NO: 7381 - protein, 9 aa, Homo sapiens
  Light chain CDR3 for antibody 3691 (IGKV5-2)
LQHDNFPWT

SEQ ID NO: 7382 - protein, 17 aa, Homo sapiens
  Heavy chain CDR3 for antibody 3691 (IGHV3-33)
ARDQDDILTGYYWYFDL

SEQ ID NO: 7383 - protein, 8 aa, Homo sapiens
  Light chain CDR3 for antibody 3692 (IGKV3D-7)
QQDYNLLT

SEQ ID NO: 7384 - protein, 16 aa, Homo sapiens
  Heavy chain CDR3 for antibody 3692 (IGHV3-33)
ARGGRSDWLYYYGMDV

SEQ ID NO: 7385 - protein, 9 aa, Homo sapiens
  Light chain CDR3 for antibody 3693 (IGKV6-21)
HQSSSLPYT

SEQ ID NO: 7386 - protein, 11 aa, Homo sapiens
  Heavy chain CDR3 for antibody 3693 (IGHV3-23)
AKAGIVGCLDV

SEQ ID NO: 7387 - protein, 9 aa, Homo sapiens
  Light chain CDR3 for antibody 3694 (IGKV3-11)
QQRSNWPLT

SEQ ID NO: 7388 - protein, 11 aa, Homo sapiens
  Heavy chain CDR3 for antibody 3694 (IGHV3-13)
AREAIIGPFDY

SEQ ID NO: 7389 - protein, 8 aa, Homo sapiens
  Light chain CDR3 for antibody 3695 (IGKV6-21)
HQSSSLPT

SEQ ID NO: 7390 - protein, 11 aa, Homo sapiens
  Heavy chain CDR3 for antibody 3695 (IGHV3-33)
ARDRSSGPFDY

SEQ ID NO: 7391 - protein, 8 aa, Homo sapiens
  Light chain CDR3 for antibody 3696 (IGKV1-5)
QQYNSYST

SEQ ID NO: 7392 - protein, 9 aa, Homo sapiens
  Heavy chain CDR3 for antibody 3696 (IGHV1-18)
ARGKDWFDP

SEQ ID NO: 7393 - protein, 9 aa, Homo sapiens
  Light chain CDR3 for antibody 3697 (IGKV1-17)
LQHNSYPYT

SEQ ID NO: 7394 - protein, 14 aa, Homo sapiens
  Heavy chain CDR3 for antibody 3697 (IGHV3-23)
AKDDIVRATGAFDI

SEQ ID NO: 7395 - protein, 8 aa, Homo sapiens
  Light chain CDR3 for antibody 3698 (IGKV1D-13)
QQFNNYPT

SEQ ID NO: 7396 - protein, 11 aa, Homo sapiens
  Heavy chain CDR3 for antibody 3698 (IGHV4-59)
AREMGHDTFDI

SEQ ID NO: 7397 - protein, 9 aa, Homo sapiens
  Light chain CDR3 for antibody 3699 (IGKV3-15)
QQYNNWPLT

SEQ ID NO: 7398 - protein, 15 aa, Homo sapiens
  Heavy chain CDR3 for antibody 3699 (IGHV1-18)
ARGYCSSTSCYYFDY

SEQ ID NO: 7399 - protein, 9 aa, Homo sapiens
  Light chain CDR3 for antibody 3700 (IGKV1-9)
QQLNSYPWT

SEQ ID NO: 7400 - protein, 19 aa, Homo sapiens
  Heavy chain CDR3 for antibody 3700 (IGHV3-33)
ARDRYYDILTGYSSYYFDY

SEQ ID NO: 7401 - protein, 9 aa, Homo sapiens
  Light chain CDR3 for antibody 3701 (IGKV3D-20)
QQYGSSPYT

SEQ ID NO: 7402 - protein, 12 aa, Homo sapiens
  Heavy chain CDR3 for antibody 3701 (IGHV3-33)
ARGYFTSGSAHY

SEQ ID NO: 7403 - protein, 9 aa, Homo sapiens
  Light chain CDR3 for antibody 3702 (IGKV1-9)
QQYNSYPLT

SEQ ID NO: 7404 - protein, 13 aa, Homo sapiens
  Heavy chain CDR3 for antibody 3702 (IGHV4-39)
ARPGIVAAGWFDP

SEQ ID NO: 7405 - protein, 9 aa, Homo sapiens
  Light chain CDR3 for antibody 3703 (IGKV5-2)
LQHDNFPYT

SEQ ID NO: 7406 - protein, 15 aa, Homo sapiens
  Heavy chain CDR3 for antibody 3703 (IGHV3-23)
AKDRDYDFLSGPFDY

SEQ ID NO: 7407 - protein, 10 aa, Homo sapiens
  Light chain CDR3 for antibody 3704 (IGKV3-11)
QQRSNWPIFT

SEQ ID NO: 7408 - protein, 10 aa, Homo sapiens
  Heavy chain CDR3 for antibody 3704 (IGHV3-23)
AKDHYGDYPY

SEQ ID NO: 7409 - protein, 9 aa, Homo sapiens
  Light chain CDR3 for antibody 3705 (IGKV2-30)
MQGTHWPLT

SEQ ID NO: 7410 - protein, 14 aa, Homo sapiens
  Heavy chain CDR3 for antibody 3705 (IGHV3-33)
ARQYSYGYPYYFDY

SEQ ID NO: 7411 - protein, 8 aa, Homo sapiens
  Light chain CDR3 for antibody 3706 (IGKV3D-7)
QQDYNLLT

SEQ ID NO: 7412 - protein, 15 aa, Homo sapiens
  Heavy chain CDR3 for antibody 3706 (IGHV3-20)
ARDRGSSGWRDWFDP

SEQ ID NO: 7413 - protein, 8 aa, Homo sapiens
  Light chain CDR3 for antibody 3707 (IGKV3D-7)
QQDYNLLT

SEQ ID NO: 7414 - protein, 19 aa, Homo sapiens
  Heavy chain CDR3 for antibody 3707 (IGHV3-33)
ARGVRLRYFDPYYYYGMDV

SEQ ID NO: 7415 - protein, 9 aa, Homo sapiens
  Light chain CDR3 for antibody 3708 (IGKV3-11)
QQRSNWPLT

SEQ ID NO: 7416 - protein, 12 aa, Homo sapiens
  Heavy chain CDR3 for antibody 3708 (IGHV4-59)
ARVDSSGWFFDY

SEQ ID NO: 7417 - protein, 9 aa, Homo sapiens
  Light chain CDR3 for antibody 3709 (IGKV6-21)
HQSSSLPYT

SEQ ID NO: 7418 - protein, 11 aa, Homo sapiens
  Heavy chain CDR3 for antibody 3709 (IGHV3-33)
ARDQGGSSFDY

SEQ ID NO: 7419 - protein, 9 aa, Homo sapiens
  Light chain CDR3 for antibody 3710 (IGKV3D-7)
QQDYNLPLT

SEQ ID NO: 7420 - protein, 14 aa, Homo sapiens
  Heavy chain CDR3 for antibody 3710 (IGHV1-18)
ARCFGSGSYGWFDP

SEQ ID NO: 7421 - protein, 9 aa, Homo sapiens
  Light chain CDR3 for antibody 3711 (IGKV1-6)
LQDYNYPYT

SEQ ID NO: 7422 - protein, 13 aa, Homo sapiens
  Heavy chain CDR3 for antibody 3711 (IGHV3-33)
ARDSGSYSYYFNY

SEQ ID NO: 7423 - protein, 9 aa, Homo sapiens
  Light chain CDR3 for antibody 3712 (IGKV6-21)
HQSSSLPYT

SEQ ID NO: 7424 - protein, 12 aa, Homo sapiens
  Heavy chain CDR3 for antibody 3712 (IGHV4-39)
ARREVILGAFDY

SEQ ID NO: 7425 - protein, 9 aa, Homo sapiens
  Light chain CDR3 for antibody 3713 (IGKV6-21)
HQSSSLPHT

SEQ ID NO: 7426 - protein, 10 aa, Homo sapiens
  Heavy chain CDR3 for antibody 3713 (IGHV3-33)
ARDHGWCFDY

SEQ ID NO: 7427 - protein, 9 aa, Homo sapiens
  Light chain CDR3 for antibody 3714 (IGKV1D-13)
QQFNNYPYT

SEQ ID NO: 7428 - protein, 10 aa, Homo sapiens
  Heavy chain CDR3 for antibody 3714 (IGHV3-30)
AREWYGGMDV

SEQ ID NO: 7429 - protein, 9 aa, Homo sapiens
  Light chain CDR3 for antibody 3715 (IGKV3-20)
QQYGSSPYT

SEQ ID NO: 7430 - protein, 17 aa, Homo sapiens
  Heavy chain CDR3 for antibody 3715 (IGHV3-33)
AREGYYYGSGSYHFFDY

SEQ ID NO: 7431 - protein, 9 aa, Homo sapiens
  Light chain CDR3 for antibody 3716 (IGKV6-21)
HQSSSLPYT

SEQ ID NO: 7432 - protein, 14 aa, Homo sapiens
  Heavy chain CDR3 for antibody 3716 (IGHV3-20)
ARGGSSGWYDWFDP

SEQ ID NO: 7433 - protein, 9 aa, Homo sapiens
  Light chain CDR3 for antibody 3717 (IGKV3-20)
QQYGSSPYT

SEQ ID NO: 7434 - protein, 13 aa, Homo sapiens
  Heavy chain CDR3 for antibody 3717 (IGHV4-39)
ARRDGSYYGYFGY

SEQ ID NO: 7435 - protein, 9 aa, Homo sapiens
  Light chain CDR3 for antibody 3718 (IGKV1-9)
LQDYNSPFT

SEQ ID NO: 7436 - protein, 18 aa, Homo sapiens
  Heavy chain CDR3 for antibody 3718 (IGHV4-59)
AREGHYYTSGSYYKAFDY

SEQ ID NO: 7437 - protein, 8 aa, Homo sapiens
  Light chain CDR3 for antibody 3719 (IGKV3D-7)
QQDYNLLT

SEQ ID NO: 7438 - protein, 15 aa, Homo sapiens
  Heavy chain CDR3 for antibody 3719 (IGHV1-18)
ARGYCSSTSCYYFDY

SEQ ID NO: 7439 - protein, 8 aa, Homo sapiens
  Light chain CDR3 for antibody 3720 (IGKV1D-13)
QQFNNYPT

SEQ ID NO: 7440 - protein, 11 aa, Homo sapiens
  Heavy chain CDR3 for antibody 3720 (IGHV3-33)
AREAANWGFDY

SEQ ID NO: 7441 - protein, 9 aa, Homo sapiens
  Light chain CDR3 for antibody 3721 (IGKV1-17)
LQHNSYPYT

SEQ ID NO: 7442 - protein, 10 aa, Homo sapiens
  Heavy chain CDR3 for antibody 3721 (IGHV3-23)
ATIVGPFLDV

SEQ ID NO: 7443 - protein, 9 aa, Homo sapiens
  Light chain CDR3 for antibody 3722 (IGKV3-20)
QQYGSSPYT

SEQ ID NO: 7444 - protein, 12 aa, Homo sapiens
  Heavy chain CDR3 for antibody 3722 (IGHV3-33)
ARKGYGLYVLDV

SEQ ID NO: 7445 - protein, 9 aa, Homo sapiens
  Light chain CDR3 for antibody 3723 (IGKV1D-13)
QQFNNYPHT

SEQ ID NO: 7446 - protein, 11 aa, Homo sapiens
  Heavy chain CDR3 for antibody 3723 (IGHV3-74)
ARDRGNWGFDY

SEQ ID NO: 7447 - protein, 9 aa, Homo sapiens
  Light chain CDR3 for antibody 3724 (IGKV1-39)
QQSYSTPLT

SEQ ID NO: 7448 - protein, 13 aa, Homo sapiens
  Heavy chain CDR3 for antibody 3724 (IGHV3-33)
ARDSSSWYHWFDP

SEQ ID NO: 7449 - protein, 9 aa, Homo sapiens
  Light chain CDR3 for antibody 3725 (IGKV1-27)
QKYNSAPYT

SEQ ID NO: 7450 - protein, 17 aa, Homo sapiens
  Heavy chain CDR3 for antibody 3725 (IGHV4-34)
AGLRFFDWLFDYYGMDV

SEQ ID NO: 7451 - protein, 9 aa, Homo sapiens
  Light chain CDR3 for antibody 3726 (IGKV6-21)
HQSSSLPYT

SEQ ID NO: 7452 - protein, 12 aa, Homo sapiens
  Heavy chain CDR3 for antibody 3726 (IGHV4-39)
ARHPRYLDAFDI

SEQ ID NO: 7453 - protein, 9 aa, Homo sapiens
  Light chain CDR3 for antibody 3727 (IGKV1D-16)
QQYNSFPLT

SEQ ID NO: 7454 - protein, 18 aa, Homo sapiens
  Heavy chain CDR3 for antibody 3727 (IGHV4-59)
AREGHYYTSGSYYKAFDY

SEQ ID NO: 7455 - protein, 9 aa, Homo sapiens
  Light chain CDR3 for antibody 3728 (IGKV5-2)
LQHDNFPYT

SEQ ID NO: 7456 - protein, 17 aa, Homo sapiens
  Heavy chain CDR3 for antibody 3728 (IGHV3-30)
ARDGVGATSYYYYGMDV

SEQ ID NO: 7457 - protein, 9 aa, Homo sapiens
  Light chain CDR3 for antibody 3729 (IGKV3-11)
QQRSNWMYT

SEQ ID NO: 7458 - protein, 13 aa, Homo sapiens
  Heavy chain CDR3 for antibody 3729 (IGHV3-33)
ARRYRSGWYPFDY

SEQ ID NO: 7459 - protein, 9 aa, Homo sapiens
  Light chain CDR3 for antibody 3730 (IGKV1-17)
LQHNSYPYT

SEQ ID NO: 7460 - protein, 10 aa, Homo sapiens
  Heavy chain CDR3 for antibody 3730 (IGHV3-30)
ARDNFEGMDV

SEQ ID NO: 7461 - protein, 10 aa, Homo sapiens
  Light chain CDR3 for antibody 3731 (IGKV3-11)
QQRSNWPIFT

SEQ ID NO: 7462 - protein, 13 aa, Homo sapiens
  Heavy chain CDR3 for antibody 3731 (IGHV4-39)
ARREVVGGRGFDY

SEQ ID NO: 7463 - protein, 9 aa, Homo sapiens
  Light chain CDR3 for antibody 3732 (IGKV1D-13)
QQFNNYPYT

SEQ ID NO: 7464 - protein, 17 aa, Homo sapiens
  Heavy chain CDR3 for antibody 3732 (IGHV3-15)
TTERYPRRYYYYFGMDV

SEQ ID NO: 7465 - protein, 9 aa, Homo sapiens
  Light chain CDR3 for antibody 3733 (IGKV1-39)
QQSYRTPLT

SEQ ID NO: 7466 - protein, 17 aa, Homo sapiens
  Heavy chain CDR3 for antibody 3733 (IGHV3-15)
TTERYPRRYYYYFGMDV

SEQ ID NO: 7467 - protein, 9 aa, Homo sapiens
  Light chain CDR3 for antibody 3734 (IGKV1-6)
QQEYNYPLT

SEQ ID NO: 7468 - protein, 15 aa, Homo sapiens
  Heavy chain CDR3 for antibody 3734 (IGHV1-18)
ARGYCSSTSCYYFDY

SEQ ID NO: 7469 - protein, 9 aa, Homo sapiens
  Light chain CDR3 for antibody 3735 (IGKV2D-28)
MQALQTPPT

SEQ ID NO: 7470 - protein, 13 aa, Homo sapiens
  Heavy chain CDR3 for antibody 3735 (IGHV3-11)
ARDGGAAAGTWDS

SEQ ID NO: 7471 - protein, 9 aa, Homo sapiens
  Light chain CDR3 for antibody 3736 (IGKV1D-13)
QQFNNYPYT

SEQ ID NO: 7472 - protein, 10 aa, Homo sapiens
  Heavy chain CDR3 for antibody 3736 (IGHV3-33)
ARDLGWSFDH

SEQ ID NO: 7473 - protein, 8 aa, Homo sapiens
  Light chain CDR3 for antibody 3737 (IGKV1D-13)
QQFNNYPT

SEQ ID NO: 7474 - protein, 11 aa, Homo sapiens
  Heavy chain CDR3 for antibody 3737 (IGHV3-33)
ARDTWDDYFDY

SEQ ID NO: 7475 - protein, 9 aa, Homo sapiens
  Light chain CDR3 for antibody 3738 (IGKV1-9)
QQVKSYPYT

SEQ ID NO: 7476 - protein, 15 aa, Homo sapiens
  Heavy chain CDR3 for antibody 3738 (IGHV1-46)
ARGAVDDYYYYGMDV

SEQ ID NO: 7477 - protein, 9 aa, Homo sapiens
  Light chain CDR3 for antibody 3739 (IGKV1-6)
LQDYNYPFT

SEQ ID NO: 7478 - protein, 16 aa, Homo sapiens
  Heavy chain CDR3 for antibody 3739 (IGHV1-46)
ARGGGYSGSYSNWFDP

SEQ ID NO: 7479 - protein, 9 aa, Homo sapiens
  Light chain CDR3 for antibody 3740 (IGKV3D-7)
QQDYNLPLT

SEQ ID NO: 7480 - protein, 16 aa, Homo sapiens
  Heavy chain CDR3 for antibody 3740 (IGHV3-33)
ARGGRSDWLYYYGMDV

SEQ ID NO: 7481 - protein, 9 aa, Homo sapiens
  Light chain CDR3 for antibody 3741 (IGKV5-2)
LQHDNFPYT

SEQ ID NO: 7482 - protein, 17 aa, Homo sapiens
  Heavy chain CDR3 for antibody 3741 (IGHV3-23)
AKGNYGSGSYYNGDFQH

SEQ ID NO: 7483 - protein, 9 aa, Homo sapiens
  Light chain CDR3 for antibody 3742 (IGKV3-11)
QQRSNWPYT

SEQ ID NO: 7484 - protein, 18 aa, Homo sapiens
  Heavy chain CDR3 for antibody 3742 (IGHV3-23)
AKDRITGTTYGYYSGLDV

SEQ ID NO: 7485 - protein, 9 aa, Homo sapiens
  Light chain CDR3 for antibody 3743 (IGKV1-27)
QKYNSAPYT

SEQ ID NO: 7486 - protein, 10 aa, Homo sapiens
  Heavy chain CDR3 for antibody 3743 (IGHV3-23)
AKDHYGDYPY

SEQ ID NO: 7487 - protein, 10 aa, Homo sapiens
  Light chain CDR3 for antibody 3744 (IGKV1-39)
QQSYSTPMYT

SEQ ID NO: 7488 - protein, 13 aa, Homo sapiens
  Heavy chain CDR3 for antibody 3744 (IGHV3-33)
ARTDYYFYYGLDV

SEQ ID NO: 7489 - protein, 9 aa, Homo sapiens
  Light chain CDR3 for antibody 3745 (IGKV5-2)
LQHDNFPYT

SEQ ID NO: 7490 - protein, 12 aa, Homo sapiens
  Heavy chain CDR3 for antibody 3745 (IGHV3-23)
AKGAVVTAIFDY

SEQ ID NO: 7491 - protein, 9 aa, Homo sapiens
  Light chain CDR3 for antibody 3746 (IGKV5-2)
LQHDNFPYT

SEQ ID NO: 7492 - protein, 13 aa, Homo sapiens
  Heavy chain CDR3 for antibody 3746 (IGHV3-33)
ASAGNSYYNVMDV

SEQ ID NO: 7493 - protein, 9 aa, Homo sapiens
  Light chain CDR3 for antibody 3747 (IGKV3-11)
QQRSNWMYT

SEQ ID NO: 7494 - protein, 24 aa, Homo sapiens
  Heavy chain CDR3 for antibody 3747 (IGHV3-20)
ARGRITMVRGVIINPLDYYNGMDV

SEQ ID NO: 7495 - protein, 9 aa, Homo sapiens
  Light chain CDR3 for antibody 3748 (IGKV3D-7)
QQDYNLPLT

SEQ ID NO: 7496 - protein, 15 aa, Homo sapiens
  Heavy chain CDR3 for antibody 3748 (IGHV3-23)
AKEALRYFDWSGMDV

SEQ ID NO: 7497 - protein, 9 aa, Homo sapiens
  Light chain CDR3 for antibody 3749 (IGKV2-30)
MQGTHWPLT

SEQ ID NO: 7498 - protein, 18 aa, Homo sapiens
  Heavy chain CDR3 for antibody 3749 (IGHV3-33)
ARDGYSGYDYYYYYGMDV

SEQ ID NO: 7499 - protein, 9 aa, Homo sapiens
  Light chain CDR3 for antibody 3750 (IGKV1-9)
QQLNSYPLT

SEQ ID NO: 7500 - protein, 15 aa, Homo sapiens
  Heavy chain CDR3 for antibody 3750 (IGHV4-39)
ARRDYDISTGYLFDY

SEQ ID NO: 7501 - protein, 9 aa, Homo sapiens
  Light chain CDR3 for antibody 3751 (IGKV3-20)
QQYGSSPLT

SEQ ID NO: 7502 - protein, 14 aa, Homo sapiens
  Heavy chain CDR3 for antibody 3751 (IGHV3-33)
ARASSGSSYWYIDL

SEQ ID NO: 7503 - protein, 9 aa, Homo sapiens
  Light chain CDR3 for antibody 3752 (IGKV3-15)
QQYNNWPYT

SEQ ID NO: 7504 - protein, 13 aa, Homo sapiens
  Heavy chain CDR3 for antibody 3752 (IGHV4-39)
ARRDVLAPAAFDY

SEQ ID NO: 7505 - protein, 9 aa, Homo sapiens
  Light chain CDR3 for antibody 3753 (IGKV2-30)
MQGTHWPLT

SEQ ID NO: 7506 - protein, 13 aa, Homo sapiens
  Heavy chain CDR3 for antibody 3753 (IGHV3-33)
ARGDNWNDGGFDY

SEQ ID NO: 7507 - protein, 9 aa, Homo sapiens
  Light chain CDR3 for antibody 3754 (IGKV3-20)
QQYGSSPYT

SEQ ID NO: 7508 - protein, 19 aa, Homo sapiens
  Heavy chain CDR3 for antibody 3754 (IGHV3-33)
ARIPGIAVAGGYYYYGMDV

SEQ ID NO: 7509 - protein, 8 aa, Homo sapiens
  Light chain CDR3 for antibody 3755 (IGKV3D-7)
QQDYNLLT

SEQ ID NO: 7510 - protein, 13 aa, Homo sapiens
  Heavy chain CDR3 for antibody 3755 (IGHV3-33)
ARAFTMVRGVIDY

SEQ ID NO: 7511 - protein, 9 aa, Homo sapiens
  Light chain CDR3 for antibody 3756 (IGKV1-39)
QQSYSTPLT

SEQ ID NO: 7512 - protein, 18 aa, Homo sapiens
  Heavy chain CDR3 for antibody 3756 (IGHV1-8)
ARSRIAAAGIYYYYGMDV

SEQ ID NO: 7513 - protein, 9 aa, Homo sapiens
  Light chain CDR3 for antibody 3757 (IGKV1-39)
QQSYRTPLT

SEQ ID NO: 7514 - protein, 11 aa, Homo sapiens
  Heavy chain CDR3 for antibody 3757 (IGHV3-33)
ARGSGSYAFDS

SEQ ID NO: 7515 - protein, 9 aa, Homo sapiens
  Light chain CDR3 for antibody 3758 (IGKV2-30)
MQGTHWPLT

SEQ ID NO: 7516 - protein, 18 aa, Homo sapiens
  Heavy chain CDR3 for antibody 3758 (IGHV3-23)
AKDRITGTTYGYYSGLDV

SEQ ID NO: 7517 - protein, 9 aa, Homo sapiens
  Light chain CDR3 for antibody 3759 (IGKV1-6)
LQDYNYPYT

SEQ ID NO: 7518 - protein, 14 aa, Homo sapiens
  Heavy chain CDR3 for antibody 3759 (IGHV3-33)
ARDGAAAALDAFDI

SEQ ID NO: 7519 - protein, 9 aa, Homo sapiens
  Light chain CDR3 for antibody 3760 (IGKV1-6)
LQDYNYPYT

SEQ ID NO: 7520 - protein, 15 aa, Homo sapiens
  Heavy chain CDR3 for antibody 3760 (IGHV3-11)
AREYSSGWYGDAFDI

SEQ ID NO: 7521 - protein, 9 aa, Homo sapiens
  Light chain CDR3 for antibody 3761 (IGKV3-20)
QQYGSSPLT

SEQ ID NO: 7522 - protein, 17 aa, Homo sapiens
  Heavy chain CDR3 for antibody 3761 (IGHV3-33)
ARDQDDILTGYYWYFDL

SEQ ID NO: 7523 - protein, 9 aa, Homo sapiens
  Light chain CDR3 for antibody 3762 (IGKV3D-7)
QQDYNLPLT

SEQ ID NO: 7524 - protein, 21 aa, Homo sapiens
  Heavy chain CDR3 for antibody 3762 (IGHV3-33)
ARDEYYEIVTGYGYYHYGMDV

SEQ ID NO: 7525 - protein, 9 aa, Homo sapiens
  Light chain CDR3 for antibody 3763 (IGKV1-6)
LQDYNYPYT

SEQ ID NO: 7526 - protein, 13 aa, Homo sapiens
  Heavy chain CDR3 for antibody 3763 (IGHV3-33)
AKRYSSGWYPFDF

SEQ ID NO: 7527 - protein, 9 aa, Homo sapiens
  Light chain CDR3 for antibody 3764 (IGKV3-20)
QQYGSSPYT

SEQ ID NO: 7528 - protein, 12 aa, Homo sapiens
  Heavy chain CDR3 for antibody 3764 (IGHV3-21)
AREGFGESSFDY

SEQ ID NO: 7529 - protein, 9 aa, Homo sapiens
  Light chain CDR3 for antibody 3765 (IGKV3D-7)
QQDYNLPYT

SEQ ID NO: 7530 - protein, 17 aa, Homo sapiens
  Heavy chain CDR3 for antibody 3765 (IGHV3-33)
ARVYYDILTGYSPAFDI

SEQ ID NO: 7531 - protein, 9 aa, Homo sapiens
  Light chain CDR3 for antibody 3766 (IGKV1D-13)
QQFNNYPRT

SEQ ID NO: 7532 - protein, 13 aa, Homo sapiens
  Heavy chain CDR3 for antibody 3766 (IGHV1-24)
ARVKLGSLGAFDI

SEQ ID NO: 7533 - protein, 9 aa, Homo sapiens
  Light chain CDR3 for antibody 3767 (IGKV1-27)
QKYNSAPYT

SEQ ID NO: 7534 - protein, 20 aa, Homo sapiens
  Heavy chain CDR3 for antibody 3767 (IGHV3-33)
ARDPAQLERRYYYFYYGMDV

SEQ ID NO: 7535 - protein, 9 aa, Homo sapiens
  Light chain CDR3 for antibody 3768 (IGKV1D-16)
QQYNSFPLT

SEQ ID NO: 7536 - protein, 20 aa, Homo sapiens
  Heavy chain CDR3 for antibody 3768 (IGHV3-20)
ARDLCSSTSCYGYYYYGMDV

SEQ ID NO: 7537 - protein, 9 aa, Homo sapiens
  Light chain CDR3 for antibody 3769 (IGKV3D-7)
QQDYNLPLT

SEQ ID NO: 7538 - protein, 15 aa, Homo sapiens
  Heavy chain CDR3 for antibody 3769 (IGHV3-33)
VCVLYDYGDYVGFDY

SEQ ID NO: 7539 - protein, 9 aa, Homo sapiens
  Light chain CDR3 for antibody 3770 (IGKV5-2)
LQHDNFPYT

SEQ ID NO: 7540 - protein, 12 aa, Homo sapiens
  Heavy chain CDR3 for antibody 3770 (IGHV3-33)
AREGIAVAGVDP

SEQ ID NO: 7541 - protein, 9 aa, Homo sapiens
  Light chain CDR3 for antibody 3771 (IGKV1D-13)
QQFNNYPYT

SEQ ID NO: 7542 - protein, 16 aa, Homo sapiens
  Heavy chain CDR3 for antibody 3771 (IGHV3-33)
AREVAGSYYYYYGMDV

SEQ ID NO: 7543 - protein, 9 aa, Homo sapiens
  Light chain CDR3 for antibody 3772 (IGKV1D-13)
QQFNNYPST

SEQ ID NO: 7544 - protein, 15 aa, Homo sapiens
  Heavy chain CDR3 for antibody 3772 (IGHV3-30)
ARRGYGSGSPDAFDL

SEQ ID NO: 7545 - protein, 9 aa, Homo sapiens
  Light chain CDR3 for antibody 3773 (IGKV1-17)
LQHNSYPYT

SEQ ID NO: 7546 - protein, 11 aa, Homo sapiens
  Heavy chain CDR3 for antibody 3773 (IGHV3-33)
ASWDILTGSGY

SEQ ID NO: 7547 - protein, 9 aa, Homo sapiens
  Light chain CDR3 for antibody 3774 (IGKV1-39)
QQSYSTPLT

SEQ ID NO: 7548 - protein, 14 aa, Homo sapiens
  Heavy chain CDR3 for antibody 3774 (IGHV4-39)
ARQGGSGSYYNLDY

SEQ ID NO: 7549 - protein, 9 aa, Homo sapiens
  Light chain CDR3 for antibody 3775 (IGKV3D-20)
QQYGSSPYT

SEQ ID NO: 7550 - protein, 14 aa, Homo sapiens
  Heavy chain CDR3 for antibody 3775 (IGHV3-33)
ARDLNYDILNGGGY

SEQ ID NO: 7551 - protein, 9 aa, Homo sapiens
  Light chain CDR3 for antibody 3776 (IGKV6-21)
HQSSSLPYT

SEQ ID NO: 7552 - protein, 16 aa, Homo sapiens
  Heavy chain CDR3 for antibody 3776 (IGHV3-23)
AKDLRYFDWSLYAFDI

SEQ ID NO: 7553 - protein, 9 aa, Homo sapiens
  Light chain CDR3 for antibody 3777 (IGKV5-2)
LQHDNFPYT

SEQ ID NO: 7554 - protein, 13 aa, Homo sapiens
  Heavy chain CDR3 for antibody 3777 (IGHV3-33)
ARDGYSYGPYFDY

SEQ ID NO: 7555 - protein, 11 aa, Homo sapiens
  Light chain CDR3 for antibody 3778 (IGKV3-11)
QQRSNWPPTWT

SEQ ID NO: 7556 - protein, 14 aa, Homo sapiens
  Heavy chain CDR3 for antibody 3778 (IGHV3-23)
AKSRIVGALYYFDY

SEQ ID NO: 7557 - protein, 9 aa, Homo sapiens
  Light chain CDR3 for antibody 3779 (IGKV1-27)
QKYNSAPYT

SEQ ID NO: 7558 - protein, 11 aa, Homo sapiens
  Heavy chain CDR3 for antibody 3779 (IGHV3-23)
AKGLWSYYFDY

SEQ ID NO: 7559 - protein, 9 aa, Homo sapiens
  Light chain CDR3 for antibody 3780 (IGKV3-15)
QQYNNWPLT

SEQ ID NO: 7560 - protein, 14 aa, Homo sapiens
  Heavy chain CDR3 for antibody 3780 (IGHV4-39)
ARHGYYGSSNWFDP

SEQ ID NO: 7561 - protein, 9 aa, Homo sapiens
  Light chain CDR3 for antibody 3781 (IGKV1D-16)
QQYYSYPRT

SEQ ID NO: 7562 - protein, 15 aa, Homo sapiens
  Heavy chain CDR3 for antibody 3781 (IGHV3-30)
ARRGYGSGSPDAFDL

SEQ ID NO: 7563 - protein, 9 aa, Homo sapiens
  Light chain CDR3 for antibody 3782 (IGKV1D-16)
QQYNSYPYT

SEQ ID NO: 7564 - protein, 10 aa, Homo sapiens
  Heavy chain CDR3 for antibody 3782 (IGHV3-33)
ARDHGWCFDY

SEQ ID NO: 7565 - protein, 9 aa, Homo sapiens
  Light chain CDR3 for antibody 3783 (IGKV1-6)
LQDFNYPRT

SEQ ID NO: 7566 - protein, 7 aa, Homo sapiens
  Heavy chain CDR3 for antibody 3783 (IGHV1-46)
AREGGDY

SEQ ID NO: 7567 - protein, 9 aa, Homo sapiens
  Light chain CDR3 for antibody 3784 (IGKV1-16)
QQYNSYPYT

SEQ ID NO: 7568 - protein, 11 aa, Homo sapiens
  Heavy chain CDR3 for antibody 3784 (IGHV1-18)
SRGGFSVGYDS

SEQ ID NO: 7569 - protein, 9 aa, Homo sapiens
  Light chain CDR3 for antibody 3785 (IGKV1-39)
QQSYSTPFT

SEQ ID NO: 7570 - protein, 15 aa, Homo sapiens
  Heavy chain CDR3 for antibody 3785 (IGHV3-33)
ARDRVVRGVMGYFDY

SEQ ID NO: 7571 - protein, 9 aa, Homo sapiens
  Light chain CDR3 for antibody 3786 (IGKV3D-7)
QQDYEFPIT

SEQ ID NO: 7572 - protein, 11 aa, Homo sapiens
  Heavy chain CDR3 for antibody 3786 (IGHV4-59)
AREMGHDTFDI

SEQ ID NO: 7573 - protein, 9 aa, Homo sapiens
  Light chain CDR3 for antibody 3787 (IGKV1-27)
QKYNSAPYT

SEQ ID NO: 7574 - protein, 16 aa, Homo sapiens
  Heavy chain CDR3 for antibody 3787 (IGHV3-33)
ARDKNTDYDILTGFDY

SEQ ID NO: 7575 - protein, 9 aa, Homo sapiens
  Light chain CDR3 for antibody 3788 (IGKV1-9)
QQLNSYPLT

SEQ ID NO: 7576 - protein, 10 aa, Homo sapiens
  Heavy chain CDR3 for antibody 3788 (IGHV3-23)
AKDRYGDYVY

SEQ ID NO: 7577 - protein, 9 aa, Homo sapiens
  Light chain CDR3 for antibody 3789 (IGKV1-39)
QQSYRTPLT

SEQ ID NO: 7578 - protein, 13 aa, Homo sapiens
  Heavy chain CDR3 for antibody 3789 (IGHV3-33)
ANTGDSYYYDMDV

SEQ ID NO: 7579 - protein, 8 aa, Homo sapiens
  Light chain CDR3 for antibody 3790 (IGKV1-5)
QQYNSYWT

SEQ ID NO: 7580 - protein, 15 aa, Homo sapiens
  Heavy chain CDR3 for antibody 3790 (IGHV3-33)
ARDRGWKAPGYGMDV

SEQ ID NO: 7581 - protein, 10 aa, Homo sapiens
  Light chain CDR3 for antibody 3791 (IGKV3-11)
QQRSNWPIFT

SEQ ID NO: 7582 - protein, 16 aa, Homo sapiens
  Heavy chain CDR3 for antibody 3791 (IGHV3-33)
ARAVYYGSGSSLIMDV

SEQ ID NO: 7583 - protein, 9 aa, Homo sapiens
  Light chain CDR3 for antibody 3792 (IGKV3-15)
QQYNNWPLT

SEQ ID NO: 7584 - protein, 13 aa, Homo sapiens
  Heavy chain CDR3 for antibody 3792 (IGHV3-53)
ARSGSYWGYYFDY

SEQ ID NO: 7585 - protein, 9 aa, Homo sapiens
  Light chain CDR3 for antibody 3793 (IGKV3D-7)
QQDYNLPLT

SEQ ID NO: 7586 - protein, 18 aa, Homo sapiens
  Heavy chain CDR3 for antibody 3793 (IGHV3-33)
ARGGYSSGWDYYYYGMDV

SEQ ID NO: 7587 - protein, 9 aa, Homo sapiens
  Light chain CDR3 for antibody 3794 (IGKV2-30)
MQGTHWPYT

SEQ ID NO: 7588 - protein, 12 aa, Homo sapiens
  Heavy chain CDR3 for antibody 3794 (IGHV4-39)
ARHGSGSSYFDY

SEQ ID NO: 7589 - protein, 9 aa, Homo sapiens
  Light chain CDR3 for antibody 3795 (IGKV1-39)
QQSYSTPLT

SEQ ID NO: 7590 - protein, 11 aa, Homo sapiens
  Heavy chain CDR3 for antibody 3795 (IGHV3-21)
ARDRATATVDY

SEQ ID NO: 7591 - protein, 9 aa, Homo sapiens
  Light chain CDR3 for antibody 3796 (IGKV6-21)
HQSSSLPYT

SEQ ID NO: 7592 - protein, 13 aa, Homo sapiens
  Heavy chain CDR3 for antibody 3796 (IGHV3-33)
AKRYSSGWYPFDF

SEQ ID NO: 7593 - protein, 9 aa, Homo sapiens
  Light chain CDR3 for antibody 3797 (IGKV1-6)
LQDYNYPWT

SEQ ID NO: 7594 - protein, 17 aa, Homo sapiens
  Heavy chain CDR3 for antibody 3797 (IGHV4-59)
AREEDYFGSGSFGTFDI

SEQ ID NO: 7595 - protein, 9 aa, Homo sapiens
  Light chain CDR3 for antibody 3798 (IGKV3-15)
QQYNNWPLT

SEQ ID NO: 7596 - protein, 13 aa, Homo sapiens
  Heavy chain CDR3 for antibody 3798 (IGHV3-33)
ARGDNWNDGGFDY

SEQ ID NO: 7597 - protein, 9 aa, Homo sapiens
  Light chain CDR3 for antibody 3799 (IGKV1D-16)
QQYKSYPLT

SEQ ID NO: 7598 - protein, 16 aa, Homo sapiens
  Heavy chain CDR3 for antibody 3799 (IGHV4-59)
ARGRYFEWLLGDVFDI

SEQ ID NO: 7599 - protein, 9 aa, Homo sapiens
  Light chain CDR3 for antibody 3800 (IGKV1-6)
LQDFHYPWT

SEQ ID NO: 7600 - protein, 16 aa, Homo sapiens
  Heavy chain CDR3 for antibody 3800 (IGHV3-23)
AKEGMVLRYFDWLWDY

SEQ ID NO: 7601 - protein, 10 aa, Homo sapiens
  Light chain CDR3 for antibody 3801 (IGKV1-39)
QQSYSTPMYT

SEQ ID NO: 7602 - protein, 11 aa, Homo sapiens
  Heavy chain CDR3 for antibody 3801 (IGHV3-33)
ARDKSSGWSDY

SEQ ID NO: 7603 - protein, 9 aa, Homo sapiens
  Light chain CDR3 for antibody 3802 (IGKV5-2)
LQHDNFPYT

SEQ ID NO: 7604 - protein, 18 aa, Homo sapiens
  Heavy chain CDR3 for antibody 3802 (IGHV3-33)
ARGYNQGSGSYYNVCFDY

SEQ ID NO: 7605 - protein, 9 aa, Homo sapiens
  Light chain CDR3 for antibody 3803 (IGKV1D-13)
QQFNNYPHT

SEQ ID NO: 7606 - protein, 14 aa, Homo sapiens
  Heavy chain CDR3 for antibody 3803 (IGHV3-33)
ARDRDIMATSYFDY

SEQ ID NO: 7607 - protein, 8 aa, Homo sapiens
  Light chain CDR3 for antibody 3804 (IGKV3-20)
QQYGSSFT

SEQ ID NO: 7608 - protein, 13 aa, Homo sapiens
  Heavy chain CDR3 for antibody 3804 (IGHV3-33)
ARDYCGGDCYLDY

SEQ ID NO: 7609 - protein, 9 aa, Homo sapiens
  Light chain CDR3 for antibody 3805 (IGKV1-6)
LQDYNYPWT

SEQ ID NO: 7610 - protein, 18 aa, Homo sapiens
  Heavy chain CDR3 for antibody 3805 (IGHV3-33)
ARRSAAGTWDYYYCGMDV

SEQ ID NO: 7611 - protein, 9 aa, Homo sapiens
  Light chain CDR3 for antibody 3806 (IGKV6-21)
HQSSSLPHT

SEQ ID NO: 7612 - protein, 17 aa, Homo sapiens
  Heavy chain CDR3 for antibody 3806 (IGHV3-23)
AKGNYGSGSYYNGDFQH

SEQ ID NO: 7613 - protein, 9 aa, Homo sapiens
  Light chain CDR3 for antibody 3807 (IGKV6-21)
HQSSSLPYT

SEQ ID NO: 7614 - protein, 14 aa, Homo sapiens
  Heavy chain CDR3 for antibody 3807 (IGHV3-33)
ARDLDIMATSPFAY

SEQ ID NO: 7615 - protein, 9 aa, Homo sapiens
  Light chain CDR3 for antibody 3808 (IGKV1D-16)
QQYNSYPLT

SEQ ID NO: 7616 - protein, 17 aa, Homo sapiens
  Heavy chain CDR3 for antibody 3808 (IGHV3-11)
ARAGPRYDSSGHDAFDI

SEQ ID NO: 7617 - protein, 8 aa, Homo sapiens
  Light chain CDR3 for antibody 3809 (IGKV6-21)
HQSSSLPT

SEQ ID NO: 7618 - protein, 17 aa, Homo sapiens
  Heavy chain CDR3 for antibody 3809 (IGHV3-33)
ARGYCSRTSCYLYYFDY

SEQ ID NO: 7619 - protein, 10 aa, Homo sapiens
  Light chain CDR3 for antibody 3810 (IGKV1-33)
QQYDNLPPYT

SEQ ID NO: 7620 - protein, 16 aa, Homo sapiens
  Heavy chain CDR3 for antibody 3810 (IGHV3-30)
AKHGYSYGYWLGYFDY

SEQ ID NO: 7621 - protein, 9 aa, Homo sapiens
  Light chain CDR3 for antibody 3811 (IGKV1D-13)
QQFNNYPHT

SEQ ID NO: 7622 - protein, 14 aa, Homo sapiens
  Heavy chain CDR3 for antibody 3811 (IGHV3-20)
ARDGGSTCYDWFDP

SEQ ID NO: 7623 - protein, 9 aa, Homo sapiens
  Light chain CDR3 for antibody 3812 (IGKV3-11)
QQRSNWPYT

SEQ ID NO: 7624 - protein, 8 aa, Homo sapiens
  Heavy chain CDR3 for antibody 3812 (IGHV3-23)
AKESLLDY

SEQ ID NO: 7625 - protein, 9 aa, Homo sapiens
  Light chain CDR3 for antibody 3813 (IGKV1-9)
QQLKSYLYT

SEQ ID NO: 7626 - protein, 16 aa, Homo sapiens
  Heavy chain CDR3 for antibody 3813 (IGHV4-59)
ARGRYFEWLLGDVFDI

SEQ ID NO: 7627 - protein, 9 aa, Homo sapiens
  Light chain CDR3 for antibody 3814 (IGKV1D-13)
QQFNNYPHT

SEQ ID NO: 7628 - protein, 14 aa, Homo sapiens
  Heavy chain CDR3 for antibody 3814 (IGHV3-33)
AREDYYGPLNWFDP

SEQ ID NO: 7629 - protein, 9 aa, Homo sapiens
  Light chain CDR3 for antibody 3815 (IGKV6-21)
HQSSSLPYT

SEQ ID NO: 7630 - protein, 15 aa, Homo sapiens
  Heavy chain CDR3 for antibody 3815 (IGHV3-23)
AKDGFYYGSGSSFDH

SEQ ID NO: 7631 - protein, 9 aa, Homo sapiens
  Light chain CDR3 for antibody 3816 (IGKV3D-20)
QQYGSSPYT

SEQ ID NO: 7632 - protein, 10 aa, Homo sapiens
  Heavy chain CDR3 for antibody 3816 (IGHV3-33)
AREGLRYFDH

SEQ ID NO: 7633 - protein, 9 aa, Homo sapiens
  Light chain CDR3 for antibody 3817 (IGKV2-30)
MQGTHWPLT

SEQ ID NO: 7634 - protein, 16 aa, Homo sapiens
  Heavy chain CDR3 for antibody 3817 (IGHV4-39)
ARDTPYYSGSGRPFDY

SEQ ID NO: 7635 - protein, 9 aa, Homo sapiens
  Light chain CDR3 for antibody 3818 (IGKV1-6)
LQDYNYPYT

SEQ ID NO: 7636 - protein, 12 aa, Homo sapiens
  Heavy chain CDR3 for antibody 3818 (IGHV1-46)
ARALTVGASFDY

SEQ ID NO: 7637 - protein, 9 aa, Homo sapiens
  Light chain CDR3 for antibody 3819 (IGKV1-6)
LQDYNYPWT

SEQ ID NO: 7638 - protein, 12 aa, Homo sapiens
  Heavy chain CDR3 for antibody 3819 (IGHV3-13)
VREAGIPDAFDI

SEQ ID NO: 7639 - protein, 9 aa, Homo sapiens
  Light chain CDR3 for antibody 3820 (IGKV2D-24)
TQATQFPHT

SEQ ID NO: 7640 - protein, 12 aa, Homo sapiens
  Heavy chain CDR3 for antibody 3820 (IGHV1-46)
ARGLTGDHAVDI

SEQ ID NO: 7641 - protein, 9 aa, Homo sapiens
  Light chain CDR3 for antibody 3821 (IGKV1-6)
LQDYNYPYT

SEQ ID NO: 7642 - protein, 9 aa, Homo sapiens
  Heavy chain CDR3 for antibody 3821 (IGHV1-18)
ARDEGYDIL

SEQ ID NO: 7643 - protein, 8 aa, Homo sapiens
  Light chain CDR3 for antibody 3822 (IGKV1-5)
QQYNSYWT

SEQ ID NO: 7644 - protein, 17 aa, Homo sapiens
  Heavy chain CDR3 for antibody 3822 (IGHV3-33)
ARGYCSRTSCYLYYFDY

SEQ ID NO: 7645 - protein, 9 aa, Homo sapiens
  Light chain CDR3 for antibody 3823 (IGKV1-27)
QKYNSAPYT

SEQ ID NO: 7646 - protein, 12 aa, Homo sapiens
  Heavy chain CDR3 for antibody 3823 (IGHV3-33)
AKDPGWQQLAEY

SEQ ID NO: 7647 - protein, 10 aa, Homo sapiens
  Light chain CDR3 for antibody 3824 (IGKV1-39)
QQSYSTPMYT

SEQ ID NO: 7648 - protein, 9 aa, Homo sapiens
  Heavy chain CDR3 for antibody 3824 (IGHV3-30)
ARDNWGFDY

SEQ ID NO: 7649 - protein, 9 aa, Homo sapiens
  Light chain CDR3 for antibody 3825 (IGKV1-16)
LQDYNYPRT

SEQ ID NO: 7650 - protein, 17 aa, Homo sapiens
  Heavy chain CDR3 for antibody 3825 (IGHV3-33)
ARVRGVIEGYYYYGMDV

SEQ ID NO: 7651 - protein, 9 aa, Homo sapiens
  Light chain CDR3 for antibody 3826 (IGKV1-39)
QQSYSTPLT

SEQ ID NO: 7652 - protein, 13 aa, Homo sapiens
  Heavy chain CDR3 for antibody 3826 (IGHV3-11)
ARDEGYSGYNLDN

SEQ ID NO: 7653 - protein, 10 aa, Homo sapiens
  Light chain CDR3 for antibody 3827 (IGKV3-11)
QQRSNWPIFT

SEQ ID NO: 7654 - protein, 13 aa, Homo sapiens
  Heavy chain CDR3 for antibody 3827 (IGHV4-39)
ARHEVMIRGVFDY

SEQ ID NO: 7655 - protein, 9 aa, Homo sapiens
  Light chain CDR3 for antibody 3828 (IGKV6-21)
HQSSSLPYT

SEQ ID NO: 7656 - protein, 15 aa, Homo sapiens
  Heavy chain CDR3 for antibody 3828 (IGHV3-20)
AREGPYYYGSGSLDY

SEQ ID NO: 7657 - protein, 9 aa, Homo sapiens
  Light chain CDR3 for antibody 3829 (IGKV1-16)
QHYNDYPFT

SEQ ID NO: 7658 - protein, 17 aa, Homo sapiens
  Heavy chain CDR3 for antibody 3829 (IGHV3-33)
ARGYCSRTSCYLYYFDY

SEQ ID NO: 7659 - protein, 9 aa, Homo sapiens
  Light chain CDR3 for antibody 3830 (IGKV3-11)
QQRSNWPWT

SEQ ID NO: 7660 - protein, 7 aa, Homo sapiens
  Heavy chain CDR3 for antibody 3830 (IGHV3-33)
ARELVDY

SEQ ID NO: 7661 - protein, 9 aa, Homo sapiens
  Light chain CDR3 for antibody 3831 (IGKV3-20)
QQYGSSPYT

SEQ ID NO: 7662 - protein, 8 aa, Homo sapiens
  Heavy chain CDR3 for antibody 3831 (IGHV4-39)
ARRGGLDY

SEQ ID NO: 7663 - protein, 9 aa, Homo sapiens
  Light chain CDR3 for antibody 3832 (IGKV3-20)
QQYGSSPRT

SEQ ID NO: 7664 - protein, 6 aa, Homo sapiens
  Heavy chain CDR3 for antibody 3832 (IGHV3-23)
AKEGDY

SEQ ID NO: 7665 - protein, 9 aa, Homo sapiens
  Light chain CDR3 for antibody 3833 (IGKV1D-13)
QQFNNYPYT

SEQ ID NO: 7666 - protein, 14 aa, Homo sapiens
  Heavy chain CDR3 for antibody 3833 (IGHV1-46)
ARRFRIAVAAPFDY

SEQ ID NO: 7667 - protein, 8 aa, Homo sapiens
  Light chain CDR3 for antibody 3834 (IGKV3-20)
QQYGRSFT

SEQ ID NO: 7668 - protein, 18 aa, Homo sapiens
  Heavy chain CDR3 for antibody 3834 (IGHV4-59)
AREGHYYTSGSYYKAFDY

SEQ ID NO: 7669 - protein, 9 aa, Homo sapiens
  Light chain CDR3 for antibody 3835 (IGKV1D-13)
QQFNNYPHT

SEQ ID NO: 7670 - protein, 18 aa, Homo sapiens
  Heavy chain CDR3 for antibody 3835 (IGHV3-33)
AREGYDILTGYYNVKFDY

SEQ ID NO: 7671 - protein, 9 aa, Homo sapiens
  Light chain CDR3 for antibody 3836 (IGKV1-16)
QQYNSYPYT

SEQ ID NO: 7672 - protein, 18 aa, Homo sapiens
  Heavy chain CDR3 for antibody 3836 (IGHV3-23)
AREYYDFLTGYYKGAFDI

SEQ ID NO: 7673 - protein, 9 aa, Homo sapiens
  Light chain CDR3 for antibody 3837 (IGKV3-20)
QQYGSSPYT

SEQ ID NO: 7674 - protein, 17 aa, Homo sapiens
  Heavy chain CDR3 for antibody 3837 (IGHV3-33)
ARENDILTGSYYYGMDV

SEQ ID NO: 7675 - protein, 10 aa, Homo sapiens
  Light chain CDR3 for antibody 3838 (IGKV3-20)
QQYGRSPPVT

SEQ ID NO: 7676 - protein, 16 aa, Homo sapiens
  Heavy chain CDR3 for antibody 3838 (IGHV3-23)
AKEGMVLRYFDWLWDY

SEQ ID NO: 7677 - protein, 9 aa, Homo sapiens
  Light chain CDR3 for antibody 3839 (IGKV2-30)
MQGTHWPLT

SEQ ID NO: 7678 - protein, 12 aa, Homo sapiens
  Heavy chain CDR3 for antibody 3839 (IGHV3-33)
AREGDILTGYSL

SEQ ID NO: 7679 - protein, 9 aa, Homo sapiens
  Light chain CDR3 for antibody 3840 (IGKV1-9)
QQLNSYPLT

SEQ ID NO: 7680 - protein, 22 aa, Homo sapiens
  Heavy chain CDR3 for antibody 3840 (IGHV3-h)
AREAYYDILTGYYTGYYYGMDV

SEQ ID NO: 7681 - protein, 9 aa, Homo sapiens
  Light chain CDR3 for antibody 3841 (IGKV1-9)
QQLISYPLT

SEQ ID NO: 7682 - protein, 10 aa, Homo sapiens
  Heavy chain CDR3 for antibody 3841 (IGHV3-33)
ARDGSGSQPI

SEQ ID NO: 7683 - protein, 10 aa, Homo sapiens
  Light chain CDR3 for antibody 3842 (IGKV3-11)
QQRSNWPTWT

SEQ ID NO: 7684 - protein, 13 aa, Homo sapiens
  Heavy chain CDR3 for antibody 3842 (IGHV3-33)
ARGDNWNDGGFDY

SEQ ID NO: 7685 - protein, 9 aa, Homo sapiens
  Light chain CDR3 for antibody 3843 (IGKV5-2)
LQHDNFPYT

SEQ ID NO: 7686 - protein, 18 aa, Homo sapiens
  Heavy chain CDR3 for antibody 3843 (IGHV3-33)
VREGGYYGSGSYPDAFDI

SEQ ID NO: 7687 - protein, 9 aa, Homo sapiens
  Light chain CDR3 for antibody 3844 (IGKV1-39)
QQSYSTPLT

SEQ ID NO: 7688 - protein, 14 aa, Homo sapiens
  Heavy chain CDR3 for antibody 3844 (IGHV3-33)
AREDYYGPLNWFDP

SEQ ID NO: 7689 - protein, 8 aa, Homo sapiens
  Light chain CDR3 for antibody 3845 (IGKV3D-7)
QQDYNLLT

SEQ ID NO: 7690 - protein, 11 aa, Homo sapiens
  Heavy chain CDR3 for antibody 3845 (IGHV3-33)
ARDILTGFLDH

SEQ ID NO: 7691 - protein, 9 aa, Homo sapiens
  Light chain CDR3 for antibody 3846 (IGKV5-2)
LQHDNFPYT

SEQ ID NO: 7692 - protein, 19 aa, Homo sapiens
  Heavy chain CDR3 for antibody 3846 (IGHV3-33)
ARIPGIAVAGGYYYYGMDV

SEQ ID NO: 7693 - protein, 9 aa, Homo sapiens
  Light chain CDR3 for antibody 3847 (IGKV1-27)
QKYNSAPYT

SEQ ID NO: 7694 - protein, 15 aa, Homo sapiens
  Heavy chain CDR3 for antibody 3847 (IGHV3-33)
ARRSILTGSYWYFDL

SEQ ID NO: 7695 - protein, 9 aa, Homo sapiens
  Light chain CDR3 for antibody 3848 (IGKV5-2)
LQHDNFPYT

SEQ ID NO: 7696 - protein, 18 aa, Homo sapiens
  Heavy chain CDR3 for antibody 3848 (IGHV3-33)
ARGGVLYDILTGFYGMDV

SEQ ID NO: 7697 - protein, 9 aa, Homo sapiens
  Light chain CDR3 for antibody 3849 (IGKV1-17)
LQHNSYPRT

SEQ ID NO: 7698 - protein, 15 aa, Homo sapiens
  Heavy chain CDR3 for antibody 3849 (IGHV4-39)
ARRDYDILTGYLFDY

SEQ ID NO: 7699 - protein, 9 aa, Homo sapiens
  Light chain CDR3 for antibody 3850 (IGKV1-39)
QQSYSTPLT

SEQ ID NO: 7700 - protein, 19 aa, Homo sapiens
  Heavy chain CDR3 for antibody 3850 (IGHV5-51)
ARHGEKGKRITMVRGSLDV

SEQ ID NO: 7701 - protein, 9 aa, Homo sapiens
  Light chain CDR3 for antibody 3851 (IGKV1-6)
LQDYKSPFT

SEQ ID NO: 7702 - protein, 14 aa, Homo sapiens
  Heavy chain CDR3 for antibody 3851 (IGHV3-33)
ARDNILTAYYLFDY

SEQ ID NO: 7703 - protein, 9 aa, Homo sapiens
  Light chain CDR3 for antibody 3852 (IGKV1D-16)
HQYNSYPFT

SEQ ID NO: 7704 - protein, 13 aa, Homo sapiens
  Heavy chain CDR3 for antibody 3852 (IGHV3-64)
ARERWAANTCFDY

SEQ ID NO: 7705 - protein, 8 aa, Homo sapiens
  Light chain CDR3 for antibody 3853 (IGKV3D-7)
QQDYNLLT

SEQ ID NO: 7706 - protein, 14 aa, Homo sapiens
  Heavy chain CDR3 for antibody 3853 (IGHV3-33)
AREGYSSNWYDFDY

SEQ ID NO: 7707 - protein, 9 aa, Homo sapiens
  Light chain CDR3 for antibody 3854 (IGKV3D-7)
QQDYNLPLT

SEQ ID NO: 7708 - protein, 19 aa, Homo sapiens
  Heavy chain CDR3 for antibody 3854 (IGHV1-18)
ARDDILTGYSLYYYYGMDV

SEQ ID NO: 7709 - protein, 9 aa, Homo sapiens
  Light chain CDR3 for antibody 3855 (IGKV1-17)
LQHNSYPWT

SEQ ID NO: 7710 - protein, 13 aa, Homo sapiens
  Heavy chain CDR3 for antibody 3855 (IGHV4-61)
ASRYSSGWYPFDY

SEQ ID NO: 7711 - protein, 9 aa, Homo sapiens
  Light chain CDR3 for antibody 3856 (IGKV1-39)
QQSYSTPYT

SEQ ID NO: 7712 - protein, 18 aa, Homo sapiens
  Heavy chain CDR3 for antibody 3856 (IGHV3-33)
VRDRERYGSGSYPDAFDI

SEQ ID NO: 7713 - protein, 10 aa, Homo sapiens
  Light chain CDR3 for antibody 3857 (IGKV1-39)
QQSYSTPMYT

SEQ ID NO: 7714 - protein, 13 aa, Homo sapiens
  Heavy chain CDR3 for antibody 3857 (IGHV4-39)
ARQWPSGYWYFDL

SEQ ID NO: 7715 - protein, 9 aa, Homo sapiens
  Light chain CDR3 for antibody 3858 (IGKV3-20)
QQYGSSPYT

SEQ ID NO: 7716 - protein, 15 aa, Homo sapiens
  Heavy chain CDR3 for antibody 3858 (IGHV3-33)
ARDGGPDGDYKAFDI

SEQ ID NO: 7717 - protein, 9 aa, Homo sapiens
  Light chain CDR3 for antibody 3859 (IGKV1-39)
QQSYRTPLT

SEQ ID NO: 7718 - protein, 17 aa, Homo sapiens
  Heavy chain CDR3 for antibody 3859 (IGHV3-66)
ARVQYDILTGYSPYFDN

SEQ ID NO: 7719 - protein, 9 aa, Homo sapiens
  Light chain CDR3 for antibody 3860 (IGKV1-17)
LQHNSYPWT

SEQ ID NO: 7720 - protein, 15 aa, Homo sapiens
  Heavy chain CDR3 for antibody 3860 (IGHV3-33)
ARDRGMVRGDGYLDY

SEQ ID NO: 7721 - protein, 9 aa, Homo sapiens
  Light chain CDR3 for antibody 3861 (IGKV1-6)
LQDYKSPFT

SEQ ID NO: 7722 - protein, 11 aa, Homo sapiens
  Heavy chain CDR3 for antibody 3861 (IGHV4-59)
AREMGHDTFDI

SEQ ID NO: 7723 - protein, 9 aa, Homo sapiens
  Light chain CDR3 for antibody 3862 (IGKV2D-28)
MQVLQTPFT

SEQ ID NO: 7724 - protein, 18 aa, Homo sapiens
  Heavy chain CDR3 for antibody 3862 (IGHV4-59)
AREGHYYTSGSYYKAFDY

SEQ ID NO: 7725 - protein, 9 aa, Homo sapiens
  Light chain CDR3 for antibody 3863 (IGKV1-9)
QQLKSYPYT

SEQ ID NO: 7726 - protein, 12 aa, Homo sapiens
  Heavy chain CDR3 for antibody 3863 (IGHV3-33)
ARGYFGSGYAHF

SEQ ID NO: 7727 - protein, 8 aa, Homo sapiens
  Light chain CDR3 for antibody 3864 (IGKV3-11)
QQRSNWLT

SEQ ID NO: 7728 - protein, 18 aa, Homo sapiens
  Heavy chain CDR3 for antibody 3864 (IGHV1-46)
ARDGDYVWGSYRSDWFDP

SEQ ID NO: 7729 - protein, 9 aa, Homo sapiens
  Light chain CDR3 for antibody 3865 (IGKV2-30)
MQGTHWPLT

SEQ ID NO: 7730 - protein, 12 aa, Homo sapiens
  Heavy chain CDR3 for antibody 3865 (IGHV1-24)
ASDWAYYYGMDV

SEQ ID NO: 7731 - protein, 9 aa, Homo sapiens
  Light chain CDR3 for antibody 3866 (IGKV1D-13)
QQFNNYPYT

SEQ ID NO: 7732 - protein, 18 aa, Homo sapiens
  Heavy chain CDR3 for antibody 3866 (IGHV3-33)
ARKGGYYSGSGSYRHFDF

SEQ ID NO: 7733 - protein, 10 aa, Homo sapiens
  Light chain CDR3 for antibody 3867 (IGKV1-39)
QQSYSTPMYT

SEQ ID NO: 7734 - protein, 15 aa, Homo sapiens
  Heavy chain CDR3 for antibody 3867 (IGHV3-20)
ARDRGSSGWRDWFDP

SEQ ID NO: 7735 - protein, 9 aa, Homo sapiens
  Light chain CDR3 for antibody 3868 (IGKV5-2)
LQHDNFPYT

SEQ ID NO: 7736 - protein, 19 aa, Homo sapiens
  Heavy chain CDR3 for antibody 3868 (IGHV3-33)
ARRRDDILTGWDYYFGMDV

SEQ ID NO: 7737 - protein, 9 aa, Homo sapiens
  Light chain CDR3 for antibody 3869 (IGKV1-39)
QQSYSTPLT

SEQ ID NO: 7738 - protein, 17 aa, Homo sapiens
  Heavy chain CDR3 for antibody 3869 (IGHV3-23)
AKDTITMVRGALFGMDV

SEQ ID NO: 7739 - protein, 9 aa, Homo sapiens
  Light chain CDR3 for antibody 3870 (IGKV3-15)
QQYNNWPFT

SEQ ID NO: 7740 - protein, 16 aa, Homo sapiens
  Heavy chain CDR3 for antibody 3870 (IGHV1-18)
ARYFDWLLRDYYGMDV

SEQ ID NO: 7741 - protein, 9 aa, Homo sapiens
  Light chain CDR3 for antibody 3871 (IGKV1-6)
LQDYKSPFT

SEQ ID NO: 7742 - protein, 15 aa, Homo sapiens
  Heavy chain CDR3 for antibody 3871 (IGHV4-59)
ARDLGHYYGSVSIDY

SEQ ID NO: 7743 - protein, 9 aa, Homo sapiens
  Light chain CDR3 for antibody 3872 (IGKV6-21)
HQSSSLPYT

SEQ ID NO: 7744 - protein, 17 aa, Homo sapiens
  Heavy chain CDR3 for antibody 3872 (IGHV1-24)
ATHYGSGSHYKGYGMDV

SEQ ID NO: 7745 - protein, 9 aa, Homo sapiens
  Light chain CDR3 for antibody 3873 (IGKV1-6)
LQDYNYPWT

SEQ ID NO: 7746 - protein, 16 aa, Homo sapiens
  Heavy chain CDR3 for antibody 3873 (IGHV3-33)
ARGYDMLTGDYHGMDV

SEQ ID NO: 7747 - protein, 9 aa, Homo sapiens
  Light chain CDR3 for antibody 3874 (IGKV1D-16)
QQYHSYPYT

SEQ ID NO: 7748 - protein, 20 aa, Homo sapiens
  Heavy chain CDR3 for antibody 3874 (IGHV1-f)
ATHYDILTGSPYYYYCALDV

SEQ ID NO: 7749 - protein, 9 aa, Homo sapiens
  Light chain CDR3 for antibody 3875 (IGKV5-2)
LQHDNFPYT

SEQ ID NO: 7750 - protein, 18 aa, Homo sapiens
  Heavy chain CDR3 for antibody 3875 (IGHV3-33)
AREGYDILTGDYRLGFDY

SEQ ID NO: 7751 - protein, 9 aa, Homo sapiens
  Light chain CDR3 for antibody 3876 (IGKV1-6)
QQEYNYPLT

SEQ ID NO: 7752 - protein, 9 aa, Homo sapiens
  Heavy chain CDR3 for antibody 3876 (IGHV1-8)
ARGRLDFDY

SEQ ID NO: 7753 - protein, 9 aa, Homo sapiens
  Light chain CDR3 for antibody 3877 (IGKV1-17)
LQHNSYPYT

SEQ ID NO: 7754 - protein, 13 aa, Homo sapiens
  Heavy chain CDR3 for antibody 3877 (IGHV1-24)
ATGYSINWYEFDY

SEQ ID NO: 7755 - protein, 9 aa, Homo sapiens
  Light chain CDR3 for antibody 3878 (IGKV1-9)
QQYNSYPLT

SEQ ID NO: 7756 - protein, 12 aa, Homo sapiens
  Heavy chain CDR3 for antibody 3878 (IGHV3-23)
AKGYTSFWYFDL

SEQ ID NO: 7757 - protein, 10 aa, Homo sapiens
  Light chain CDR3 for antibody 3879 (IGKV3-15)
QQYNNWPPYT

SEQ ID NO: 7758 - protein, 16 aa, Homo sapiens
  Heavy chain CDR3 for antibody 3879 (IGHV3-23)
AKEGMVLRYFDWLWDY

SEQ ID NO: 7759 - protein, 9 aa, Homo sapiens
  Light chain CDR3 for antibody 3880 (IGKV1-6)
LQDYNYPYT

SEQ ID NO: 7760 - protein, 13 aa, Homo sapiens
  Heavy chain CDR3 for antibody 3880 (IGHV3-23)
ARGELLWFGEFAC

SEQ ID NO: 7761 - protein, 9 aa, Homo sapiens
  Light chain CDR3 for antibody 3881 (IGKV3D-7)
QQDYNLPLT

SEQ ID NO: 7762 - protein, 18 aa, Homo sapiens
  Heavy chain CDR3 for antibody 3881 (IGHV1-8)
ARSRIAAAGIYYYYGMDV

SEQ ID NO: 7763 - protein, 9 aa, Homo sapiens
  Light chain CDR3 for antibody 3882 (IGKV5-2)
LQHDNFPYT

SEQ ID NO: 7764 - protein, 16 aa, Homo sapiens
  Heavy chain CDR3 for antibody 3882 (IGHV3-33)
ARGANYYGSGIPNFEY

SEQ ID NO: 7765 - protein, 10 aa, Homo sapiens
  Light chain CDR3 for antibody 3883 (IGKV1-39)
QQSYSTPMYT

SEQ ID NO: 7766 - protein, 18 aa, Homo sapiens
  Heavy chain CDR3 for antibody 3883 (IGHV3-23)
AKDRITGTTYGYYSGLDV

SEQ ID NO: 7767 - protein, 9 aa, Homo sapiens
  Light chain CDR3 for antibody 3884 (IGKV1D-13)
QQFNNYPYT

SEQ ID NO: 7768 - protein, 24 aa, Homo sapiens
  Heavy chain CDR3 for antibody 3884 (IGHV3-11)
AREWEGNYGSGSYYKSAYYYGMDV

SEQ ID NO: 7769 - protein, 9 aa, Homo sapiens
  Light chain CDR3 for antibody 3885 (IGKV3-11)
QQRSNWPLT

SEQ ID NO: 7770 - protein, 13 aa, Homo sapiens
  Heavy chain CDR3 for antibody 3885 (IGHV1-18)
ARSITMVRGVIGY

SEQ ID NO: 7771 - protein, 10 aa, Homo sapiens
  Light chain CDR3 for antibody 3886 (IGKV1-39)
QQSYSTPMYT

SEQ ID NO: 7772 - protein, 15 aa, Homo sapiens
  Heavy chain CDR3 for antibody 3886 (IGHV3-33)
ARRVCSGGSCSLFDY

SEQ ID NO: 7773 - protein, 9 aa, Homo sapiens
  Light chain CDR3 for antibody 3887 (IGKV5-2)
LQHDNFPYT

SEQ ID NO: 7774 - protein, 13 aa, Homo sapiens
  Heavy chain CDR3 for antibody 3887 (IGHV3-33)
ARVHFDWLDAFDI

SEQ ID NO: 7775 - protein, 9 aa, Homo sapiens
  Light chain CDR3 for antibody 3888 (IGKV1-17)
LQHNSYPWT

SEQ ID NO: 7776 - protein, 14 aa, Homo sapiens
  Heavy chain CDR3 for antibody 3888 (IGHV3-33)
ARKPDYYGSGYFDY

SEQ ID NO: 7777 - protein, 9 aa, Homo sapiens
  Light chain CDR3 for antibody 3889 (IGKV3D-7)
QQDYNLPLT

SEQ ID NO: 7778 - protein, 13 aa, Homo sapiens
  Heavy chain CDR3 for antibody 3889 (IGHV4-59)
ANRDYYGYYGMDV

SEQ ID NO: 7779 - protein, 9 aa, Homo sapiens
  Light chain CDR3 for antibody 3890 (IGKV1-17)
LQHNSYPYT

SEQ ID NO: 7780 - protein, 16 aa, Homo sapiens
  Heavy chain CDR3 for antibody 3890 (IGHV3-23)
ARDVGIAAAGSGWFDP

SEQ ID NO: 7781 - protein, 9 aa, Homo sapiens
  Light chain CDR3 for antibody 3891 (IGKV1-9)
QQLNSYPYT

SEQ ID NO: 7782 - protein, 18 aa, Homo sapiens
  Heavy chain CDR3 for antibody 3891 (IGHV3-33)
ARGYNQGSGSYYNVCFDY

SEQ ID NO: 7783 - protein, 9 aa, Homo sapiens
  Light chain CDR3 for antibody 3892 (IGKV3D-20)
QQYGSSPYT

SEQ ID NO: 7784 - protein, 15 aa, Homo sapiens
  Heavy chain CDR3 for antibody 3892 (IGHV3-64)
ARDSRPEITGPPFDY

SEQ ID NO: 7785 - protein, 9 aa, Homo sapiens
  Light chain CDR3 for antibody 3893 (IGKV1-27)
QKYNSAPYT

SEQ ID NO: 7786 - protein, 16 aa, Homo sapiens
  Heavy chain CDR3 for antibody 3893 (IGHV3-33)
ARGDDILTHQYYGVDV

SEQ ID NO: 7787 - protein, 9 aa, Homo sapiens
  Light chain CDR3 for antibody 3894 (IGKV1-39)
QQSYRTPLT

SEQ ID NO: 7788 - protein, 12 aa, Homo sapiens
  Heavy chain CDR3 for antibody 3894 (IGHV3-33)
ARDPGYYYGLDV

SEQ ID NO: 7789 - protein, 9 aa, Homo sapiens
  Light chain CDR3 for antibody 3895 (IGKV3D-20)
QQYGSSPRT

SEQ ID NO: 7790 - protein, 20 aa, Homo sapiens
  Heavy chain CDR3 for antibody 3895 (IGHV3-23)
AKGMGGLRYFDWPHYYGMDV

SEQ ID NO: 7791 - protein, 9 aa, Homo sapiens
  Light chain CDR3 for antibody 3896 (IGKV1-39)
QQSYSTPLT

SEQ ID NO: 7792 - protein, 14 aa, Homo sapiens
  Heavy chain CDR3 for antibody 3896 (IGHV4-59)
AKGGSGSYYNWFDP

SEQ ID NO: 7793 - protein, 9 aa, Homo sapiens
  Light chain CDR3 for antibody 3897 (IGKV1-39)
QQSYSTPYT

SEQ ID NO: 7794 - protein, 12 aa, Homo sapiens
  Heavy chain CDR3 for antibody 3897 (IGHV1-46)
ARGLTGDHAFDI

SEQ ID NO: 7795 - protein, 9 aa, Homo sapiens
  Light chain CDR3 for antibody 3898 (IGKV1-39)
QQSYSTPLT

SEQ ID NO: 7796 - protein, 16 aa, Homo sapiens
  Heavy chain CDR3 for antibody 3898 (IGHV3-23)
AKEGEVLRYFDWLFNY

SEQ ID NO: 7797 - protein, 9 aa, Homo sapiens
  Light chain CDR3 for antibody 3899 (IGKV1-6)
LQDYNYPYT

SEQ ID NO: 7798 - protein, 17 aa, Homo sapiens
  Heavy chain CDR3 for antibody 3899 (IGHV1-18)
ARERYYGSGNYKYNMDV

SEQ ID NO: 7799 - protein, 9 aa, Homo sapiens
  Light chain CDR3 for antibody 3900 (IGKV1D-16)
QQYYSYPRT

SEQ ID NO: 7800 - protein, 15 aa, Homo sapiens
  Heavy chain CDR3 for antibody 3900 (IGHV3-33)
ARDRGWKAPGYGMDV

SEQ ID NO: 7801 - protein, 9 aa, Homo sapiens
  Light chain CDR3 for antibody 3901 (IGKV1-6)
LQDYNYPRT

SEQ ID NO: 7802 - protein, 12 aa, Homo sapiens
  Heavy chain CDR3 for antibody 3901 (IGHV4-39)
ARQGAYSRFFDY

SEQ ID NO: 7803 - protein, 9 aa, Homo sapiens
  Light chain CDR3 for antibody 3902 (IGKV1-17)
LQHNGYPLT

SEQ ID NO: 7804 - protein, 13 aa, Homo sapiens
  Heavy chain CDR3 for antibody 3902 (IGHV3-11)
ARDEGYRGYVLDT

SEQ ID NO: 7805 - protein, 9 aa, Homo sapiens
  Light chain CDR3 for antibody 3903 (IGKV1-39)
QQSYSTPLT

SEQ ID NO: 7806 - protein, 12 aa, Homo sapiens
  Heavy chain CDR3 for antibody 3903 (IGHV3-23)
AKEGIVGVPFDY

SEQ ID NO: 7807 - protein, 9 aa, Homo sapiens
  Light chain CDR3 for antibody 3904 (IGKV5-2)
LQHDNFPWT

SEQ ID NO: 7808 - protein, 17 aa, Homo sapiens
  Heavy chain CDR3 for antibody 3904 (IGHV4-59)
AREEDYFGSGSFGTFDI

SEQ ID NO: 7809 - protein, 8 aa, Homo sapiens
  Light chain CDR3 for antibody 3905 (IGKV1-5)
QQYNSYWT

SEQ ID NO: 7810 - protein, 17 aa, Homo sapiens
  Heavy chain CDR3 for antibody 3905 (IGHV3-33)
VREGGLLWVGELSLFDY

SEQ ID NO: 7811 - protein, 9 aa, Homo sapiens
  Light chain CDR3 for antibody 3906 (IGKV1D-16)
QQYNSYPYT

SEQ ID NO: 7812 - protein, 9 aa, Homo sapiens
  Heavy chain CDR3 for antibody 3906 (IGHV3-64)
VRYYYGMDV

SEQ ID NO: 7813 - protein, 9 aa, Homo sapiens
  Light chain CDR3 for antibody 3907 (IGKV3D-7)
QQDYTLPLT

SEQ ID NO: 7814 - protein, 13 aa, Homo sapiens
  Heavy chain CDR3 for antibody 3907 (IGHV1-46)
ARVKLGSLGAFDI

SEQ ID NO: 7815 - protein, 9 aa, Homo sapiens
  Light chain CDR3 for antibody 3908 (IGKV1-39)
QQSYSTPYT

SEQ ID NO: 7816 - protein, 13 aa, Homo sapiens
  Heavy chain CDR3 for antibody 3908 (IGHV3-33)
ARRYRSGWYPFDY

SEQ ID NO: 7817 - protein, 9 aa, Homo sapiens
  Light chain CDR3 for antibody 3909 (IGKV1-16)
QQYNSYPLT

SEQ ID NO: 7818 - protein, 18 aa, Homo sapiens
  Heavy chain CDR3 for antibody 3909 (IGHV3-33)
VRERGHYGSGSFPDAFDI

SEQ ID NO: 7819 - protein, 9 aa, Homo sapiens
  Light chain CDR3 for antibody 3910 (IGKV5-2)
LQHDNFPWT

SEQ ID NO: 7820 - protein, 20 aa, Homo sapiens
  Heavy chain CDR3 for antibody 3910 (IGHV1-f)
ATHYDILTGSPYYYYCALDV

SEQ ID NO: 7821 - protein, 9 aa, Homo sapiens
  Light chain CDR3 for antibody 3911 (IGKV1-39)
QQSYSTPFT

SEQ ID NO: 7822 - protein, 7 aa, Homo sapiens
  Heavy chain CDR3 for antibody 3911 (IGHV3-33)
ARELFDY

SEQ ID NO: 7823 - protein, 9 aa, Homo sapiens
  Light chain CDR3 for antibody 3912 (IGKV3D-7)
QQDYNLPLT

SEQ ID NO: 7824 - protein, 17 aa, Homo sapiens
  Heavy chain CDR3 for antibody 3912 (IGHV3-33)
ARGGAAAGPYLYYGLDV

SEQ ID NO: 7825 - protein, 9 aa, Homo sapiens
  Light chain CDR3 for antibody 3913 (IGKV1-33)
QQYDNLPFT

SEQ ID NO: 7826 - protein, 21 aa, Homo sapiens
  Heavy chain CDR3 for antibody 3913 (IGHV3-33)
ARKRLYDILTGYYKAYYGMDV

SEQ ID NO: 7827 - protein, 9 aa, Homo sapiens
  Light chain CDR3 for antibody 3914 (IGKV5-2)
LQHDNFPYT

SEQ ID NO: 7828 - protein, 11 aa, Homo sapiens
  Heavy chain CDR3 for antibody 3914 (IGHV3-23)
AKEGTYFDIPH

SEQ ID NO: 7829 - protein, 9 aa, Homo sapiens
  Light chain CDR3 for antibody 3915 (IGKV1-6)
LQDYKSPFT

SEQ ID NO: 7830 - protein, 14 aa, Homo sapiens
  Heavy chain CDR3 for antibody 3915 (IGHV3-33)
ARAISGSSYWYFDL

SEQ ID NO: 7831 - protein, 9 aa, Homo sapiens
  Light chain CDR3 for antibody 3916 (IGKV3-15)
QQYNNWPLT

SEQ ID NO: 7832 - protein, 9 aa, Homo sapiens
  Heavy chain CDR3 for antibody 3916 (IGHV4-59)
ARGGASFDY

SEQ ID NO: 7833 - protein, 8 aa, Homo sapiens
  Light chain CDR3 for antibody 3917 (IGKV1D-13)
QQFNNYPT

SEQ ID NO: 7834 - protein, 10 aa, Homo sapiens
  Heavy chain CDR3 for antibody 3917 (IGHV3-33)
ARDGSGSQPI

SEQ ID NO: 7835 - protein, 9 aa, Homo sapiens
  Light chain CDR3 for antibody 3918 (IGKV1-27)
QKYNSAPYT

SEQ ID NO: 7836 - protein, 17 aa, Homo sapiens
  Heavy chain CDR3 for antibody 3918 (IGHV1-18)
ARERYYGSGSYKYNMDV

SEQ ID NO: 7837 - protein, 9 aa, Homo sapiens
  Light chain CDR3 for antibody 3919 (IGKV1D-16)
QQYDSYPWT

SEQ ID NO: 7838 - protein, 12 aa, Homo sapiens
  Heavy chain CDR3 for antibody 3919 (IGHV3-13)
VREAGIPDAFDI

SEQ ID NO: 7839 - protein, 9 aa, Homo sapiens
  Light chain CDR3 for antibody 3920 (IGKV5-2)
LQHDNFPWT

SEQ ID NO: 7840 - protein, 14 aa, Homo sapiens
  Heavy chain CDR3 for antibody 3920 (IGHV3-33)
ARKGYSGRYYYFDY

SEQ ID NO: 7841 - protein, 9 aa, Homo sapiens
  Light chain CDR3 for antibody 3921 (IGKV5-2)
LQHDNFPWT

SEQ ID NO: 7842 - protein, 16 aa, Homo sapiens
  Heavy chain CDR3 for antibody 3921 (IGHV3-33)
ARIAAPGSEYYYGMDV

SEQ ID NO: 7843 - protein, 9 aa, Homo sapiens
  Light chain CDR3 for antibody 3922 (IGKV1-39)
QQSYSTPLT

SEQ ID NO: 7844 - protein, 11 aa, Homo sapiens
  Heavy chain CDR3 for antibody 3922 (IGHV3-23)
ARDPGSITGDY

SEQ ID NO: 7845 - protein, 9 aa, Homo sapiens
  Light chain CDR3 for antibody 3923 (IGKV3D-7)
QQDYEFPLT

SEQ ID NO: 7846 - protein, 13 aa, Homo sapiens
  Heavy chain CDR3 for antibody 3923 (IGHV4-28)
ARKGATGYYGMDV

SEQ ID NO: 7847 - protein, 9 aa, Homo sapiens
  Light chain CDR3 for antibody 3924 (IGKV1-9)
QQLKSYLYT

SEQ ID NO: 7848 - protein, 14 aa, Homo sapiens
  Heavy chain CDR3 for antibody 3924 (IGHV1-46)
ARRGIVGALDAFDI

SEQ ID NO: 7849 - protein, 9 aa, Homo sapiens
  Light chain CDR3 for antibody 3925 (IGKV1-27)
QKYNSAPLT

SEQ ID NO: 7850 - protein, 8 aa, Homo sapiens
  Heavy chain CDR3 for antibody 3925 (IGHV3-11)
ARTGPLDY

SEQ ID NO: 7851 - protein, 9 aa, Homo sapiens
  Light chain CDR3 for antibody 3926 (IGKV1-6)
LQDYNYPYT

SEQ ID NO: 7852 - protein, 9 aa, Homo sapiens
  Heavy chain CDR3 for antibody 3926 (IGHV1-18)
ARGNTWFDY

SEQ ID NO: 7853 - protein, 9 aa, Homo sapiens
  Light chain CDR3 for antibody 3927 (IGKV6-21)
HQSSSLPYT

SEQ ID NO: 7854 - protein, 9 aa, Homo sapiens
  Heavy chain CDR3 for antibody 3927 (IGHV3-33)
AANSYGLDY

SEQ ID NO: 7855 - protein, 9 aa, Homo sapiens
  Light chain CDR3 for antibody 3928 (IGKV1-39)
QQSYRTPLT

SEQ ID NO: 7856 - protein, 13 aa, Homo sapiens
  Heavy chain CDR3 for antibody 3928 (IGHV3-33)
ASGYSGYDWYFDL

SEQ ID NO: 7857 - protein, 9 aa, Homo sapiens
  Light chain CDR3 for antibody 3929 (IGKV1-16)
QHYNDYPFT

SEQ ID NO: 7858 - protein, 16 aa, Homo sapiens
  Heavy chain CDR3 for antibody 3929 (IGHV3-23)
AKEGMVLRYFDWLWDY

SEQ ID NO: 7859 - protein, 9 aa, Homo sapiens
  Light chain CDR3 for antibody 3930 (IGKV1-17)
LQQNSYPWT

SEQ ID NO: 7860 - protein, 13 aa, Homo sapiens
  Heavy chain CDR3 for antibody 3930 (IGHV4-59)
ARDAGYSSSWFDY

SEQ ID NO: 7861 - protein, 9 aa, Homo sapiens
  Light chain CDR3 for antibody 3931 (IGKV3-20)
QQYGSSPYT

SEQ ID NO: 7862 - protein, 13 aa, Homo sapiens
  Heavy chain CDR3 for antibody 3931 (IGHV3-53)
ARDEGYSGYNLDN

SEQ ID NO: 7863 - protein, 9 aa, Homo sapiens
  Light chain CDR3 for antibody 3932 (IGKV3D-7)
QQDYTLPLT

SEQ ID NO: 7864 - protein, 11 aa, Homo sapiens
  Heavy chain CDR3 for antibody 3932 (IGHV4-4)
AREAYYYGLDV

SEQ ID NO: 7865 - protein, 8 aa, Homo sapiens
  Light chain CDR3 for antibody 3933 (IGKV1-5)
QQYNSYYT

SEQ ID NO: 7866 - protein, 10 aa, Homo sapiens
  Heavy chain CDR3 for antibody 3933 (IGHV3-33)
ARENSTPLDY

SEQ ID NO: 7867 - protein, 9 aa, Homo sapiens
  Light chain CDR3 for antibody 3934 (IGKV3-11)
QQRSNWPPT

SEQ ID NO: 7868 - protein, 14 aa, Homo sapiens
  Heavy chain CDR3 for antibody 3934 (IGHV3-33)
VRDAMGATTAWFDP

SEQ ID NO: 7869 - protein, 8 aa, Homo sapiens
  Light chain CDR3 for antibody 3935 (IGKV3D-7)
QQDYNLLT

SEQ ID NO: 7870 - protein, 9 aa, Homo sapiens
  Heavy chain CDR3 for antibody 3935 (IGHV3-13)
ARDRWYFDL

SEQ ID NO: 7871 - protein, 9 aa, Homo sapiens
  Light chain CDR3 for antibody 3936 (IGKV3-11)
QQRINWPWT

SEQ ID NO: 7872 - protein, 11 aa, Homo sapiens
  Heavy chain CDR3 for antibody 3936 (IGHV4-59)
ARSIRYSVFDY

SEQ ID NO: 7873 - protein, 9 aa, Homo sapiens
  Light chain CDR3 for antibody 3937 (IGKV5-2)
LQHDNFPYT

SEQ ID NO: 7874 - protein, 9 aa, Homo sapiens
  Heavy chain CDR3 for antibody 3937 (IGHV3-33)
ARELAYFDY

SEQ ID NO: 7875 - protein, 9 aa, Homo sapiens
  Light chain CDR3 for antibody 3938 (IGKV1-6)
LQDYNYPYT

SEQ ID NO: 7876 - protein, 10 aa, Homo sapiens
  Heavy chain CDR3 for antibody 3938 (IGHV1-18)
ARGPTSDVDY

SEQ ID NO: 7877 - protein, 9 aa, Homo sapiens
  Light chain CDR3 for antibody 3939 (IGKV1-6)
LQDYNYPYT

SEQ ID NO: 7878 - protein, 16 aa, Homo sapiens
  Heavy chain CDR3 for antibody 3939 (IGHV4-59)
AREPLRYFDWPDAFDI

SEQ ID NO: 7879 - protein, 9 aa, Homo sapiens
  Light chain CDR3 for antibody 3940 (IGKV1-6)
LQDYNYPYT

SEQ ID NO: 7880 - protein, 13 aa, Homo sapiens
  Heavy chain CDR3 for antibody 3940 (IGHV3-15)
TTDRLLLFGAFDY

SEQ ID NO: 7881 - protein, 8 aa, Homo sapiens
  Light chain CDR3 for antibody 3941 (IGKV3D-7)
QQDYNLLT

SEQ ID NO: 7882 - protein, 9 aa, Homo sapiens
  Heavy chain CDR3 for antibody 3941 (IGHV3-30)
ARDNWGFDY

SEQ ID NO: 7883 - protein, 10 aa, Homo sapiens
  Light chain CDR3 for antibody 3942 (IGKV3-11)
QQRSNWPIFT

SEQ ID NO: 7884 - protein, 17 aa, Homo sapiens
  Heavy chain CDR3 for antibody 3942 (IGHV3-33)
ARVYYDILTGYSPAFDI

SEQ ID NO: 7885 - protein, 9 aa, Homo sapiens
  Light chain CDR3 for antibody 3943 (IGKV1-6)
LQDYNYPYT

SEQ ID NO: 7886 - protein, 17 aa, Homo sapiens
  Heavy chain CDR3 for antibody 3943 (IGHV3-23)
ANGGFGESHYNYYGMDV

SEQ ID NO: 7887 - protein, 9 aa, Homo sapiens
  Light chain CDR3 for antibody 3944 (IGKV1-6)
LQDYKSPFT

SEQ ID NO: 7888 - protein, 12 aa, Homo sapiens
  Heavy chain CDR3 for antibody 3944 (IGHV3-13)
AREAGIPDAFDI

SEQ ID NO: 7889 - protein, 9 aa, Homo sapiens
  Light chain CDR3 for antibody 3945 (IGKV1-6)
LQDFHYPWT

SEQ ID NO: 7890 - protein, 13 aa, Homo sapiens
  Heavy chain CDR3 for antibody 3945 (IGHV3-11)
ARDGGAAAGTWDS

SEQ ID NO: 7891 - protein, 8 aa, Homo sapiens
  Light chain CDR3 for antibody 3946 (IGKV3D-7)
QQDYNLLT

SEQ ID NO: 7892 - protein, 15 aa, Homo sapiens
  Heavy chain CDR3 for antibody 3946 (IGHV3-33)
ARRICSGGSCSLFDY

SEQ ID NO: 7893 - protein, 9 aa, Homo sapiens
  Light chain CDR3 for antibody 3947 (IGKV1-6)
LQDYNYPYT

SEQ ID NO: 7894 - protein, 24 aa, Homo sapiens
  Heavy chain CDR3 for antibody 3947 (IGHV1-24)
ATEAHYDILTGYYNPHYYYYGMDV

SEQ ID NO: 7895 - protein, 9 aa, Homo sapiens
  Light chain CDR3 for antibody 3948 (IGKV1-9)
QQLISYPLT

SEQ ID NO: 7896 - protein, 11 aa, Homo sapiens
  Heavy chain CDR3 for antibody 3948 (IGHV3-33)
ARDTWDDYFDY

SEQ ID NO: 7897 - protein, 10 aa, Homo sapiens
  Light chain CDR3 for antibody 3949 (IGKV1-39)
QQSYSTPMYT

SEQ ID NO: 7898 - protein, 13 aa, Homo sapiens
  Heavy chain CDR3 for antibody 3949 (IGHV3-33)
ARRATLVRGVFDP

SEQ ID NO: 7899 - protein, 9 aa, Homo sapiens
  Light chain CDR3 for antibody 3950 (IGKV1D-13)
QQFYNYPHT

SEQ ID NO: 7900 - protein, 13 aa, Homo sapiens
  Heavy chain CDR3 for antibody 3950 (IGHV3-33)
GRFLEGIGGAFDI

SEQ ID NO: 7901 - protein, 10 aa, Homo sapiens
  Light chain CDR3 for antibody 3951 (IGKV1-39)
QQSYSTPMYT

SEQ ID NO: 7902 - protein, 15 aa, Homo sapiens
  Heavy chain CDR3 for antibody 3951 (IGHV3-23)
AKDGSYYDYYYGMDV

SEQ ID NO: 7903 - protein, 9 aa, Homo sapiens
  Light chain CDR3 for antibody 3952 (IGKV1-17)
LQHNSYPLT

SEQ ID NO: 7904 - protein, 13 aa, Homo sapiens
  Heavy chain CDR3 for antibody 3952 (IGHV3-33)
ARDPLYSGSYFDY

SEQ ID NO: 7905 - protein, 9 aa, Homo sapiens
  Light chain CDR3 for antibody 3953 (IGKV1D-16)
QQYNSYPLT

SEQ ID NO: 7906 - protein, 18 aa, Homo sapiens
  Heavy chain CDR3 for antibody 3953 (IGHV3-64)
ARDEYYYGSGSYYNYFDW

SEQ ID NO: 7907 - protein, 9 aa, Homo sapiens
  Light chain CDR3 for antibody 3954 (IGKV1-27)
QKYNSAPYT

SEQ ID NO: 7908 - protein, 19 aa, Homo sapiens
  Heavy chain CDR3 for antibody 3954 (IGHV3-33)
ARIPGIAVAGGYYYYGMDV

SEQ ID NO: 7909 - protein, 10 aa, Homo sapiens
  Light chain CDR3 for antibody 3955 (IGKV3-11)
QQRSNWPIFT

SEQ ID NO: 7910 - protein, 17 aa, Homo sapiens
  Heavy chain CDR3 for antibody 3955 (IGHV3-23)
AKEYCSGGSCYVYYFDY

SEQ ID NO: 7911 - protein, 9 aa, Homo sapiens
  Light chain CDR3 for antibody 3956 (IGKV1-39)
QQSYRTPLT

SEQ ID NO: 7912 - protein, 19 aa, Homo sapiens
  Heavy chain CDR3 for antibody 3956 (IGHV3-23)
AKDGRSGSYDYYYYYGMDV

SEQ ID NO: 7913 - protein, 9 aa, Homo sapiens
  Light chain CDR3 for antibody 3957 (IGKV1-9)
QQLNSYPLT

SEQ ID NO: 7914 - protein, 17 aa, Homo sapiens
  Heavy chain CDR3 for antibody 3957 (IGHV4-59)
AREEDYFGSGSFGTFDI

SEQ ID NO: 7915 - protein, 9 aa, Homo sapiens
  Light chain CDR3 for antibody 3958 (IGKV1-6)
LQDYNYPYT

SEQ ID NO: 7916 - protein, 14 aa, Homo sapiens
  Heavy chain CDR3 for antibody 3958 (IGHV1-18)
ARDQPTVPSGYFDY

SEQ ID NO: 7917 - protein, 8 aa, Homo sapiens
  Light chain CDR3 for antibody 3959 (IGKV3D-7)
QQDYNLVT

SEQ ID NO: 7918 - protein, 11 aa, Homo sapiens
  Heavy chain CDR3 for antibody 3959 (IGHV4-59)
ARSIRYSVFDY

SEQ ID NO: 7919 - protein, 8 aa, Homo sapiens
  Light chain CDR3 for antibody 3960 (IGKV1-5)
QQYNSYWT

SEQ ID NO: 7920 - protein, 17 aa, Homo sapiens
  Heavy chain CDR3 for antibody 3960 (IGHV3-33)
ARGFSGYDGYYYYGMDV

SEQ ID NO: 7921 - protein, 9 aa, Homo sapiens
  Light chain CDR3 for antibody 3961 (IGKV6-21)
HQSSSLPYT

SEQ ID NO: 7922 - protein, 10 aa, Homo sapiens
  Heavy chain CDR3 for antibody 3961 (IGHV3-23)
AKDHWGDFDY

SEQ ID NO: 7923 - protein, 9 aa, Homo sapiens
  Light chain CDR3 for antibody 3962 (IGKV1-6)
LQDYNYPYT

SEQ ID NO: 7924 - protein, 18 aa, Homo sapiens
  Heavy chain CDR3 for antibody 3962 (IGHV4-59)
ARDNHYYSSGTYSNWFDP

SEQ ID NO: 7925 - protein, 9 aa, Homo sapiens
  Light chain CDR3 for antibody 3963 (IGKV6-21)
HQSSSLPYT

SEQ ID NO: 7926 - protein, 14 aa, Homo sapiens
  Heavy chain CDR3 for antibody 3963 (IGHV4-39)
ARQGTMIRGGYFDY

SEQ ID NO: 7927 - protein, 9 aa, Homo sapiens
  Light chain CDR3 for antibody 3964 (IGKV1-6)
LQDYNYPYT

SEQ ID NO: 7928 - protein, 18 aa, Homo sapiens
  Heavy chain CDR3 for antibody 3964 (IGHV3-33)
AGGGSGSYSSYYYYGMDV

SEQ ID NO: 7929 - protein, 9 aa, Homo sapiens
  Light chain CDR3 for antibody 3965 (IGKV5-2)
LQHDNFPWT

SEQ ID NO: 7930 - protein, 13 aa, Homo sapiens
  Heavy chain CDR3 for antibody 3965 (IGHV4-59)
ARESPGPYDAFDI

SEQ ID NO: 7931 - protein, 9 aa, Homo sapiens
  Light chain CDR3 for antibody 3966 (IGKV1D-13)
QQFNNYPYT

SEQ ID NO: 7932 - protein, 15 aa, Homo sapiens
  Heavy chain CDR3 for antibody 3966 (IGHV3-33)
ARDRVVRGVMGYFDY

SEQ ID NO: 7933 - protein, 9 aa, Homo sapiens
  Light chain CDR3 for antibody 3967 (IGKV2-30)
MQGTHWPLT

SEQ ID NO: 7934 - protein, 16 aa, Homo sapiens
  Heavy chain CDR3 for antibody 3967 (IGHV3-33)
ARGGRSDWLYYYGMDV

SEQ ID NO: 7935 - protein, 9 aa, Homo sapiens
  Light chain CDR3 for antibody 3968 (IGKV1-39)
QQSYSTPLT

SEQ ID NO: 7936 - protein, 14 aa, Homo sapiens
  Heavy chain CDR3 for antibody 3968 (IGHV3-33)
ARDAYDILTGYYDY

SEQ ID NO: 7937 - protein, 9 aa, Homo sapiens
  Light chain CDR3 for antibody 3969 (IGKV4-1)
QQYYSTPWT

SEQ ID NO: 7938 - protein, 14 aa, Homo sapiens
  Heavy chain CDR3 for antibody 3969 (IGHV4-39)
ARQDYDILTGLFDY

SEQ ID NO: 7939 - protein, 8 aa, Homo sapiens
  Light chain CDR3 for antibody 3970 (IGKV6-21)
HQSSSLPT

SEQ ID NO: 7940 - protein, 12 aa, Homo sapiens
  Heavy chain CDR3 for antibody 3970 (IGHV3-33)
TRGYSSKSYFDY

SEQ ID NO: 7941 - protein, 8 aa, Homo sapiens
  Light chain CDR3 for antibody 3971 (IGKV3-11)
QQRSNWLT

SEQ ID NO: 7942 - protein, 17 aa, Homo sapiens
  Heavy chain CDR3 for antibody 3971 (IGHV1-18)
ARDRAFTMVRGVPPFDY

SEQ ID NO: 7943 - protein, 8 aa, Homo sapiens
  Light chain CDR3 for antibody 3972 (IGKV3-11)
LQRGNWPT

SEQ ID NO: 7944 - protein, 14 aa, Homo sapiens
  Heavy chain CDR3 for antibody 3972 (IGHV4-39)
ARQDYDILTGLFDY

SEQ ID NO: 7945 - protein, 9 aa, Homo sapiens
  Light chain CDR3 for antibody 3973 (IGKV3D-7)
QQDYNLPLT

SEQ ID NO: 7946 - protein, 15 aa, Homo sapiens
  Heavy chain CDR3 for antibody 3973 (IGHV3-33)
ARDHLTGYYYYGMDV

SEQ ID NO: 7947 - protein, 9 aa, Homo sapiens
  Light chain CDR3 for antibody 3974 (IGKV1D-13)
QQFNNYPHT

SEQ ID NO: 7948 - protein, 11 aa, Homo sapiens
  Heavy chain CDR3 for antibody 3974 (IGHV4-4)
AREAYYYGLDV

SEQ ID NO: 7949 - protein, 9 aa, Homo sapiens
  Light chain CDR3 for antibody 3975 (IGKV2-30)
MQGTHWPLT

SEQ ID NO: 7950 - protein, 13 aa, Homo sapiens
  Heavy chain CDR3 for antibody 3975 (IGHV3-33)
AKEDGDYHHYFDY

SEQ ID NO: 7951 - protein, 9 aa, Homo sapiens
  Light chain CDR3 for antibody 3976 (IGKV6-21)
HQSSSLPYT

SEQ ID NO: 7952 - protein, 15 aa, Homo sapiens
  Heavy chain CDR3 for antibody 3976 (IGHV3-33)
ARHSSGFYYYYGMDV

SEQ ID NO: 7953 - protein, 9 aa, Homo sapiens
  Light chain CDR3 for antibody 3977 (IGKV2-30)
MQGTHWPLT

SEQ ID NO: 7954 - protein, 18 aa, Homo sapiens
  Heavy chain CDR3 for antibody 3977 (IGHV3-33)
ARDRDRYGSGTYPDAIDI

SEQ ID NO: 7955 - protein, 10 aa, Homo sapiens
  Light chain CDR3 for antibody 3978 (IGKV1-17)
LQHNSYPMYT

SEQ ID NO: 7956 - protein, 13 aa, Homo sapiens
  Heavy chain CDR3 for antibody 3978 (IGHV3-33)
ARDWGYSHGYFDY

SEQ ID NO: 7957 - protein, 9 aa, Homo sapiens
  Light chain CDR3 for antibody 3979 (IGKV1-39)
QQSYSTPLT

SEQ ID NO: 7958 - protein, 13 aa, Homo sapiens
  Heavy chain CDR3 for antibody 3979 (IGHV3-33)
ARQSSGWFDAFDI

SEQ ID NO: 7959 - protein, 9 aa, Homo sapiens
  Light chain CDR3 for antibody 3980 (IGKV1-39)
QQSYSTPLT

SEQ ID NO: 7960 - protein, 13 aa, Homo sapiens
  Heavy chain CDR3 for antibody 3980 (IGHV3-23)
AKDRGYSSTSTAY

SEQ ID NO: 7961 - protein, 10 aa, Homo sapiens
  Light chain CDR3 for antibody 3981 (IGKV3-11)
QQRSNWPALT

SEQ ID NO: 7962 - protein, 16 aa, Homo sapiens
  Heavy chain CDR3 for antibody 3981 (IGHV4-59)
ARGRYFEWLLGDVFDI

SEQ ID NO: 7963 - protein, 9 aa, Homo sapiens
  Light chain CDR3 for antibody 3982 (IGKV1-17)
LQHNSYPRT

SEQ ID NO: 7964 - protein, 13 aa, Homo sapiens
  Heavy chain CDR3 for antibody 3982 (IGHV3-33)
ARTDYYYYYGMDV

SEQ ID NO: 7965 - protein, 9 aa, Homo sapiens
  Light chain CDR3 for antibody 3983 (IGKV3-20)
QQYGSSPYT

SEQ ID NO: 7966 - protein, 11 aa, Homo sapiens
  Heavy chain CDR3 for antibody 3983 (IGHV3-23)
AKEGTYFDIPH

SEQ ID NO: 7967 - protein, 9 aa, Homo sapiens
  Light chain CDR3 for antibody 3984 (IGKV1D-16)
QQYNSYPYT

SEQ ID NO: 7968 - protein, 11 aa, Homo sapiens
  Heavy chain CDR3 for antibody 3984 (IGHV4-39)
ARLSGEGHFDS

SEQ ID NO: 7969 - protein, 9 aa, Homo sapiens
  Light chain CDR3 for antibody 3985 (IGKV3-11)
QQRSNWPYT

SEQ ID NO: 7970 - protein, 14 aa, Homo sapiens
  Heavy chain CDR3 for antibody 3985 (IGHV3-23)
ANWAYDILTGYLDY

SEQ ID NO: 7971 - protein, 9 aa, Homo sapiens
  Light chain CDR3 for antibody 3986 (IGKV1D-16)
QQYFSYPYT

SEQ ID NO: 7972 - protein, 12 aa, Homo sapiens
  Heavy chain CDR3 for antibody 3986 (IGHV3-33)
ARDNIAAPYFDY

SEQ ID NO: 7973 - protein, 9 aa, Homo sapiens
  Light chain CDR3 for antibody 3987 (IGKV1D-13)
QQFYNYPRT

SEQ ID NO: 7974 - protein, 12 aa, Homo sapiens
  Heavy chain CDR3 for antibody 3987 (IGHV3-33)
ARDWGIGGGMDV

SEQ ID NO: 7975 - protein, 9 aa, Homo sapiens
  Light chain CDR3 for antibody 3988 (IGKV1-27)
QKYNSAPYT

SEQ ID NO: 7976 - protein, 18 aa, Homo sapiens
  Heavy chain CDR3 for antibody 3988 (IGHV3-33)
AREGDYVWGSYRPNWFDP

SEQ ID NO: 7977 - protein, 9 aa, Homo sapiens
  Light chain CDR3 for antibody 3989 (IGKV1D-16)
QQYNSFPLT

SEQ ID NO: 7978 - protein, 9 aa, Homo sapiens
  Heavy chain CDR3 for antibody 3989 (IGHV4-59)
AREGGSGNL

SEQ ID NO: 7979 - protein, 9 aa, Homo sapiens
  Light chain CDR3 for antibody 3990 (IGKV3-11)
QQRSNWPYT

SEQ ID NO: 7980 - protein, 18 aa, Homo sapiens
  Heavy chain CDR3 for antibody 3990 (IGHV3-33)
ARDRYYDILTGYYMGFDY

SEQ ID NO: 7981 - protein, 9 aa, Homo sapiens
  Light chain CDR3 for antibody 3991 (IGKV3D-7)
QQDYNFPLT

SEQ ID NO: 7982 - protein, 14 aa, Homo sapiens
  Heavy chain CDR3 for antibody 3991 (IGHV3-33)
ARDREQQLVRYFDY

SEQ ID NO: 7983 - protein, 9 aa, Homo sapiens
  Light chain CDR3 for antibody 3992 (IGKV3D-7)
QQDYNLPLT

SEQ ID NO: 7984 - protein, 13 aa, Homo sapiens
  Heavy chain CDR3 for antibody 3992 (IGHV3-66)
ASTGDSYYYGMDV

SEQ ID NO: 7985 - protein, 8 aa, Homo sapiens
  Light chain CDR3 for antibody 3993 (IGKV1-5)
QQYNSYWT

SEQ ID NO: 7986 - protein, 13 aa, Homo sapiens
  Heavy chain CDR3 for antibody 3993 (IGHV3-11)
ARDEGYRGYVLDT

SEQ ID NO: 7987 - protein, 9 aa, Homo sapiens
  Light chain CDR3 for antibody 3994 (IGKV6-21)
HQSSSLPYT

SEQ ID NO: 7988 - protein, 12 aa, Homo sapiens
  Heavy chain CDR3 for antibody 3994 (IGHV3-33)
AREGIAVAGVDP

SEQ ID NO: 7989 - protein, 9 aa, Homo sapiens
  Light chain CDR3 for antibody 3995 (IGKV6-21)
HQSSSLPYT

SEQ ID NO: 7990 - protein, 18 aa, Homo sapiens
  Heavy chain CDR3 for antibody 3995 (IGHV3-11)
ARDGYYGSGSFYYYGMDV

SEQ ID NO: 7991 - protein, 9 aa, Homo sapiens
  Light chain CDR3 for antibody 3996 (IGKV6-21)
HQSSSLPYT

SEQ ID NO: 7992 - protein, 12 aa, Homo sapiens
  Heavy chain CDR3 for antibody 3996 (IGHV3-23)
AKGYTSFWYFDL

SEQ ID NO: 7993 - protein, 9 aa, Homo sapiens
  Light chain CDR3 for antibody 3997 (IGKV3-11)
QQRSNWPWT

SEQ ID NO: 7994 - protein, 16 aa, Homo sapiens
  Heavy chain CDR3 for antibody 3997 (IGHV4-59)
ARYSGSYYGDYYGMDV

SEQ ID NO: 7995 - protein, 9 aa, Homo sapiens
  Light chain CDR3 for antibody 3998 (IGKV1-39)
QQSYSTPYT

SEQ ID NO: 7996 - protein, 10 aa, Homo sapiens
  Heavy chain CDR3 for antibody 3998 (IGHV3-33)
ARNILTPLDY

SEQ ID NO: 7997 - protein, 10 aa, Homo sapiens
  Light chain CDR3 for antibody 3999 (IGKV3-15)
QQYNNWPPYT

SEQ ID NO: 7998 - protein, 9 aa, Homo sapiens
  Heavy chain CDR3 for antibody 3999 (IGHV1-18)
ARGKDWFDP

SEQ ID NO: 7999 - protein, 11 aa, Homo sapiens
  Light chain CDR3 for antibody 4000 (IGKV3-11)
QQRSNWPPTWT

SEQ ID NO: 8000 - protein, 18 aa, Homo sapiens
  Heavy chain CDR3 for antibody 4000 (IGHV1-46)
ARDGDYVWGSYRSDWFDP

SEQ ID NO: 8001 - protein, 9 aa, Homo sapiens
  Light chain CDR3 for antibody 4001 (IGKV1-33)
QQYDNLPFT

SEQ ID NO: 8002 - protein, 12 aa, Homo sapiens
  Heavy chain CDR3 for antibody 4001 (IGHV3-33)
ARESGGSYSFDY

SEQ ID NO: 8003 - protein, 9 aa, Homo sapiens
  Light chain CDR3 for antibody 4002 (IGKV3D-20)
QQYGSSPLT

SEQ ID NO: 8004 - protein, 14 aa, Homo sapiens
  Heavy chain CDR3 for antibody 4002 (IGHV4-39)
ARQGTMIRGGYFDY

SEQ ID NO: 8005 - protein, 9 aa, Homo sapiens
  Light chain CDR3 for antibody 4003 (IGKV5-2)
LQHDNFPWT

SEQ ID NO: 8006 - protein, 15 aa, Homo sapiens
  Heavy chain CDR3 for antibody 4003 (IGHV1-18)
ARIYYGSGSSYYFDY

SEQ ID NO: 8007 - protein, 9 aa, Homo sapiens
  Light chain CDR3 for antibody 4004 (IGKV5-2)
LQHDNFPWT

SEQ ID NO: 8008 - protein, 9 aa, Homo sapiens
  Heavy chain CDR3 for antibody 4004 (IGHV4-59)
ARGGVHFDS

SEQ ID NO: 8009 - protein, 9 aa, Homo sapiens
  Light chain CDR3 for antibody 4005 (IGKV1-39)
QQSYSTPLT

SEQ ID NO: 8010 - protein, 13 aa, Homo sapiens
  Heavy chain CDR3 for antibody 4005 (IGHV3-33)
ARDYTMVRGVMNY

SEQ ID NO: 8011 - protein, 9 aa, Homo sapiens
  Light chain CDR3 for antibody 4006 (IGKV1-27)
QKYNSAPYT

SEQ ID NO: 8012 - protein, 13 aa, Homo sapiens
  Heavy chain CDR3 for antibody 4006 (IGHV1-46)
ARRQVGYYYGMDV

SEQ ID NO: 8013 - protein, 9 aa, Homo sapiens
  Light chain CDR3 for antibody 4007 (IGKV1-39)
QQSYSTPLT

SEQ ID NO: 8014 - protein, 15 aa, Homo sapiens
  Heavy chain CDR3 for antibody 4007 (IGHV3-33)
ARDEHYDILTGYWGY

SEQ ID NO: 8015 - protein, 9 aa, Homo sapiens
  Light chain CDR3 for antibody 4008 (IGKV2-30)
MQGTHWPLT

SEQ ID NO: 8016 - protein, 17 aa, Homo sapiens
  Heavy chain CDR3 for antibody 4008 (IGHV3-33)
ARESLKLGIYYYYGMDV

SEQ ID NO: 8017 - protein, 9 aa, Homo sapiens
  Light chain CDR3 for antibody 4009 (IGKV1D-13)
QQFNNYPHT

SEQ ID NO: 8018 - protein, 11 aa, Homo sapiens
  Heavy chain CDR3 for antibody 4009 (IGHV3-33)
ARGTTVTHFDY

SEQ ID NO: 8019 - protein, 9 aa, Homo sapiens
  Light chain CDR3 for antibody 4010 (IGKV1D-16)
QQYNSYPYT

SEQ ID NO: 8020 - protein, 15 aa, Homo sapiens
  Heavy chain CDR3 for antibody 4010 (IGHV3-33)
ARDRGSSGYDRYFDY

SEQ ID NO: 8021 - protein, 9 aa, Homo sapiens
  Light chain CDR3 for antibody 4011 (IGKV6-21)
HQSSSLPYT

SEQ ID NO: 8022 - protein, 14 aa, Homo sapiens
  Heavy chain CDR3 for antibody 4011 (IGHV3-33)
VSAISGSSYWYFAL

SEQ ID NO: 8023 - protein, 9 aa, Homo sapiens
  Light chain CDR3 for antibody 4012 (IGKV5-2)
LQHDNFPWT

SEQ ID NO: 8024 - protein, 19 aa, Homo sapiens
  Heavy chain CDR3 for antibody 4012 (IGHV1-18)
ARGGHIGVVTAFHGYGMDV

SEQ ID NO: 8025 - protein, 9 aa, Homo sapiens
  Light chain CDR3 for antibody 4013 (IGKV1-39)
QQSYSTPFT

SEQ ID NO: 8026 - protein, 17 aa, Homo sapiens
  Heavy chain CDR3 for antibody 4013 (IGHV1-18)
ARDRAFTMVRGVPPFDY

SEQ ID NO: 8027 - protein, 9 aa, Homo sapiens
  Light chain CDR3 for antibody 4014 (IGKV3-15)
QQYNNWPYT

SEQ ID NO: 8028 - protein, 12 aa, Homo sapiens
  Heavy chain CDR3 for antibody 4014 (IGHV3-33)
ARDLVGATPFDY

SEQ ID NO: 8029 - protein, 9 aa, Homo sapiens
  Light chain CDR3 for antibody 4015 (IGKV3D-20)
QQYGSSPWT

SEQ ID NO: 8030 - protein, 14 aa, Homo sapiens
  Heavy chain CDR3 for antibody 4015 (IGHV3-64)
ARDHAAGGYSHSDY

SEQ ID NO: 8031 - protein, 11 aa, Homo sapiens
  Light chain CDR3 for antibody 4016 (IGKV3-11)
QQRSNWPPTWT

SEQ ID NO: 8032 - protein, 16 aa, Homo sapiens
  Heavy chain CDR3 for antibody 4016 (IGHV4-59)
ARYSGSYYGDYYGMDV

SEQ ID NO: 8033 - protein, 9 aa, Homo sapiens
  Light chain CDR3 for antibody 4017 (IGKV1-17)
LQHNSYPYT

SEQ ID NO: 8034 - protein, 15 aa, Homo sapiens
  Heavy chain CDR3 for antibody 4017 (IGHV3-23)
AKDRNYDFLTGPFDP

SEQ ID NO: 8035 - protein, 10 aa, Homo sapiens
  Light chain CDR3 for antibody 4018 (IGKV3-11)
QQRSNWPIFT

SEQ ID NO: 8036 - protein, 13 aa, Homo sapiens
  Heavy chain CDR3 for antibody 4018 (IGHV3-23)
AKDRGGSYSYFDF

SEQ ID NO: 8037 - protein, 9 aa, Homo sapiens
  Light chain CDR3 for antibody 4019 (IGKV5-2)
LQHDNFPYT

SEQ ID NO: 8038 - protein, 18 aa, Homo sapiens
  Heavy chain CDR3 for antibody 4019 (IGHV3-33)
AREGSYYGSGSFPNWFDP

SEQ ID NO: 8039 - protein, 9 aa, Homo sapiens
  Light chain CDR3 for antibody 4020 (IGKV3-20)
QQYGSSPYT

SEQ ID NO: 8040 - protein, 12 aa, Homo sapiens
  Heavy chain CDR3 for antibody 4020 (IGHV1-18)
ARVLFDGDYFDY

SEQ ID NO: 8041 - protein, 10 aa, Homo sapiens
  Light chain CDR3 for antibody 4021 (IGKV1-17)
LQHNSYPMYT

SEQ ID NO: 8042 - protein, 13 aa, Homo sapiens
  Heavy chain CDR3 for antibody 4021 (IGHV3-33)
ARDQRYSSGWYDY

SEQ ID NO: 8043 - protein, 9 aa, Homo sapiens
  Light chain CDR3 for antibody 4022 (IGKV5-2)
LQHDNFPWT

SEQ ID NO: 8044 - protein, 13 aa, Homo sapiens
  Heavy chain CDR3 for antibody 4022 (IGHV3-33)
ARDPLYSGSYFDY

SEQ ID NO: 8045 - protein, 9 aa, Homo sapiens
  Light chain CDR3 for antibody 4023 (IGKV3D-7)
QQDYNLPLT

SEQ ID NO: 8046 - protein, 17 aa, Homo sapiens
  Heavy chain CDR3 for antibody 4023 (IGHV3-33)
VREGGLLWVGELSLFDY

SEQ ID NO: 8047 - protein, 9 aa, Homo sapiens
  Light chain CDR3 for antibody 4024 (IGKV1-17)
LQHNSYPYT

SEQ ID NO: 8048 - protein, 15 aa, Homo sapiens
  Heavy chain CDR3 for antibody 4024 (IGHV3-20)
AREGSSSWYLYYFDY

SEQ ID NO: 8049 - protein, 9 aa, Homo sapiens
  Light chain CDR3 for antibody 4025 (IGKV1-27)
QKYNSAPYT

SEQ ID NO: 8050 - protein, 10 aa, Homo sapiens
  Heavy chain CDR3 for antibody 4025 (IGHV3-33)
AREWFGGFDI

SEQ ID NO: 8051 - protein, 9 aa, Homo sapiens
  Light chain CDR3 for antibody 4026 (IGKV3D-7)
QQDYEFPLT

SEQ ID NO: 8052 - protein, 11 aa, Homo sapiens
  Heavy chain CDR3 for antibody 4026 (IGHV3-33)
ARDRSSGPFDY

SEQ ID NO: 8053 - protein, 9 aa, Homo sapiens
  Light chain CDR3 for antibody 4027 (IGKV1-39)
QQSYSTPLT

SEQ ID NO: 8054 - protein, 13 aa, Homo sapiens
  Heavy chain CDR3 for antibody 4027 (IGHV4-39)
APFRVMVRGVLDY

SEQ ID NO: 8055 - protein, 9 aa, Homo sapiens
  Light chain CDR3 for antibody 4028 (IGKV6-21)
HQSSSLPYT

SEQ ID NO: 8056 - protein, 15 aa, Homo sapiens
  Heavy chain CDR3 for antibody 4028 (IGHV3-11)
ARDRAVAGTIHAFDI

SEQ ID NO: 8057 - protein, 9 aa, Homo sapiens
  Light chain CDR3 for antibody 4029 (IGKV2-30)
MQGTHWPYT

SEQ ID NO: 8058 - protein, 13 aa, Homo sapiens
  Heavy chain CDR3 for antibody 4029 (IGHV4-39)
ARQWPSGYWYFDL

SEQ ID NO: 8059 - protein, 10 aa, Homo sapiens
  Light chain CDR3 for antibody 4030 (IGKV1-17)
LQHNSYPMYT

SEQ ID NO: 8060 - protein, 14 aa, Homo sapiens
  Heavy chain CDR3 for antibody 4030 (IGHV3-33)
ARDWNDVYYYGMDV

SEQ ID NO: 8061 - protein, 9 aa, Homo sapiens
  Light chain CDR3 for antibody 4031 (IGKV6-21)
HQSSSLPYT

SEQ ID NO: 8062 - protein, 18 aa, Homo sapiens
  Heavy chain CDR3 for antibody 4031 (IGHV3-23)
AKERGYYGSGSYSNWFDP

SEQ ID NO: 8063 - protein, 8 aa, Homo sapiens
  Light chain CDR3 for antibody 4032 (IGKV3D-7)
QQDYNLLT

SEQ ID NO: 8064 - protein, 16 aa, Homo sapiens
  Heavy chain CDR3 for antibody 4032 (IGHV1-24)
ATEDSSSTYYYYGLDV

SEQ ID NO: 8065 - protein, 9 aa, Homo sapiens
  Light chain CDR3 for antibody 4033 (IGKV3-11)
QQRSNWPYT

SEQ ID NO: 8066 - protein, 11 aa, Homo sapiens
  Heavy chain CDR3 for antibody 4033 (IGHV3-33)
ARDKSSGWSDY

SEQ ID NO: 8067 - protein, 9 aa, Homo sapiens
  Light chain CDR3 for antibody 4034 (IGKV3D-7)
QQDYNLPWT

SEQ ID NO: 8068 - protein, 18 aa, Homo sapiens
  Heavy chain CDR3 for antibody 4034 (IGHV3-23)
ARYHLYFGSGFGSDGMDV

SEQ ID NO: 8069 - protein, 9 aa, Homo sapiens
  Light chain CDR3 for antibody 4035 (IGKV3D-7)
QQDYNLPLT

SEQ ID NO: 8070 - protein, 15 aa, Homo sapiens
  Heavy chain CDR3 for antibody 4035 (IGHV3-33)
ARDRGWKAPGYGMDV

SEQ ID NO: 8071 - protein, 9 aa, Homo sapiens
  Light chain CDR3 for antibody 4036 (IGKV1D-13)
QQFNNYPHT

SEQ ID NO: 8072 - protein, 24 aa, Homo sapiens
  Heavy chain CDR3 for antibody 4036 (IGHV1-46)
ARDEARGLLTGYYNMREYYYGMDV

SEQ ID NO: 8073 - protein, 9 aa, Homo sapiens
  Light chain CDR3 for antibody 4037 (IGKV1-39)
QQSYSTPFT

SEQ ID NO: 8074 - protein, 15 aa, Homo sapiens
  Heavy chain CDR3 for antibody 4037 (IGHV4-39)
ARRDYDILTGYLFDY

SEQ ID NO: 8075 - protein, 8 aa, Homo sapiens
  Light chain CDR3 for antibody 4038 (IGKV1-5)
QQYNSYYT

SEQ ID NO: 8076 - protein, 13 aa, Homo sapiens
  Heavy chain CDR3 for antibody 4038 (IGHV3-33)
ARDQRYSSGWYDY

SEQ ID NO: 8077 - protein, 10 aa, Homo sapiens
  Light chain CDR3 for antibody 4039 (IGKV3-11)
QQRSNWPIFT

SEQ ID NO: 8078 - protein, 13 aa, Homo sapiens
  Heavy chain CDR3 for antibody 4039 (IGHV3-23)
AKDRGLRYYGMDV

SEQ ID NO: 8079 - protein, 9 aa, Homo sapiens
  Light chain CDR3 for antibody 4040 (IGKV5-2)
LQHDNFPYT

SEQ ID NO: 8080 - protein, 10 aa, Homo sapiens
  Heavy chain CDR3 for antibody 4040 (IGHV3-11)
ARGQWPPLDY

SEQ ID NO: 8081 - protein, 8 aa, Homo sapiens
  Light chain CDR3 for antibody 4041 (IGKV1D-13)
QQFNNYPT

SEQ ID NO: 8082 - protein, 14 aa, Homo sapiens
  Heavy chain CDR3 for antibody 4041 (IGHV3-33)
ARDNILTAYYLFDY

SEQ ID NO: 8083 - protein, 9 aa, Homo sapiens
  Light chain CDR3 for antibody 4042 (IGKV1D-16)
QQYNSYPYT

SEQ ID NO: 8084 - protein, 12 aa, Homo sapiens
  Heavy chain CDR3 for antibody 4042 (IGHV3-33)
ASGYFGSGSAHY

SEQ ID NO: 8085 - protein, 9 aa, Homo sapiens
  Light chain CDR3 for antibody 4043 (IGKV1-39)
QQSYSTPYT

SEQ ID NO: 8086 - protein, 14 aa, Homo sapiens
  Heavy chain CDR3 for antibody 4043 (IGHV3-23)
AKDRYRGYEGLFDY

SEQ ID NO: 8087 - protein, 9 aa, Homo sapiens
  Light chain CDR3 for antibody 4044 (IGKV1-9)
KQLNSYPYI

SEQ ID NO: 8088 - protein, 19 aa, Homo sapiens
  Heavy chain CDR3 for antibody 4044 (IGHV3-33)
ARGVRLRFFDPYYYYGLDV

SEQ ID NO: 8089 - protein, 8 aa, Homo sapiens
  Light chain CDR3 for antibody 4045 (IGKV3D-7)
QQDYNLLT

SEQ ID NO: 8090 - protein, 10 aa, Homo sapiens
  Heavy chain CDR3 for antibody 4045 (IGHV3-23)
AKGDRWRFDP

SEQ ID NO: 8091 - protein, 9 aa, Homo sapiens
  Light chain CDR3 for antibody 4046 (IGKV3-20)
QQYGSSPYT

SEQ ID NO: 8092 - protein, 17 aa, Homo sapiens
  Heavy chain CDR3 for antibody 4046 (IGHV3-33)
AREGTMVRGYYYYGMDV

SEQ ID NO: 8093 - protein, 9 aa, Homo sapiens
  Light chain CDR3 for antibody 4047 (IGKV1-27)
QKYNSAPYT

SEQ ID NO: 8094 - protein, 14 aa, Homo sapiens
  Heavy chain CDR3 for antibody 4047 (IGHV3-33)
ARDKSYPLSYGMDV

SEQ ID NO: 8095 - protein, 9 aa, Homo sapiens
  Light chain CDR3 for antibody 4048 (IGKV6-21)
HQSSSLPYT

SEQ ID NO: 8096 - protein, 16 aa, Homo sapiens
  Heavy chain CDR3 for antibody 4048 (IGHV3-20)
ARDSSSLDYYYYGMDV

SEQ ID NO: 8097 - protein, 9 aa, Homo sapiens
  Light chain CDR3 for antibody 4049 (IGKV6-21)
HQSSSLPYT

SEQ ID NO: 8098 - protein, 18 aa, Homo sapiens
  Heavy chain CDR3 for antibody 4049 (IGHV3-53)
AKAGDYYVSGSYWGYFDL

SEQ ID NO: 8099 - protein, 10 aa, Homo sapiens
  Light chain CDR3 for antibody 4050 (IGKV3-20)
QQYGRSPPVT

SEQ ID NO: 8100 - protein, 13 aa, Homo sapiens
  Heavy chain CDR3 for antibody 4050 (IGHV3-33)
ARDYCGGDCYLDY

SEQ ID NO: 8101 - protein, 9 aa, Homo sapiens
  Light chain CDR3 for antibody 4051 (IGKV3-11)
QQRSNWPPT

SEQ ID NO: 8102 - protein, 17 aa, Homo sapiens
  Heavy chain CDR3 for antibody 4051 (IGHV3-33)
ARVYYDILTGYSPAFDI

SEQ ID NO: 8103 - protein, 9 aa, Homo sapiens
  Light chain CDR3 for antibody 4052 (IGKV1-17)
LQHNSYPYT

SEQ ID NO: 8104 - protein, 15 aa, Homo sapiens
  Heavy chain CDR3 for antibody 4052 (IGHV3-33)
ARHSSGFYYYYGMDV

SEQ ID NO: 8105 - protein, 10 aa, Homo sapiens
  Light chain CDR3 for antibody 4053 (IGKV1-39)
QQSYSTPMYT

SEQ ID NO: 8106 - protein, 12 aa, Homo sapiens
  Heavy chain CDR3 for antibody 4053 (IGHV3-33)
ARDLVGATPFDY

SEQ ID NO: 8107 - protein, 9 aa, Homo sapiens
  Light chain CDR3 for antibody 4054 (IGKV6-21)
HQSSSLPYT

SEQ ID NO: 8108 - protein, 11 aa, Homo sapiens
  Heavy chain CDR3 for antibody 4054 (IGHV1-24)
ATYFGSGSLDY

SEQ ID NO: 8109 - protein, 10 aa, Homo sapiens
  Light chain CDR3 for antibody 4055 (IGKV3-11)
QQRSNWPIFT

SEQ ID NO: 8110 - protein, 19 aa, Homo sapiens
  Heavy chain CDR3 for antibody 4055 (IGHV5-51)
ARHGEKGKRITMVRGSLDV

SEQ ID NO: 8111 - protein, 10 aa, Homo sapiens
  Light chain CDR3 for antibody 4056 (IGKV1-39)
QQSYSTPMYT

SEQ ID NO: 8112 - protein, 12 aa, Homo sapiens
  Heavy chain CDR3 for antibody 4056 (IGHV3-33)
ARVDAAAPYFDY

SEQ ID NO: 8113 - protein, 8 aa, Homo sapiens
  Light chain CDR3 for antibody 4057 (IGKV3D-7)
QQDYNLLT

SEQ ID NO: 8114 - protein, 13 aa, Homo sapiens
  Heavy chain CDR3 for antibody 4057 (IGHV4-39)
ARRDVLAPAAFDY

SEQ ID NO: 8115 - protein, 9 aa, Homo sapiens
  Light chain CDR3 for antibody 4058 (IGKV1-39)
QQSYSTPLT

SEQ ID NO: 8116 - protein, 14 aa, Homo sapiens
  Heavy chain CDR3 for antibody 4058 (IGHV3-33)
ARDRRDFYYYGMDV

SEQ ID NO: 8117 - protein, 9 aa, Homo sapiens
  Light chain CDR3 for antibody 4059 (IGKV1-17)
LQHNSYPYT

SEQ ID NO: 8118 - protein, 13 aa, Homo sapiens
  Heavy chain CDR3 for antibody 4059 (IGHV3-33)
ARGRGYNYGYGDY

SEQ ID NO: 8119 - protein, 9 aa, Homo sapiens
  Light chain CDR3 for antibody 4060 (IGKV5-2)
LQHDNFPWT

SEQ ID NO: 8120 - protein, 15 aa, Homo sapiens
  Heavy chain CDR3 for antibody 4060 (IGHV1-46)
ARGRFFDWLLSPFDY

SEQ ID NO: 8121 - protein, 8 aa, Homo sapiens
  Light chain CDR3 for antibody 4061 (IGKV3-20)
QQYGRSFT

SEQ ID NO: 8122 - protein, 12 aa, Homo sapiens
  Heavy chain CDR3 for antibody 4061 (IGHV4-39)
ARHGSGSSYFDY

SEQ ID NO: 8123 - protein, 9 aa, Homo sapiens
  Light chain CDR3 for antibody 4062 (IGKV3D-20)
QQYGSSPWT

SEQ ID NO: 8124 - protein, 11 aa, Homo sapiens
  Heavy chain CDR3 for antibody 4062 (IGHV1-46)
ARDPGSITGDY

SEQ ID NO: 8125 - protein, 8 aa, Homo sapiens
  Light chain CDR3 for antibody 4063 (IGKV3D-7)
QQDYNLVT

SEQ ID NO: 8126 - protein, 19 aa, Homo sapiens
  Heavy chain CDR3 for antibody 4063 (IGHV4-59)
ARDRVVGATTYYYYYGMDV

SEQ ID NO: 8127 - protein, 9 aa, Homo sapiens
  Light chain CDR3 for antibody 4064 (IGKV2D-28)
MQVLQTPFT

SEQ ID NO: 8128 - protein, 11 aa, Homo sapiens
  Heavy chain CDR3 for antibody 4064 (IGHV4-59)
AREMGHDTFDI

SEQ ID NO: 8129 - protein, 9 aa, Homo sapiens
  Light chain CDR3 for antibody 4065 (IGKV1-6)
LQDYNYPYT

SEQ ID NO: 8130 - protein, 17 aa, Homo sapiens
  Heavy chain CDR3 for antibody 4065 (IGHV3-23)
AKGDYYGSGSYSTFFDY

SEQ ID NO: 8131 - protein, 9 aa, Homo sapiens
  Light chain CDR3 for antibody 4066 (IGKV3-11)
QQRSNWPLT

SEQ ID NO: 8132 - protein, 16 aa, Homo sapiens
  Heavy chain CDR3 for antibody 4066 (IGHV1-24)
ATEDSSSYYYYYGMDV

SEQ ID NO: 8133 - protein, 10 aa, Homo sapiens
  Light chain CDR3 for antibody 4067 (IGKV3-20)
QQYGRSPPVT

SEQ ID NO: 8134 - protein, 18 aa, Homo sapiens
  Heavy chain CDR3 for antibody 4067 (IGHV4-59)
AREGDYVWGSYRPNWFDP

SEQ ID NO: 8135 - protein, 9 aa, Homo sapiens
  Light chain CDR3 for antibody 4068 (IGKV6-21)
HQSSSLPYT

SEQ ID NO: 8136 - protein, 22 aa, Homo sapiens
  Heavy chain CDR3 for antibody 4068 (IGHV4-59)
AREINYGSGSYYNEDYYYGMDV

SEQ ID NO: 8137 - protein, 9 aa, Homo sapiens
  Light chain CDR3 for antibody 4069 (IGKV1-9)
QQGNTYSRT

SEQ ID NO: 8138 - protein, 11 aa, Homo sapiens
  Heavy chain CDR3 for antibody 4069 (IGHV4-59)
ARSIRYSVFDY

SEQ ID NO: 8139 - protein, 8 aa, Homo sapiens
  Light chain CDR3 for antibody 4070 (IGKV1D-13)
QQFNNYPT

SEQ ID NO: 8140 - protein, 12 aa, Homo sapiens
  Heavy chain CDR3 for antibody 4070 (IGHV3-13)
AREAGIPDAFDI

SEQ ID NO: 8141 - protein, 9 aa, Homo sapiens
  Light chain CDR3 for antibody 4071 (IGKV1-9)
QQLISYPLT

SEQ ID NO: 8142 - protein, 13 aa, Homo sapiens
  Heavy chain CDR3 for antibody 4071 (IGHV3-23)
ASPFNWNDGFFDY

SEQ ID NO: 8143 - protein, 9 aa, Homo sapiens
  Light chain CDR3 for antibody 4072 (IGKV1D-13)
QQFNNYPHT

SEQ ID NO: 8144 - protein, 13 aa, Homo sapiens
  Heavy chain CDR3 for antibody 4072 (IGHV3-33)
ARGVLWFGELFDY

SEQ ID NO: 8145 - protein, 9 aa, Homo sapiens
  Light chain CDR3 for antibody 4073 (IGKV6-21)
HQSSSLPYT

SEQ ID NO: 8146 - protein, 14 aa, Homo sapiens
  Heavy chain CDR3 for antibody 4073 (IGHV1-46)
ARSYYDILTGAFDI

SEQ ID NO: 8147 - protein, 9 aa, Homo sapiens
  Light chain CDR3 for antibody 4074 (IGKV3-20)
QQYGSSPYT

SEQ ID NO: 8148 - protein, 15 aa, Homo sapiens
  Heavy chain CDR3 for antibody 4074 (IGHV4-59)
ARDLGYYGSGSPLAY

SEQ ID NO: 8149 - protein, 9 aa, Homo sapiens
  Light chain CDR3 for antibody 4075 (IGKV1-39)
QQSYRTPLT

SEQ ID NO: 8150 - protein, 16 aa, Homo sapiens
  Heavy chain CDR3 for antibody 4075 (IGHV4-59)
ARGRYFDWLLGDVFDI

SEQ ID NO: 8151 - protein, 9 aa, Homo sapiens
  Light chain CDR3 for antibody 4076 (IGKV1-17)
LQHNSYPYT

SEQ ID NO: 8152 - protein, 20 aa, Homo sapiens
  Heavy chain CDR3 for antibody 4076 (IGHV1-8)
ARGDGTMVRGIYYYYYGMDV

SEQ ID NO: 8153 - protein, 9 aa, Homo sapiens
  Light chain CDR3 for antibody 4077 (IGKV3-20)
QQYGSSPYT

SEQ ID NO: 8154 - protein, 14 aa, Homo sapiens
  Heavy chain CDR3 for antibody 4077 (IGHV3-20)
AREGWFGDYYGMDV

SEQ ID NO: 8155 - protein, 9 aa, Homo sapiens
  Light chain CDR3 for antibody 4078 (IGKV6-21)
HQSSSLPYT

SEQ ID NO: 8156 - protein, 17 aa, Homo sapiens
  Heavy chain CDR3 for antibody 4078 (IGHV3-23)
SKERNWNDGYYYFGMDA

SEQ ID NO: 8157 - protein, 9 aa, Homo sapiens
  Light chain CDR3 for antibody 4079 (IGKV6-21)
HQSSSLPYT

SEQ ID NO: 8158 - protein, 17 aa, Homo sapiens
  Heavy chain CDR3 for antibody 4079 (IGHV3-30)
ARDGVGATSYYYYGMDV

SEQ ID NO: 8159 - protein, 8 aa, Homo sapiens
  Light chain CDR3 for antibody 4080 (IGKV3-20)
QQYGRSFT

SEQ ID NO: 8160 - protein, 17 aa, Homo sapiens
  Heavy chain CDR3 for antibody 4080 (IGHV3-33)
ARGYCSRTSCYLYYFDY

SEQ ID NO: 8161 - protein, 9 aa, Homo sapiens
  Light chain CDR3 for antibody 4081 (IGKV1D-16)
QQFNNYPRT

SEQ ID NO: 8162 - protein, 16 aa, Homo sapiens
  Heavy chain CDR3 for antibody 4081 (IGHV1-18)
ARYFDWLLRDYYGMDV

SEQ ID NO: 8163 - protein, 9 aa, Homo sapiens
  Light chain CDR3 for antibody 4082 (IGKV1D-13)
QQFNNYPYT

SEQ ID NO: 8164 - protein, 12 aa, Homo sapiens
  Heavy chain CDR3 for antibody 4082 (IGHV3-33)
ARDYISTYGMDV

SEQ ID NO: 8165 - protein, 9 aa, Homo sapiens
  Light chain CDR3 for antibody 4083 (IGKV1-9)
QQLNSYPYT

SEQ ID NO: 8166 - protein, 14 aa, Homo sapiens
  Heavy chain CDR3 for antibody 4083 (IGHV3-33)
ARDGYDILTGPFDY

SEQ ID NO: 8167 - protein, 9 aa, Homo sapiens
  Light chain CDR3 for antibody 4084 (IGKV6-21)
HQSSSLPYT

SEQ ID NO: 8168 - protein, 21 aa, Homo sapiens
  Heavy chain CDR3 for antibody 4084 (IGHV1-18)
ASGVLIWFGELLSEDYYDMDV

SEQ ID NO: 8169 - protein, 8 aa, Homo sapiens
  Light chain CDR3 for antibody 4085 (IGKV1D-13)
QQFNNYPT

SEQ ID NO: 8170 - protein, 16 aa, Homo sapiens
  Heavy chain CDR3 for antibody 4085 (IGHV3-33)
ARAVYYGSGSSLIMDV

SEQ ID NO: 8171 - protein, 9 aa, Homo sapiens
  Light chain CDR3 for antibody 4086 (IGKV1D-16)
QQYNSYPYT

SEQ ID NO: 8172 - protein, 16 aa, Homo sapiens
  Heavy chain CDR3 for antibody 4086 (IGHV3-33)
ARGSVSDILTGAYFDY

SEQ ID NO: 8173 - protein, 9 aa, Homo sapiens
  Light chain CDR3 for antibody 4087 (IGKV3D-7)
QQDYEFPIT

SEQ ID NO: 8174 - protein, 16 aa, Homo sapiens
  Heavy chain CDR3 for antibody 4087 (IGHV3-23)
AKEGMVLRYFDWLWDY

SEQ ID NO: 8175 - protein, 8 aa, Homo sapiens
  Light chain CDR3 for antibody 4088 (IGKV3D-7)
QQDYNLLT

SEQ ID NO: 8176 - protein, 11 aa, Homo sapiens
  Heavy chain CDR3 for antibody 4088 (IGHV3-33)
ARDTWDDYFDY

SEQ ID NO: 8177 - protein, 9 aa, Homo sapiens
  Light chain CDR3 for antibody 4089 (IGKV3-15)
QQYNNWPLT

SEQ ID NO: 8178 - protein, 15 aa, Homo sapiens
  Heavy chain CDR3 for antibody 4089 (IGHV4-39)
ARHSKYSSGWYPFDY

SEQ ID NO: 8179 - protein, 8 aa, Homo sapiens
  Light chain CDR3 for antibody 4090 (IGKV3D-7)
QQDYNLLT

SEQ ID NO: 8180 - protein, 14 aa, Homo sapiens
  Heavy chain CDR3 for antibody 4090 (IGHV4-39)
ARDSGYDYYYGMDV

SEQ ID NO: 8181 - protein, 9 aa, Homo sapiens
  Light chain CDR3 for antibody 4091 (IGKV3-11)
QQRSNWPPT

SEQ ID NO: 8182 - protein, 15 aa, Homo sapiens
  Heavy chain CDR3 for antibody 4091 (IGHV3-33)
ARDRVVRGVMGYFDY

SEQ ID NO: 8183 - protein, 9 aa, Homo sapiens
  Light chain CDR3 for antibody 4092 (IGKV5-2)
LQHDNFPYT

SEQ ID NO: 8184 - protein, 16 aa, Homo sapiens
  Heavy chain CDR3 for antibody 4092 (IGHV1-24)
ATDWNDRGYYYYGMDV

SEQ ID NO: 8185 - protein, 9 aa, Homo sapiens
  Light chain CDR3 for antibody 4093 (IGKV1-9)
QQLNSYPLT

SEQ ID NO: 8186 - protein, 16 aa, Homo sapiens
  Heavy chain CDR3 for antibody 4093 (IGHV4-39)
ARGANYYGSGIPNFEY

SEQ ID NO: 8187 - protein, 9 aa, Homo sapiens
  Light chain CDR3 for antibody 4094 (IGKV3D-7)
QQDYNLPYT

SEQ ID NO: 8188 - protein, 14 aa, Homo sapiens
  Heavy chain CDR3 for antibody 4094 (IGHV3-33)
ARRGSPLRPSHLDV

SEQ ID NO: 8189 - protein, 10 aa, Homo sapiens
  Light chain CDR3 for antibody 4095 (IGKV1-17)
LQHNSYPMYT

SEQ ID NO: 8190 - protein, 17 aa, Homo sapiens
  Heavy chain CDR3 for antibody 4095 (IGHV1-18)
ARDEGYDILTGYPHFDY

SEQ ID NO: 8191 - protein, 9 aa, Homo sapiens
  Light chain CDR3 for antibody 4096 (IGKV1-39)
QQCYSTPRT

SEQ ID NO: 8192 - protein, 20 aa, Homo sapiens
  Heavy chain CDR3 for antibody 4096 (IGHV3-11)
ARDAGVWFVDPYYYYNGMDV

SEQ ID NO: 8193 - protein, 9 aa, Homo sapiens
  Light chain CDR3 for antibody 4097 (IGKV3D-7)
QQDYNLPWT

SEQ ID NO: 8194 - protein, 14 aa, Homo sapiens
  Heavy chain CDR3 for antibody 4097 (IGHV3-33)
ARDREQQLVRYFDY

SEQ ID NO: 8195 - protein, 10 aa, Homo sapiens
  Light chain CDR3 for antibody 4098 (IGKV1-39)
QQSYSTPMYT

SEQ ID NO: 8196 - protein, 18 aa, Homo sapiens
  Heavy chain CDR3 for antibody 4098 (IGHV3-33)
ARDRYYDILTGYYMGFDY

SEQ ID NO: 8197 - protein, 9 aa, Homo sapiens
  Light chain CDR3 for antibody 4099 (IGKV1D-13)
QQFNNYPRT

SEQ ID NO: 8198 - protein, 15 aa, Homo sapiens
  Heavy chain CDR3 for antibody 4099 (IGHV1-24)
ATHWDLRYYYYGMDV

SEQ ID NO: 8199 - protein, 10 aa, Homo sapiens
  Light chain CDR3 for antibody 4100 (IGKV1-39)
QQSYSTPMYT

SEQ ID NO: 8200 - protein, 14 aa, Homo sapiens
  Heavy chain CDR3 for antibody 4100 (IGHV3-33)
ARRGSPLRPSHLDV

SEQ ID NO: 8201 - protein, 9 aa, Homo sapiens
  Light chain CDR3 for antibody 4101 (IGKV1D-16)
QQYYSYPRT

SEQ ID NO: 8202 - protein, 14 aa, Homo sapiens
  Heavy chain CDR3 for antibody 4101 (IGHV3-33)
ARASSGSSYWYFDL

SEQ ID NO: 8203 - protein, 9 aa, Homo sapiens
  Light chain CDR3 for antibody 4102 (IGKV6-21)
HQSSSLPYT

SEQ ID NO: 8204 - protein, 12 aa, Homo sapiens
  Heavy chain CDR3 for antibody 4102 (IGHV1-18)
ARRDGSGTSFDY

SEQ ID NO: 8205 - protein, 8 aa, Homo sapiens
  Light chain CDR3 for antibody 4103 (IGKV3D-7)
QQDYNLLT

SEQ ID NO: 8206 - protein, 17 aa, Homo sapiens
  Heavy chain CDR3 for antibody 4103 (IGHV3-33)
ARGFSGYDGYYYYGMDV

SEQ ID NO: 8207 - protein, 9 aa, Homo sapiens
  Light chain CDR3 for antibody 4104 (IGKV1-39)
QQSYRTPLT

SEQ ID NO: 8208 - protein, 19 aa, Homo sapiens
  Heavy chain CDR3 for antibody 4104 (IGHV3-33)
ARGPYYDILTGYGYYGMDV

SEQ ID NO: 8209 - protein, 9 aa, Homo sapiens
  Light chain CDR3 for antibody 4105 (IGKV1D-16)
QQYNSFPLT

SEQ ID NO: 8210 - protein, 18 aa, Homo sapiens
  Heavy chain CDR3 for antibody 4105 (IGHV1-46)
ARDGDYVWGSYRSNWFDP

SEQ ID NO: 8211 - protein, 8 aa, Homo sapiens
  Light chain CDR3 for antibody 4106 (IGKV3D-7)
QQDYNLLT

SEQ ID NO: 8212 - protein, 20 aa, Homo sapiens
  Heavy chain CDR3 for antibody 4106 (IGHV3-20)
ARDLCSSTSCYGYYYYGMDV

SEQ ID NO: 8213 - protein, 10 aa, Homo sapiens
  Light chain CDR3 for antibody 4107 (IGKV3-11)
QQRSNWPTLT

SEQ ID NO: 8214 - protein, 15 aa, Homo sapiens
  Heavy chain CDR3 for antibody 4107 (IGHV3-30)
ARRGYGSGSPDAFDL

SEQ ID NO: 8215 - protein, 10 aa, Homo sapiens
  Light chain CDR3 for antibody 4108 (IGKV3-11)
QQRSNWPIFT

SEQ ID NO: 8216 - protein, 11 aa, Homo sapiens
  Heavy chain CDR3 for antibody 4108 (IGHV3-74)
ARDRGNWGFDY

SEQ ID NO: 8217 - protein, 9 aa, Homo sapiens
  Light chain CDR3 for antibody 4109 (IGKV3-11)
QQRINWPWT

SEQ ID NO: 8218 - protein, 15 aa, Homo sapiens
  Heavy chain CDR3 for antibody 4109 (IGHV3-33)
ARDSRPEIIGPPFDY

SEQ ID NO: 8219 - protein, 11 aa, Homo sapiens
  Light chain CDR3 for antibody 4110 (IGKV3-11)
QQRSNWPPTWT

SEQ ID NO: 8220 - protein, 16 aa, Homo sapiens
  Heavy chain CDR3 for antibody 4110 (IGHV1-24)
ATEDSSSTYYYYGLDV

SEQ ID NO: 8221 - protein, 9 aa, Homo sapiens
  Light chain CDR3 for antibody 4111 (IGKV1D-16)
QQYNSYPYT

SEQ ID NO: 8222 - protein, 16 aa, Homo sapiens
  Heavy chain CDR3 for antibody 4111 (IGHV3-33)
ARGGLTGGGDYDAFDI

SEQ ID NO: 8223 - protein, 9 aa, Homo sapiens
  Light chain CDR3 for antibody 4112 (IGKV1D-13)
QQFNNYPYT

SEQ ID NO: 8224 - protein, 18 aa, Homo sapiens
  Heavy chain CDR3 for antibody 4112 (IGHV3-33)
ARDRGDILTGYYKGWFDP

SEQ ID NO: 8225 - protein, 9 aa, Homo sapiens
  Light chain CDR3 for antibody 4113 (IGKV1-39)
QQSYSTPLT

SEQ ID NO: 8226 - protein, 16 aa, Homo sapiens
  Heavy chain CDR3 for antibody 4113 (IGHV1-8)
AREGTMVRGVTYAFDI

SEQ ID NO: 8227 - protein, 9 aa, Homo sapiens
  Light chain CDR3 for antibody 4114 (IGKV3-11)
QQRSNWPYT

SEQ ID NO: 8228 - protein, 12 aa, Homo sapiens
  Heavy chain CDR3 for antibody 4114 (IGHV3-33)
ARDPGYYYGLDV

SEQ ID NO: 8229 - protein, 9 aa, Homo sapiens
  Light chain CDR3 for antibody 4115 (IGKV3-15)
QQYNNWPLT

SEQ ID NO: 8230 - protein, 14 aa, Homo sapiens
  Heavy chain CDR3 for antibody 4115 (IGHV4-39)
ARQGTMIRGGYFDY

SEQ ID NO: 8231 - protein, 9 aa, Homo sapiens
  Light chain CDR3 for antibody 4116 (IGKV1-27)
QKYNSAPYT

SEQ ID NO: 8232 - protein, 15 aa, Homo sapiens
  Heavy chain CDR3 for antibody 4116 (IGHV3-33)
AREGLRYFHYYGMDV

SEQ ID NO: 8233 - protein, 9 aa, Homo sapiens
  Light chain CDR3 for antibody 4117 (IGKV1-9)
QQLNSYPWT

SEQ ID NO: 8234 - protein, 13 aa, Homo sapiens
  Heavy chain CDR3 for antibody 4117 (IGHV3-33)
ASAGNSYYNVMDV

SEQ ID NO: 8235 - protein, 10 aa, Homo sapiens
  Light chain CDR3 for antibody 4118 (IGKV1-39)
QQSYSTPMYT

SEQ ID NO: 8236 - protein, 15 aa, Homo sapiens
  Heavy chain CDR3 for antibody 4118 (IGHV3-33)
ARDTGYSSSWNWFDP

SEQ ID NO: 8237 - protein, 9 aa, Homo sapiens
  Light chain CDR3 for antibody 4119 (IGKV5-2)
LQHDNFPWT

SEQ ID NO: 8238 - protein, 12 aa, Homo sapiens
  Heavy chain CDR3 for antibody 4119 (IGHV3-33)
ARESGGSFGMDV

SEQ ID NO: 8239 - protein, 9 aa, Homo sapiens
  Light chain CDR3 for antibody 4120 (IGKV1-9)
QQLNSYPYT

SEQ ID NO: 8240 - protein, 11 aa, Homo sapiens
  Heavy chain CDR3 for antibody 4120 (IGHV3-h)
AREDYYYGMDV

SEQ ID NO: 8241 - protein, 10 aa, Homo sapiens
  Light chain CDR3 for antibody 4121 (IGKV3-11)
QQRSNWPIFT

SEQ ID NO: 8242 - protein, 16 aa, Homo sapiens
  Heavy chain CDR3 for antibody 4121 (IGHV1-24)
ATEDSSSTYYYYGLDV

SEQ ID NO: 8243 - protein, 10 aa, Homo sapiens
  Light chain CDR3 for antibody 4122 (IGKV1-39)
QQSYSTPMYT

SEQ ID NO: 8244 - protein, 18 aa, Homo sapiens
  Heavy chain CDR3 for antibody 4122 (IGHV1-46)
ARDGDYVWGSYRSDWFDP

SEQ ID NO: 8245 - protein, 8 aa, Homo sapiens
  Light chain CDR3 for antibody 4123 (IGKV3D-7)
QQDYNLLT

SEQ ID NO: 8246 - protein, 17 aa, Homo sapiens
  Heavy chain CDR3 for antibody 4123 (IGHV4-34)
AGLRFFDWLFDYYGMDV

SEQ ID NO: 8247 - protein, 9 aa, Homo sapiens
  Light chain CDR3 for antibody 4124 (IGKV5-2)
LQHDNFPYT

SEQ ID NO: 8248 - protein, 12 aa, Homo sapiens
  Heavy chain CDR3 for antibody 4124 (IGHV4-61)
ARVDSSGWFFDY

SEQ ID NO: 8249 - protein, 9 aa, Homo sapiens
  Light chain CDR3 for antibody 4125 (IGKV5-2)
LQHDKFPYT

SEQ ID NO: 8250 - protein, 11 aa, Homo sapiens
  Heavy chain CDR3 for antibody 4125 (IGHV3-33)
ARAGIAALFDY

SEQ ID NO: 8251 - protein, 9 aa, Homo sapiens
  Light chain CDR3 for antibody 4126 (IGKV1D-13)
QQFNNYPHT

SEQ ID NO: 8252 - protein, 12 aa, Homo sapiens
  Heavy chain CDR3 for antibody 4126 (IGHV4-59)
ARDSGSYYYFDY

SEQ ID NO: 8253 - protein, 9 aa, Homo sapiens
  Light chain CDR3 for antibody 4127 (IGKV3D-20)
QQYGSSPYT

SEQ ID NO: 8254 - protein, 21 aa, Homo sapiens
  Heavy chain CDR3 for antibody 4127 (IGHV3-33)
AREGYDILTGMGYYYYYGMDV

SEQ ID NO: 8255 - protein, 9 aa, Homo sapiens
  Light chain CDR3 for antibody 4128 (IGKV1D-13)
QQFNNYPHT

SEQ ID NO: 8256 - protein, 16 aa, Homo sapiens
  Heavy chain CDR3 for antibody 4128 (IGHV3-23)
ARNWNDVGDYYYGMDV

SEQ ID NO: 8257 - protein, 9 aa, Homo sapiens
  Light chain CDR3 for antibody 4129 (IGKV3D-7)
QQDYNLPWT

SEQ ID NO: 8258 - protein, 13 aa, Homo sapiens
  Heavy chain CDR3 for antibody 4129 (IGHV4-39)
ARRDGSYYGYFDY

SEQ ID NO: 8259 - protein, 9 aa, Homo sapiens
  Light chain CDR3 for antibody 4130 (IGKV1-17)
LQHNSYPPT

SEQ ID NO: 8260 - protein, 17 aa, Homo sapiens
  Heavy chain CDR3 for antibody 4130 (IGHV1-8)
ARGDYYGSGSPYWYFDL

SEQ ID NO: 8261 - protein, 9 aa, Homo sapiens
  Light chain CDR3 for antibody 4131 (IGKV1-17)
LQHNSYPYT

SEQ ID NO: 8262 - protein, 11 aa, Homo sapiens
  Heavy chain CDR3 for antibody 4131 (IGHV3-64)
ARERGSYAFDI

SEQ ID NO: 8263 - protein, 9 aa, Homo sapiens
  Light chain CDR3 for antibody 4132 (IGKV1-6)
LQDYNYPYT

SEQ ID NO: 8264 - protein, 19 aa, Homo sapiens
  Heavy chain CDR3 for antibody 4132 (IGHV1-24)
ATEGGIVGGTRYYYYGMDV

SEQ ID NO: 8265 - protein, 9 aa, Homo sapiens
  Light chain CDR3 for antibody 4133 (IGKV1-9)
QQLNSYPLT

SEQ ID NO: 8266 - protein, 16 aa, Homo sapiens
  Heavy chain CDR3 for antibody 4133 (IGHV4-59)
ARYSGSYYGDYYGMDV

SEQ ID NO: 8267 - protein, 9 aa, Homo sapiens
  Light chain CDR3 for antibody 4134 (IGKV6-21)
HQSSSLPYT

SEQ ID NO: 8268 - protein, 20 aa, Homo sapiens
  Heavy chain CDR3 for antibody 4134 (IGHV1-f)
ATHYDILTGSPYYYYCALDV

SEQ ID NO: 8269 - protein, 9 aa, Homo sapiens
  Light chain CDR3 for antibody 4135 (IGKV1-27)
QKYNSAPYT

SEQ ID NO: 8270 - protein, 15 aa, Homo sapiens
  Heavy chain CDR3 for antibody 4135 (IGHV3-23)
AKEFTMVRGVITPDY

SEQ ID NO: 8271 - protein, 9 aa, Homo sapiens
  Light chain CDR3 for antibody 4136 (IGKV3D-7)
QQDYNLPYT

SEQ ID NO: 8272 - protein, 17 aa, Homo sapiens
  Heavy chain CDR3 for antibody 4136 (IGHV3-33)
ARGFSGYDGYYYYGMDV

SEQ ID NO: 8273 - protein, 10 aa, Homo sapiens
  Light chain CDR3 for antibody 4137 (IGKV1-9)
QQLDSYPMYT

SEQ ID NO: 8274 - protein, 13 aa, Homo sapiens
  Heavy chain CDR3 for antibody 4137 (IGHV3-33)
ARAFTMVRGVIDY

SEQ ID NO: 8275 - protein, 9 aa, Homo sapiens
  Light chain CDR3 for antibody 4138 (IGKV3-15)
QQYINWPLT

SEQ ID NO: 8276 - protein, 16 aa, Homo sapiens
  Heavy chain CDR3 for antibody 4138 (IGHV4-59)
ARGRYFEWLLGDVFDI

SEQ ID NO: 8277 - protein, 9 aa, Homo sapiens
  Light chain CDR3 for antibody 4139 (IGKV1D-13)
QQFNNYPYT

SEQ ID NO: 8278 - protein, 11 aa, Homo sapiens
  Heavy chain CDR3 for antibody 4139 (IGHV3-23)
ARDPGSITGDY

SEQ ID NO: 8279 - protein, 9 aa, Homo sapiens
  Light chain CDR3 for antibody 4140 (IGKV1-27)
QKYNSAPYT

SEQ ID NO: 8280 - protein, 8 aa, Homo sapiens
  Heavy chain CDR3 for antibody 4140 (IGHV3-23)
AKESLLDY

SEQ ID NO: 8281 - protein, 8 aa, Homo sapiens
  Light chain CDR3 for antibody 4141 (IGKV3D-7)
QQDYNLLT

SEQ ID NO: 8282 - protein, 11 aa, Homo sapiens
  Heavy chain CDR3 for antibody 4141 (IGHV3-33)
AREAANWGFDY

SEQ ID NO: 8283 - protein, 9 aa, Homo sapiens
  Light chain CDR3 for antibody 4142 (IGKV1D-13)
QQFNNYPHT

SEQ ID NO: 8284 - protein, 13 aa, Homo sapiens
  Heavy chain CDR3 for antibody 4142 (IGHV4-39)
ARHPPSRDYGMDV

SEQ ID NO: 8285 - protein, 9 aa, Homo sapiens
  Light chain CDR3 for antibody 4143 (IGKV1D-13)
QRFNNYLYT

SEQ ID NO: 8286 - protein, 13 aa, Homo sapiens
  Heavy chain CDR3 for antibody 4143 (IGHV3-11)
ARDGGAAAGTWDS

SEQ ID NO: 8287 - protein, 9 aa, Homo sapiens
  Light chain CDR3 for antibody 4144 (IGKV6-21)
HQSTSLPFT

SEQ ID NO: 8288 - protein, 13 aa, Homo sapiens
  Heavy chain CDR3 for antibody 4144 (IGHV4-39)
ARHEVMIRGVFDY

SEQ ID NO: 8289 - protein, 9 aa, Homo sapiens
  Light chain CDR3 for antibody 4145 (IGKV1D-13)
QQFNNYPYT

SEQ ID NO: 8290 - protein, 19 aa, Homo sapiens
  Heavy chain CDR3 for antibody 4145 (IGHV3-33)
ARDRYYDILTGYSSYYFDY

SEQ ID NO: 8291 - protein, 9 aa, Homo sapiens
  Light chain CDR3 for antibody 4146 (IGKV3-20)
QQYGSSPYT

SEQ ID NO: 8292 - protein, 14 aa, Homo sapiens
  Heavy chain CDR3 for antibody 4146 (IGHV3-33)
ARGYGSGSYYSFDY

SEQ ID NO: 8293 - protein, 9 aa, Homo sapiens
  Light chain CDR3 for antibody 4147 (IGKV1-39)
QQSYSTPFT

SEQ ID NO: 8294 - protein, 13 aa, Homo sapiens
  Heavy chain CDR3 for antibody 4147 (IGHV4-39)
ARRGVVAPAAFDY

SEQ ID NO: 8295 - protein, 9 aa, Homo sapiens
  Light chain CDR3 for antibody 4148 (IGKV1-27)
QKYNSAPYT

SEQ ID NO: 8296 - protein, 15 aa, Homo sapiens
  Heavy chain CDR3 for antibody 4148 (IGHV3-23)
AKDPRGYYYYYGMDV

SEQ ID NO: 8297 - protein, 10 aa, Homo sapiens
  Light chain CDR3 for antibody 4149 (IGKV1-39)
QQSYSTPMYT

SEQ ID NO: 8298 - protein, 14 aa, Homo sapiens
  Heavy chain CDR3 for antibody 4149 (IGHV3-33)
AREGYSSNWYDFDY

SEQ ID NO: 8299 - protein, 9 aa, Homo sapiens
  Light chain CDR3 for antibody 4150 (IGKV3-11)
QQRSNWMYT

SEQ ID NO: 8300 - protein, 13 aa, Homo sapiens
  Heavy chain CDR3 for antibody 4150 (IGHV3-23)
ARAFFMVRGVIDF

SEQ ID NO: 8301 - protein, 9 aa, Homo sapiens
  Light chain CDR3 for antibody 4151 (IGKV5-2)
LQHDNFPWT

SEQ ID NO: 8302 - protein, 20 aa, Homo sapiens
  Heavy chain CDR3 for antibody 4151 (IGHV1-8)
ARGDGTMVRGIYYYYYGMDV

SEQ ID NO: 8303 - protein, 10 aa, Homo sapiens
  Light chain CDR3 for antibody 4152 (IGKV3-20)
QQYGRSPPVT

SEQ ID NO: 8304 - protein, 15 aa, Homo sapiens
  Heavy chain CDR3 for antibody 4152 (IGHV3-30)
ARGAMVRGVDYGMDV

SEQ ID NO: 8305 - protein, 9 aa, Homo sapiens
  Light chain CDR3 for antibody 4153 (IGKV3-20)
QQYGSSPYT

SEQ ID NO: 8306 - protein, 15 aa, Homo sapiens
  Heavy chain CDR3 for antibody 4153 (IGHV3-33)
ARDGLRYFDWLFPWY

SEQ ID NO: 8307 - protein, 8 aa, Homo sapiens
  Light chain CDR3 for antibody 4154 (IGKV1-5)
QQYNSYWT

SEQ ID NO: 8308 - protein, 11 aa, Homo sapiens
  Heavy chain CDR3 for antibody 4154 (IGHV3-33)
ARDTWDDYFDY

SEQ ID NO: 8309 - protein, 9 aa, Homo sapiens
  Light chain CDR3 for antibody 4155 (IGKV2-30)
MQGTHWPLT

SEQ ID NO: 8310 - protein, 11 aa, Homo sapiens
  Heavy chain CDR3 for antibody 4155 (IGHV3-13)
AREAIIGPFDY

SEQ ID NO: 8311 - protein, 8 aa, Homo sapiens
  Light chain CDR3 for antibody 4156 (IGKV1D-13)
QQFNNYPT

SEQ ID NO: 8312 - protein, 7 aa, Homo sapiens
  Heavy chain CDR3 for antibody 4156 (IGHV3-33)
ARELVDY

SEQ ID NO: 8313 - protein, 9 aa, Homo sapiens
  Light chain CDR3 for antibody 4157 (IGKV3-11)
QQRSNWPPT

SEQ ID NO: 8314 - protein, 18 aa, Homo sapiens
  Heavy chain CDR3 for antibody 4157 (IGHV3-33)
ARDGYSGYDYYYYYGMDV

SEQ ID NO: 8315 - protein, 9 aa, Homo sapiens
  Light chain CDR3 for antibody 4158 (IGKV2-30)
MQGTHWPLT

SEQ ID NO: 8316 - protein, 13 aa, Homo sapiens
  Heavy chain CDR3 for antibody 4158 (IGHV3-30)
AAPFMVRGDGMDV

SEQ ID NO: 8317 - protein, 8 aa, Homo sapiens
  Light chain CDR3 for antibody 4159 (IGKV3-20)
QQYGSSLT

SEQ ID NO: 8318 - protein, 14 aa, Homo sapiens
  Heavy chain CDR3 for antibody 4159 (IGHV3-33)
ARGAAAGNFYGLDV

SEQ ID NO: 8319 - protein, 9 aa, Homo sapiens
  Light chain CDR3 for antibody 4160 (IGKV3-11)
QQRSNWPYT

SEQ ID NO: 8320 - protein, 11 aa, Homo sapiens
  Heavy chain CDR3 for antibody 4160 (IGHV3-74)
ARDRGNWGFDY

SEQ ID NO: 8321 - protein, 10 aa, Homo sapiens
  Light chain CDR3 for antibody 4161 (IGKV1-39)
QQSYSTPMYT

SEQ ID NO: 8322 - protein, 18 aa, Homo sapiens
  Heavy chain CDR3 for antibody 4161 (IGHV3-33)
ARGLLWFGVSYYYYGMDV

SEQ ID NO: 8323 - protein, 9 aa, Homo sapiens
  Light chain CDR3 for antibody 4162 (IGKV1-17)
PQHNSYPHT

SEQ ID NO: 8324 - protein, 12 aa, Homo sapiens
  Heavy chain CDR3 for antibody 4162 (IGHV3-33)
ARDRAYRGSLDH

SEQ ID NO: 8325 - protein, 9 aa, Homo sapiens
  Light chain CDR3 for antibody 4163 (IGKV1D-13)
QQFNNYPST

SEQ ID NO: 8326 - protein, 13 aa, Homo sapiens
  Heavy chain CDR3 for antibody 4163 (IGHV3-66)
ANTGDSYYYGFYV

SEQ ID NO: 8327 - protein, 9 aa, Homo sapiens
  Light chain CDR3 for antibody 4164 (IGKV3D-7)
QQDYNLPLT

SEQ ID NO: 8328 - protein, 13 aa, Homo sapiens
  Heavy chain CDR3 for antibody 4164 (IGHV4-39)
ARHHYGSGSLRDY

SEQ ID NO: 8329 - protein, 8 aa, Homo sapiens
  Light chain CDR3 for antibody 4165 (IGKV1-5)
QQYNSYWT

SEQ ID NO: 8330 - protein, 14 aa, Homo sapiens
  Heavy chain CDR3 for antibody 4165 (IGHV3-33)
ARDKTYPLSYGMDV

SEQ ID NO: 8331 - protein, 9 aa, Homo sapiens
  Light chain CDR3 for antibody 4166 (IGKV1-27)
QKYNSAPYT

SEQ ID NO: 8332 - protein, 19 aa, Homo sapiens
  Heavy chain CDR3 for antibody 4166 (IGHV3-33)
ARDSGYSGYDYYYYYGMDV

SEQ ID NO: 8333 - protein, 8 aa, Homo sapiens
  Light chain CDR3 for antibody 4167 (IGKV1-5)
QQYNSYWT

SEQ ID NO: 8334 - protein, 9 aa, Homo sapiens
  Heavy chain CDR3 for antibody 4167 (IGHV3-33)
ARATVGVDY

SEQ ID NO: 8335 - protein, 9 aa, Homo sapiens
  Light chain CDR3 for antibody 4168 (IGKV3-20)
QQYGSSPYT

SEQ ID NO: 8336 - protein, 15 aa, Homo sapiens
  Heavy chain CDR3 for antibody 4168 (IGHV3-33)
ARDGSGSYSLYGMDV

SEQ ID NO: 8337 - protein, 9 aa, Homo sapiens
  Light chain CDR3 for antibody 4169 (IGKV3D-7)
QQDYNLPLT

SEQ ID NO: 8338 - protein, 15 aa, Homo sapiens
  Heavy chain CDR3 for antibody 4169 (IGHV1-18)
ARGYCSSTSCYYFDY

SEQ ID NO: 8339 - protein, 8 aa, Homo sapiens
  Light chain CDR3 for antibody 4170 (IGKV1-5)
QQYNSYYT

SEQ ID NO: 8340 - protein, 10 aa, Homo sapiens
  Heavy chain CDR3 for antibody 4170 (IGHV3-23)
AKGDRWRFDP

SEQ ID NO: 8341 - protein, 9 aa, Homo sapiens
  Light chain CDR3 for antibody 4171 (IGKV1-39)
QQSYSTPLT

SEQ ID NO: 8342 - protein, 14 aa, Homo sapiens
  Heavy chain CDR3 for antibody 4171 (IGHV3-20)
ARDGGSGSYDGLDV

SEQ ID NO: 8343 - protein, 8 aa, Homo sapiens
  Light chain CDR3 for antibody 4172 (IGKV3D-7)
QQDYNLLT

SEQ ID NO: 8344 - protein, 11 aa, Homo sapiens
  Heavy chain CDR3 for antibody 4172 (IGHV3-74)
ARDRGNWGFDY

SEQ ID NO: 8345 - protein, 9 aa, Homo sapiens
  Light chain CDR3 for antibody 4173 (IGKV1-39)
QQSYRTPLT

SEQ ID NO: 8346 - protein, 17 aa, Homo sapiens
  Heavy chain CDR3 for antibody 4173 (IGHV3-30)
AREGVRGLIYYYYGMDV

SEQ ID NO: 8347 - protein, 9 aa, Homo sapiens
  Light chain CDR3 for antibody 4174 (IGKV1-27)
QKYNSAPYT

SEQ ID NO: 8348 - protein, 15 aa, Homo sapiens
  Heavy chain CDR3 for antibody 4174 (IGHV3-33)
ARDGSGSYSLYGMDV

SEQ ID NO: 8349 - protein, 9 aa, Homo sapiens
  Light chain CDR3 for antibody 4175 (IGKV1D-16)
QQYNSYPLT

SEQ ID NO: 8350 - protein, 13 aa, Homo sapiens
  Heavy chain CDR3 for antibody 4175 (IGHV1-18)
ARGGGVRGAPLDY

SEQ ID NO: 8351 - protein, 9 aa, Homo sapiens
  Light chain CDR3 for antibody 4176 (IGKV6-21)
HQSSSLPYT

SEQ ID NO: 8352 - protein, 18 aa, Homo sapiens
  Heavy chain CDR3 for antibody 4176 (IGHV3-23)
AKVGDFFASGNYWDYFDY

SEQ ID NO: 8353 - protein, 9 aa, Homo sapiens
  Light chain CDR3 for antibody 4177 (IGKV1-5)
QQYNTYSRT

SEQ ID NO: 8354 - protein, 13 aa, Homo sapiens
  Heavy chain CDR3 for antibody 4177 (IGHV3-11)
ARDGGAAAGTWDS

SEQ ID NO: 8355 - protein, 9 aa, Homo sapiens
  Light chain CDR3 for antibody 4178 (IGKV6-21)
HQSSSLPYT

SEQ ID NO: 8356 - protein, 14 aa, Homo sapiens
  Heavy chain CDR3 for antibody 4178 (IGHV3-23)
AKDDIVRATGAFDI

SEQ ID NO: 8357 - protein, 9 aa, Homo sapiens
  Light chain CDR3 for antibody 4179 (IGKV1-6)
LQDYNYPRT

SEQ ID NO: 8358 - protein, 12 aa, Homo sapiens
  Heavy chain CDR3 for antibody 4179 (IGHV4-28)
ARKDSGYDWFDY

SEQ ID NO: 8359 - protein, 9 aa, Homo sapiens
  Light chain CDR3 for antibody 4180 (IGKV3D-7)
QQDYNLPWT

SEQ ID NO: 8360 - protein, 11 aa, Homo sapiens
  Heavy chain CDR3 for antibody 4180 (IGHV3-33)
ARDTWDDYFDY

SEQ ID NO: 8361 - protein, 9 aa, Homo sapiens
  Light chain CDR3 for antibody 4181 (IGKV6-21)
HQSSSLPYT

SEQ ID NO: 8362 - protein, 12 aa, Homo sapiens
  Heavy chain CDR3 for antibody 4181 (IGHV3-33)
ARDLVRGIRMDV

SEQ ID NO: 8363 - protein, 10 aa, Homo sapiens
  Light chain CDR3 for antibody 4182 (IGKV1-17)
LQHNSYPMYT

SEQ ID NO: 8364 - protein, 18 aa, Homo sapiens
  Heavy chain CDR3 for antibody 4182 (IGHV1-46)
ARDGDYVWGSYRSDWFDP

SEQ ID NO: 8365 - protein, 8 aa, Homo sapiens
  Light chain CDR3 for antibody 4183 (IGKV3D-7)
QQDYNLLT

SEQ ID NO: 8366 - protein, 13 aa, Homo sapiens
  Heavy chain CDR3 for antibody 4183 (IGHV3-33)
ARDQRYSSGWYDY

SEQ ID NO: 8367 - protein, 9 aa, Homo sapiens
  Light chain CDR3 for antibody 4184 (IGKV2-30)
MQGTHWPLT

SEQ ID NO: 8368 - protein, 15 aa, Homo sapiens
  Heavy chain CDR3 for antibody 4184 (IGHV3-33)
ARDHLTGYYYYGMDV

SEQ ID NO: 8369 - protein, 9 aa, Homo sapiens
  Light chain CDR3 for antibody 4185 (IGKV1-9)
QQLKSYLYT

SEQ ID NO: 8370 - protein, 18 aa, Homo sapiens
  Heavy chain CDR3 for antibody 4185 (IGHV1-18)
ARDRYYYDSGSYYYGMDV

SEQ ID NO: 8371 - protein, 9 aa, Homo sapiens
  Light chain CDR3 for antibody 4186 (IGKV5-2)
LQHDNFPYT

SEQ ID NO: 8372 - protein, 14 aa, Homo sapiens
  Heavy chain CDR3 for antibody 4186 (IGHV3-20)
ARGGSSGWYDWFDP

SEQ ID NO: 8373 - protein, 9 aa, Homo sapiens
  Light chain CDR3 for antibody 4187 (IGKV1-17)
LQHNSYPYT

SEQ ID NO: 8374 - protein, 19 aa, Homo sapiens
  Heavy chain CDR3 for antibody 4187 (IGHV3-33)
ARIPGIAVAGGYYYYGMDV

SEQ ID NO: 8375 - protein, 9 aa, Homo sapiens
  Light chain CDR3 for antibody 4188 (IGKV1D-16)
QQYDSYPWT

SEQ ID NO: 8376 - protein, 13 aa, Homo sapiens
  Heavy chain CDR3 for antibody 4188 (IGHV4-39)
ARREVVGGRGFDY

SEQ ID NO: 8377 - protein, 9 aa, Homo sapiens
  Light chain CDR3 for antibody 4189 (IGKV1-17)
LQHNSYPYT

SEQ ID NO: 8378 - protein, 17 aa, Homo sapiens
  Heavy chain CDR3 for antibody 4189 (IGHV3-33)
ARDPWIYSGYGGGWFDP

SEQ ID NO: 8379 - protein, 9 aa, Homo sapiens
  Light chain CDR3 for antibody 4190 (IGKV1-9)
QQLNSYPRT

SEQ ID NO: 8380 - protein, 11 aa, Homo sapiens
  Heavy chain CDR3 for antibody 4190 (IGHV3-11)
ARDRRYYGMDV

SEQ ID NO: 8381 - protein, 9 aa, Homo sapiens
  Light chain CDR3 for antibody 4191 (IGKV5-2)
LQHDNFPWT

SEQ ID NO: 8382 - protein, 17 aa, Homo sapiens
  Heavy chain CDR3 for antibody 4191 (IGHV3-33)
TRDSGMVRGIIIYGMDV

SEQ ID NO: 8383 - protein, 8 aa, Homo sapiens
  Light chain CDR3 for antibody 4192 (IGKV3-20)
QQYGRSFT

SEQ ID NO: 8384 - protein, 12 aa, Homo sapiens
  Heavy chain CDR3 for antibody 4192 (IGHV1-46)
ARGLTGDHAVDI

SEQ ID NO: 8385 - protein, 6 aa, Homo sapiens
  Light chain CDR3 for antibody 4193 (IGKV3-20)
QQYGST

SEQ ID NO: 8386 - protein, 13 aa, Homo sapiens
  Heavy chain CDR3 for antibody 4193 (IGHV3-11)
ARDGGAAAGTWDS

SEQ ID NO: 8387 - protein, 9 aa, Homo sapiens
  Light chain CDR3 for antibody 4194 (IGKV1-27)
QKYNSAPYT

SEQ ID NO: 8388 - protein, 14 aa, Homo sapiens
  Heavy chain CDR3 for antibody 4194 (IGHV1-2)
ARDYYGSGNYYMGY

SEQ ID NO: 8389 - protein, 8 aa, Homo sapiens
  Light chain CDR3 for antibody 4195 (IGKV1-5)
QQYNSYWT

SEQ ID NO: 8390 - protein, 12 aa, Homo sapiens
  Heavy chain CDR3 for antibody 4195 (IGHV3-23)
AKDGWFGESLDY

SEQ ID NO: 8391 - protein, 9 aa, Homo sapiens
  Light chain CDR3 for antibody 4196 (IGKV1-39)
QQSYSTPLT

SEQ ID NO: 8392 - protein, 14 aa, Homo sapiens
  Heavy chain CDR3 for antibody 4196 (IGHV3-33)
AREEDYYYYYDMDV

SEQ ID NO: 8393 - protein, 9 aa, Homo sapiens
  Light chain CDR3 for antibody 4197 (IGKV1-27)
QKYNSAPYT

SEQ ID NO: 8394 - protein, 12 aa, Homo sapiens
  Heavy chain CDR3 for antibody 4197 (IGHV3-33)
ARAGMGAPYFDY

SEQ ID NO: 8395 - protein, 9 aa, Homo sapiens
  Light chain CDR3 for antibody 4198 (IGKV1-6)
LQDYKSPFT

SEQ ID NO: 8396 - protein, 17 aa, Homo sapiens
  Heavy chain CDR3 for antibody 4198 (IGHV4-59)
ARDFLVRGEGSYYGMDV

SEQ ID NO: 8397 - protein, 9 aa, Homo sapiens
  Light chain CDR3 for antibody 4199 (IGKV3D-20)
QQYGSSPYT

SEQ ID NO: 8398 - protein, 16 aa, Homo sapiens
  Heavy chain CDR3 for antibody 4199 (IGHV3-11)
ARDSELRYFDWFGMDV

SEQ ID NO: 8399 - protein, 9 aa, Homo sapiens
  Light chain CDR3 for antibody 4200 (IGKV1-39)
QQSYSTPYT

SEQ ID NO: 8400 - protein, 11 aa, Homo sapiens
  Heavy chain CDR3 for antibody 4200 (IGHV1-46)
AREEDLGAFDI

SEQ ID NO: 8401 - protein, 8 aa, Homo sapiens
  Light chain CDR3 for antibody 4201 (IGKV1-5)
QQYNSYWT

SEQ ID NO: 8402 - protein, 7 aa, Homo sapiens
  Heavy chain CDR3 for antibody 4201 (IGHV3-33)
ARELVDY

SEQ ID NO: 8403 - protein, 8 aa, Homo sapiens
  Light chain CDR3 for antibody 4202 (IGKV1D-13)
QQFNNYYT

SEQ ID NO: 8404 - protein, 12 aa, Homo sapiens
  Heavy chain CDR3 for antibody 4202 (IGHV1-24)
ASDWAYYYGMDV

SEQ ID NO: 8405 - protein, 8 aa, Homo sapiens
  Light chain CDR3 for antibody 4203 (IGKV3D-7)
QQDYNLLT

SEQ ID NO: 8406 - protein, 17 aa, Homo sapiens
  Heavy chain CDR3 for antibody 4203 (IGHV3-66)
ARVQYDILTGYSPYFDN

SEQ ID NO: 8407 - protein, 9 aa, Homo sapiens
  Light chain CDR3 for antibody 4204 (IGKV5-2)
LQHDKFPYT

SEQ ID NO: 8408 - protein, 14 aa, Homo sapiens
  Heavy chain CDR3 for antibody 4204 (IGHV3-33)
ARDGYDILTGPFDY

SEQ ID NO: 8409 - protein, 10 aa, Homo sapiens
  Light chain CDR3 for antibody 4205 (IGKV1-17)
LQHNSYPMYT

SEQ ID NO: 8410 - protein, 9 aa, Homo sapiens
  Heavy chain CDR3 for antibody 4205 (IGHV1-18)
ARGKDWFDP

SEQ ID NO: 8411 - protein, 9 aa, Homo sapiens
  Light chain CDR3 for antibody 4206 (IGKV6-21)
HQSTSLPFT

SEQ ID NO: 8412 - protein, 21 aa, Homo sapiens
  Heavy chain CDR3 for antibody 4206 (IGHV4-59)
AAGVLLWFGEPNYYYYYGMDV

SEQ ID NO: 8413 - protein, 8 aa, Homo sapiens
  Light chain CDR3 for antibody 4207 (IGKV3D-7)
QQDYNLLT

SEQ ID NO: 8414 - protein, 11 aa, Homo sapiens
  Heavy chain CDR3 for antibody 4207 (IGHV3-33)
ARGSGSYAFDY

SEQ ID NO: 8415 - protein, 9 aa, Homo sapiens
  Light chain CDR3 for antibody 4208 (IGKV5-2)
LQHDNFPWT

SEQ ID NO: 8416 - protein, 15 aa, Homo sapiens
  Heavy chain CDR3 for antibody 4208 (IGHV4-59)
ARDLGYYGSGSPLAY

SEQ ID NO: 8417 - protein, 9 aa, Homo sapiens
  Light chain CDR3 for antibody 4209 (IGKV1-27)
QKYNSAPYT

SEQ ID NO: 8418 - protein, 9 aa, Homo sapiens
  Heavy chain CDR3 for antibody 4209 (IGHV4-59)
AGGSWDFDY

SEQ ID NO: 8419 - protein, 8 aa, Homo sapiens
  Light chain CDR3 for antibody 4210 (IGKV3D-7)
QQDYNLLT

SEQ ID NO: 8420 - protein, 12 aa, Homo sapiens
  Heavy chain CDR3 for antibody 4210 (IGHV3-33)
ARDPGYYYGLDV

SEQ ID NO: 8421 - protein, 9 aa, Homo sapiens
  Light chain CDR3 for antibody 4211 (IGKV1D-13)
QHFNNYMYT

SEQ ID NO: 8422 - protein, 13 aa, Homo sapiens
  Heavy chain CDR3 for antibody 4211 (IGHV4-39)
ARREVVGGRGFDY

SEQ ID NO: 8423 - protein, 9 aa, Homo sapiens
  Light chain CDR3 for antibody 4212 (IGKV5-2)
LQHDNFPWT

SEQ ID NO: 8424 - protein, 17 aa, Homo sapiens
  Heavy chain CDR3 for antibody 4212 (IGHV3-33)
AREGTMVRGYYYYGMDV

SEQ ID NO: 8425 - protein, 9 aa, Homo sapiens
  Light chain CDR3 for antibody 4213 (IGKV3D-7)
QQDYTLPLT

SEQ ID NO: 8426 - protein, 19 aa, Homo sapiens
  Heavy chain CDR3 for antibody 4213 (IGHV4-59)
ARDRVVGATTYYYYYGMDV

SEQ ID NO: 8427 - protein, 9 aa, Homo sapiens
  Light chain CDR3 for antibody 4214 (IGKV3-20)
QQYGSSPLT

SEQ ID NO: 8428 - protein, 18 aa, Homo sapiens
  Heavy chain CDR3 for antibody 4214 (IGHV1-18)
ARDRGYYYGSGSYSPFDY

SEQ ID NO: 8429 - protein, 9 aa, Homo sapiens
  Light chain CDR3 for antibody 4215 (IGKV3-15)
QQYNNWPRT

SEQ ID NO: 8430 - protein, 11 aa, Homo sapiens
  Heavy chain CDR3 for antibody 4215 (IGHV3-33)
AREGAVARFDY

SEQ ID NO: 8431 - protein, 9 aa, Homo sapiens
  Light chain CDR3 for antibody 4216 (IGKV1-27)
QKYNSAPYT

SEQ ID NO: 8432 - protein, 19 aa, Homo sapiens
  Heavy chain CDR3 for antibody 4216 (IGHV3-33)
ARDRYYDILTGYSSYYFDY

SEQ ID NO: 8433 - protein, 9 aa, Homo sapiens
  Light chain CDR3 for antibody 4217 (IGKV1D-13)
QQFNNYPST

SEQ ID NO: 8434 - protein, 20 aa, Homo sapiens
  Heavy chain CDR3 for antibody 4217 (IGHV1-f)
ATHYDILTGSPYYYYCALDV

SEQ ID NO: 8435 - protein, 9 aa, Homo sapiens
  Light chain CDR3 for antibody 4218 (IGKV1-6)
LQDYNYPWT

SEQ ID NO: 8436 - protein, 12 aa, Homo sapiens
  Heavy chain CDR3 for antibody 4218 (IGHV3-64)
ARVNSGSPYFDY

SEQ ID NO: 8437 - protein, 9 aa, Homo sapiens
  Light chain CDR3 for antibody 4219 (IGKV1-17)
LQHNSYPWT

SEQ ID NO: 8438 - protein, 17 aa, Homo sapiens
  Heavy chain CDR3 for antibody 4219 (IGHV4-59)
ARDRELLWFGEFGGMDV

SEQ ID NO: 8439 - protein, 11 aa, Homo sapiens
  Light chain CDR3 for antibody 4220 (IGKV3-11)
QQRSNWPPMYT

SEQ ID NO: 8440 - protein, 13 aa, Homo sapiens
  Heavy chain CDR3 for antibody 4220 (IGHV4-59)
ARDAGYSSSWFDY

SEQ ID NO: 8441 - protein, 9 aa, Homo sapiens
  Light chain CDR3 for antibody 4221 (IGKV1D-13)
QQFNNYPRT

SEQ ID NO: 8442 - protein, 19 aa, Homo sapiens
  Heavy chain CDR3 for antibody 4221 (IGHV1-24)
ATAGLQWFGEKIGYYGMDV

SEQ ID NO: 8443 - protein, 8 aa, Homo sapiens
  Light chain CDR3 for antibody 4222 (IGKV1-5)
QQYNSYWT

SEQ ID NO: 8444 - protein, 13 aa, Homo sapiens
  Heavy chain CDR3 for antibody 4222 (IGHV3-23)
ARAFFMVRGVIDY

SEQ ID NO: 8445 - protein, 9 aa, Homo sapiens
  Light chain CDR3 for antibody 4223 (IGKV2-30)
MQGTHWPLT

SEQ ID NO: 8446 - protein, 12 aa, Homo sapiens
  Heavy chain CDR3 for antibody 4223 (IGHV3-33)
ARDPGYYYGLDV

SEQ ID NO: 8447 - protein, 9 aa, Homo sapiens
  Light chain CDR3 for antibody 4224 (IGKV6-21)
HQSSSLPYT

SEQ ID NO: 8448 - protein, 18 aa, Homo sapiens
  Heavy chain CDR3 for antibody 4224 (IGHV3-33)
ARDQGIVVLPGAPWYFDP

SEQ ID NO: 8449 - protein, 9 aa, Homo sapiens
  Light chain CDR3 for antibody 4225 (IGKV1-9)
QQLNSYPLT

SEQ ID NO: 8450 - protein, 12 aa, Homo sapiens
  Heavy chain CDR3 for antibody 4225 (IGHV4-39)
ARREVILGAFDY

SEQ ID NO: 8451 - protein, 9 aa, Homo sapiens
  Light chain CDR3 for antibody 4226 (IGKV1D-16)
QQYNSYPFT

SEQ ID NO: 8452 - protein, 17 aa, Homo sapiens
  Heavy chain CDR3 for antibody 4226 (IGHV3-23)
AKERNWNDGYYYYGMDV

SEQ ID NO: 8453 - protein, 8 aa, Homo sapiens
  Light chain CDR3 for antibody 4227 (IGKV3D-7)
QQDYNLLT

SEQ ID NO: 8454 - protein, 13 aa, Homo sapiens
  Heavy chain CDR3 for antibody 4227 (IGHV4-39)
ARHPPSRDYGMDV

SEQ ID NO: 8455 - protein, 9 aa, Homo sapiens
  Light chain CDR3 for antibody 4228 (IGKV3-11)
QQRSNWMYT

SEQ ID NO: 8456 - protein, 9 aa, Homo sapiens
  Heavy chain CDR3 for antibody 4228 (IGHV3-30)
ARDNWGFDY

SEQ ID NO: 8457 - protein, 9 aa, Homo sapiens
  Light chain CDR3 for antibody 4229 (IGKV1-16)
QQYNSYPYT

SEQ ID NO: 8458 - protein, 9 aa, Homo sapiens
  Heavy chain CDR3 for antibody 4229 (IGHV4-59)
ARGNTWFDY

SEQ ID NO: 8459 - protein, 11 aa, Homo sapiens
  Light chain CDR3 for antibody 4230 (IGKV3-11)
QQRSNWPPTWT

SEQ ID NO: 8460 - protein, 17 aa, Homo sapiens
  Heavy chain CDR3 for antibody 4230 (IGHV1-18)
ARDRAFTMVRGVPPFDY

SEQ ID NO: 8461 - protein, 9 aa, Homo sapiens
  Light chain CDR3 for antibody 4231 (IGKV2-30)
MQGTHWPLT

SEQ ID NO: 8462 - protein, 11 aa, Homo sapiens
  Heavy chain CDR3 for antibody 4231 (IGHV3-33)
AREGAVARFDY

SEQ ID NO: 8463 - protein, 9 aa, Homo sapiens
  Light chain CDR3 for antibody 4232 (IGKV1-39)
QQSYRTPLT

SEQ ID NO: 8464 - protein, 18 aa, Homo sapiens
  Heavy chain CDR3 for antibody 4232 (IGHV3-33)
ARDRGDILTGYYKGWFDP

SEQ ID NO: 8465 - protein, 9 aa, Homo sapiens
  Light chain CDR3 for antibody 4233 (IGKV5-2)
LQHDNFPWT

SEQ ID NO: 8466 - protein, 18 aa, Homo sapiens
  Heavy chain CDR3 for antibody 4233 (IGHV4-39)
ARGALTYYDILTGYFFDY

SEQ ID NO: 8467 - protein, 9 aa, Homo sapiens
  Light chain CDR3 for antibody 4234 (IGKV3D-7)
QQDYNLPLT

SEQ ID NO: 8468 - protein, 14 aa, Homo sapiens
  Heavy chain CDR3 for antibody 4234 (IGHV3-20)
ARDGGSTSFDWFDP

SEQ ID NO: 8469 - protein, 9 aa, Homo sapiens
  Light chain CDR3 for antibody 4235 (IGKV1D-13)
QQFNNYPHT

SEQ ID NO: 8470 - protein, 14 aa, Homo sapiens
  Heavy chain CDR3 for antibody 4235 (IGHV1-46)
ARRGIVGALDAFDI

SEQ ID NO: 8471 - protein, 9 aa, Homo sapiens
  Light chain CDR3 for antibody 4236 (IGKV1-9)
QQLNSYPLT

SEQ ID NO: 8472 - protein, 13 aa, Homo sapiens
  Heavy chain CDR3 for antibody 4236 (IGHV4-4)
ARERGIAAAGPDY

SEQ ID NO: 8473 - protein, 9 aa, Homo sapiens
  Light chain CDR3 for antibody 4237 (IGKV1-9)
QQYNSYPLT

SEQ ID NO: 8474 - protein, 8 aa, Homo sapiens
  Heavy chain CDR3 for antibody 4237 (IGHV4-4)
ARGARFDP

SEQ ID NO: 8475 - protein, 9 aa, Homo sapiens
  Light chain CDR3 for antibody 4238 (IGKV1-39)
QQSYSTPLT

SEQ ID NO: 8476 - protein, 15 aa, Homo sapiens
  Heavy chain CDR3 for antibody 4238 (IGHV3-33)
ARRSILTGSYWYFDL

SEQ ID NO: 8477 - protein, 9 aa, Homo sapiens
  Light chain CDR3 for antibody 4239 (IGKV3D-7)
QQDYEFPLT

SEQ ID NO: 8478 - protein, 13 aa, Homo sapiens
  Heavy chain CDR3 for antibody 4239 (IGHV4-39)
ARQWPSGYWYFDL

SEQ ID NO: 8479 - protein, 9 aa, Homo sapiens
  Light chain CDR3 for antibody 4240 (IGKV1D-16)
QQYNSFPLT

SEQ ID NO: 8480 - protein, 14 aa, Homo sapiens
  Heavy chain CDR3 for antibody 4240 (IGHV4-39)
ARRGVLVPPGGMDV

SEQ ID NO: 8481 - protein, 9 aa, Homo sapiens
  Light chain CDR3 for antibody 4241 (IGKV3D-20)
QQYGSSPYT

SEQ ID NO: 8482 - protein, 12 aa, Homo sapiens
  Heavy chain CDR3 for antibody 4241 (IGHV3-33)
ARESGGSFGMDV

SEQ ID NO: 8483 - protein, 9 aa, Homo sapiens
  Light chain CDR3 for antibody 4242 (IGKV1-5)
QQYNTYSRT

SEQ ID NO: 8484 - protein, 16 aa, Homo sapiens
  Heavy chain CDR3 for antibody 4242 (IGHV3-23)
AKEGMVLRYFDWLWDY

SEQ ID NO: 8485 - protein, 9 aa, Homo sapiens
  Light chain CDR3 for antibody 4243 (IGKV2-30)
MQGTHWPLT

SEQ ID NO: 8486 - protein, 16 aa, Homo sapiens
  Heavy chain CDR3 for antibody 4243 (IGHV4-59)
ARYSGSYYGDYYGMDV

SEQ ID NO: 8487 - protein, 9 aa, Homo sapiens
  Light chain CDR3 for antibody 4244 (IGKV1-27)
QKYNSAPYT

SEQ ID NO: 8488 - protein, 13 aa, Homo sapiens
  Heavy chain CDR3 for antibody 4244 (IGHV4-39)
ARHPPSRDYGMDV

SEQ ID NO: 8489 - protein, 9 aa, Homo sapiens
  Light chain CDR3 for antibody 4245 (IGKV1-16)
QQYNSYPLT

SEQ ID NO: 8490 - protein, 14 aa, Homo sapiens
  Heavy chain CDR3 for antibody 4245 (IGHV3-33)
ARDDILTGYSYFQH

SEQ ID NO: 8491 - protein, 9 aa, Homo sapiens
  Light chain CDR3 for antibody 4246 (IGKV1D-16)
QQYNSYPYT

SEQ ID NO: 8492 - protein, 18 aa, Homo sapiens
  Heavy chain CDR3 for antibody 4246 (IGHV3-33)
ARRGVGARGYYYYYGMDV

SEQ ID NO: 8493 - protein, 9 aa, Homo sapiens
  Light chain CDR3 for antibody 4247 (IGKV1D-16)
QQYNSYPYT

SEQ ID NO: 8494 - protein, 18 aa, Homo sapiens
  Heavy chain CDR3 for antibody 4247 (IGHV3-33)
ARDPYSSGWYDYYFGMDV

SEQ ID NO: 8495 - protein, 8 aa, Homo sapiens
  Light chain CDR3 for antibody 4248 (IGKV1-5)
QQYNSYWT

SEQ ID NO: 8496 - protein, 15 aa, Homo sapiens
  Heavy chain CDR3 for antibody 4248 (IGHV3-33)
ARDSRPEIIGPPFDY

SEQ ID NO: 8497 - protein, 9 aa, Homo sapiens
  Light chain CDR3 for antibody 4249 (IGKV1-6)
LQDYNYPYT

SEQ ID NO: 8498 - protein, 13 aa, Homo sapiens
  Heavy chain CDR3 for antibody 4249 (IGHV3-21)
ATGAWASSWWGDY

SEQ ID NO: 8499 - protein, 9 aa, Homo sapiens
  Light chain CDR3 for antibody 4250 (IGKV1-39)
QQSYRTPLT

SEQ ID NO: 8500 - protein, 19 aa, Homo sapiens
  Heavy chain CDR3 for antibody 4250 (IGHV1-24)
ATAGLQWFGEKIGYYGMDV

SEQ ID NO: 8501 - protein, 9 aa, Homo sapiens
  Light chain CDR3 for antibody 4251 (IGKV1-17)
LQHNSYPYT

SEQ ID NO: 8502 - protein, 11 aa, Homo sapiens
  Heavy chain CDR3 for antibody 4251 (IGHV3-33)
ARDILTGYFDY

SEQ ID NO: 8503 - protein, 9 aa, Homo sapiens
  Light chain CDR3 for antibody 4252 (IGKV1D-13)
QQFNNYPHT

SEQ ID NO: 8504 - protein, 13 aa, Homo sapiens
  Heavy chain CDR3 for antibody 4252 (IGHV4-39)
APFRVMVRGVLDY

SEQ ID NO: 8505 - protein, 9 aa, Homo sapiens
  Light chain CDR3 for antibody 4253 (IGKV1-6)
LQDYNYPYT

SEQ ID NO: 8506 - protein, 16 aa, Homo sapiens
  Heavy chain CDR3 for antibody 4253 (IGHV4-59)
ARQLLWFGELKGVFDY

SEQ ID NO: 8507 - protein, 11 aa, Homo sapiens
  Light chain CDR3 for antibody 4254 (IGKV3-11)
QQRSNWPPTWT

SEQ ID NO: 8508 - protein, 13 aa, Homo sapiens
  Heavy chain CDR3 for antibody 4254 (IGHV4-61)
ASRYSSGWYPFDY

SEQ ID NO: 8509 - protein, 9 aa, Homo sapiens
  Light chain CDR3 for antibody 4255 (IGKV1D-13)
QHFNNYMYT

SEQ ID NO: 8510 - protein, 13 aa, Homo sapiens
  Heavy chain CDR3 for antibody 4255 (IGHV4-39)
ARQWPSGYWYFDL

SEQ ID NO: 8511 - protein, 9 aa, Homo sapiens
  Light chain CDR3 for antibody 4256 (IGKV3-20)
QQYGSSPYT

SEQ ID NO: 8512 - protein, 14 aa, Homo sapiens
  Heavy chain CDR3 for antibody 4256 (IGHV3-33)
AREEDYYYHYDMDV

SEQ ID NO: 8513 - protein, 9 aa, Homo sapiens
  Light chain CDR3 for antibody 4257 (IGKV1-9)
QQLNSYPLT

SEQ ID NO: 8514 - protein, 13 aa, Homo sapiens
  Heavy chain CDR3 for antibody 4257 (IGHV3-33)
ARTDYYYYYGMDV

SEQ ID NO: 8515 - protein, 9 aa, Homo sapiens
  Light chain CDR3 for antibody 4258 (IGKV2-30)
MQGTHWPLT

SEQ ID NO: 8516 - protein, 10 aa, Homo sapiens
  Heavy chain CDR3 for antibody 4258 (IGHV3-33)
ARDVVVYFDY

SEQ ID NO: 8517 - protein, 9 aa, Homo sapiens
  Light chain CDR3 for antibody 4259 (IGKV2-30)
MQGTHWPLT

SEQ ID NO: 8518 - protein, 19 aa, Homo sapiens
  Heavy chain CDR3 for antibody 4259 (IGHV3-33)
ARGVRLRYFDPYYYYGMDV

SEQ ID NO: 8519 - protein, 9 aa, Homo sapiens
  Light chain CDR3 for antibody 4260 (IGKV5-2)
LQHDNFPYT

SEQ ID NO: 8520 - protein, 17 aa, Homo sapiens
  Heavy chain CDR3 for antibody 4260 (IGHV3-33)
ARKDYGILSGYYSPFDY

SEQ ID NO: 8521 - protein, 9 aa, Homo sapiens
  Light chain CDR3 for antibody 4261 (IGKV1-16)
QHYNDYPFT

SEQ ID NO: 8522 - protein, 13 aa, Homo sapiens
  Heavy chain CDR3 for antibody 4261 (IGHV3-11)
ARDGGAAAGTWDS

SEQ ID NO: 8523 - protein, 9 aa, Homo sapiens
  Light chain CDR3 for antibody 4262 (IGKV1-9)
QQLNSYPYT

SEQ ID NO: 8524 - protein, 4 aa, Homo sapiens
  Heavy chain CDR3 for antibody 4262 (IGHV1-2)
ARDY

SEQ ID NO: 8525 - protein, 10 aa, Homo sapiens
  Light chain CDR3 for antibody 4263 (IGKV1-39)
QQSYSTPMYT

SEQ ID NO: 8526 - protein, 11 aa, Homo sapiens
  Heavy chain CDR3 for antibody 4263 (IGHV3-33)
ARDTWDDYFDY

SEQ ID NO: 8527 - protein, 9 aa, Homo sapiens
  Light chain CDR3 for antibody 4264 (IGKV1-39)
QQSYSTPLT

SEQ ID NO: 8528 - protein, 15 aa, Homo sapiens
  Heavy chain CDR3 for antibody 4264 (IGHV3-20)
AREGPYYYGSGSLDY

SEQ ID NO: 8529 - protein, 9 aa, Homo sapiens
  Light chain CDR3 for antibody 4265 (IGKV1-16)
QQYNSYPLT

SEQ ID NO: 8530 - protein, 17 aa, Homo sapiens
  Heavy chain CDR3 for antibody 4265 (IGHV3-30)
ARDGVGATSYYYYGMDV

SEQ ID NO: 8531 - protein, 9 aa, Homo sapiens
  Light chain CDR3 for antibody 4266 (IGKV5-2)
LQHDNFPWT

SEQ ID NO: 8532 - protein, 15 aa, Homo sapiens
  Heavy chain CDR3 for antibody 4266 (IGHV3-33)
ARGYYYGSGSFPFDY

SEQ ID NO: 8533 - protein, 9 aa, Homo sapiens
  Light chain CDR3 for antibody 4267 (IGKV6-21)
HQSSSLPYT

SEQ ID NO: 8534 - protein, 16 aa, Homo sapiens
  Heavy chain CDR3 for antibody 4267 (IGHV1-8)
AREGTMVRGVTYALDI

SEQ ID NO: 8535 - protein, 9 aa, Homo sapiens
  Light chain CDR3 for antibody 4268 (IGKV1-9)
QQYNSYPLT

SEQ ID NO: 8536 - protein, 10 aa, Homo sapiens
  Heavy chain CDR3 for antibody 4268 (IGHV4-59)
VSSGTSLLAY

SEQ ID NO: 8537 - protein, 9 aa, Homo sapiens
  Light chain CDR3 for antibody 4269 (IGKV5-2)
LQHDNFPYT

SEQ ID NO: 8538 - protein, 16 aa, Homo sapiens
  Heavy chain CDR3 for antibody 4269 (IGHV3-33)
AREMAGSYYYYYGMDV

SEQ ID NO: 8539 - protein, 10 aa, Homo sapiens
  Light chain CDR3 for antibody 4270 (IGKV3-11)
QQRSNWPIFT

SEQ ID NO: 8540 - protein, 15 aa, Homo sapiens
  Heavy chain CDR3 for antibody 4270 (IGHV3-33)
ARRICSGGSCSLFDY

SEQ ID NO: 8541 - protein, 9 aa, Homo sapiens
  Light chain CDR3 for antibody 4271 (IGKV1-33)
QQYDNLPFT

SEQ ID NO: 8542 - protein, 18 aa, Homo sapiens
  Heavy chain CDR3 for antibody 4271 (IGHV4-59)
AREGDYVWGSYRPNWFDP

SEQ ID NO: 8543 - protein, 10 aa, Homo sapiens
  Light chain CDR3 for antibody 4272 (IGKV1-17)
LQHNSYPMYT

SEQ ID NO: 8544 - protein, 10 aa, Homo sapiens
  Heavy chain CDR3 for antibody 4272 (IGHV3-23)
AKEQWLVLDY

SEQ ID NO: 8545 - protein, 10 aa, Homo sapiens
  Light chain CDR3 for antibody 4273 (IGKV3-11)
QQRSNWPIFT

SEQ ID NO: 8546 - protein, 13 aa, Homo sapiens
  Heavy chain CDR3 for antibody 4273 (IGHV3-33)
ARRATLVRGVFDP

SEQ ID NO: 8547 - protein, 9 aa, Homo sapiens
  Light chain CDR3 for antibody 4274 (IGKV1D-16)
QQYNSYPYT

SEQ ID NO: 8548 - protein, 16 aa, Homo sapiens
  Heavy chain CDR3 for antibody 4274 (IGHV3-33)
ARAFTMVRGVDYGMDV

SEQ ID NO: 8549 - protein, 8 aa, Homo sapiens
  Light chain CDR3 for antibody 4275 (IGKV6-21)
HQSSSLPT

SEQ ID NO: 8550 - protein, 13 aa, Homo sapiens
  Heavy chain CDR3 for antibody 4275 (IGHV4-34)
ASNFYYYYYGMDV

SEQ ID NO: 8551 - protein, 9 aa, Homo sapiens
  Light chain CDR3 for antibody 4276 (IGKV1-9)
QQYNTYSRT

SEQ ID NO: 8552 - protein, 18 aa, Homo sapiens
  Heavy chain CDR3 for antibody 4276 (IGHV4-59)
AREGHYYTSGSYYKAFDY

SEQ ID NO: 8553 - protein, 9 aa, Homo sapiens
  Light chain CDR3 for antibody 4277 (IGKV2D-28)
MQALQTPPT

SEQ ID NO: 8554 - protein, 13 aa, Homo sapiens
  Heavy chain CDR3 for antibody 4277 (IGHV3-23)
ASPFNWNDGFFDY

SEQ ID NO: 8555 - protein, 10 aa, Homo sapiens
  Light chain CDR3 for antibody 4278 (IGKV3-11)
QQRSNWPIFT

SEQ ID NO: 8556 - protein, 17 aa, Homo sapiens
  Heavy chain CDR3 for antibody 4278 (IGHV3-33)
VREGGLLWVGELSLFDY

SEQ ID NO: 8557 - protein, 8 aa, Homo sapiens
  Light chain CDR3 for antibody 4279 (IGKV2D-28)
MQALQTPT

SEQ ID NO: 8558 - protein, 16 aa, Homo sapiens
  Heavy chain CDR3 for antibody 4279 (IGHV3-23)
AKEGMVLRYFDWLWDY

SEQ ID NO: 8559 - protein, 9 aa, Homo sapiens
  Light chain CDR3 for antibody 4280 (IGKV6-21)
HQSSSLPYT

SEQ ID NO: 8560 - protein, 12 aa, Homo sapiens
  Heavy chain CDR3 for antibody 4280 (IGHV3-33)
ARESGGSFGMDV

SEQ ID NO: 8561 - protein, 9 aa, Homo sapiens
  Light chain CDR3 for antibody 4281 (IGKV1-39)
QQSYSTPFT

SEQ ID NO: 8562 - protein, 15 aa, Homo sapiens
  Heavy chain CDR3 for antibody 4281 (IGHV3-33)
ARRICSGGSCSLFDY

SEQ ID NO: 8563 - protein, 9 aa, Homo sapiens
  Light chain CDR3 for antibody 4282 (IGKV1D-13)
QQFNNYPYT

SEQ ID NO: 8564 - protein, 17 aa, Homo sapiens
  Heavy chain CDR3 for antibody 4282 (IGHV3-33)
AREDYDILTGYPFYFDY

SEQ ID NO: 8565 - protein, 9 aa, Homo sapiens
  Light chain CDR3 for antibody 4283 (IGKV3-11)
QQRSNWPLT

SEQ ID NO: 8566 - protein, 15 aa, Homo sapiens
  Heavy chain CDR3 for antibody 4283 (IGHV3-33)
VCVLYDYGDYVGFDY

SEQ ID NO: 8567 - protein, 9 aa, Homo sapiens
  Light chain CDR3 for antibody 4284 (IGKV1D-16)
QQYNSYPYT

SEQ ID NO: 8568 - protein, 14 aa, Homo sapiens
  Heavy chain CDR3 for antibody 4284 (IGHV1-2)
AREGGSGSSPGMDV

SEQ ID NO: 8569 - protein, 9 aa, Homo sapiens
  Light chain CDR3 for antibody 4285 (IGKV3D-7)
QQDYNLPYT

SEQ ID NO: 8570 - protein, 13 aa, Homo sapiens
  Heavy chain CDR3 for antibody 4285 (IGHV4-39)
ARHVLLWFGEFDP

SEQ ID NO: 8571 - protein, 9 aa, Homo sapiens
  Light chain CDR3 for antibody 4286 (IGKV1-17)
LQHNGYPLT

SEQ ID NO: 8572 - protein, 15 aa, Homo sapiens
  Heavy chain CDR3 for antibody 4286 (IGHV3-33)
ARRVCSGGSCSLFDY

SEQ ID NO: 8573 - protein, 9 aa, Homo sapiens
  Light chain CDR3 for antibody 4287 (IGKV1D-13)
QQFNNYPST

SEQ ID NO: 8574 - protein, 13 aa, Homo sapiens
  Heavy chain CDR3 for antibody 4287 (IGHV3-33)
ANTGDSYYYDMDV

SEQ ID NO: 8575 - protein, 9 aa, Homo sapiens
  Light chain CDR3 for antibody 4288 (IGKV1-9)
QQLNSYPLT

SEQ ID NO: 8576 - protein, 15 aa, Homo sapiens
  Heavy chain CDR3 for antibody 4288 (IGHV4-59)
ARDLGYYGSGSPLAY

SEQ ID NO: 8577 - protein, 9 aa, Homo sapiens
  Light chain CDR3 for antibody 4289 (IGKV1-39)
QQSYSTPLT

SEQ ID NO: 8578 - protein, 18 aa, Homo sapiens
  Heavy chain CDR3 for antibody 4289 (IGHV3-30)
ARDRHHDILTGYSDAFEI

SEQ ID NO: 8579 - protein, 9 aa, Homo sapiens
  Light chain CDR3 for antibody 4290 (IGKV2-30)
MQGTHWPLT

SEQ ID NO: 8580 - protein, 18 aa, Homo sapiens
  Heavy chain CDR3 for antibody 4290 (IGHV3-33)
ARGLLWFGVSYYYYGMDV

SEQ ID NO: 8581 - protein, 9 aa, Homo sapiens
  Light chain CDR3 for antibody 4291 (IGKV2D-28)
MQALQTPFT

SEQ ID NO: 8582 - protein, 13 aa, Homo sapiens
  Heavy chain CDR3 for antibody 4291 (IGHV4-39)
ARQWPSGYWYFDL

SEQ ID NO: 8583 - protein, 9 aa, Homo sapiens
  Light chain CDR3 for antibody 4292 (IGKV6-21)
HQSSSLPYT

SEQ ID NO: 8584 - protein, 19 aa, Homo sapiens
  Heavy chain CDR3 for antibody 4292 (IGHV3-33)
ARRRDDILTGWDYYFGMDV

SEQ ID NO: 8585 - protein, 8 aa, Homo sapiens
  Light chain CDR3 for antibody 4293 (IGKV1-5)
QQYNSYWT

SEQ ID NO: 8586 - protein, 18 aa, Homo sapiens
  Heavy chain CDR3 for antibody 4293 (IGHV3-33)
ARGLLWFGVSYYYYGMDV

SEQ ID NO: 8587 - protein, 9 aa, Homo sapiens
  Light chain CDR3 for antibody 4294 (IGKV1-6)
LQDYNYPWT

SEQ ID NO: 8588 - protein, 12 aa, Homo sapiens
  Heavy chain CDR3 for antibody 4294 (IGHV3-33)
ASGYFGSGSAHY

SEQ ID NO: 8589 - protein, 9 aa, Homo sapiens
  Light chain CDR3 for antibody 4295 (IGKV1-6)
LQDYNYPWT

SEQ ID NO: 8590 - protein, 11 aa, Homo sapiens
  Heavy chain CDR3 for antibody 4295 (IGHV1-18)
SRGGFSVGYDS

SEQ ID NO: 8591 - protein, 8 aa, Homo sapiens
  Light chain CDR3 for antibody 4296 (IGKV3D-7)
QQDYNLLT

SEQ ID NO: 8592 - protein, 11 aa, Homo sapiens
  Heavy chain CDR3 for antibody 4296 (IGHV3-33)
ARDRVLTPFDY

SEQ ID NO: 8593 - protein, 9 aa, Homo sapiens
  Light chain CDR3 for antibody 4297 (IGKV5-2)
LQHDNFPWT

SEQ ID NO: 8594 - protein, 6 aa, Homo sapiens
  Heavy chain CDR3 for antibody 4297 (IGHV1-8)
AREGTY

SEQ ID NO: 8595 - protein, 8 aa, Homo sapiens
  Light chain CDR3 for antibody 4298 (IGKV6-21)
HQSSSLPT

SEQ ID NO: 8596 - protein, 18 aa, Homo sapiens
  Heavy chain CDR3 for antibody 4298 (IGHV4-59)
AREGDYVWGSYRPNWFDP

SEQ ID NO: 8597 - protein, 9 aa, Homo sapiens
  Light chain CDR3 for antibody 4299 (IGKV1-39)
QQSYSTPLT

SEQ ID NO: 8598 - protein, 14 aa, Homo sapiens
  Heavy chain CDR3 for antibody 4299 (IGHV3-33)
ARKGYSGRYYYFDY

SEQ ID NO: 8599 - protein, 9 aa, Homo sapiens
  Light chain CDR3 for antibody 4300 (IGKV1-9)
QQLNSYPLT

SEQ ID NO: 8600 - protein, 14 aa, Homo sapiens
  Heavy chain CDR3 for antibody 4300 (IGHV4-39)
ARQGDILTGYSFDN

SEQ ID NO: 8601 - protein, 8 aa, Homo sapiens
  Light chain CDR3 for antibody 4301 (IGKV1D-13)
QQFNNYPT

SEQ ID NO: 8602 - protein, 18 aa, Homo sapiens
  Heavy chain CDR3 for antibody 4301 (IGHV3-23)
AKDRITGTTYGYYSGLDV

SEQ ID NO: 8603 - protein, 9 aa, Homo sapiens
  Light chain CDR3 for antibody 4302 (IGKV3-15)
QQYNNWPLT

SEQ ID NO: 8604 - protein, 15 aa, Homo sapiens
  Heavy chain CDR3 for antibody 4302 (IGHV3-23)
AKEALRYFDWSGMDV

SEQ ID NO: 8605 - protein, 10 aa, Homo sapiens
  Light chain CDR3 for antibody 4303 (IGKV3-11)
QQRSNWPIFT

SEQ ID NO: 8606 - protein, 21 aa, Homo sapiens
  Heavy chain CDR3 for antibody 4303 (IGHV3-23)
AKDIDYYGSGSYPLYYYGMDV

SEQ ID NO: 8607 - protein, 9 aa, Homo sapiens
  Light chain CDR3 for antibody 4304 (IGKV3D-20)
QQYGSSPWT

SEQ ID NO: 8608 - protein, 13 aa, Homo sapiens
  Heavy chain CDR3 for antibody 4304 (IGHV3-33)
ARGVLWFGELFDY

SEQ ID NO: 8609 - protein, 9 aa, Homo sapiens
  Light chain CDR3 for antibody 4305 (IGKV3D-7)
QQDYNLPFT

SEQ ID NO: 8610 - protein, 19 aa, Homo sapiens
  Heavy chain CDR3 for antibody 4305 (IGHV3-33)
ARGVRLRYFDPYYYYGMDV

SEQ ID NO: 8611 - protein, 10 aa, Homo sapiens
  Light chain CDR3 for antibody 4306 (IGKV1-17)
LQHNSYPMYT

SEQ ID NO: 8612 - protein, 13 aa, Homo sapiens
  Heavy chain CDR3 for antibody 4306 (IGHV3-33)
VSTGDSYYYVMDV

SEQ ID NO: 8613 - protein, 8 aa, Homo sapiens
  Light chain CDR3 for antibody 4307 (IGKV3D-7)
QQDYNLLT

SEQ ID NO: 8614 - protein, 14 aa, Homo sapiens
  Heavy chain CDR3 for antibody 4307 (IGHV3-33)
ARQYSYGYPYYFDY

SEQ ID NO: 8615 - protein, 9 aa, Homo sapiens
  Light chain CDR3 for antibody 4308 (IGKV3-11)
QQRSNWPPT

SEQ ID NO: 8616 - protein, 18 aa, Homo sapiens
  Heavy chain CDR3 for antibody 4308 (IGHV3-33)
ARDRDRYGSGTYPDAIDI

SEQ ID NO: 8617 - protein, 9 aa, Homo sapiens
  Light chain CDR3 for antibody 4309 (IGKV3-15)
QQYNNWPRT

SEQ ID NO: 8618 - protein, 21 aa, Homo sapiens
  Heavy chain CDR3 for antibody 4309 (IGHV3-33)
ARKRLYDILTGYYKAYYGMDV

SEQ ID NO: 8619 - protein, 10 aa, Homo sapiens
  Light chain CDR3 for antibody 4310 (IGKV3-11)
QQRSNWPMYT

SEQ ID NO: 8620 - protein, 11 aa, Homo sapiens
  Heavy chain CDR3 for antibody 4310 (IGHV3-33)
ARARYTTGLDY

SEQ ID NO: 8621 - protein, 9 aa, Homo sapiens
  Light chain CDR3 for antibody 4311 (IGKV1-9)
QQLNSYPLT

SEQ ID NO: 8622 - protein, 18 aa, Homo sapiens
  Heavy chain CDR3 for antibody 4311 (IGHV1-46)
ARDLTGRTENYYFYGMDV

SEQ ID NO: 8623 - protein, 9 aa, Homo sapiens
  Light chain CDR3 for antibody 4312 (IGKV3-11)
QQRSNWPPT

SEQ ID NO: 8624 - protein, 14 aa, Homo sapiens
  Heavy chain CDR3 for antibody 4312 (IGHV3-33)
ARDNILTVYYLFDY

SEQ ID NO: 8625 - protein, 9 aa, Homo sapiens
  Light chain CDR3 for antibody 4313 (IGKV5-2)
LQHDNFPWT

SEQ ID NO: 8626 - protein, 10 aa, Homo sapiens
  Heavy chain CDR3 for antibody 4313 (IGHV3-30)
ARGSWYGFDY

SEQ ID NO: 8627 - protein, 9 aa, Homo sapiens
  Light chain CDR3 for antibody 4314 (IGKV5-2)
LQHDNFPWT

SEQ ID NO: 8628 - protein, 9 aa, Homo sapiens
  Heavy chain CDR3 for antibody 4314 (IGHV1-18)
ARGGWGFEY

SEQ ID NO: 8629 - protein, 9 aa, Homo sapiens
  Light chain CDR3 for antibody 4315 (IGKV3D-7)
QQDYNLPLT

SEQ ID NO: 8630 - protein, 20 aa, Homo sapiens
  Heavy chain CDR3 for antibody 4315 (IGHV3-33)
SRGGATLVRGVIDYYYGMDV

SEQ ID NO: 8631 - protein, 8 aa, Homo sapiens
  Light chain CDR3 for antibody 4316 (IGKV1-5)
QQYNSYWT

SEQ ID NO: 8632 - protein, 11 aa, Homo sapiens
  Heavy chain CDR3 for antibody 4316 (IGHV3-33)
AREAANWGFDY

SEQ ID NO: 8633 - protein, 9 aa, Homo sapiens
  Light chain CDR3 for antibody 4317 (IGKV3-20)
QQYGSSPLT

SEQ ID NO: 8634 - protein, 9 aa, Homo sapiens
  Heavy chain CDR3 for antibody 4317 (IGHV3-30)
VRDNWGFDY

SEQ ID NO: 8635 - protein, 10 aa, Homo sapiens
  Light chain CDR3 for antibody 4318 (IGKV3-11)
QQRSNWPIFT

SEQ ID NO: 8636 - protein, 14 aa, Homo sapiens
  Heavy chain CDR3 for antibody 4318 (IGHV3-33)
ARDRIAAASSDFDC

SEQ ID NO: 8637 - protein, 9 aa, Homo sapiens
  Light chain CDR3 for antibody 4319 (IGKV1-27)
QKYNSAPYT

SEQ ID NO: 8638 - protein, 19 aa, Homo sapiens
  Heavy chain CDR3 for antibody 4319 (IGHV3-33)
TRDPHYDILTGYAYYGMDV

SEQ ID NO: 8639 - protein, 9 aa, Homo sapiens
  Light chain CDR3 for antibody 4320 (IGKV1-39)
QQGFSTPWT

SEQ ID NO: 8640 - protein, 16 aa, Homo sapiens
  Heavy chain CDR3 for antibody 4320 (IGHV4-59)
ARGRYFEWLLGDVFDI

SEQ ID NO: 8641 - protein, 9 aa, Homo sapiens
  Light chain CDR3 for antibody 4321 (IGKV3-20)
QQYGSSPYT

SEQ ID NO: 8642 - protein, 16 aa, Homo sapiens
  Heavy chain CDR3 for antibody 4321 (IGHV1-8)
ARGHYYGSGSYYNFDY

SEQ ID NO: 8643 - protein, 9 aa, Homo sapiens
  Light chain CDR3 for antibody 4322 (IGKV1D-13)
QQFNNYPHT

SEQ ID NO: 8644 - protein, 13 aa, Homo sapiens
  Heavy chain CDR3 for antibody 4322 (IGHV3-30)
AAPFMVRGDGMDV

SEQ ID NO: 8645 - protein, 9 aa, Homo sapiens
  Light chain CDR3 for antibody 4323 (IGKV5-2)
LQHDNFPWT

SEQ ID NO: 8646 - protein, 13 aa, Homo sapiens
  Heavy chain CDR3 for antibody 4323 (IGHV3-11)
AREGIAVAGDFDH

SEQ ID NO: 8647 - protein, 9 aa, Homo sapiens
  Light chain CDR3 for antibody 4324 (IGKV3-20)
QQYGSSPYT

SEQ ID NO: 8648 - protein, 13 aa, Homo sapiens
  Heavy chain CDR3 for antibody 4324 (IGHV3-33)
ARALYSSSWPGDY

SEQ ID NO: 8649 - protein, 9 aa, Homo sapiens
  Light chain CDR3 for antibody 4325 (IGKV5-2)
LQHDNFPYT

SEQ ID NO: 8650 - protein, 14 aa, Homo sapiens
  Heavy chain CDR3 for antibody 4325 (IGHV3-33)
ARWELPFYYSGMDV

SEQ ID NO: 8651 - protein, 9 aa, Homo sapiens
  Light chain CDR3 for antibody 4326 (IGKV3-11)
QQRSNWPLT

SEQ ID NO: 8652 - protein, 12 aa, Homo sapiens
  Heavy chain CDR3 for antibody 4326 (IGHV3-33)
ARKGYDMHAFDI

SEQ ID NO: 8653 - protein, 9 aa, Homo sapiens
  Light chain CDR3 for antibody 4327 (IGKV1-6)
LQDYKSPFT

SEQ ID NO: 8654 - protein, 8 aa, Homo sapiens
  Heavy chain CDR3 for antibody 4327 (IGHV3-23)
AKETGNNY

SEQ ID NO: 8655 - protein, 9 aa, Homo sapiens
  Light chain CDR3 for antibody 4328 (IGKV1-17)
LQHNSYPRT

SEQ ID NO: 8656 - protein, 13 aa, Homo sapiens
  Heavy chain CDR3 for antibody 4328 (IGHV3-11)
ARDEGYSGYNLDN

SEQ ID NO: 8657 - protein, 8 aa, Homo sapiens
  Light chain CDR3 for antibody 4329 (IGKV1D-13)
QQFNNYPT

SEQ ID NO: 8658 - protein, 15 aa, Homo sapiens
  Heavy chain CDR3 for antibody 4329 (IGHV3-33)
ARDRGWKAPGYGMDV

SEQ ID NO: 8659 - protein, 9 aa, Homo sapiens
  Light chain CDR3 for antibody 4330 (IGKV3-15)
QQYNNWPLT

SEQ ID NO: 8660 - protein, 9 aa, Homo sapiens
  Heavy chain CDR3 for antibody 4330 (IGHV3-33)
AREYKEFDY

SEQ ID NO: 8661 - protein, 9 aa, Homo sapiens
  Light chain CDR3 for antibody 4331 (IGKV1-6)
LQDYNYPYT

SEQ ID NO: 8662 - protein, 19 aa, Homo sapiens
  Heavy chain CDR3 for antibody 4331 (IGHV3-33)
ARGRGSYYYGPGSHNGMDV

SEQ ID NO: 8663 - protein, 9 aa, Homo sapiens
  Light chain CDR3 for antibody 4332 (IGKV1-6)
LQDYNYPWT

SEQ ID NO: 8664 - protein, 18 aa, Homo sapiens
  Heavy chain CDR3 for antibody 4332 (IGHV1-46)
ARDGDYVWGSYRSNWFDP

SEQ ID NO: 8665 - protein, 9 aa, Homo sapiens
  Light chain CDR3 for antibody 4333 (IGKV1D-13)
QQFNNYPHT

SEQ ID NO: 8666 - protein, 11 aa, Homo sapiens
  Heavy chain CDR3 for antibody 4333 (IGHV3-33)
ARGSGSYAFDS

SEQ ID NO: 8667 - protein, 9 aa, Homo sapiens
  Light chain CDR3 for antibody 4334 (IGKV3-11)
QQRSNWPPT

SEQ ID NO: 8668 - protein, 21 aa, Homo sapiens
  Heavy chain CDR3 for antibody 4334 (IGHV3-33)
ARKRLYDILTGYYKAYYGMDV

SEQ ID NO: 8669 - protein, 10 aa, Homo sapiens
  Light chain CDR3 for antibody 4335 (IGKV3-11)
QQRSNWPIFT

SEQ ID NO: 8670 - protein, 11 aa, Homo sapiens
  Heavy chain CDR3 for antibody 4335 (IGHV3-33)
AREGAVARFDY

SEQ ID NO: 8671 - protein, 9 aa, Homo sapiens
  Light chain CDR3 for antibody 4336 (IGKV5-2)
LQHDNFPYT

SEQ ID NO: 8672 - protein, 17 aa, Homo sapiens
  Heavy chain CDR3 for antibody 4336 (IGHV3-23)
AKDRDWKDGYYYFGMDV

SEQ ID NO: 8673 - protein, 9 aa, Homo sapiens
  Light chain CDR3 for antibody 4337 (IGKV1D-13)
QQFNNYPHT

SEQ ID NO: 8674 - protein, 20 aa, Homo sapiens
  Heavy chain CDR3 for antibody 4337 (IGHV1-18)
AREVGIAVAGTLYYYYGMDV

SEQ ID NO: 8675 - protein, 8 aa, Homo sapiens
  Light chain CDR3 for antibody 4338 (IGKV3D-7)
QQDYNLLT

SEQ ID NO: 8676 - protein, 18 aa, Homo sapiens
  Heavy chain CDR3 for antibody 4338 (IGHV3-33)
ARGLLWFGVSYYYYGMDV

SEQ ID NO: 8677 - protein, 9 aa, Homo sapiens
  Light chain CDR3 for antibody 4339 (IGKV6-21)
HQSSSLPYT

SEQ ID NO: 8678 - protein, 16 aa, Homo sapiens
  Heavy chain CDR3 for antibody 4339 (IGHV3-33)
AREGGLIAAAGTGFDY

SEQ ID NO: 8679 - protein, 9 aa, Homo sapiens
  Light chain CDR3 for antibody 4340 (IGKV1D-16)
QQYNSYPYT

SEQ ID NO: 8680 - protein, 14 aa, Homo sapiens
  Heavy chain CDR3 for antibody 4340 (IGHV3-20)
ARDGGSSSFDWFDP

SEQ ID NO: 8681 - protein, 9 aa, Homo sapiens
  Light chain CDR3 for antibody 4341 (IGKV3D-20)
QQYGSSPYT

SEQ ID NO: 8682 - protein, 13 aa, Homo sapiens
  Heavy chain CDR3 for antibody 4341 (IGHV3-21)
ATGAWASSWWGDY

SEQ ID NO: 8683 - protein, 9 aa, Homo sapiens
  Light chain CDR3 for antibody 4342 (IGKV1-6)
LQDYNYPYT

SEQ ID NO: 8684 - protein, 15 aa, Homo sapiens
  Heavy chain CDR3 for antibody 4342 (IGHV1-18)
ARLRWFGELSGWFDP

SEQ ID NO: 8685 - protein, 8 aa, Homo sapiens
  Light chain CDR3 for antibody 4343 (IGKV3D-7)
QQDYNLLT

SEQ ID NO: 8686 - protein, 14 aa, Homo sapiens
  Heavy chain CDR3 for antibody 4343 (IGHV3-33)
ARDNILTAYYLFDY

SEQ ID NO: 8687 - protein, 10 aa, Homo sapiens
  Light chain CDR3 for antibody 4344 (IGKV1-39)
QQSYSTPMYT

SEQ ID NO: 8688 - protein, 14 aa, Homo sapiens
  Heavy chain CDR3 for antibody 4344 (IGHV3-33)
ARDNILTAYYLFDY

SEQ ID NO: 8689 - protein, 9 aa, Homo sapiens
  Light chain CDR3 for antibody 4345 (IGKV2-30)
MQGTHWPLT

SEQ ID NO: 8690 - protein, 20 aa, Homo sapiens
  Heavy chain CDR3 for antibody 4345 (IGHV1-f)
ATGLITFVRGVILTYRSFDY

SEQ ID NO: 8691 - protein, 9 aa, Homo sapiens
  Light chain CDR3 for antibody 4346 (IGKV1-27)
QKYNSAPYT

SEQ ID NO: 8692 - protein, 13 aa, Homo sapiens
  Heavy chain CDR3 for antibody 4346 (IGHV3-30)
AAPFMVRGDGMDV

SEQ ID NO: 8693 - protein, 9 aa, Homo sapiens
  Light chain CDR3 for antibody 4347 (IGKV1D-16)
QQYNSFPLT

SEQ ID NO: 8694 - protein, 18 aa, Homo sapiens
  Heavy chain CDR3 for antibody 4347 (IGHV4-59)
AREGDYVWGSYRPNWFDP

SEQ ID NO: 8695 - protein, 9 aa, Homo sapiens
  Light chain CDR3 for antibody 4348 (IGKV1-9)
QQYNSFPLT

SEQ ID NO: 8696 - protein, 15 aa, Homo sapiens
  Heavy chain CDR3 for antibody 4348 (IGHV3-30)
ARRGYGSGSPDAFDL

SEQ ID NO: 8697 - protein, 9 aa, Homo sapiens
  Light chain CDR3 for antibody 4349 (IGKV1D-16)
QQYDSYPWT

SEQ ID NO: 8698 - protein, 18 aa, Homo sapiens
  Heavy chain CDR3 for antibody 4349 (IGHV4-59)
AREGHYYTSGSYYKAFDY

SEQ ID NO: 8699 - protein, 9 aa, Homo sapiens
  Light chain CDR3 for antibody 4350 (IGKV6-21)
HQSSSLPLT

SEQ ID NO: 8700 - protein, 15 aa, Homo sapiens
  Heavy chain CDR3 for antibody 4350 (IGHV3-11)
AREYSSGWYGDAFDI

SEQ ID NO: 8701 - protein, 9 aa, Homo sapiens
  Light chain CDR3 for antibody 4351 (IGKV1-16)
QQYNSYPLT

SEQ ID NO: 8702 - protein, 16 aa, Homo sapiens
  Heavy chain CDR3 for antibody 4351 (IGHV4-59)
AREGYNWNDGVNWFDP

SEQ ID NO: 8703 - protein, 9 aa, Homo sapiens
  Light chain CDR3 for antibody 4352 (IGKV3-15)
QQYNNWPYT

SEQ ID NO: 8704 - protein, 20 aa, Homo sapiens
  Heavy chain CDR3 for antibody 4352 (IGHV3-20)
ARDLCSSTSCYGYYYYGMDV

SEQ ID NO: 8705 - protein, 10 aa, Homo sapiens
  Light chain CDR3 for antibody 4353 (IGKV3-11)
QQRSNWPIFT

SEQ ID NO: 8706 - protein, 11 aa, Homo sapiens
  Heavy chain CDR3 for antibody 4353 (IGHV3-33)
ARGSGSYAFDS

SEQ ID NO: 8707 - protein, 9 aa, Homo sapiens
  Light chain CDR3 for antibody 4354 (IGKV3-15)
QQYNNWPRT

SEQ ID NO: 8708 - protein, 17 aa, Homo sapiens
  Heavy chain CDR3 for antibody 4354 (IGHV3-33)
ARGYCSRTSCYLYYFDY

SEQ ID NO: 8709 - protein, 9 aa, Homo sapiens
  Light chain CDR3 for antibody 4355 (IGKV1-27)
QKYNSAPYT

SEQ ID NO: 8710 - protein, 18 aa, Homo sapiens
  Heavy chain CDR3 for antibody 4355 (IGHV3-33)
ARDRGDILTGYYKGWFDP

SEQ ID NO: 8711 - protein, 9 aa, Homo sapiens
  Light chain CDR3 for antibody 4356 (IGKV1-6)
LQDYNYPYT

SEQ ID NO: 8712 - protein, 18 aa, Homo sapiens
  Heavy chain CDR3 for antibody 4356 (IGHV3-23)
AKEGDYYSSGSYWGYFDL

SEQ ID NO: 8713 - protein, 9 aa, Homo sapiens
  Light chain CDR3 for antibody 4357 (IGKV1-27)
QKYNSAPYT

SEQ ID NO: 8714 - protein, 15 aa, Homo sapiens
  Heavy chain CDR3 for antibody 4357 (IGHV3-20)
ARDRGSSGWRDWFDP

SEQ ID NO: 8715 - protein, 9 aa, Homo sapiens
  Light chain CDR3 for antibody 4358 (IGKV1-39)
QQSYSTPLT

SEQ ID NO: 8716 - protein, 11 aa, Homo sapiens
  Heavy chain CDR3 for antibody 4358 (IGHV4-59)
ARDGVRGVFDI

SEQ ID NO: 8717 - protein, 9 aa, Homo sapiens
  Light chain CDR3 for antibody 4359 (IGKV5-2)
LQHDNFPWT

SEQ ID NO: 8718 - protein, 10 aa, Homo sapiens
  Heavy chain CDR3 for antibody 4359 (IGHV3-30)
ARDNFEGMDV

SEQ ID NO: 8719 - protein, 9 aa, Homo sapiens
  Light chain CDR3 for antibody 4360 (IGKV3-15)
QQYNNWPYT

SEQ ID NO: 8720 - protein, 11 aa, Homo sapiens
  Heavy chain CDR3 for antibody 4360 (IGHV3-74)
ARDRGNWGFDY

SEQ ID NO: 8721 - protein, 9 aa, Homo sapiens
  Light chain CDR3 for antibody 4361 (IGKV1-27)
QKYNSAPYT

SEQ ID NO: 8722 - protein, 18 aa, Homo sapiens
  Heavy chain CDR3 for antibody 4361 (IGHV3-33)
VRERGHYGSGSFPDAFDI

SEQ ID NO: 8723 - protein, 9 aa, Homo sapiens
  Light chain CDR3 for antibody 4362 (IGKV1-27)
QKYNSAPYT

SEQ ID NO: 8724 - protein, 12 aa, Homo sapiens
  Heavy chain CDR3 for antibody 4362 (IGHV3-23)
AKEGLGSDYESY

SEQ ID NO: 8725 - protein, 9 aa, Homo sapiens
  Light chain CDR3 for antibody 4363 (IGKV3-15)
QQYNNWPLT

SEQ ID NO: 8726 - protein, 12 aa, Homo sapiens
  Heavy chain CDR3 for antibody 4363 (IGHV4-59)
ARDSGSYYYFDY

SEQ ID NO: 8727 - protein, 9 aa, Homo sapiens
  Light chain CDR3 for antibody 4364 (IGKV1D-13)
QQFNNYPST

SEQ ID NO: 8728 - protein, 13 aa, Homo sapiens
  Heavy chain CDR3 for antibody 4364 (IGHV3-33)
VSTGDSYYYVMDV

SEQ ID NO: 8729 - protein, 9 aa, Homo sapiens
  Light chain CDR3 for antibody 4365 (IGKV1D-13)
QQFNNYPHT

SEQ ID NO: 8730 - protein, 13 aa, Homo sapiens
  Heavy chain CDR3 for antibody 4365 (IGHV3-23)
AKDRGLRYYGMDV

SEQ ID NO: 8731 - protein, 9 aa, Homo sapiens
  Light chain CDR3 for antibody 4366 (IGKV6-21)
HQSSSLPYT

SEQ ID NO: 8732 - protein, 11 aa, Homo sapiens
  Heavy chain CDR3 for antibody 4366 (IGHV4-59)
ARETGDDAFDI

SEQ ID NO: 8733 - protein, 9 aa, Homo sapiens
  Light chain CDR3 for antibody 4367 (IGKV1-6)
LQDYNYPYT

SEQ ID NO: 8734 - protein, 13 aa, Homo sapiens
  Heavy chain CDR3 for antibody 4367 (IGHV3-33)
ARDRDSSGSYFDY

SEQ ID NO: 8735 - protein, 9 aa, Homo sapiens
  Light chain CDR3 for antibody 4368 (IGKV3D-7)
QQDYNLPLT

SEQ ID NO: 8736 - protein, 14 aa, Homo sapiens
  Heavy chain CDR3 for antibody 4368 (IGHV3-33)
ARDGYDFLTGPFDY

SEQ ID NO: 8737 - protein, 9 aa, Homo sapiens
  Light chain CDR3 for antibody 4369 (IGKV1-9)
QQLISYPLT

SEQ ID NO: 8738 - protein, 13 aa, Homo sapiens
  Heavy chain CDR3 for antibody 4369 (IGHV3-33)
AKEDGDYHHYFDY

SEQ ID NO: 8739 - protein, 9 aa, Homo sapiens
  Light chain CDR3 for antibody 4370 (IGKV5-2)
LQHDNFPWT

SEQ ID NO: 8740 - protein, 15 aa, Homo sapiens
  Heavy chain CDR3 for antibody 4370 (IGHV3-23)
AKDRYFDWLSDAFDI

SEQ ID NO: 8741 - protein, 9 aa, Homo sapiens
  Light chain CDR3 for antibody 4371 (IGKV2-30)
MQGTHWPLT

SEQ ID NO: 8742 - protein, 14 aa, Homo sapiens
  Heavy chain CDR3 for antibody 4371 (IGHV1-18)
ARCFGSGSYGWFDP

SEQ ID NO: 8743 - protein, 9 aa, Homo sapiens
  Light chain CDR3 for antibody 4372 (IGKV5-2)
LQHDNFPWT

SEQ ID NO: 8744 - protein, 14 aa, Homo sapiens
  Heavy chain CDR3 for antibody 4372 (IGHV1-24)
ATWLPLYYYYGMDV

SEQ ID NO: 8745 - protein, 9 aa, Homo sapiens
  Light chain CDR3 for antibody 4373 (IGKV5-2)
LQHDNFPYT

SEQ ID NO: 8746 - protein, 14 aa, Homo sapiens
  Heavy chain CDR3 for antibody 4373 (IGHV1-46)
ARKGIVGAFDAFDI

SEQ ID NO: 8747 - protein, 9 aa, Homo sapiens
  Light chain CDR3 for antibody 4374 (IGKV1-39)
QQSYSTPFT

SEQ ID NO: 8748 - protein, 17 aa, Homo sapiens
  Heavy chain CDR3 for antibody 4374 (IGHV4-39)
AGRLTYYYGSGSPSFDY

SEQ ID NO: 8749 - protein, 9 aa, Homo sapiens
  Light chain CDR3 for antibody 4375 (IGKV6-21)
HQSSSLPYT

SEQ ID NO: 8750 - protein, 10 aa, Homo sapiens
  Heavy chain CDR3 for antibody 4375 (IGHV3-23)
AKDQVGATDC

SEQ ID NO: 8751 - protein, 9 aa, Homo sapiens
  Light chain CDR3 for antibody 4376 (IGKV1-6)
LQDYKSPFT

SEQ ID NO: 8752 - protein, 18 aa, Homo sapiens
  Heavy chain CDR3 for antibody 4376 (IGHV1-46)
ARDGDYVWGSYRSDWFDP

SEQ ID NO: 8753 - protein, 9 aa, Homo sapiens
  Light chain CDR3 for antibody 4377 (IGKV2D-28)
MQALQTPFT

SEQ ID NO: 8754 - protein, 17 aa, Homo sapiens
  Heavy chain CDR3 for antibody 4377 (IGHV4-59)
ARDFLVRGEGSYYGMDV

SEQ ID NO: 8755 - protein, 9 aa, Homo sapiens
  Light chain CDR3 for antibody 4378 (IGKV3-20)
QQYGSSPYT

SEQ ID NO: 8756 - protein, 15 aa, Homo sapiens
  Heavy chain CDR3 for antibody 4378 (IGHV3-23)
AKDRYFDWLSDAFDI

SEQ ID NO: 8757 - protein, 9 aa, Homo sapiens
  Light chain CDR3 for antibody 4379 (IGKV2-30)
MQGTHWPLT

SEQ ID NO: 8758 - protein, 14 aa, Homo sapiens
  Heavy chain CDR3 for antibody 4379 (IGHV3-33)
VRDAMGATTAWFDP

SEQ ID NO: 8759 - protein, 9 aa, Homo sapiens
  Light chain CDR3 for antibody 4380 (IGKV3D-7)
QQDYNLPWT

SEQ ID NO: 8760 - protein, 8 aa, Homo sapiens
  Heavy chain CDR3 for antibody 4380 (IGHV3-23)
AETFLFDY

SEQ ID NO: 8761 - protein, 9 aa, Homo sapiens
  Light chain CDR3 for antibody 4381 (IGKV1D-13)
QQFNNYPYT

SEQ ID NO: 8762 - protein, 7 aa, Homo sapiens
  Heavy chain CDR3 for antibody 4381 (IGHV3-33)
ARDRGPY

SEQ ID NO: 8763 - protein, 10 aa, Homo sapiens
  Light chain CDR3 for antibody 4382 (IGKV3-20)
QQYGRSPPVT

SEQ ID NO: 8764 - protein, 12 aa, Homo sapiens
  Heavy chain CDR3 for antibody 4382 (IGHV1-18)
ARILFYGDYFDY

SEQ ID NO: 8765 - protein, 9 aa, Homo sapiens
  Light chain CDR3 for antibody 4383 (IGKV1-39)
QQSYSTPLT

SEQ ID NO: 8766 - protein, 13 aa, Homo sapiens
  Heavy chain CDR3 for antibody 4383 (IGHV3-66)
ANTGDSYYYGFYV

SEQ ID NO: 8767 - protein, 8 aa, Homo sapiens
  Light chain CDR3 for antibody 4384 (IGKV1D-13)
QQFNNYPT

SEQ ID NO: 8768 - protein, 11 aa, Homo sapiens
  Heavy chain CDR3 for antibody 4384 (IGHV3-33)
ARDKSSGWSDY

SEQ ID NO: 8769 - protein, 9 aa, Homo sapiens
  Light chain CDR3 for antibody 4385 (IGKV3-20)
QQYGSSPLT

SEQ ID NO: 8770 - protein, 14 aa, Homo sapiens
  Heavy chain CDR3 for antibody 4385 (IGHV1-46)
ARKGIVGGFDAFDV

SEQ ID NO: 8771 - protein, 9 aa, Homo sapiens
  Light chain CDR3 for antibody 4386 (IGKV5-2)
LQHDNFPYT

SEQ ID NO: 8772 - protein, 9 aa, Homo sapiens
  Heavy chain CDR3 for antibody 4386 (IGHV1-8)
ARGPRIMDV

SEQ ID NO: 8773 - protein, 9 aa, Homo sapiens
  Light chain CDR3 for antibody 4387 (IGKV1-17)
LQHNSYPYT

SEQ ID NO: 8774 - protein, 18 aa, Homo sapiens
  Heavy chain CDR3 for antibody 4387 (IGHV3-53)
AKAGDYYVSGSYWGYFDL

SEQ ID NO: 8775 - protein, 9 aa, Homo sapiens
  Light chain CDR3 for antibody 4388 (IGKV1-39)
QQSYSTPLT

SEQ ID NO: 8776 - protein, 16 aa, Homo sapiens
  Heavy chain CDR3 for antibody 4388 (IGHV3-30)
ARDIAVAGHVYYGMDV

SEQ ID NO: 8777 - protein, 9 aa, Homo sapiens
  Light chain CDR3 for antibody 4389 (IGKV4-1)
QQYYSTPYT

SEQ ID NO: 8778 - protein, 9 aa, Homo sapiens
  Heavy chain CDR3 for antibody 4389 (IGHV3-30)
ARDNWGFDY

SEQ ID NO: 8779 - protein, 9 aa, Homo sapiens
  Light chain CDR3 for antibody 4390 (IGKV1-17)
LQHNSYPYT

SEQ ID NO: 8780 - protein, 23 aa, Homo sapiens
  Heavy chain CDR3 for antibody 4390 (IGHV3-11)
ARGGDYDILTGFYNSYYYYGMDV

SEQ ID NO: 8781 - protein, 9 aa, Homo sapiens
  Light chain CDR3 for antibody 4391 (IGKV3-15)
QQYNNWPRT

SEQ ID NO: 8782 - protein, 13 aa, Homo sapiens
  Heavy chain CDR3 for antibody 4391 (IGHV3-33)
ARKAYGDYFYFDY

SEQ ID NO: 8783 - protein, 9 aa, Homo sapiens
  Light chain CDR3 for antibody 4392 (IGKV1-16)
QQYIRYPYT

SEQ ID NO: 8784 - protein, 11 aa, Homo sapiens
  Heavy chain CDR3 for antibody 4392 (IGHV3-33)
ARDRSSGPFDY

SEQ ID NO: 8785 - protein, 8 aa, Homo sapiens
  Light chain CDR3 for antibody 4393 (IGKV3-20)
QQYGSSLT

SEQ ID NO: 8786 - protein, 13 aa, Homo sapiens
  Heavy chain CDR3 for antibody 4393 (IGHV3-33)
ARQSSGWFDAFDI

SEQ ID NO: 8787 - protein, 9 aa, Homo sapiens
  Light chain CDR3 for antibody 4394 (IGKV1-39)
QQSYRTPLT

SEQ ID NO: 8788 - protein, 10 aa, Homo sapiens
  Heavy chain CDR3 for antibody 4394 (IGHV3-23)
AKDHWGDFDY

SEQ ID NO: 8789 - protein, 9 aa, Homo sapiens
  Light chain CDR3 for antibody 4395 (IGKV1-9)
QQLHIYPWT

SEQ ID NO: 8790 - protein, 15 aa, Homo sapiens
  Heavy chain CDR3 for antibody 4395 (IGHV3-33)
ARDTGYSSSWNWFDP

SEQ ID NO: 8791 - protein, 9 aa, Homo sapiens
  Light chain CDR3 for antibody 4396 (IGKV1-6)
LQDYNYPYT

SEQ ID NO: 8792 - protein, 19 aa, Homo sapiens
  Heavy chain CDR3 for antibody 4396 (IGHV3-74)
AREYFDILTGYYKTGFFQH

SEQ ID NO: 8793 - protein, 9 aa, Homo sapiens
  Light chain CDR3 for antibody 4397 (IGKV3-15)
QQYNNWPLT

SEQ ID NO: 8794 - protein, 11 aa, Homo sapiens
  Heavy chain CDR3 for antibody 4397 (IGHV3-33)
ARDTWDDYFDY

SEQ ID NO: 8795 - protein, 9 aa, Homo sapiens
  Light chain CDR3 for antibody 4398 (IGKV1-39)
QQSYRTPLT

SEQ ID NO: 8796 - protein, 13 aa, Homo sapiens
  Heavy chain CDR3 for antibody 4398 (IGHV4-59)
ARDAGYSSSWFDY

SEQ ID NO: 8797 - protein, 9 aa, Homo sapiens
  Light chain CDR3 for antibody 4399 (IGKV1D-13)
QQFNNYPYT

SEQ ID NO: 8798 - protein, 12 aa, Homo sapiens
  Heavy chain CDR3 for antibody 4399 (IGHV3-33)
ARGYFTSGSAHY

SEQ ID NO: 8799 - protein, 9 aa, Homo sapiens
  Light chain CDR3 for antibody 4400 (IGKV1-6)
LQDFHYPWT

SEQ ID NO: 8800 - protein, 14 aa, Homo sapiens
  Heavy chain CDR3 for antibody 4400 (IGHV3-48)
ARGAAAGNFYGLDV

SEQ ID NO: 8801 - protein, 9 aa, Homo sapiens
  Light chain CDR3 for antibody 4401 (IGKV3-11)
QQRSNWPPT

SEQ ID NO: 8802 - protein, 9 aa, Homo sapiens
  Heavy chain CDR3 for antibody 4401 (IGHV3-23)
AKEQLLFDY

SEQ ID NO: 8803 - protein, 9 aa, Homo sapiens
  Light chain CDR3 for antibody 4402 (IGKV1-17)
LQHNSYPLT

SEQ ID NO: 8804 - protein, 13 aa, Homo sapiens
  Heavy chain CDR3 for antibody 4402 (IGHV3-33)
ARALYSSSWPGDY

SEQ ID NO: 8805 - protein, 9 aa, Homo sapiens
  Light chain CDR3 for antibody 4403 (IGKV3-11)
QQRSNWPWT

SEQ ID NO: 8806 - protein, 17 aa, Homo sapiens
  Heavy chain CDR3 for antibody 4403 (IGHV4-39)
ARVLRYFDWLSHDAFDI

SEQ ID NO: 8807 - protein, 9 aa, Homo sapiens
  Light chain CDR3 for antibody 4404 (IGKV2-30)
MQGTHWPLT

SEQ ID NO: 8808 - protein, 10 aa, Homo sapiens
  Heavy chain CDR3 for antibody 4404 (IGHV3-23)
AKEQWLVLDY

SEQ ID NO: 8809 - protein, 9 aa, Homo sapiens
  Light chain CDR3 for antibody 4405 (IGKV1-16)
QQYNSYPLT

SEQ ID NO: 8810 - protein, 12 aa, Homo sapiens
  Heavy chain CDR3 for antibody 4405 (IGHV3-33)
AREDYYYYGMDV

SEQ ID NO: 8811 - protein, 8 aa, Homo sapiens
  Light chain CDR3 for antibody 4406 (IGKV1-5)
QQYNSYWT

SEQ ID NO: 8812 - protein, 16 aa, Homo sapiens
  Heavy chain CDR3 for antibody 4406 (IGHV4-59)
ARGRYFEWLLGDVFDI

SEQ ID NO: 8813 - protein, 9 aa, Homo sapiens
  Light chain CDR3 for antibody 4407 (IGKV1-6)
LQDYKSPFT

SEQ ID NO: 8814 - protein, 13 aa, Homo sapiens
  Heavy chain CDR3 for antibody 4407 (IGHV3-33)
ARDWGYSHGYFDY

SEQ ID NO: 8815 - protein, 9 aa, Homo sapiens
  Light chain CDR3 for antibody 4408 (IGKV2-30)
MQGTHWPLT

SEQ ID NO: 8816 - protein, 13 aa, Homo sapiens
  Heavy chain CDR3 for antibody 4408 (IGHV3-23)
AKDRGYSSTSTAY

SEQ ID NO: 8817 - protein, 9 aa, Homo sapiens
  Light chain CDR3 for antibody 4409 (IGKV1-27)
QKYNSAPYT

SEQ ID NO: 8818 - protein, 18 aa, Homo sapiens
  Heavy chain CDR3 for antibody 4409 (IGHV3-13)
ARDYYGSGSLYYYYGMDV

SEQ ID NO: 8819 - protein, 9 aa, Homo sapiens
  Light chain CDR3 for antibody 4410 (IGKV3D-20)
QQYGSSPLT

SEQ ID NO: 8820 - protein, 15 aa, Homo sapiens
  Heavy chain CDR3 for antibody 4410 (IGHV3-33)
AKDRNSGYDWGGFDY

SEQ ID NO: 8821 - protein, 9 aa, Homo sapiens
  Light chain CDR3 for antibody 4411 (IGKV1-9)
QQLHSYPYT

SEQ ID NO: 8822 - protein, 17 aa, Homo sapiens
  Heavy chain CDR3 for antibody 4411 (IGHV3-33)
VRCGYSSSWYDPYYFDY

SEQ ID NO: 8823 - protein, 9 aa, Homo sapiens
  Light chain CDR3 for antibody 4412 (IGKV1-9)
QQLNTYPYT

SEQ ID NO: 8824 - protein, 13 aa, Homo sapiens
  Heavy chain CDR3 for antibody 4412 (IGHV3-33)
ARDWGYSHGYFDY

SEQ ID NO: 8825 - protein, 9 aa, Homo sapiens
  Light chain CDR3 for antibody 4413 (IGKV6-21)
HQSSSLPLT

SEQ ID NO: 8826 - protein, 14 aa, Homo sapiens
  Heavy chain CDR3 for antibody 4413 (IGHV1-46)
ARKGIVGAFDAFDI

SEQ ID NO: 8827 - protein, 9 aa, Homo sapiens
  Light chain CDR3 for antibody 4414 (IGKV1-6)
LQDYNYPRT

SEQ ID NO: 8828 - protein, 11 aa, Homo sapiens
  Heavy chain CDR3 for antibody 4414 (IGHV3-11)
ARASRGSYYDY

SEQ ID NO: 8829 - protein, 9 aa, Homo sapiens
  Light chain CDR3 for antibody 4415 (IGKV1-17)
LQHNSYPRT

SEQ ID NO: 8830 - protein, 16 aa, Homo sapiens
  Heavy chain CDR3 for antibody 4415 (IGHV3-33)
ARDRGGMTMVRGGFDY

SEQ ID NO: 8831 - protein, 10 aa, Homo sapiens
  Light chain CDR3 for antibody 4416 (IGKV1-39)
QQSYSTPMYT

SEQ ID NO: 8832 - protein, 10 aa, Homo sapiens
  Heavy chain CDR3 for antibody 4416 (IGHV3-33)
ARENSTPLDY

SEQ ID NO: 8833 - protein, 8 aa, Homo sapiens
  Light chain CDR3 for antibody 4417 (IGKV3D-7)
QQDYNLLT

SEQ ID NO: 8834 - protein, 15 aa, Homo sapiens
  Heavy chain CDR3 for antibody 4417 (IGHV4-59)
ARDLGHYYGSVSIDY

SEQ ID NO: 8835 - protein, 9 aa, Homo sapiens
  Light chain CDR3 for antibody 4418 (IGKV6-21)
HQSSSLPYT

SEQ ID NO: 8836 - protein, 18 aa, Homo sapiens
  Heavy chain CDR3 for antibody 4418 (IGHV3-33)
AREGYDILTGYYNVKFDY

SEQ ID NO: 8837 - protein, 9 aa, Homo sapiens
  Light chain CDR3 for antibody 4419 (IGKV5-2)
LQHDNFPWT

SEQ ID NO: 8838 - protein, 16 aa, Homo sapiens
  Heavy chain CDR3 for antibody 4419 (IGHV4-39)
ARRVPYYDILTGYLDY

SEQ ID NO: 8839 - protein, 10 aa, Homo sapiens
  Light chain CDR3 for antibody 4420 (IGKV1-39)
QQSYSTPMYT

SEQ ID NO: 8840 - protein, 17 aa, Homo sapiens
  Heavy chain CDR3 for antibody 4420 (IGHV1-18)
ARDEGYDILTGYPHFDY

SEQ ID NO: 8841 - protein, 9 aa, Homo sapiens
  Light chain CDR3 for antibody 4421 (IGKV1D-16)
QQYHSYPYT

SEQ ID NO: 8842 - protein, 13 aa, Homo sapiens
  Heavy chain CDR3 for antibody 4421 (IGHV1-46)
ANRDYYGYYGMDV

SEQ ID NO: 8843 - protein, 9 aa, Homo sapiens
  Light chain CDR3 for antibody 4422 (IGKV1-27)
QKYNSAPYT

SEQ ID NO: 8844 - protein, 13 aa, Homo sapiens
  Heavy chain CDR3 for antibody 4422 (IGHV3-11)
ARDEGYRGYVLDN

SEQ ID NO: 8845 - protein, 9 aa, Homo sapiens
  Light chain CDR3 for antibody 4423 (IGKV3-20)
QQYGSSPYT

SEQ ID NO: 8846 - protein, 16 aa, Homo sapiens
  Heavy chain CDR3 for antibody 4423 (IGHV3-33)
AREGGLIAAAGTGFDY

SEQ ID NO: 8847 - protein, 9 aa, Homo sapiens
  Light chain CDR3 for antibody 4424 (IGKV1D-13)
QQFNNYPYT

SEQ ID NO: 8848 - protein, 15 aa, Homo sapiens
  Heavy chain CDR3 for antibody 4424 (IGHV3-74)
SRGSGSHYFYYGMDV

SEQ ID NO: 8849 - protein, 9 aa, Homo sapiens
  Light chain CDR3 for antibody 4425 (IGKV1-17)
QQYNSYPYT

SEQ ID NO: 8850 - protein, 16 aa, Homo sapiens
  Heavy chain CDR3 for antibody 4425 (IGHV3-33)
ARGFSGYDGYYYGMDV

SEQ ID NO: 8851 - protein, 9 aa, Homo sapiens
  Light chain CDR3 for antibody 4426 (IGKV6-21)
HQSSSLPYT

SEQ ID NO: 8852 - protein, 13 aa, Homo sapiens
  Heavy chain CDR3 for antibody 4426 (IGHV1-18)
ARSYYGSGSPFDY

SEQ ID NO: 8853 - protein, 10 aa, Homo sapiens
  Light chain CDR3 for antibody 4427 (IGKV3-11)
QQRSNWPIFT

SEQ ID NO: 8854 - protein, 16 aa, Homo sapiens
  Heavy chain CDR3 for antibody 4427 (IGHV3-33)
ARGYDMLTGDYYGMDV

SEQ ID NO: 8855 - protein, 8 aa, Homo sapiens
  Light chain CDR3 for antibody 4428 (IGKV1D-13)
QQFNNYYT

SEQ ID NO: 8856 - protein, 20 aa, Homo sapiens
  Heavy chain CDR3 for antibody 4428 (IGHV1-18)
AREVGIAVAGTLYYYYGMDV

SEQ ID NO: 8857 - protein, 8 aa, Homo sapiens
  Light chain CDR3 for antibody 4429 (IGKV3D-7)
QQDYNLLT

SEQ ID NO: 8858 - protein, 16 aa, Homo sapiens
  Heavy chain CDR3 for antibody 4429 (IGHV3-33)
ARAVYYGSGSSLIMDV

SEQ ID NO: 8859 - protein, 8 aa, Homo sapiens
  Light chain CDR3 for antibody 4430 (IGKV1-5)
QQYNSYYT

SEQ ID NO: 8860 - protein, 14 aa, Homo sapiens
  Heavy chain CDR3 for antibody 4430 (IGHV3-33)
ARDGYDFLTGPFDY

SEQ ID NO: 8861 - protein, 9 aa, Homo sapiens
  Light chain CDR3 for antibody 4431 (IGKV1-6)
LQDFHYPWT

SEQ ID NO: 8862 - protein, 18 aa, Homo sapiens
  Heavy chain CDR3 for antibody 4431 (IGHV4-59)
AREGDYVWGSYRPNWFDP

SEQ ID NO: 8863 - protein, 9 aa, Homo sapiens
  Light chain CDR3 for antibody 4432 (IGKV2D-24)
TQATQFPHT

SEQ ID NO: 8864 - protein, 12 aa, Homo sapiens
  Heavy chain CDR3 for antibody 4432 (IGHV1-18)
ARILFYGDYFDY

SEQ ID NO: 8865 - protein, 9 aa, Homo sapiens
  Light chain CDR3 for antibody 4433 (IGKV1D-16)
QQYNSFPLT

SEQ ID NO: 8866 - protein, 12 aa, Homo sapiens
  Heavy chain CDR3 for antibody 4433 (IGHV3-33)
ARVDTAAPYFDY

SEQ ID NO: 8867 - protein, 9 aa, Homo sapiens
  Light chain CDR3 for antibody 4434 (IGKV2-30)
MQGTHWPLT

SEQ ID NO: 8868 - protein, 11 aa, Homo sapiens
  Heavy chain CDR3 for antibody 4434 (IGHV3-33)
ARDRATATVDY

SEQ ID NO: 8869 - protein, 9 aa, Homo sapiens
  Light chain CDR3 for antibody 4435 (IGKV1-17)
LQHNSYPYT

SEQ ID NO: 8870 - protein, 15 aa, Homo sapiens
  Heavy chain CDR3 for antibody 4435 (IGHV3-33)
SRDHLTGYNYYGMDV

SEQ ID NO: 8871 - protein, 9 aa, Homo sapiens
  Light chain CDR3 for antibody 4436 (IGKV1-17)
LQHNSYPYT

SEQ ID NO: 8872 - protein, 18 aa, Homo sapiens
  Heavy chain CDR3 for antibody 4436 (IGHV3-33)
VRERGHYGSGSFPDAFDI

SEQ ID NO: 8873 - protein, 9 aa, Homo sapiens
  Light chain CDR3 for antibody 4437 (IGKV1D-16)
QQYNSYPLT

SEQ ID NO: 8874 - protein, 16 aa, Homo sapiens
  Heavy chain CDR3 for antibody 4437 (IGHV3-23)
ARDLGIAAAGTGWFDP

SEQ ID NO: 8875 - protein, 9 aa, Homo sapiens
  Light chain CDR3 for antibody 4438 (IGKV3-15)
QQYNNWPLT

SEQ ID NO: 8876 - protein, 17 aa, Homo sapiens
  Heavy chain CDR3 for antibody 4438 (IGHV4-39)
AGRLTYYFGSGSPSFDY

SEQ ID NO: 8877 - protein, 9 aa, Homo sapiens
  Light chain CDR3 for antibody 4439 (IGKV1-17)
LQHNGYPLT

SEQ ID NO: 8878 - protein, 14 aa, Homo sapiens
  Heavy chain CDR3 for antibody 4439 (IGHV3-33)
ARATSGSSYWYFDL

SEQ ID NO: 8879 - protein, 9 aa, Homo sapiens
  Light chain CDR3 for antibody 4440 (IGKV3D-7)
QQDYEFPIT

SEQ ID NO: 8880 - protein, 15 aa, Homo sapiens
  Heavy chain CDR3 for antibody 4440 (IGHV4-59)
ARDLGHYYGSVSIDY

SEQ ID NO: 8881 - protein, 9 aa, Homo sapiens
  Light chain CDR3 for antibody 4441 (IGKV3D-7)
QQDYNLPYT

SEQ ID NO: 8882 - protein, 16 aa, Homo sapiens
  Heavy chain CDR3 for antibody 4441 (IGHV3-33)
ARDNFGSGSYYSHFHY

SEQ ID NO: 8883 - protein, 9 aa, Homo sapiens
  Light chain CDR3 for antibody 4442 (IGKV1D-13)
QQFNNYPYT

SEQ ID NO: 8884 - protein, 14 aa, Homo sapiens
  Heavy chain CDR3 for antibody 4442 (IGHV3-33)
ARDRGRHNYFGMDV

SEQ ID NO: 8885 - protein, 9 aa, Homo sapiens
  Light chain CDR3 for antibody 4443 (IGKV1-17)
LQHNSYPYT

SEQ ID NO: 8886 - protein, 13 aa, Homo sapiens
  Heavy chain CDR3 for antibody 4443 (IGHV3-33)
ARCIVAAMGGFDY

SEQ ID NO: 8887 - protein, 9 aa, Homo sapiens
  Light chain CDR3 for antibody 4444 (IGKV1D-13)
QQFNNYPHT

SEQ ID NO: 8888 - protein, 18 aa, Homo sapiens
  Heavy chain CDR3 for antibody 4444 (IGHV3-33)
ARDYDSLTTYPEDYGMDV

SEQ ID NO: 8889 - protein, 9 aa, Homo sapiens
  Light chain CDR3 for antibody 4445 (IGKV1-39)
QQSYSTPLT

SEQ ID NO: 8890 - protein, 11 aa, Homo sapiens
  Heavy chain CDR3 for antibody 4445 (IGHV4-59)
TRDRGLGSFDY

SEQ ID NO: 8891 - protein, 9 aa, Homo sapiens
  Light chain CDR3 for antibody 4446 (IGKV3D-20)
QQYGSYPYT

SEQ ID NO: 8892 - protein, 16 aa, Homo sapiens
  Heavy chain CDR3 for antibody 4446 (IGHV3-30)
ARDSSYYGSGYYGMDV

SEQ ID NO: 8893 - protein, 8 aa, Homo sapiens
  Light chain CDR3 for antibody 4447 (IGKV3-11)
QQRSNWLT

SEQ ID NO: 8894 - protein, 13 aa, Homo sapiens
  Heavy chain CDR3 for antibody 4447 (IGHV4-34)
ASNFYYYYYGMDV

SEQ ID NO: 8895 - protein, 9 aa, Homo sapiens
  Light chain CDR3 for antibody 4448 (IGKV3-11)
QQRSNWPPT

SEQ ID NO: 8896 - protein, 20 aa, Homo sapiens
  Heavy chain CDR3 for antibody 4448 (IGHV3-33)
ARDPAQLERRYYYFYYGMDV

SEQ ID NO: 8897 - protein, 9 aa, Homo sapiens
  Light chain CDR3 for antibody 4449 (IGKV1-27)
QKYNSAPYT

SEQ ID NO: 8898 - protein, 13 aa, Homo sapiens
  Heavy chain CDR3 for antibody 4449 (IGHV3-53)
ARDRDSSGSYFDY

SEQ ID NO: 8899 - protein, 9 aa, Homo sapiens
  Light chain CDR3 for antibody 4450 (IGKV2-30)
MQGTHWPLT

SEQ ID NO: 8900 - protein, 15 aa, Homo sapiens
  Heavy chain CDR3 for antibody 4450 (IGHV1-46)
ARGRFFDWLLSPFDY

SEQ ID NO: 8901 - protein, 8 aa, Homo sapiens
  Light chain CDR3 for antibody 4451 (IGKV3-11)
QQRSNWLT

SEQ ID NO: 8902 - protein, 16 aa, Homo sapiens
  Heavy chain CDR3 for antibody 4451 (IGHV4-59)
ARGRYFDWLLGDVFDI

SEQ ID NO: 8903 - protein, 9 aa, Homo sapiens
  Light chain CDR3 for antibody 4452 (IGKV1-39)
QQSYSTPLT

SEQ ID NO: 8904 - protein, 8 aa, Homo sapiens
  Heavy chain CDR3 for antibody 4452 (IGHV4-39)
ARRGGLDY

SEQ ID NO: 8905 - protein, 8 aa, Homo sapiens
  Light chain CDR3 for antibody 4453 (IGKV3-11)
QQRSNWLT

SEQ ID NO: 8906 - protein, 11 aa, Homo sapiens
  Heavy chain CDR3 for antibody 4453 (IGHV4-59)
AREMGHDTFDI

SEQ ID NO: 8907 - protein, 9 aa, Homo sapiens
  Light chain CDR3 for antibody 4454 (IGKV1D-13)
QQFNNYPRT

SEQ ID NO: 8908 - protein, 13 aa, Homo sapiens
  Heavy chain CDR3 for antibody 4454 (IGHV4-59)
ANRDYYGYYGMDV

SEQ ID NO: 8909 - protein, 9 aa, Homo sapiens
  Light chain CDR3 for antibody 4455 (IGKV1-27)
QKYNSAPYT

SEQ ID NO: 8910 - protein, 15 aa, Homo sapiens
  Heavy chain CDR3 for antibody 4455 (IGHV3-33)
ARAYDLPHYYYGMDV

SEQ ID NO: 8911 - protein, 9 aa, Homo sapiens
  Light chain CDR3 for antibody 4456 (IGKV3-20)
QQYGSSPYT

SEQ ID NO: 8912 - protein, 14 aa, Homo sapiens
  Heavy chain CDR3 for antibody 4456 (IGHV3-23)
AKCDYDILTGILDY

SEQ ID NO: 8913 - protein, 9 aa, Homo sapiens
  Light chain CDR3 for antibody 4457 (IGKV1-6)
QQEYNYPLT

SEQ ID NO: 8914 - protein, 14 aa, Homo sapiens
  Heavy chain CDR3 for antibody 4457 (IGHV1-46)
ARRGIVGALDAFDI

SEQ ID NO: 8915 - protein, 10 aa, Homo sapiens
  Light chain CDR3 for antibody 4458 (IGKV1-17)
LQHNSYPMYT

SEQ ID NO: 8916 - protein, 10 aa, Homo sapiens
  Heavy chain CDR3 for antibody 4458 (IGHV3-23)
AKGDRWRFDP

SEQ ID NO: 8917 - protein, 9 aa, Homo sapiens
  Light chain CDR3 for antibody 4459 (IGKV1-9)
LQHNSYPYT

SEQ ID NO: 8918 - protein, 16 aa, Homo sapiens
  Heavy chain CDR3 for antibody 4459 (IGHV4-39)
ARHPLIWTGYPNWFDP

SEQ ID NO: 8919 - protein, 9 aa, Homo sapiens
  Light chain CDR3 for antibody 4460 (IGKV1-9)
QQLNSYPYT

SEQ ID NO: 8920 - protein, 12 aa, Homo sapiens
  Heavy chain CDR3 for antibody 4460 (IGHV3-33)
ARGYSSKSYFDY

SEQ ID NO: 8921 - protein, 9 aa, Homo sapiens
  Light chain CDR3 for antibody 4461 (IGKV3-11)
QQRSNWMYT

SEQ ID NO: 8922 - protein, 14 aa, Homo sapiens
  Heavy chain CDR3 for antibody 4461 (IGHV4-39)
ARDSGYDYYYGMDV

SEQ ID NO: 8923 - protein, 9 aa, Homo sapiens
  Light chain CDR3 for antibody 4462 (IGKV6-21)
HQSSSLPYT

SEQ ID NO: 8924 - protein, 16 aa, Homo sapiens
  Heavy chain CDR3 for antibody 4462 (IGHV3-33)
ARAYYYGSGSYPHFQH

SEQ ID NO: 8925 - protein, 9 aa, Homo sapiens
  Light chain CDR3 for antibody 4463 (IGKV3D-20)
QQYGSSPWT

SEQ ID NO: 8926 - protein, 17 aa, Homo sapiens
  Heavy chain CDR3 for antibody 4463 (IGHV3-23)
AKEGSSSSWYGGLYFDY

SEQ ID NO: 8927 - protein, 9 aa, Homo sapiens
  Light chain CDR3 for antibody 4464 (IGKV3-20)
QQYGSSPLT

SEQ ID NO: 8928 - protein, 11 aa, Homo sapiens
  Heavy chain CDR3 for antibody 4464 (IGHV3-11)
ARASRGSYYDY

SEQ ID NO: 8929 - protein, 8 aa, Homo sapiens
  Light chain CDR3 for antibody 4465 (IGKV3-11)
QQRSNWLT

SEQ ID NO: 8930 - protein, 19 aa, Homo sapiens
  Heavy chain CDR3 for antibody 4465 (IGHV1-18)
ARDDILTGYSLYYYYGMDV

SEQ ID NO: 8931 - protein, 8 aa, Homo sapiens
  Light chain CDR3 for antibody 4466 (IGKV3D-7)
QQDYNLLT

SEQ ID NO: 8932 - protein, 9 aa, Homo sapiens
  Heavy chain CDR3 for antibody 4466 (IGHV4-59)
AGGSWDFDY

SEQ ID NO: 8933 - protein, 9 aa, Homo sapiens
  Light chain CDR3 for antibody 4467 (IGKV1-9)
QQLNSYPLT

SEQ ID NO: 8934 - protein, 12 aa, Homo sapiens
  Heavy chain CDR3 for antibody 4467 (IGHV3-33)
ARDGPVAGLFDY

SEQ ID NO: 8935 - protein, 9 aa, Homo sapiens
  Light chain CDR3 for antibody 4468 (IGKV3D-7)
QQDYTLPLT

SEQ ID NO: 8936 - protein, 18 aa, Homo sapiens
  Heavy chain CDR3 for antibody 4468 (IGHV4-39)
ARQYYFGSGNYYRGWFDP

SEQ ID NO: 8937 - protein, 8 aa, Homo sapiens
  Light chain CDR3 for antibody 4469 (IGKV3D-7)
QQDYNLLT

SEQ ID NO: 8938 - protein, 13 aa, Homo sapiens
  Heavy chain CDR3 for antibody 4469 (IGHV3-33)
ARIDYYSYYGMDV

SEQ ID NO: 8939 - protein, 10 aa, Homo sapiens
  Light chain CDR3 for antibody 4470 (IGKV3-11)
QQRSNWPIWT

SEQ ID NO: 8940 - protein, 13 aa, Homo sapiens
  Heavy chain CDR3 for antibody 4470 (IGHV3-23)
AKDRGYSSTSTAY

SEQ ID NO: 8941 - protein, 9 aa, Homo sapiens
  Light chain CDR3 for antibody 4471 (IGKV1-27)
QKYNSAPHT

SEQ ID NO: 8942 - protein, 13 aa, Homo sapiens
  Heavy chain CDR3 for antibody 4471 (IGHV3-33)
ARKAYGDYFYFDY

SEQ ID NO: 8943 - protein, 9 aa, Homo sapiens
  Light chain CDR3 for antibody 4472 (IGKV6-21)
HQSSSLPYT

SEQ ID NO: 8944 - protein, 10 aa, Homo sapiens
  Heavy chain CDR3 for antibody 4472 (IGHV1-46)
AREWELLFDY

SEQ ID NO: 8945 - protein, 8 aa, Homo sapiens
  Light chain CDR3 for antibody 4473 (IGKV3-20)
QQYGSSLT

SEQ ID NO: 8946 - protein, 13 aa, Homo sapiens
  Heavy chain CDR3 for antibody 4473 (IGHV3-23)
ASPFNWNDGFFDY

SEQ ID NO: 8947 - protein, 9 aa, Homo sapiens
  Light chain CDR3 for antibody 4474 (IGKV1D-16)
QQYDSYPWT

SEQ ID NO: 8948 - protein, 15 aa, Homo sapiens
  Heavy chain CDR3 for antibody 4474 (IGHV4-59)
ARDLGHYYGSVSIDY

SEQ ID NO: 8949 - protein, 9 aa, Homo sapiens
  Light chain CDR3 for antibody 4475 (IGKV1-17)
LQLNSFPWT

SEQ ID NO: 8950 - protein, 16 aa, Homo sapiens
  Heavy chain CDR3 for antibody 4475 (IGHV3-23)
AKEGMVLRYFDWLWDY

SEQ ID NO: 8951 - protein, 8 aa, Homo sapiens
  Light chain CDR3 for antibody 4476 (IGKV3D-7)
QQDYNLLT

SEQ ID NO: 8952 - protein, 15 aa, Homo sapiens
  Heavy chain CDR3 for antibody 4476 (IGHV3-33)
VCVLYDYGDYVGFDY

SEQ ID NO: 8953 - protein, 9 aa, Homo sapiens
  Light chain CDR3 for antibody 4477 (IGKV3-15)
QQYNNWPYT

SEQ ID NO: 8954 - protein, 19 aa, Homo sapiens
  Heavy chain CDR3 for antibody 4477 (IGHV3-33)
TRDPHYDILTGYAYYGMDV

SEQ ID NO: 8955 - protein, 9 aa, Homo sapiens
  Light chain CDR3 for antibody 4478 (IGKV6-21)
HQSSSLPYT

SEQ ID NO: 8956 - protein, 9 aa, Homo sapiens
  Heavy chain CDR3 for antibody 4478 (IGHV1-18)
ARGGWGFEY

SEQ ID NO: 8957 - protein, 9 aa, Homo sapiens
  Light chain CDR3 for antibody 4479 (IGKV1D-16)
QQYNSYPYT

SEQ ID NO: 8958 - protein, 11 aa, Homo sapiens
  Heavy chain CDR3 for antibody 4479 (IGHV1-24)
ATYFGSGSLDY

SEQ ID NO: 8959 - protein, 9 aa, Homo sapiens
  Light chain CDR3 for antibody 4480 (IGKV3-15)
QQYNNWPLT

SEQ ID NO: 8960 - protein, 17 aa, Homo sapiens
  Heavy chain CDR3 for antibody 4480 (IGHV4-39)
ARQGWYYGSGSSLLFDY

SEQ ID NO: 8961 - protein, 9 aa, Homo sapiens
  Light chain CDR3 for antibody 4481 (IGKV1-9)
QQLNSYPLT

SEQ ID NO: 8962 - protein, 10 aa, Homo sapiens
  Heavy chain CDR3 for antibody 4481 (IGHV3-23)
AKDHWGDFDY

SEQ ID NO: 8963 - protein, 10 aa, Homo sapiens
  Light chain CDR3 for antibody 4482 (IGKV3-11)
QQRSNWPIFT

SEQ ID NO: 8964 - protein, 15 aa, Homo sapiens
  Heavy chain CDR3 for antibody 4482 (IGHV3-23)
AKEALRYFDWSGMDV

SEQ ID NO: 8965 - protein, 9 aa, Homo sapiens
  Light chain CDR3 for antibody 4483 (IGKV1D-13)
QQFNNYPYT

SEQ ID NO: 8966 - protein, 18 aa, Homo sapiens
  Heavy chain CDR3 for antibody 4483 (IGHV1-8)
AREGAAAGSYYYYNGMDV

SEQ ID NO: 8967 - protein, 9 aa, Homo sapiens
  Light chain CDR3 for antibody 4484 (IGKV1-16)
QHYNDYPFT

SEQ ID NO: 8968 - protein, 12 aa, Homo sapiens
  Heavy chain CDR3 for antibody 4484 (IGHV3-33)
TRGYSSKSYFDY

SEQ ID NO: 8969 - protein, 9 aa, Homo sapiens
  Light chain CDR3 for antibody 4485 (IGKV5-2)
LQHDNFPYT

SEQ ID NO: 8970 - protein, 17 aa, Homo sapiens
  Heavy chain CDR3 for antibody 4485 (IGHV3-23)
AKGDYYGSGSYSTFFDY

SEQ ID NO: 8971 - protein, 8 aa, Homo sapiens
  Light chain CDR3 for antibody 4486 (IGKV3-11)
QQRSNWWT

SEQ ID NO: 8972 - protein, 13 aa, Homo sapiens
  Heavy chain CDR3 for antibody 4486 (IGHV3-33)
ARDYCGGDCYLDY

SEQ ID NO: 8973 - protein, 9 aa, Homo sapiens
  Light chain CDR3 for antibody 4487 (IGKV2-30)
MQGTHWPLT

SEQ ID NO: 8974 - protein, 15 aa, Homo sapiens
  Heavy chain CDR3 for antibody 4487 (IGHV3-23)
AKEALRYFDWSGMDV

SEQ ID NO: 8975 - protein, 9 aa, Homo sapiens
  Light chain CDR3 for antibody 4488 (IGKV3-20)
QQYGSSPYT

SEQ ID NO: 8976 - protein, 17 aa, Homo sapiens
  Heavy chain CDR3 for antibody 4488 (IGHV3-33)
ARDSYDILTGYYKPFDY

SEQ ID NO: 8977 - protein, 9 aa, Homo sapiens
  Light chain CDR3 for antibody 4489 (IGKV2-30)
MQGTHWPLT

SEQ ID NO: 8978 - protein, 12 aa, Homo sapiens
  Heavy chain CDR3 for antibody 4489 (IGHV3-13)
ARDRGYSGYFDY

SEQ ID NO: 8979 - protein, 9 aa, Homo sapiens
  Light chain CDR3 for antibody 4490 (IGKV5-2)
LQHDNFPYT

SEQ ID NO: 8980 - protein, 10 aa, Homo sapiens
  Heavy chain CDR3 for antibody 4490 (IGHV3-23)
AKDQVGATDC

SEQ ID NO: 8981 - protein, 9 aa, Homo sapiens
  Light chain CDR3 for antibody 4491 (IGKV1-39)
QQSYSTPLT

SEQ ID NO: 8982 - protein, 13 aa, Homo sapiens
  Heavy chain CDR3 for antibody 4491 (IGHV3-33)
AREYCSGGSCYDY

SEQ ID NO: 8983 - protein, 9 aa, Homo sapiens
  Light chain CDR3 for antibody 4492 (IGKV3-20)
QQYGSSPLT

SEQ ID NO: 8984 - protein, 16 aa, Homo sapiens
  Heavy chain CDR3 for antibody 4492 (IGHV1-46)
ARGGGYSGSYSNWFDP

SEQ ID NO: 8985 - protein, 8 aa, Homo sapiens
  Light chain CDR3 for antibody 4493 (IGKV1D-13)
QQFNNYPT

SEQ ID NO: 8986 - protein, 17 aa, Homo sapiens
  Heavy chain CDR3 for antibody 4493 (IGHV3-23)
AKDGIGELSYYYYGMDV

SEQ ID NO: 8987 - protein, 9 aa, Homo sapiens
  Light chain CDR3 for antibody 4494 (IGKV1-17)
LQHNSYPRT

SEQ ID NO: 8988 - protein, 13 aa, Homo sapiens
  Heavy chain CDR3 for antibody 4494 (IGHV3-33)
AREYFDWLLPLDY

SEQ ID NO: 8989 - protein, 9 aa, Homo sapiens
  Light chain CDR3 for antibody 4495 (IGKV1D-13)
QQFNNYPST

SEQ ID NO: 8990 - protein, 19 aa, Homo sapiens
  Heavy chain CDR3 for antibody 4495 (IGHV3-33)
TRDPHYDILTGYAYYGMDV

SEQ ID NO: 8991 - protein, 9 aa, Homo sapiens
  Light chain CDR3 for antibody 4496 (IGKV3D-20)
QQYGSSPYT

SEQ ID NO: 8992 - protein, 18 aa, Homo sapiens
  Heavy chain CDR3 for antibody 4496 (IGHV3-33)
AREGYFGSGSYYRNWFDP

SEQ ID NO: 8993 - protein, 9 aa, Homo sapiens
  Light chain CDR3 for antibody 4497 (IGKV1-39)
QQSYSTPLT

SEQ ID NO: 8994 - protein, 13 aa, Homo sapiens
  Heavy chain CDR3 for antibody 4497 (IGHV3-33)
ASAGNSYYNVMDV

SEQ ID NO: 8995 - protein, 9 aa, Homo sapiens
  Light chain CDR3 for antibody 4498 (IGKV1-27)
QKYNSAPYT

SEQ ID NO: 8996 - protein, 13 aa, Homo sapiens
  Heavy chain CDR3 for antibody 4498 (IGHV4-39)
ARHVLLWFGEFDP

SEQ ID NO: 8997 - protein, 9 aa, Homo sapiens
  Light chain CDR3 for antibody 4499 (IGKV1-16)
QHYNDYPFT

SEQ ID NO: 8998 - protein, 14 aa, Homo sapiens
  Heavy chain CDR3 for antibody 4499 (IGHV3-33)
ARDWNDVYYYGMDV

SEQ ID NO: 8999 - protein, 9 aa, Homo sapiens
  Light chain CDR3 for antibody 4500 (IGKV3-20)
QQYGSSPLT

SEQ ID NO: 9000 - protein, 15 aa, Homo sapiens
  Heavy chain CDR3 for antibody 4500 (IGHV4-59)
ARDGHGNWGSGTFDY

SEQ ID NO: 9001 - protein, 9 aa, Homo sapiens
  Light chain CDR3 for antibody 4501 (IGKV1-6)
LQDYNYPWT

SEQ ID NO: 9002 - protein, 16 aa, Homo sapiens
  Heavy chain CDR3 for antibody 4501 (IGHV3-11)
ARDSELRYFDWFGMDV

SEQ ID NO: 9003 - protein, 9 aa, Homo sapiens
  Light chain CDR3 for antibody 4502 (IGKV3-11)
QQRSNWPLT

SEQ ID NO: 9004 - protein, 17 aa, Homo sapiens
  Heavy chain CDR3 for antibody 4502 (IGHV3-33)
ARGGAAAGPYLYYGLDV

SEQ ID NO: 9005 - protein, 9 aa, Homo sapiens
  Light chain CDR3 for antibody 4503 (IGKV1-27)
QKYNSAPYT

SEQ ID NO: 9006 - protein, 18 aa, Homo sapiens
  Heavy chain CDR3 for antibody 4503 (IGHV3-33)
AREGYDILTGYYNVKFDY

SEQ ID NO: 9007 - protein, 9 aa, Homo sapiens
  Light chain CDR3 for antibody 4504 (IGKV1-17)
LQHNSYPWT

SEQ ID NO: 9008 - protein, 19 aa, Homo sapiens
  Heavy chain CDR3 for antibody 4504 (IGHV3-33)
ARRRDDILTGWDYYFGMDV

SEQ ID NO: 9009 - protein, 8 aa, Homo sapiens
  Light chain CDR3 for antibody 4505 (IGKV3-20)
QQYGSSFT

SEQ ID NO: 9010 - protein, 13 aa, Homo sapiens
  Heavy chain CDR3 for antibody 4505 (IGHV4-39)
ARQWPSGYWYFDL

SEQ ID NO: 9011 - protein, 9 aa, Homo sapiens
  Light chain CDR3 for antibody 4506 (IGKV1-6)
LQDYKSPFT

SEQ ID NO: 9012 - protein, 17 aa, Homo sapiens
  Heavy chain CDR3 for antibody 4506 (IGHV1-18)
ARERYYGSGNYKYNMDV

SEQ ID NO: 9013 - protein, 9 aa, Homo sapiens
  Light chain CDR3 for antibody 4507 (IGKV3-15)
QQYNNWPFT

SEQ ID NO: 9014 - protein, 14 aa, Homo sapiens
  Heavy chain CDR3 for antibody 4507 (IGHV1-18)
ARRGIVGALDAFDI

SEQ ID NO: 9015 - protein, 9 aa, Homo sapiens
  Light chain CDR3 for antibody 4508 (IGKV1-39)
QQSYSTPLT

SEQ ID NO: 9016 - protein, 18 aa, Homo sapiens
  Heavy chain CDR3 for antibody 4508 (IGHV1-8)
AREGAAAGSYYYYNGMDV

SEQ ID NO: 9017 - protein, 9 aa, Homo sapiens
  Light chain CDR3 for antibody 4509 (IGKV1-17)
LQHNSYPPT

SEQ ID NO: 9018 - protein, 17 aa, Homo sapiens
  Heavy chain CDR3 for antibody 4509 (IGHV3-33)
AREGNDILTGYYHAFDI

SEQ ID NO: 9019 - protein, 9 aa, Homo sapiens
  Light chain CDR3 for antibody 4510 (IGKV5-2)
LQHDNFPWT

SEQ ID NO: 9020 - protein, 18 aa, Homo sapiens
  Heavy chain CDR3 for antibody 4510 (IGHV4-39)
VKYITMVRGDIITGPFAY

SEQ ID NO: 9021 - protein, 9 aa, Homo sapiens
  Light chain CDR3 for antibody 4511 (IGKV1-17)
LQHNGYPLT

SEQ ID NO: 9022 - protein, 15 aa, Homo sapiens
  Heavy chain CDR3 for antibody 4511 (IGHV3-30)
ARRGYGSGSPDAFDL

SEQ ID NO: 9023 - protein, 9 aa, Homo sapiens
  Light chain CDR3 for antibody 4512 (IGKV1D-16)
QQLNSYPLT

SEQ ID NO: 9024 - protein, 10 aa, Homo sapiens
  Heavy chain CDR3 for antibody 4512 (IGHV3-23)
AKENWNDFDY

SEQ ID NO: 9025 - protein, 9 aa, Homo sapiens
  Light chain CDR3 for antibody 4513 (IGKV1D-16)
QQYNSYPYT

SEQ ID NO: 9026 - protein, 9 aa, Homo sapiens
  Heavy chain CDR3 for antibody 4513 (IGHV3-23)
AIGRYYFDY

SEQ ID NO: 9027 - protein, 9 aa, Homo sapiens
  Light chain CDR3 for antibody 4514 (IGKV2D-24)
TQATQFPHT

SEQ ID NO: 9028 - protein, 9 aa, Homo sapiens
  Heavy chain CDR3 for antibody 4514 (IGHV1-18)
ARGKDWFDP

SEQ ID NO: 9029 - protein, 9 aa, Homo sapiens
  Light chain CDR3 for antibody 4515 (IGKV1-6)
LQDYNYPRT

SEQ ID NO: 9030 - protein, 15 aa, Homo sapiens
  Heavy chain CDR3 for antibody 4515 (IGHV4-39)
ARRVRGLIITRYFDY

SEQ ID NO: 9031 - protein, 9 aa, Homo sapiens
  Light chain CDR3 for antibody 4516 (IGKV3-15)
QQYNNWPLT

SEQ ID NO: 9032 - protein, 20 aa, Homo sapiens
  Heavy chain CDR3 for antibody 4516 (IGHV3-23)
AKGMGGLRYFDWPHYYGMDV

SEQ ID NO: 9033 - protein, 9 aa, Homo sapiens
  Light chain CDR3 for antibody 4517 (IGKV1-6)
QQEYNYPLT

SEQ ID NO: 9034 - protein, 7 aa, Homo sapiens
  Heavy chain CDR3 for antibody 4517 (IGHV1-46)
AREGGDY

SEQ ID NO: 9035 - protein, 9 aa, Homo sapiens
  Light chain CDR3 for antibody 4518 (IGKV1-17)
QQYNSYPLT

SEQ ID NO: 9036 - protein, 10 aa, Homo sapiens
  Heavy chain CDR3 for antibody 4518 (IGHV3-33)
ARKGMNAFDI

SEQ ID NO: 9037 - protein, 8 aa, Homo sapiens
  Light chain CDR3 for antibody 4519 (IGKV3D-7)
QQDYNLVT

SEQ ID NO: 9038 - protein, 13 aa, Homo sapiens
  Heavy chain CDR3 for antibody 4519 (IGHV4-28)
ARKGATGYYGMDV

SEQ ID NO: 9039 - protein, 9 aa, Homo sapiens
  Light chain CDR3 for antibody 4520 (IGKV1D-16)
QQYDSYPWT

SEQ ID NO: 9040 - protein, 12 aa, Homo sapiens
  Heavy chain CDR3 for antibody 4520 (IGHV3-33)
AREKGGSYSFDY

SEQ ID NO: 9041 - protein, 9 aa, Homo sapiens
  Light chain CDR3 for antibody 4521 (IGKV1-17)
LQHNSYPPT

SEQ ID NO: 9042 - protein, 16 aa, Homo sapiens
  Heavy chain CDR3 for antibody 4521 (IGHV1-24)
ATDWNDRGYYYYGMDV

SEQ ID NO: 9043 - protein, 10 aa, Homo sapiens
  Light chain CDR3 for antibody 4522 (IGKV3-15)
QQYNNWPPYT

SEQ ID NO: 9044 - protein, 13 aa, Homo sapiens
  Heavy chain CDR3 for antibody 4522 (IGHV3-33)
ARDWGYSHGYFDY

SEQ ID NO: 9045 - protein, 9 aa, Homo sapiens
  Light chain CDR3 for antibody 4523 (IGKV1-39)
QQSYSTPLT

SEQ ID NO: 9046 - protein, 15 aa, Homo sapiens
  Heavy chain CDR3 for antibody 4523 (IGHV1-18)
ARRSPNWGHYYGMDV

SEQ ID NO: 9047 - protein, 9 aa, Homo sapiens
  Light chain CDR3 for antibody 4524 (IGKV1-17)
LQHNSYPRT

SEQ ID NO: 9048 - protein, 14 aa, Homo sapiens
  Heavy chain CDR3 for antibody 4524 (IGHV3-15)
SIYYYGSGRDFFDY

SEQ ID NO: 9049 - protein, 9 aa, Homo sapiens
  Light chain CDR3 for antibody 4525 (IGKV1D-16)
QQYNSYPYT

SEQ ID NO: 9050 - protein, 14 aa, Homo sapiens
  Heavy chain CDR3 for antibody 4525 (IGHV1-46)
ARAYYAFLTGALDI

SEQ ID NO: 9051 - protein, 10 aa, Homo sapiens
  Light chain CDR3 for antibody 4526 (IGKV1-39)
QQSYSTPMYT

SEQ ID NO: 9052 - protein, 10 aa, Homo sapiens
  Heavy chain CDR3 for antibody 4526 (IGHV3-30)
AREWYGGMDV

SEQ ID NO: 9053 - protein, 9 aa, Homo sapiens
  Light chain CDR3 for antibody 4527 (IGKV2-30)
MQGTHWPLT

SEQ ID NO: 9054 - protein, 14 aa, Homo sapiens
  Heavy chain CDR3 for antibody 4527 (IGHV3-33)
ARDNILTAYYLFDY

SEQ ID NO: 9055 - protein, 8 aa, Homo sapiens
  Light chain CDR3 for antibody 4528 (IGKV3D-7)
QQDYNLLT

SEQ ID NO: 9056 - protein, 20 aa, Homo sapiens
  Heavy chain CDR3 for antibody 4528 (IGHV3-11)
ARGGATLIRGLIDYYYGMDV

SEQ ID NO: 9057 - protein, 9 aa, Homo sapiens
  Light chain CDR3 for antibody 4529 (IGKV3-20)
QQYGSSPYT

SEQ ID NO: 9058 - protein, 12 aa, Homo sapiens
  Heavy chain CDR3 for antibody 4529 (IGHV3-33)
ARDGPVAGLFDY

SEQ ID NO: 9059 - protein, 9 aa, Homo sapiens
  Light chain CDR3 for antibody 4530 (IGKV3D-20)
QQYGSSPWT

SEQ ID NO: 9060 - protein, 16 aa, Homo sapiens
  Heavy chain CDR3 for antibody 4530 (IGHV3-23)
ARNWNDVGDYYYGMDV

SEQ ID NO: 9061 - protein, 9 aa, Homo sapiens
  Light chain CDR3 for antibody 4531 (IGKV3-11)
QQRSNWPPT

SEQ ID NO: 9062 - protein, 12 aa, Homo sapiens
  Heavy chain CDR3 for antibody 4531 (IGHV3-33)
ARDGYSSRNFDY

SEQ ID NO: 9063 - protein, 8 aa, Homo sapiens
  Light chain CDR3 for antibody 4532 (IGKV3D-7)
QQDYNLLT

SEQ ID NO: 9064 - protein, 14 aa, Homo sapiens
  Heavy chain CDR3 for antibody 4532 (IGHV3-23)
AKDRYRGYEGLFDY

SEQ ID NO: 9065 - protein, 9 aa, Homo sapiens
  Light chain CDR3 for antibody 4533 (IGKV5-2)
LQHDNFPWT

SEQ ID NO: 9066 - protein, 14 aa, Homo sapiens
  Heavy chain CDR3 for antibody 4533 (IGHV1-46)
ARSYYDILTGAFDI

SEQ ID NO: 9067 - protein, 9 aa, Homo sapiens
  Light chain CDR3 for antibody 4534 (IGKV5-2)
LQHDNFPWT

SEQ ID NO: 9068 - protein, 12 aa, Homo sapiens
  Heavy chain CDR3 for antibody 4534 (IGHV3-21)
AREGFGESSFDY

SEQ ID NO: 9069 - protein, 9 aa, Homo sapiens
  Light chain CDR3 for antibody 4535 (IGKV2-30)
MQGTHWPLT

SEQ ID NO: 9070 - protein, 11 aa, Homo sapiens
  Heavy chain CDR3 for antibody 4535 (IGHV3-33)
ARAGIAALFDY

SEQ ID NO: 9071 - protein, 9 aa, Homo sapiens
  Light chain CDR3 for antibody 4536 (IGKV6-21)
HQSSSLPWT

SEQ ID NO: 9072 - protein, 16 aa, Homo sapiens
  Heavy chain CDR3 for antibody 4536 (IGHV4-59)
ARFYYGSGSYHWYFDL

SEQ ID NO: 9073 - protein, 10 aa, Homo sapiens
  Light chain CDR3 for antibody 4537 (IGKV1-17)
LQHNSYPMYT

SEQ ID NO: 9074 - protein, 15 aa, Homo sapiens
  Heavy chain CDR3 for antibody 4537 (IGHV3-33)
ARDHLTGYYYYGMDV

SEQ ID NO: 9075 - protein, 9 aa, Homo sapiens
  Light chain CDR3 for antibody 4538 (IGKV2-30)
MQGTHWPLT

SEQ ID NO: 9076 - protein, 9 aa, Homo sapiens
  Heavy chain CDR3 for antibody 4538 (IGHV3-23)
ARIWWLKDY

SEQ ID NO: 9077 - protein, 9 aa, Homo sapiens
  Light chain CDR3 for antibody 4539 (IGKV1-9)
QQLHIYPWT

SEQ ID NO: 9078 - protein, 16 aa, Homo sapiens
  Heavy chain CDR3 for antibody 4539 (IGHV3-23)
AKEGMVLRYFDWLWDY

SEQ ID NO: 9079 - protein, 9 aa, Homo sapiens
  Light chain CDR3 for antibody 4540 (IGKV3-11)
QQRSNWPYT

SEQ ID NO: 9080 - protein, 13 aa, Homo sapiens
  Heavy chain CDR3 for antibody 4540 (IGHV3-33)
ARQSSGWFDAFDI

SEQ ID NO: 9081 - protein, 9 aa, Homo sapiens
  Light chain CDR3 for antibody 4541 (IGKV1-17)
LQHNSYPYT

SEQ ID NO: 9082 - protein, 20 aa, Homo sapiens
  Heavy chain CDR3 for antibody 4541 (IGHV4-59)
ARDRGYDILTGYYGYYGMDV

SEQ ID NO: 9083 - protein, 8 aa, Homo sapiens
  Light chain CDR3 for antibody 4542 (IGKV1-5)
QQYNSYWT

SEQ ID NO: 9084 - protein, 13 aa, Homo sapiens
  Heavy chain CDR3 for antibody 4542 (IGHV3-23)
AKDRGYSSTSTAY

SEQ ID NO: 9085 - protein, 9 aa, Homo sapiens
  Light chain CDR3 for antibody 4543 (IGKV1D-13)
QQFNNYPHT

SEQ ID NO: 9086 - protein, 16 aa, Homo sapiens
  Heavy chain CDR3 for antibody 4543 (IGHV3-33)
ARDNFGSGSYYSHFHY

SEQ ID NO: 9087 - protein, 8 aa, Homo sapiens
  Light chain CDR3 for antibody 4544 (IGKV1D-13)
QQFNNYPT

SEQ ID NO: 9088 - protein, 18 aa, Homo sapiens
  Heavy chain CDR3 for antibody 4544 (IGHV3-33)
ARGYYGSGNFYKDSGMDV

SEQ ID NO: 9089 - protein, 9 aa, Homo sapiens
  Light chain CDR3 for antibody 4545 (IGKV1-17)
LQHNSYPWT

SEQ ID NO: 9090 - protein, 12 aa, Homo sapiens
  Heavy chain CDR3 for antibody 4545 (IGHV3-33)
VRKWFGELYFDY

SEQ ID NO: 9091 - protein, 9 aa, Homo sapiens
  Light chain CDR3 for antibody 4546 (IGKV2-30)
MQGTHWPLT

SEQ ID NO: 9092 - protein, 17 aa, Homo sapiens
  Heavy chain CDR3 for antibody 4546 (IGHV3-33)
ARDWFGELSDYYYGMDV

SEQ ID NO: 9093 - protein, 9 aa, Homo sapiens
  Light chain CDR3 for antibody 4547 (IGKV1D-13)
QQFNNYPYT

SEQ ID NO: 9094 - protein, 17 aa, Homo sapiens
  Heavy chain CDR3 for antibody 4547 (IGHV3-23)
AKDYDILTGYSHNWFDP

SEQ ID NO: 9095 - protein, 9 aa, Homo sapiens
  Light chain CDR3 for antibody 4548 (IGKV5-2)
LQHDNFPLT

SEQ ID NO: 9096 - protein, 16 aa, Homo sapiens
  Heavy chain CDR3 for antibody 4548 (IGHV3-23)
AKGMGGLRYFDWLWDY

SEQ ID NO: 9097 - protein, 9 aa, Homo sapiens
  Light chain CDR3 for antibody 4549 (IGKV1-9)
QQGNTYSRT

SEQ ID NO: 9098 - protein, 9 aa, Homo sapiens
  Heavy chain CDR3 for antibody 4549 (IGHV4-59)
AREGGSGSL

SEQ ID NO: 9099 - protein, 9 aa, Homo sapiens
  Light chain CDR3 for antibody 4550 (IGKV1D-16)
QQYNSYPYT

SEQ ID NO: 9100 - protein, 19 aa, Homo sapiens
  Heavy chain CDR3 for antibody 4550 (IGHV3-33)
ARVLDGLSPPYYYYDGLDV

SEQ ID NO: 9101 - protein, 9 aa, Homo sapiens
  Light chain CDR3 for antibody 4551 (IGKV6-21)
HQSSSLPYT

SEQ ID NO: 9102 - protein, 16 aa, Homo sapiens
  Heavy chain CDR3 for antibody 4551 (IGHV3-30)
ARDSSYYGSGYYGMDV

SEQ ID NO: 9103 - protein, 9 aa, Homo sapiens
  Light chain CDR3 for antibody 4552 (IGKV1-17)
QQRSNWMYT

SEQ ID NO: 9104 - protein, 12 aa, Homo sapiens
  Heavy chain CDR3 for antibody 4552 (IGHV3-23)
AKEGLGSDYESY

SEQ ID NO: 9105 - protein, 9 aa, Homo sapiens
  Light chain CDR3 for antibody 4553 (IGKV1-16)
QQYNSYPYT

SEQ ID NO: 9106 - protein, 16 aa, Homo sapiens
  Heavy chain CDR3 for antibody 4553 (IGHV1-18)
TRGTFYYGSGSSFFDY

SEQ ID NO: 9107 - protein, 9 aa, Homo sapiens
  Light chain CDR3 for antibody 4554 (IGKV1-39)
QQSYSTPLT

SEQ ID NO: 9108 - protein, 18 aa, Homo sapiens
  Heavy chain CDR3 for antibody 4554 (IGHV3-33)
ARKGGYYSGSGSYRHFDF

SEQ ID NO: 9109 - protein, 9 aa, Homo sapiens
  Light chain CDR3 for antibody 4555 (IGKV1D-16)
QQYNSYPLT

SEQ ID NO: 9110 - protein, 12 aa, Homo sapiens
  Heavy chain CDR3 for antibody 4555 (IGHV3-33)
ARESGGSFGMDV

SEQ ID NO: 9111 - protein, 11 aa, Homo sapiens
  Light chain CDR3 for antibody 4556 (IGKV3-11)
QQRSNWPPTWT

SEQ ID NO: 9112 - protein, 26 aa, Homo sapiens
  Heavy chain CDR3 for antibody 4556 (IGHV4-39)
ARQGLLWFGDLKAYDSSGYYYGYFHH

SEQ ID NO: 9113 - protein, 9 aa, Homo sapiens
  Light chain CDR3 for antibody 4557 (IGKV1-6)
QQYNSFPLT

SEQ ID NO: 9114 - protein, 13 aa, Homo sapiens
  Heavy chain CDR3 for antibody 4557 (IGHV4-34)
ASNFYYYYYGMNV

SEQ ID NO: 9115 - protein, 9 aa, Homo sapiens
  Light chain CDR3 for antibody 4558 (IGKV2D-24)
TQATQFPHT

SEQ ID NO: 9116 - protein, 15 aa, Homo sapiens
  Heavy chain CDR3 for antibody 4558 (IGHV1-18)
ARGYCSSTSCYYFDY

SEQ ID NO: 9117 - protein, 9 aa, Homo sapiens
  Light chain CDR3 for antibody 4559 (IGKV1-33)
QQYDNLPFT

SEQ ID NO: 9118 - protein, 17 aa, Homo sapiens
  Heavy chain CDR3 for antibody 4559 (IGHV3-33)
ARGEQWLGYYYYYGMDV

SEQ ID NO: 9119 - protein, 8 aa, Homo sapiens
  Light chain CDR3 for antibody 4560 (IGKV1D-13)
QQFNNYPT

SEQ ID NO: 9120 - protein, 17 aa, Homo sapiens
  Heavy chain CDR3 for antibody 4560 (IGHV3-33)
VREGGLLWVGELSLFDY

SEQ ID NO: 9121 - protein, 9 aa, Homo sapiens
  Light chain CDR3 for antibody 4561 (IGKV1-6)
LQDYNYPWT

SEQ ID NO: 9122 - protein, 8 aa, Homo sapiens
  Heavy chain CDR3 for antibody 4561 (IGHV3-33)
ARDDPPRY

SEQ ID NO: 9123 - protein, 9 aa, Homo sapiens
  Light chain CDR3 for antibody 4562 (IGKV1-9)
QQYNSYPYT

SEQ ID NO: 9124 - protein, 22 aa, Homo sapiens
  Heavy chain CDR3 for antibody 4562 (IGHV1-18)
ARDRYNNQSKYRNRDYYYGLDV

SEQ ID NO: 9125 - protein, 8 aa, Homo sapiens
  Light chain CDR3 for antibody 4563 (IGKV1-5)
QQYNSYYT

SEQ ID NO: 9126 - protein, 13 aa, Homo sapiens
  Heavy chain CDR3 for antibody 4563 (IGHV4-39)
ARHVLLWFGEFDP

SEQ ID NO: 9127 - protein, 9 aa, Homo sapiens
  Light chain CDR3 for antibody 4564 (IGKV6-21)
HQSSSLPLT

SEQ ID NO: 9128 - protein, 12 aa, Homo sapiens
  Heavy chain CDR3 for antibody 4564 (IGHV3-33)
ARDPGYFFGLDV

SEQ ID NO: 9129 - protein, 10 aa, Homo sapiens
  Light chain CDR3 for antibody 4565 (IGKV1-17)
LQHNSYPMYT

SEQ ID NO: 9130 - protein, 13 aa, Homo sapiens
  Heavy chain CDR3 for antibody 4565 (IGHV3-23)
AKDRGLRYYGMDV

SEQ ID NO: 9131 - protein, 8 aa, Homo sapiens
  Light chain CDR3 for antibody 4566 (IGKV1D-13)
QQFNNYPT

SEQ ID NO: 9132 - protein, 13 aa, Homo sapiens
  Heavy chain CDR3 for antibody 4566 (IGHV3-33)
ARVDTMVRGVMAY

SEQ ID NO: 9133 - protein, 8 aa, Homo sapiens
  Light chain CDR3 for antibody 4567 (IGKV3-15)
QQYNNWPT

SEQ ID NO: 9134 - protein, 9 aa, Homo sapiens
  Heavy chain CDR3 for antibody 4567 (IGHV4-59)
AREGGSGSL

SEQ ID NO: 9135 - protein, 8 aa, Homo sapiens
  Light chain CDR3 for antibody 4568 (IGKV3D-7)
QQDYNLLT

SEQ ID NO: 9136 - protein, 18 aa, Homo sapiens
  Heavy chain CDR3 for antibody 4568 (IGHV3-33)
ARDRDRYGSGTYPDAIDI

SEQ ID NO: 9137 - protein, 9 aa, Homo sapiens
  Light chain CDR3 for antibody 4569 (IGKV6-21)
HQSSSLPYT

SEQ ID NO: 9138 - protein, 16 aa, Homo sapiens
  Heavy chain CDR3 for antibody 4569 (IGHV3-33)
ARGANYYGSGIPNFEY

SEQ ID NO: 9139 - protein, 9 aa, Homo sapiens
  Light chain CDR3 for antibody 4570 (IGKV3D-7)
QQDYNLPYT

SEQ ID NO: 9140 - protein, 14 aa, Homo sapiens
  Heavy chain CDR3 for antibody 4570 (IGHV4-39)
ARQGTMIRGGYFDY

SEQ ID NO: 9141 - protein, 9 aa, Homo sapiens
  Light chain CDR3 for antibody 4571 (IGKV3-15)
QQYNNWPLT

SEQ ID NO: 9142 - protein, 17 aa, Homo sapiens
  Heavy chain CDR3 for antibody 4571 (IGHV4-34)
AGLRFFDWLFDYYGMDV

SEQ ID NO: 9143 - protein, 10 aa, Homo sapiens
  Light chain CDR3 for antibody 4572 (IGKV1-39)
QQSYSTPMYT

SEQ ID NO: 9144 - protein, 17 aa, Homo sapiens
  Heavy chain CDR3 for antibody 4572 (IGHV1-18)
ARDRAFTMVRGVPPFDY

SEQ ID NO: 9145 - protein, 9 aa, Homo sapiens
  Light chain CDR3 for antibody 4573 (IGKV1-17)
LQHNSYPWT

SEQ ID NO: 9146 - protein, 9 aa, Homo sapiens
  Heavy chain CDR3 for antibody 4573 (IGHV1-18)
ARGGWGFEY

SEQ ID NO: 9147 - protein, 8 aa, Homo sapiens
  Light chain CDR3 for antibody 4574 (IGKV3-11)
QQRSNWLT

SEQ ID NO: 9148 - protein, 17 aa, Homo sapiens
  Heavy chain CDR3 for antibody 4574 (IGHV1-18)
ARDEGYDILTGYPHFDY

SEQ ID NO: 9149 - protein, 9 aa, Homo sapiens
  Light chain CDR3 for antibody 4575 (IGKV3-11)
QQRSNWPPT

SEQ ID NO: 9150 - protein, 14 aa, Homo sapiens
  Heavy chain CDR3 for antibody 4575 (IGHV3-33)
ARAGSGYDRDWFDP

SEQ ID NO: 9151 - protein, 9 aa, Homo sapiens
  Light chain CDR3 for antibody 4576 (IGKV1D-13)
QQFNNYPYT

SEQ ID NO: 9152 - protein, 10 aa, Homo sapiens
  Heavy chain CDR3 for antibody 4576 (IGHV3-33)
AREWFGGFDI

SEQ ID NO: 9153 - protein, 10 aa, Homo sapiens
  Light chain CDR3 for antibody 4577 (IGKV3-11)
QQRSNWPIFT

SEQ ID NO: 9154 - protein, 10 aa, Homo sapiens
  Heavy chain CDR3 for antibody 4577 (IGHV3-30)
AREWYGGMDV

SEQ ID NO: 9155 - protein, 10 aa, Homo sapiens
  Light chain CDR3 for antibody 4578 (IGKV3-11)
QQRSNWPIFT

SEQ ID NO: 9156 - protein, 12 aa, Homo sapiens
  Heavy chain CDR3 for antibody 4578 (IGHV4-59)
ARDRSGWAYFDY

SEQ ID NO: 9157 - protein, 9 aa, Homo sapiens
  Light chain CDR3 for antibody 4579 (IGKV1-33)
QQYDNLPFT

SEQ ID NO: 9158 - protein, 11 aa, Homo sapiens
  Heavy chain CDR3 for antibody 4579 (IGHV3-33)
ARDILTGFLDH

SEQ ID NO: 9159 - protein, 9 aa, Homo sapiens
  Light chain CDR3 for antibody 4580 (IGKV2D-28)
MQVLQTPFT

SEQ ID NO: 9160 - protein, 16 aa, Homo sapiens
  Heavy chain CDR3 for antibody 4580 (IGHV4-59)
ARDTPYYSGSGRPFDS

SEQ ID NO: 9161 - protein, 9 aa, Homo sapiens
  Light chain CDR3 for antibody 4581 (IGKV5-2)
LQHDNFPWT

SEQ ID NO: 9162 - protein, 14 aa, Homo sapiens
  Heavy chain CDR3 for antibody 4581 (IGHV3-33)
ARDRGRHNYFGMDV

SEQ ID NO: 9163 - protein, 9 aa, Homo sapiens
  Light chain CDR3 for antibody 4582 (IGKV3-20)
QQYGSSPYT

SEQ ID NO: 9164 - protein, 9 aa, Homo sapiens
  Heavy chain CDR3 for antibody 4582 (IGHV3-30)
ARGRVSLDV

SEQ ID NO: 9165 - protein, 9 aa, Homo sapiens
  Light chain CDR3 for antibody 4583 (IGKV5-2)
LQHDKFPYT

SEQ ID NO: 9166 - protein, 14 aa, Homo sapiens
  Heavy chain CDR3 for antibody 4583 (IGHV3-33)
ARGYGSGSYYSFDY

SEQ ID NO: 9167 - protein, 9 aa, Homo sapiens
  Light chain CDR3 for antibody 4584 (IGKV1-39)
QQSYSTPLT

SEQ ID NO: 9168 - protein, 11 aa, Homo sapiens
  Heavy chain CDR3 for antibody 4584 (IGHV4-59)
VRERGYYGMDV

SEQ ID NO: 9169 - protein, 9 aa, Homo sapiens
  Light chain CDR3 for antibody 4585 (IGKV1-6)
LQDYNYPYT

SEQ ID NO: 9170 - protein, 20 aa, Homo sapiens
  Heavy chain CDR3 for antibody 4585 (IGHV3-33)
ARTMGSGSYYKAYYYYVMDV

SEQ ID NO: 9171 - protein, 8 aa, Homo sapiens
  Light chain CDR3 for antibody 4586 (IGKV3-11)
QQRSNWLT

SEQ ID NO: 9172 - protein, 16 aa, Homo sapiens
  Heavy chain CDR3 for antibody 4586 (IGHV1-24)
ATEDSSSYYYYYGMDV

SEQ ID NO: 9173 - protein, 9 aa, Homo sapiens
  Light chain CDR3 for antibody 4587 (IGKV3-11)
QQRINWPWT

SEQ ID NO: 9174 - protein, 13 aa, Homo sapiens
  Heavy chain CDR3 for antibody 4587 (IGHV4-39)
ARRDVLAPAAFDY

SEQ ID NO: 9175 - protein, 9 aa, Homo sapiens
  Light chain CDR3 for antibody 4588 (IGKV1-9)
QQVKSYPYT

SEQ ID NO: 9176 - protein, 14 aa, Homo sapiens
  Heavy chain CDR3 for antibody 4588 (IGHV3-33)
ARDWNDVYYYGMDV

SEQ ID NO: 9177 - protein, 9 aa, Homo sapiens
  Light chain CDR3 for antibody 4589 (IGKV1D-13)
QQFNNYPHT

SEQ ID NO: 9178 - protein, 12 aa, Homo sapiens
  Heavy chain CDR3 for antibody 4589 (IGHV3-33)
AREGTGGNWFDP

SEQ ID NO: 9179 - protein, 9 aa, Homo sapiens
  Light chain CDR3 for antibody 4590 (IGKV3D-7)
QQDYNLPYT

SEQ ID NO: 9180 - protein, 14 aa, Homo sapiens
  Heavy chain CDR3 for antibody 4590 (IGHV3-33)
ARAGSGYDRDWFDP

SEQ ID NO: 9181 - protein, 9 aa, Homo sapiens
  Light chain CDR3 for antibody 4591 (IGKV1D-16)
QQYNSYPYT

SEQ ID NO: 9182 - protein, 12 aa, Homo sapiens
  Heavy chain CDR3 for antibody 4591 (IGHV1-18)
ARAPYNWNDPDY

SEQ ID NO: 9183 - protein, 9 aa, Homo sapiens
  Light chain CDR3 for antibody 4592 (IGKV1-9)
QQLNGYPFT

SEQ ID NO: 9184 - protein, 11 aa, Homo sapiens
  Heavy chain CDR3 for antibody 4592 (IGHV3-33)
ARARYTTGLDY

SEQ ID NO: 9185 - protein, 10 aa, Homo sapiens
  Light chain CDR3 for antibody 4593 (IGKV1-17)
LQHNSYPMYT

SEQ ID NO: 9186 - protein, 15 aa, Homo sapiens
  Heavy chain CDR3 for antibody 4593 (IGHV3-33)
ARGYYYGSGSFPVDY

SEQ ID NO: 9187 - protein, 8 aa, Homo sapiens
  Light chain CDR3 for antibody 4594 (IGKV3-20)
QQYGRSFT

SEQ ID NO: 9188 - protein, 13 aa, Homo sapiens
  Heavy chain CDR3 for antibody 4594 (IGHV3-33)
ARDWGYSHGYFDY

SEQ ID NO: 9189 - protein, 9 aa, Homo sapiens
  Light chain CDR3 for antibody 4595 (IGKV6-21)
HQSTSLPFT

SEQ ID NO: 9190 - protein, 14 aa, Homo sapiens
  Heavy chain CDR3 for antibody 4595 (IGHV4-39)
ARDSGYDYYYAMDV

SEQ ID NO: 9191 - protein, 9 aa, Homo sapiens
  Light chain CDR3 for antibody 4596 (IGKV1-39)
QQSYSTPLT

SEQ ID NO: 9192 - protein, 18 aa, Homo sapiens
  Heavy chain CDR3 for antibody 4596 (IGHV1-18)
ARDPNYYGSGSYYNYFDY

SEQ ID NO: 9193 - protein, 9 aa, Homo sapiens
  Light chain CDR3 for antibody 4597 (IGKV6-21)
HQSSSLPYT

SEQ ID NO: 9194 - protein, 16 aa, Homo sapiens
  Heavy chain CDR3 for antibody 4597 (IGHV3-33)
ARPTYYDILTGYPFDY

SEQ ID NO: 9195 - protein, 9 aa, Homo sapiens
  Light chain CDR3 for antibody 4598 (IGKV6-21)
HQSSSLPYT

SEQ ID NO: 9196 - protein, 15 aa, Homo sapiens
  Heavy chain CDR3 for antibody 4598 (IGHV1-18)
ARRSPNWGHYYGMDV

SEQ ID NO: 9197 - protein, 9 aa, Homo sapiens
  Light chain CDR3 for antibody 4599 (IGKV3-20)
QQYGSSPYT

SEQ ID NO: 9198 - protein, 18 aa, Homo sapiens
  Heavy chain CDR3 for antibody 4599 (IGHV3-33)
AREGYDILTGYYNVKFDY

SEQ ID NO: 9199 - protein, 9 aa, Homo sapiens
  Light chain CDR3 for antibody 4600 (IGKV6-21)
HQSSSLPYT

SEQ ID NO: 9200 - protein, 11 aa, Homo sapiens
  Heavy chain CDR3 for antibody 4600 (IGHV4-39)
ARLLVGATTDY

SEQ ID NO: 9201 - protein, 9 aa, Homo sapiens
  Light chain CDR3 for antibody 4601 (IGKV2-30)
MQGTHWPLT

SEQ ID NO: 9202 - protein, 16 aa, Homo sapiens
  Heavy chain CDR3 for antibody 4601 (IGHV3-23)
ARNWNDVGDYYYGMDV

SEQ ID NO: 9203 - protein, 9 aa, Homo sapiens
  Light chain CDR3 for antibody 4602 (IGKV3-11)
QQRSNWPPT

SEQ ID NO: 9204 - protein, 20 aa, Homo sapiens
  Heavy chain CDR3 for antibody 4602 (IGHV3-11)
ARGGATLIRGLIDYYYGMDV

SEQ ID NO: 9205 - protein, 9 aa, Homo sapiens
  Light chain CDR3 for antibody 4603 (IGKV1-9)
QQLISYPLT

SEQ ID NO: 9206 - protein, 15 aa, Homo sapiens
  Heavy chain CDR3 for antibody 4603 (IGHV3-33)
ARRGYNDYDPYGMDV

SEQ ID NO: 9207 - protein, 8 aa, Homo sapiens
  Light chain CDR3 for antibody 4604 (IGKV3-15)
QQYNNWPT

SEQ ID NO: 9208 - protein, 13 aa, Homo sapiens
  Heavy chain CDR3 for antibody 4604 (IGHV3-33)
ARKAYGDYFYFDY

SEQ ID NO: 9209 - protein, 9 aa, Homo sapiens
  Light chain CDR3 for antibody 4605 (IGKV3D-7)
QQDYNLPYT

SEQ ID NO: 9210 - protein, 13 aa, Homo sapiens
  Heavy chain CDR3 for antibody 4605 (IGHV1-24)
ATSMITFGGAFDY

SEQ ID NO: 9211 - protein, 9 aa, Homo sapiens
  Light chain CDR3 for antibody 4606 (IGKV6-21)
HQSSSLPHT

SEQ ID NO: 9212 - protein, 10 aa, Homo sapiens
  Heavy chain CDR3 for antibody 4606 (IGHV3-33)
ARDPWIYSGY

SEQ ID NO: 9213 - protein, 9 aa, Homo sapiens
  Light chain CDR3 for antibody 4607 (IGKV1D-13)
QQFNNYPHT

SEQ ID NO: 9214 - protein, 11 aa, Homo sapiens
  Heavy chain CDR3 for antibody 4607 (IGHV3-23)
AKAGIVGCLDV

SEQ ID NO: 9215 - protein, 9 aa, Homo sapiens
  Light chain CDR3 for antibody 4608 (IGKV2D-28)
MQALQTPPT

SEQ ID NO: 9216 - protein, 14 aa, Homo sapiens
  Heavy chain CDR3 for antibody 4608 (IGHV3-33)
ARGAAAGNFYGLDV

SEQ ID NO: 9217 - protein, 9 aa, Homo sapiens
  Light chain CDR3 for antibody 4609 (IGKV1-27)
QKYNSAPYT

SEQ ID NO: 9218 - protein, 12 aa, Homo sapiens
  Heavy chain CDR3 for antibody 4609 (IGHV4-39)
ARHGSGSSYFDY

SEQ ID NO: 9219 - protein, 8 aa, Homo sapiens
  Light chain CDR3 for antibody 4610 (IGKV3-11)
QQRSNWLT

SEQ ID NO: 9220 - protein, 17 aa, Homo sapiens
  Heavy chain CDR3 for antibody 4610 (IGHV4-59)
ARDFLVRGEGSYYGMDV

SEQ ID NO: 9221 - protein, 9 aa, Homo sapiens
  Light chain CDR3 for antibody 4611 (IGKV3-11)
QQRSNWPLT

SEQ ID NO: 9222 - protein, 18 aa, Homo sapiens
  Heavy chain CDR3 for antibody 4611 (IGHV3-30)
ARDRHHDILTGYSDAFEI

SEQ ID NO: 9223 - protein, 9 aa, Homo sapiens
  Light chain CDR3 for antibody 4612 (IGKV1-9)
QQLNSYPLT

SEQ ID NO: 9224 - protein, 12 aa, Homo sapiens
  Heavy chain CDR3 for antibody 4612 (IGHV3-23)
AKEGLGSDYESY

SEQ ID NO: 9225 - protein, 10 aa, Homo sapiens
  Light chain CDR3 for antibody 4613 (IGKV3-11)
QQRSNWPIFT

SEQ ID NO: 9226 - protein, 15 aa, Homo sapiens
  Heavy chain CDR3 for antibody 4613 (IGHV3-66)
ARDSRPEITGPPFDY

SEQ ID NO: 9227 - protein, 9 aa, Homo sapiens
  Light chain CDR3 for antibody 4614 (IGKV1D-13)
QQFNNYPYT

SEQ ID NO: 9228 - protein, 17 aa, Homo sapiens
  Heavy chain CDR3 for antibody 4614 (IGHV1-8)
ARGDYYGSGSPYWYFDL

SEQ ID NO: 9229 - protein, 9 aa, Homo sapiens
  Light chain CDR3 for antibody 4615 (IGKV1-17)
LQHNSYPYT

SEQ ID NO: 9230 - protein, 14 aa, Homo sapiens
  Heavy chain CDR3 for antibody 4615 (IGHV3-33)
ARDGIVRATDAFAI

SEQ ID NO: 9231 - protein, 9 aa, Homo sapiens
  Light chain CDR3 for antibody 4616 (IGKV1-27)
QKYNSAPYT

SEQ ID NO: 9232 - protein, 23 aa, Homo sapiens
  Heavy chain CDR3 for antibody 4616 (IGHV3-11)
ARDEGVTMVRGVISYYYYYGMDV

SEQ ID NO: 9233 - protein, 9 aa, Homo sapiens
  Light chain CDR3 for antibody 4617 (IGKV5-2)
LQHDNFPYT

SEQ ID NO: 9234 - protein, 11 aa, Homo sapiens
  Heavy chain CDR3 for antibody 4617 (IGHV4-59)
ARSLRYSFFDY

SEQ ID NO: 9235 - protein, 9 aa, Homo sapiens
  Light chain CDR3 for antibody 4618 (IGKV5-2)
LQHDKFPYT

SEQ ID NO: 9236 - protein, 16 aa, Homo sapiens
  Heavy chain CDR3 for antibody 4618 (IGHV3-64)
ARGRYFDWLLGDWFDP

SEQ ID NO: 9237 - protein, 9 aa, Homo sapiens
  Light chain CDR3 for antibody 4619 (IGKV1-5)
QQYNSYPYT

SEQ ID NO: 9238 - protein, 13 aa, Homo sapiens
  Heavy chain CDR3 for antibody 4619 (IGHV4-61)
ASRYSSGWYPFDY

SEQ ID NO: 9239 - protein, 9 aa, Homo sapiens
  Light chain CDR3 for antibody 4620 (IGKV1-6)
LQDYNYPYT

SEQ ID NO: 9240 - protein, 14 aa, Homo sapiens
  Heavy chain CDR3 for antibody 4620 (IGHV3-64)
ARGGGAVTGTNFDY

SEQ ID NO: 9241 - protein, 9 aa, Homo sapiens
  Light chain CDR3 for antibody 4621 (IGKV1-9)
QQYNTYSRT

SEQ ID NO: 9242 - protein, 12 aa, Homo sapiens
  Heavy chain CDR3 for antibody 4621 (IGHV3-13)
VREAGIPDAFDI

SEQ ID NO: 9243 - protein, 9 aa, Homo sapiens
  Light chain CDR3 for antibody 4622 (IGKV2-30)
MQGTHWPLT

SEQ ID NO: 9244 - protein, 8 aa, Homo sapiens
  Heavy chain CDR3 for antibody 4622 (IGHV3-33)
ARDRGFDY

SEQ ID NO: 9245 - protein, 8 aa, Homo sapiens
  Light chain CDR3 for antibody 4623 (IGKV3-20)
QQYGRSFT

SEQ ID NO: 9246 - protein, 14 aa, Homo sapiens
  Heavy chain CDR3 for antibody 4623 (IGHV4-39)
ARDSGYDYYYGMDV

SEQ ID NO: 9247 - protein, 9 aa, Homo sapiens
  Light chain CDR3 for antibody 4624 (IGKV1-39)
QQSYSTPWT

SEQ ID NO: 9248 - protein, 14 aa, Homo sapiens
  Heavy chain CDR3 for antibody 4624 (IGHV3-33)
ARDKSYPLSYGMDV

SEQ ID NO: 9249 - protein, 9 aa, Homo sapiens
  Light chain CDR3 for antibody 4625 (IGKV3D-7)
QQDYNLPLT

SEQ ID NO: 9250 - protein, 15 aa, Homo sapiens
  Heavy chain CDR3 for antibody 4625 (IGHV3-23)
AKDGGWNYYYYGMDV

SEQ ID NO: 9251 - protein, 9 aa, Homo sapiens
  Light chain CDR3 for antibody 4626 (IGKV6-21)
HQSSSLPYT

SEQ ID NO: 9252 - protein, 10 aa, Homo sapiens
  Heavy chain CDR3 for antibody 4626 (IGHV3-33)
ARDLRADFDY

SEQ ID NO: 9253 - protein, 9 aa, Homo sapiens
  Light chain CDR3 for antibody 4627 (IGKV2-30)
MQGTHWPLT

SEQ ID NO: 9254 - protein, 18 aa, Homo sapiens
  Heavy chain CDR3 for antibody 4627 (IGHV3-33)
ARGGYSSGWDYYYYGMDV

SEQ ID NO: 9255 - protein, 9 aa, Homo sapiens
  Light chain CDR3 for antibody 4628 (IGKV1-39)
QQSYSTPLT

SEQ ID NO: 9256 - protein, 8 aa, Homo sapiens
  Heavy chain CDR3 for antibody 4628 (IGHV3-23)
AKESLLDY

SEQ ID NO: 9257 - protein, 9 aa, Homo sapiens
  Light chain CDR3 for antibody 4629 (IGKV1-6)
LQDYNYPWT

SEQ ID NO: 9258 - protein, 14 aa, Homo sapiens
  Heavy chain CDR3 for antibody 4629 (IGHV3-23)
AKGGDILTGYYTDY

SEQ ID NO: 9259 - protein, 9 aa, Homo sapiens
  Light chain CDR3 for antibody 4630 (IGKV1D-16)
QQYNSYPLT

SEQ ID NO: 9260 - protein, 16 aa, Homo sapiens
  Heavy chain CDR3 for antibody 4630 (IGHV4-39)
ARHPLILTGYPNWFDP

SEQ ID NO: 9261 - protein, 9 aa, Homo sapiens
  Light chain CDR3 for antibody 4631 (IGKV1-17)
LQHNSYPWT

SEQ ID NO: 9262 - protein, 17 aa, Homo sapiens
  Heavy chain CDR3 for antibody 4631 (IGHV4-39)
AGRLTYYYGSGSPSFDY

SEQ ID NO: 9263 - protein, 9 aa, Homo sapiens
  Light chain CDR3 for antibody 4632 (IGKV1D-13)
QQFNNYPHT

SEQ ID NO: 9264 - protein, 17 aa, Homo sapiens
  Heavy chain CDR3 for antibody 4632 (IGHV4-39)
ARQGWYYGSGSSLLFDY

SEQ ID NO: 9265 - protein, 9 aa, Homo sapiens
  Light chain CDR3 for antibody 4633 (IGKV3-20)
QQYGSSPYT

SEQ ID NO: 9266 - protein, 11 aa, Homo sapiens
  Heavy chain CDR3 for antibody 4633 (IGHV3-33)
ARDQGGSSFDY

SEQ ID NO: 9267 - protein, 9 aa, Homo sapiens
  Light chain CDR3 for antibody 4634 (IGKV2-30)
MQGTHWPLT

SEQ ID NO: 9268 - protein, 18 aa, Homo sapiens
  Heavy chain CDR3 for antibody 4634 (IGHV3-33)
ARERGYYGSDIYPAAFDI

SEQ ID NO: 9269 - protein, 8 aa, Homo sapiens
  Light chain CDR3 for antibody 4635 (IGKV6-21)
HQSSSLPT

SEQ ID NO: 9270 - protein, 12 aa, Homo sapiens
  Heavy chain CDR3 for antibody 4635 (IGHV4-39)
ARHGSGSSYFDY

SEQ ID NO: 9271 - protein, 9 aa, Homo sapiens
  Light chain CDR3 for antibody 4636 (IGKV3-20)
QQYGSSPYT

SEQ ID NO: 9272 - protein, 9 aa, Homo sapiens
  Heavy chain CDR3 for antibody 4636 (IGHV3-33)
AANSYGLDY

SEQ ID NO: 9273 - protein, 9 aa, Homo sapiens
  Light chain CDR3 for antibody 4637 (IGKV1-17)
LQHNSYPPT

SEQ ID NO: 9274 - protein, 18 aa, Homo sapiens
  Heavy chain CDR3 for antibody 4637 (IGHV3-33)
VREGGYYGSGSYPDAFDI

SEQ ID NO: 9275 - protein, 9 aa, Homo sapiens
  Light chain CDR3 for antibody 4638 (IGKV1-9)
QQLKSYLYT

SEQ ID NO: 9276 - protein, 20 aa, Homo sapiens
  Heavy chain CDR3 for antibody 4638 (IGHV3-20)
ARDLCSSTSCYGYYYYGMDV

SEQ ID NO: 9277 - protein, 8 aa, Homo sapiens
  Light chain CDR3 for antibody 4639 (IGKV3-20)
QQYGRSFT

SEQ ID NO: 9278 - protein, 13 aa, Homo sapiens
  Heavy chain CDR3 for antibody 4639 (IGHV4-39)
ARHEVMIRGVFDY

SEQ ID NO: 9279 - protein, 9 aa, Homo sapiens
  Light chain CDR3 for antibody 4640 (IGKV6-21)
HQSSSLPYT

SEQ ID NO: 9280 - protein, 17 aa, Homo sapiens
  Heavy chain CDR3 for antibody 4640 (IGHV3-33)
ARENDILTGSYYYGMDV

SEQ ID NO: 9281 - protein, 9 aa, Homo sapiens
  Light chain CDR3 for antibody 4641 (IGKV2-30)
MQGTHWPLT

SEQ ID NO: 9282 - protein, 17 aa, Homo sapiens
  Heavy chain CDR3 for antibody 4641 (IGHV3-23)
AKDGSFYSSGWYDAFDI

SEQ ID NO: 9283 - protein, 9 aa, Homo sapiens
  Light chain CDR3 for antibody 4642 (IGKV6-21)
HQSSSLPYT

SEQ ID NO: 9284 - protein, 20 aa, Homo sapiens
  Heavy chain CDR3 for antibody 4642 (IGHV3-33)
ARDLGWATMVRGVIRAPFDY

SEQ ID NO: 9285 - protein, 9 aa, Homo sapiens
  Light chain CDR3 for antibody 4643 (IGKV1-16)
QQYNRYPYT

SEQ ID NO: 9286 - protein, 13 aa, Homo sapiens
  Heavy chain CDR3 for antibody 4643 (IGHV4-39)
ARHHYGSGSLRDY

SEQ ID NO: 9287 - protein, 8 aa, Homo sapiens
  Light chain CDR3 for antibody 4644 (IGKV3-11)
LQRGNWPT

SEQ ID NO: 9288 - protein, 13 aa, Homo sapiens
  Heavy chain CDR3 for antibody 4644 (IGHV3-33)
ARDYCGGDCYLDY

SEQ ID NO: 9289 - protein, 9 aa, Homo sapiens
  Light chain CDR3 for antibody 4645 (IGKV1-16)
QQYDSYPPT

SEQ ID NO: 9290 - protein, 17 aa, Homo sapiens
  Heavy chain CDR3 for antibody 4645 (IGHV4-59)
ARDFLVRGEGSYYGMDV

SEQ ID NO: 9291 - protein, 9 aa, Homo sapiens
  Light chain CDR3 for antibody 4646 (IGKV1-6)
LQDYKSPFT

SEQ ID NO: 9292 - protein, 8 aa, Homo sapiens
  Heavy chain CDR3 for antibody 4646 (IGHV3-23)
AETFLFDY

SEQ ID NO: 9293 - protein, 9 aa, Homo sapiens
  Light chain CDR3 for antibody 4647 (IGKV1-9)
QQLNSYPLT

SEQ ID NO: 9294 - protein, 20 aa, Homo sapiens
  Heavy chain CDR3 for antibody 4647 (IGHV3-33)
ARDNDSSGYYDYYYYYGMDV

SEQ ID NO: 9295 - protein, 9 aa, Homo sapiens
  Light chain CDR3 for antibody 4648 (IGKV2-30)
MQGTHWPLT

SEQ ID NO: 9296 - protein, 16 aa, Homo sapiens
  Heavy chain CDR3 for antibody 4648 (IGHV1-24)
ATEDSSSTYYYYGLDV

SEQ ID NO: 9297 - protein, 8 aa, Homo sapiens
  Light chain CDR3 for antibody 4649 (IGKV1-5)
QQYNSYWT

SEQ ID NO: 9298 - protein, 14 aa, Homo sapiens
  Heavy chain CDR3 for antibody 4649 (IGHV3-33)
ARQYSYGYPYYFDY

SEQ ID NO: 9299 - protein, 9 aa, Homo sapiens
  Light chain CDR3 for antibody 4650 (IGKV1-27)
QKYNSAPHT

SEQ ID NO: 9300 - protein, 14 aa, Homo sapiens
  Heavy chain CDR3 for antibody 4650 (IGHV3-33)
ARAGSGYDRDWFDP

SEQ ID NO: 9301 - protein, 9 aa, Homo sapiens
  Light chain CDR3 for antibody 4651 (IGKV3D-20)
QQYGSSPYT

SEQ ID NO: 9302 - protein, 11 aa, Homo sapiens
  Heavy chain CDR3 for antibody 4651 (IGHV4-39)
ARLLVGATTDY

SEQ ID NO: 9303 - protein, 9 aa, Homo sapiens
  Light chain CDR3 for antibody 4652 (IGKV1-27)
QKYNSAPYT

SEQ ID NO: 9304 - protein, 16 aa, Homo sapiens
  Heavy chain CDR3 for antibody 4652 (IGHV3-33)
AREGGLIAAAGTGFDY

SEQ ID NO: 9305 - protein, 9 aa, Homo sapiens
  Light chain CDR3 for antibody 4653 (IGKV1D-13)
QQFNNYPYT

SEQ ID NO: 9306 - protein, 11 aa, Homo sapiens
  Heavy chain CDR3 for antibody 4653 (IGHV4-4)
ARDGVRGVFDI

SEQ ID NO: 9307 - protein, 9 aa, Homo sapiens
  Light chain CDR3 for antibody 4654 (IGKV3-11)
QQRSNWPPT

SEQ ID NO: 9308 - protein, 17 aa, Homo sapiens
  Heavy chain CDR3 for antibody 4654 (IGHV3-64)
ARERYYGSGSYYNWFDP

SEQ ID NO: 9309 - protein, 9 aa, Homo sapiens
  Light chain CDR3 for antibody 4655 (IGKV6-21)
HQSSSLPYT

SEQ ID NO: 9310 - protein, 14 aa, Homo sapiens
  Heavy chain CDR3 for antibody 4655 (IGHV3-33)
ARDGIVRATDAFAI

SEQ ID NO: 9311 - protein, 11 aa, Homo sapiens
  Light chain CDR3 for antibody 4656 (IGKV3-11)
QQRSNWPPTWT

SEQ ID NO: 9312 - protein, 14 aa, Homo sapiens
  Heavy chain CDR3 for antibody 4656 (IGHV3-33)
ARDWNDVYYYGMDV

SEQ ID NO: 9313 - protein, 9 aa, Homo sapiens
  Light chain CDR3 for antibody 4657 (IGKV4-1)
QQYYSTPWT

SEQ ID NO: 9314 - protein, 14 aa, Homo sapiens
  Heavy chain CDR3 for antibody 4657 (IGHV3-33)
ARGAAAGNFYGLDV

SEQ ID NO: 9315 - protein, 9 aa, Homo sapiens
  Light chain CDR3 for antibody 4658 (IGKV1-39)
QQSYSTPLT

SEQ ID NO: 9316 - protein, 15 aa, Homo sapiens
  Heavy chain CDR3 for antibody 4658 (IGHV3-11)
AREYSSGWYGDAFDI

SEQ ID NO: 9317 - protein, 8 aa, Homo sapiens
  Light chain CDR3 for antibody 4659 (IGKV1D-13)
QQFNNYPT

SEQ ID NO: 9318 - protein, 14 aa, Homo sapiens
  Heavy chain CDR3 for antibody 4659 (IGHV3-33)
ARAISGSSYWYFDL

SEQ ID NO: 9319 - protein, 8 aa, Homo sapiens
  Light chain CDR3 for antibody 4660 (IGKV1D-13)
QQFNNYPT

SEQ ID NO: 9320 - protein, 17 aa, Homo sapiens
  Heavy chain CDR3 for antibody 4660 (IGHV3-33)
ARVYYDILTGYSPAFDI

SEQ ID NO: 9321 - protein, 7 aa, Homo sapiens
  Light chain CDR3 for antibody 4661 (IGKV1-17)
LQHNSYP

SEQ ID NO: 9322 - protein, 18 aa, Homo sapiens
  Heavy chain CDR3 for antibody 4661 (IGHV1-46)
ARDGDYVWGSYRSDWFDP

SEQ ID NO: 9323 - protein, 11 aa, Homo sapiens
  Light chain CDR3 for antibody 4662 (IGKV3-11)
QQRSNWPPTWT

SEQ ID NO: 9324 - protein, 18 aa, Homo sapiens
  Heavy chain CDR3 for antibody 4662 (IGHV4-39)
ARQYYFGSGNYYRGWFDP

SEQ ID NO: 9325 - protein, 9 aa, Homo sapiens
  Light chain CDR3 for antibody 4663 (IGKV1D-16)
QQYNSYPYT

SEQ ID NO: 9326 - protein, 9 aa, Homo sapiens
  Heavy chain CDR3 for antibody 4663 (IGHV1-8)
ARGPRIMDV

SEQ ID NO: 9327 - protein, 9 aa, Homo sapiens
  Light chain CDR3 for antibody 4664 (IGKV1-39)
QQSYSTPLT

SEQ ID NO: 9328 - protein, 14 aa, Homo sapiens
  Heavy chain CDR3 for antibody 4664 (IGHV3-20)
AREGWFGDYYGMDV

SEQ ID NO: 9329 - protein, 9 aa, Homo sapiens
  Light chain CDR3 for antibody 4665 (IGKV2-30)
MQGTHWPLT

SEQ ID NO: 9330 - protein, 8 aa, Homo sapiens
  Heavy chain CDR3 for antibody 4665 (IGHV3-23)
AETFLFDY

SEQ ID NO: 9331 - protein, 8 aa, Homo sapiens
  Light chain CDR3 for antibody 4666 (IGKV1-6)
QQYNSYWT

SEQ ID NO: 9332 - protein, 16 aa, Homo sapiens
  Heavy chain CDR3 for antibody 4666 (IGHV3-33)
ARGYDMLTGDYYGMDV

SEQ ID NO: 9333 - protein, 9 aa, Homo sapiens
  Light chain CDR3 for antibody 4667 (IGKV3-20)
QQYGSSPYT

SEQ ID NO: 9334 - protein, 11 aa, Homo sapiens
  Heavy chain CDR3 for antibody 4667 (IGHV4-59)
AREDYGVPFDY

SEQ ID NO: 9335 - protein, 9 aa, Homo sapiens
  Light chain CDR3 for antibody 4668 (IGKV5-2)
LQHDNFPYT

SEQ ID NO: 9336 - protein, 17 aa, Homo sapiens
  Heavy chain CDR3 for antibody 4668 (IGHV3-23)
SKERNWNDGYYYFGMDA

SEQ ID NO: 9337 - protein, 9 aa, Homo sapiens
  Light chain CDR3 for antibody 4669 (IGKV1-27)
QKYNSAPYT

SEQ ID NO: 9338 - protein, 14 aa, Homo sapiens
  Heavy chain CDR3 for antibody 4669 (IGHV3-33)
AREGYSSGWDYFDH

SEQ ID NO: 9339 - protein, 9 aa, Homo sapiens
  Light chain CDR3 for antibody 4670 (IGKV1D-13)
QQFNNYPHT

SEQ ID NO: 9340 - protein, 17 aa, Homo sapiens
  Heavy chain CDR3 for antibody 4670 (IGHV3-33)
ARCGYSSSWYDPYYFDY

SEQ ID NO: 9341 - protein, 9 aa, Homo sapiens
  Light chain CDR3 for antibody 4671 (IGKV1-39)
QQSYRTPLT

SEQ ID NO: 9342 - protein, 11 aa, Homo sapiens
  Heavy chain CDR3 for antibody 4671 (IGHV4-59)
ARDRGHYGMDV

SEQ ID NO: 9343 - protein, 9 aa, Homo sapiens
  Light chain CDR3 for antibody 4672 (IGKV1-9)
QQLNSYPHT

SEQ ID NO: 9344 - protein, 14 aa, Homo sapiens
  Heavy chain CDR3 for antibody 4672 (IGHV3-33)
ARDLDIMATSPFAY

SEQ ID NO: 9345 - protein, 9 aa, Homo sapiens
  Light chain CDR3 for antibody 4673 (IGKV1D-16)
QQYNSYPYT

SEQ ID NO: 9346 - protein, 16 aa, Homo sapiens
  Heavy chain CDR3 for antibody 4673 (IGHV1-18)
ARGGGYSESYSNWFDP

SEQ ID NO: 9347 - protein, 9 aa, Homo sapiens
  Light chain CDR3 for antibody 4674 (IGKV3D-7)
QQDYNLPWT

SEQ ID NO: 9348 - protein, 10 aa, Homo sapiens
  Heavy chain CDR3 for antibody 4674 (IGHV3-23)
AKDHYGDYPY

SEQ ID NO: 9349 - protein, 9 aa, Homo sapiens
  Light chain CDR3 for antibody 4675 (IGKV1D-13)
QQFNNYPST

SEQ ID NO: 9350 - protein, 18 aa, Homo sapiens
  Heavy chain CDR3 for antibody 4675 (IGHV3-33)
ARGGYSSGWDYYYYGMDV

SEQ ID NO: 9351 - protein, 9 aa, Homo sapiens
  Light chain CDR3 for antibody 4676 (IGKV3D-7)
QQDYNLPLT

SEQ ID NO: 9352 - protein, 17 aa, Homo sapiens
  Heavy chain CDR3 for antibody 4676 (IGHV3-33)
ARCGYSSSWYDPYYFDY

SEQ ID NO: 9353 - protein, 10 aa, Homo sapiens
  Light chain CDR3 for antibody 4677 (IGKV1-27)
QKYNSAPMYT

SEQ ID NO: 9354 - protein, 11 aa, Homo sapiens
  Heavy chain CDR3 for antibody 4677 (IGHV4-59)
ARSIRYSVFDY

SEQ ID NO: 9355 - protein, 9 aa, Homo sapiens
  Light chain CDR3 for antibody 4678 (IGKV1-9)
QQLISYPLT

SEQ ID NO: 9356 - protein, 12 aa, Homo sapiens
  Heavy chain CDR3 for antibody 4678 (IGHV3-23)
AKDGWFGESLDY

SEQ ID NO: 9357 - protein, 9 aa, Homo sapiens
  Light chain CDR3 for antibody 4679 (IGKV6-21)
HQSSSLPYT

SEQ ID NO: 9358 - protein, 9 aa, Homo sapiens
  Heavy chain CDR3 for antibody 4679 (IGHV4-34)
AREKYYFDY

SEQ ID NO: 9359 - protein, 9 aa, Homo sapiens
  Light chain CDR3 for antibody 4680 (IGKV3D-20)
QQYGSSPYT

SEQ ID NO: 9360 - protein, 14 aa, Homo sapiens
  Heavy chain CDR3 for antibody 4680 (IGHV1-46)
ARAYYAFLTGAFDI

SEQ ID NO: 9361 - protein, 10 aa, Homo sapiens
  Light chain CDR3 for antibody 4681 (IGKV3-11)
QQRSNWPALT

SEQ ID NO: 9362 - protein, 12 aa, Homo sapiens
  Heavy chain CDR3 for antibody 4681 (IGHV4-61)
ARVDSSGWFFDY

SEQ ID NO: 9363 - protein, 11 aa, Homo sapiens
  Light chain CDR3 for antibody 4682 (IGKV3-11)
QQRSNWPPTWT

SEQ ID NO: 9364 - protein, 15 aa, Homo sapiens
  Heavy chain CDR3 for antibody 4682 (IGHV3-20)
ARDRGSSGWRDWFDP

SEQ ID NO: 9365 - protein, 8 aa, Homo sapiens
  Light chain CDR3 for antibody 4683 (IGKV3-11)
QQRSNWLT

SEQ ID NO: 9366 - protein, 7 aa, Homo sapiens
  Heavy chain CDR3 for antibody 4683 (IGHV1-46)
AREGGDY

SEQ ID NO: 9367 - protein, 9 aa, Homo sapiens
  Light chain CDR3 for antibody 4684 (IGKV1-33)
QQYDNLPFT

SEQ ID NO: 9368 - protein, 10 aa, Homo sapiens
  Heavy chain CDR3 for antibody 4684 (IGHV3-33)
ARDGSGSQPI

SEQ ID NO: 9369 - protein, 9 aa, Homo sapiens
  Light chain CDR3 for antibody 4685 (IGKV1-9)
QQLKSYLYT

SEQ ID NO: 9370 - protein, 14 aa, Homo sapiens
  Heavy chain CDR3 for antibody 4685 (IGHV1-18)
ARCFGSGSYGWFDP

SEQ ID NO: 9371 - protein, 9 aa, Homo sapiens
  Light chain CDR3 for antibody 4686 (IGKV1D-13)
QQFNNYPYT

SEQ ID NO: 9372 - protein, 19 aa, Homo sapiens
  Heavy chain CDR3 for antibody 4686 (IGHV4-59)
ARDRVVGATTYYYYYGMDV

SEQ ID NO: 9373 - protein, 10 aa, Homo sapiens
  Light chain CDR3 for antibody 4687 (IGKV3-11)
QQRSNWLMYT

SEQ ID NO: 9374 - protein, 16 aa, Homo sapiens
  Heavy chain CDR3 for antibody 4687 (IGHV3-23)
AKEGMVLRYFDWLWDY

SEQ ID NO: 9375 - protein, 9 aa, Homo sapiens
  Light chain CDR3 for antibody 4688 (IGKV1-16)
QQYNTYPLT

SEQ ID NO: 9376 - protein, 12 aa, Homo sapiens
  Heavy chain CDR3 for antibody 4688 (IGHV3-72)
ARVAQVEYYLDF

SEQ ID NO: 9377 - protein, 9 aa, Homo sapiens
  Light chain CDR3 for antibody 4689 (IGKV2-30)
MQGTHWPLT

SEQ ID NO: 9378 - protein, 13 aa, Homo sapiens
  Heavy chain CDR3 for antibody 4689 (IGHV3-33)
ARQSSGWFDAFDI

SEQ ID NO: 9379 - protein, 9 aa, Homo sapiens
  Light chain CDR3 for antibody 4690 (IGKV3-15)
QQYNNWPLT

SEQ ID NO: 9380 - protein, 17 aa, Homo sapiens
  Heavy chain CDR3 for antibody 4690 (IGHV1-18)
ARERYYGSGSYKYNMDV

SEQ ID NO: 9381 - protein, 9 aa, Homo sapiens
  Light chain CDR3 for antibody 4691 (IGKV1D-13)
QQFNNYPHT

SEQ ID NO: 9382 - protein, 12 aa, Homo sapiens
  Heavy chain CDR3 for antibody 4691 (IGHV3-23)
AKEGLGSDYEPY

SEQ ID NO: 9383 - protein, 9 aa, Homo sapiens
  Light chain CDR3 for antibody 4692 (IGKV2-30)
MQGTHWPLT

SEQ ID NO: 9384 - protein, 19 aa, Homo sapiens
  Heavy chain CDR3 for antibody 4692 (IGHV3-23)
AKDGRSGSYDYYYYYGMDV

SEQ ID NO: 9385 - protein, 9 aa, Homo sapiens
  Light chain CDR3 for antibody 4693 (IGKV1D-13)
QQFNNYPHT

SEQ ID NO: 9386 - protein, 15 aa, Homo sapiens
  Heavy chain CDR3 for antibody 4693 (IGHV3-33)
AKDRNSGYDWGGFDY

SEQ ID NO: 9387 - protein, 9 aa, Homo sapiens
  Light chain CDR3 for antibody 4694 (IGKV1D-13)
QHFNNYMYT

SEQ ID NO: 9388 - protein, 15 aa, Homo sapiens
  Heavy chain CDR3 for antibody 4694 (IGHV4-59)
ARDLGHYYGSVSIDY

SEQ ID NO: 9389 - protein, 9 aa, Homo sapiens
  Light chain CDR3 for antibody 4695 (IGKV3-20)
QQYGSSPYT

SEQ ID NO: 9390 - protein, 11 aa, Homo sapiens
  Heavy chain CDR3 for antibody 4695 (IGHV3-33)
ATERDMVRGDY

SEQ ID NO: 9391 - protein, 9 aa, Homo sapiens
  Light chain CDR3 for antibody 4696 (IGKV5-2)
LQHDNFPWT

SEQ ID NO: 9392 - protein, 13 aa, Homo sapiens
  Heavy chain CDR3 for antibody 4696 (IGHV1-24)
ATGYSINWYEFDY

SEQ ID NO: 9393 - protein, 9 aa, Homo sapiens
  Light chain CDR3 for antibody 4697 (IGKV1D-16)
QQYDSYPWT

SEQ ID NO: 9394 - protein, 12 aa, Homo sapiens
  Heavy chain CDR3 for antibody 4697 (IGHV3-33)
ASRDILTGYLGY

SEQ ID NO: 9395 - protein, 9 aa, Homo sapiens
  Light chain CDR3 for antibody 4698 (IGKV1-9)
QQLNSYPLT

SEQ ID NO: 9396 - protein, 14 aa, Homo sapiens
  Heavy chain CDR3 for antibody 4698 (IGHV1-24)
ATWLPLYYYYGMDV

SEQ ID NO: 9397 - protein, 9 aa, Homo sapiens
  Light chain CDR3 for antibody 4699 (IGKV6-21)
HQSSSLPHT

SEQ ID NO: 9398 - protein, 5 aa, Homo sapiens
  Heavy chain CDR3 for antibody 4699 (IGHV4-39)
ASLDY

SEQ ID NO: 9399 - protein, 10 aa, Homo sapiens
  Light chain CDR3 for antibody 4700 (IGKV1-39)
QQSYSTPMYT

SEQ ID NO: 9400 - protein, 19 aa, Homo sapiens
  Heavy chain CDR3 for antibody 4700 (IGHV3-33)
ARGVRLRFFDPYYYYGLDV

SEQ ID NO: 9401 - protein, 9 aa, Homo sapiens
  Light chain CDR3 for antibody 4701 (IGKV1-6)
LQDYNHPFT

SEQ ID NO: 9402 - protein, 18 aa, Homo sapiens
  Heavy chain CDR3 for antibody 4701 (IGHV3-33)
ARREGITLIFYYYYGMDV

SEQ ID NO: 9403 - protein, 9 aa, Homo sapiens
  Light chain CDR3 for antibody 4702 (IGKV3D-7)
QQDYEFPIT

SEQ ID NO: 9404 - protein, 16 aa, Homo sapiens
  Heavy chain CDR3 for antibody 4702 (IGHV4-59)
ARGRYFEWLLGDVFDI

SEQ ID NO: 9405 - protein, 8 aa, Homo sapiens
  Light chain CDR3 for antibody 4703 (IGKV1D-13)
QQFNNYPT

SEQ ID NO: 9406 - protein, 9 aa, Homo sapiens
  Heavy chain CDR3 for antibody 4703 (IGHV3-30)
ARDYFHFDY

SEQ ID NO: 9407 - protein, 8 aa, Homo sapiens
  Light chain CDR3 for antibody 4704 (IGKV1D-13)
QQFNNYPT

SEQ ID NO: 9408 - protein, 16 aa, Homo sapiens
  Heavy chain CDR3 for antibody 4704 (IGHV3-33)
ARDKNTDYDILTGFDY

SEQ ID NO: 9409 - protein, 9 aa, Homo sapiens
  Light chain CDR3 for antibody 4705 (IGKV5-2)
LQHDNFPYT

SEQ ID NO: 9410 - protein, 15 aa, Homo sapiens
  Heavy chain CDR3 for antibody 4705 (IGHV3-33)
ARDALAVTGTGWFDP

SEQ ID NO: 9411 - protein, 10 aa, Homo sapiens
  Light chain CDR3 for antibody 4706 (IGKV1-39)
QQSYSTPMYT

SEQ ID NO: 9412 - protein, 9 aa, Homo sapiens
  Heavy chain CDR3 for antibody 4706 (IGHV3-13)
ARDRWYFDL

SEQ ID NO: 9413 - protein, 9 aa, Homo sapiens
  Light chain CDR3 for antibody 4707 (IGKV2-30)
MQGTHWPLT

SEQ ID NO: 9414 - protein, 15 aa, Homo sapiens
  Heavy chain CDR3 for antibody 4707 (IGHV1-18)
ARGYCSSTSCYYFDY

SEQ ID NO: 9415 - protein, 9 aa, Homo sapiens
  Light chain CDR3 for antibody 4708 (IGKV1D-16)
QQYYSYPWT

SEQ ID NO: 9416 - protein, 9 aa, Homo sapiens
  Heavy chain CDR3 for antibody 4708 (IGHV4-59)
AREGGSGSL

SEQ ID NO: 9417 - protein, 8 aa, Homo sapiens
  Light chain CDR3 for antibody 4709 (IGKV1-5)
QQYNSYWT

SEQ ID NO: 9418 - protein, 18 aa, Homo sapiens
  Heavy chain CDR3 for antibody 4709 (IGHV3-33)
ARDYDSLTTYPEDYGMDV

SEQ ID NO: 9419 - protein, 9 aa, Homo sapiens
  Light chain CDR3 for antibody 4710 (IGKV1-39)
QQSYSTPIT

SEQ ID NO: 9420 - protein, 18 aa, Homo sapiens
  Heavy chain CDR3 for antibody 4710 (IGHV3-33)
ARGGYDILTGYYRTGMDV

SEQ ID NO: 9421 - protein, 9 aa, Homo sapiens
  Light chain CDR3 for antibody 4711 (IGKV3-20)
QQYGSYPYT

SEQ ID NO: 9422 - protein, 12 aa, Homo sapiens
  Heavy chain CDR3 for antibody 4711 (IGHV3-23)
AKGYTSFWYFDL

SEQ ID NO: 9423 - protein, 9 aa, Homo sapiens
  Light chain CDR3 for antibody 4712 (IGKV1D-13)
QQFNNYPYT

SEQ ID NO: 9424 - protein, 13 aa, Homo sapiens
  Heavy chain CDR3 for antibody 4712 (IGHV3-33)
ARVHFDWLDAFDI

SEQ ID NO: 9425 - protein, 9 aa, Homo sapiens
  Light chain CDR3 for antibody 4713 (IGKV5-2)
LQHDNFPWT

SEQ ID NO: 9426 - protein, 20 aa, Homo sapiens
  Heavy chain CDR3 for antibody 4713 (IGHV4-34)
ARRMVRGVKKTYYYYYGLDV

SEQ ID NO: 9427 - protein, 9 aa, Homo sapiens
  Light chain CDR3 for antibody 4714 (IGKV6-21)
HQSSSLPYT

SEQ ID NO: 9428 - protein, 15 aa, Homo sapiens
  Heavy chain CDR3 for antibody 4714 (IGHV1-18)
ARIYYGSGSSYYFDY

SEQ ID NO: 9429 - protein, 9 aa, Homo sapiens
  Light chain CDR3 for antibody 4715 (IGKV2-30)
MQGTHWPLT

SEQ ID NO: 9430 - protein, 10 aa, Homo sapiens
  Heavy chain CDR3 for antibody 4715 (IGHV3-33)
AREWFGGFDI

SEQ ID NO: 9431 - protein, 8 aa, Homo sapiens
  Light chain CDR3 for antibody 4716 (IGKV1-5)
QQYNSYYT

SEQ ID NO: 9432 - protein, 14 aa, Homo sapiens
  Heavy chain CDR3 for antibody 4716 (IGHV3-33)
ARTTAAAGPRDFQH

SEQ ID NO: 9433 - protein, 9 aa, Homo sapiens
  Light chain CDR3 for antibody 4717 (IGKV3-11)
QQRSNWMYT

SEQ ID NO: 9434 - protein, 11 aa, Homo sapiens
  Heavy chain CDR3 for antibody 4717 (IGHV3-33)
AREAANWGFDY

SEQ ID NO: 9435 - protein, 8 aa, Homo sapiens
  Light chain CDR3 for antibody 4718 (IGKV1D-13)
QQFNNYPT

SEQ ID NO: 9436 - protein, 16 aa, Homo sapiens
  Heavy chain CDR3 for antibody 4718 (IGHV4-59)
ARDTPYYSGSGRPFDS

SEQ ID NO: 9437 - protein, 9 aa, Homo sapiens
  Light chain CDR3 for antibody 4719 (IGKV1-9)
QQLNSYPLT

SEQ ID NO: 9438 - protein, 11 aa, Homo sapiens
  Heavy chain CDR3 for antibody 4719 (IGHV3-64)
ARERGSYAFDI

SEQ ID NO: 9439 - protein, 9 aa, Homo sapiens
  Light chain CDR3 for antibody 4720 (IGKV3-11)
QQRSNWPWT

SEQ ID NO: 9440 - protein, 13 aa, Homo sapiens
  Heavy chain CDR3 for antibody 4720 (IGHV4-39)
ARHEVMIRGVFDY

SEQ ID NO: 9441 - protein, 8 aa, Homo sapiens
  Light chain CDR3 for antibody 4721 (IGKV3D-7)
QQDYNLLT

SEQ ID NO: 9442 - protein, 13 aa, Homo sapiens
  Heavy chain CDR3 for antibody 4721 (IGHV3-33)
ARQSSGWFDAFDI

SEQ ID NO: 9443 - protein, 9 aa, Homo sapiens
  Light chain CDR3 for antibody 4722 (IGKV5-2)
LQHDNFPYT

SEQ ID NO: 9444 - protein, 18 aa, Homo sapiens
  Heavy chain CDR3 for antibody 4722 (IGHV3-33)
ARRGVGARGYYYYYGMDV

SEQ ID NO: 9445 - protein, 10 aa, Homo sapiens
  Light chain CDR3 for antibody 4723 (IGKV1-27)
QKYNSAPMYT

SEQ ID NO: 9446 - protein, 13 aa, Homo sapiens
  Heavy chain CDR3 for antibody 4723 (IGHV4-34)
ASNFYYYYYGMDV

SEQ ID NO: 9447 - protein, 9 aa, Homo sapiens
  Light chain CDR3 for antibody 4724 (IGKV3-20)
QQYGSSPYT

SEQ ID NO: 9448 - protein, 10 aa, Homo sapiens
  Heavy chain CDR3 for antibody 4724 (IGHV1-18)
ARGPTSDVDY

SEQ ID NO: 9449 - protein, 9 aa, Homo sapiens
  Light chain CDR3 for antibody 4725 (IGKV3-11)
QQRINWPWT

SEQ ID NO: 9450 - protein, 12 aa, Homo sapiens
  Heavy chain CDR3 for antibody 4725 (IGHV4-39)
ARQMVREGWFDP

SEQ ID NO: 9451 - protein, 10 aa, Homo sapiens
  Light chain CDR3 for antibody 4726 (IGKV3-11)
QQRSNWPIFT

SEQ ID NO: 9452 - protein, 14 aa, Homo sapiens
  Heavy chain CDR3 for antibody 4726 (IGHV3-23)
ANWAYDILTGYLDY

SEQ ID NO: 9453 - protein, 8 aa, Homo sapiens
  Light chain CDR3 for antibody 4727 (IGKV3D-7)
QQDYNLLT

SEQ ID NO: 9454 - protein, 9 aa, Homo sapiens
  Heavy chain CDR3 for antibody 4727 (IGHV3-33)
ARATVGVDY

SEQ ID NO: 9455 - protein, 9 aa, Homo sapiens
  Light chain CDR3 for antibody 4728 (IGKV3-11)
QQRINWPWT

SEQ ID NO: 9456 - protein, 9 aa, Homo sapiens
  Heavy chain CDR3 for antibody 4728 (IGHV4-59)
ARGGASFDY

SEQ ID NO: 9457 - protein, 10 aa, Homo sapiens
  Light chain CDR3 for antibody 4729 (IGKV1-17)
LQHNSYPMYT

SEQ ID NO: 9458 - protein, 14 aa, Homo sapiens
  Heavy chain CDR3 for antibody 4729 (IGHV3-33)
ARDNILTVYYLFDY

SEQ ID NO: 9459 - protein, 9 aa, Homo sapiens
  Light chain CDR3 for antibody 4730 (IGKV3D-20)
QQYGSSPYT

SEQ ID NO: 9460 - protein, 20 aa, Homo sapiens
  Heavy chain CDR3 for antibody 4730 (IGHV3-33)
ARDLGWATMVRGVIRAPFDY

SEQ ID NO: 9461 - protein, 8 aa, Homo sapiens
  Light chain CDR3 for antibody 4731 (IGKV3D-7)
QQDYNLLT

SEQ ID NO: 9462 - protein, 14 aa, Homo sapiens
  Heavy chain CDR3 for antibody 4731 (IGHV3-33)
ARAGSGYDRDWFDP

SEQ ID NO: 9463 - protein, 9 aa, Homo sapiens
  Light chain CDR3 for antibody 4732 (IGKV1-39)
QQSYRTPLT

SEQ ID NO: 9464 - protein, 14 aa, Homo sapiens
  Heavy chain CDR3 for antibody 4732 (IGHV3-20)
ARDGGSTSFDWFDP

SEQ ID NO: 9465 - protein, 8 aa, Homo sapiens
  Light chain CDR3 for antibody 4733 (IGKV6-21)
HQSSSLPT

SEQ ID NO: 9466 - protein, 13 aa, Homo sapiens
  Heavy chain CDR3 for antibody 4733 (IGHV3-11)
ARDGGAAAGTWDS

SEQ ID NO: 9467 - protein, 9 aa, Homo sapiens
  Light chain CDR3 for antibody 4734 (IGKV4-1)
QQYYSTPWT

SEQ ID NO: 9468 - protein, 12 aa, Homo sapiens
  Heavy chain CDR3 for antibody 4734 (IGHV3-33)
ARGYFGSGYAHF

SEQ ID NO: 9469 - protein, 9 aa, Homo sapiens
  Light chain CDR3 for antibody 4735 (IGKV1-39)
QQSYSTPLT

SEQ ID NO: 9470 - protein, 17 aa, Homo sapiens
  Heavy chain CDR3 for antibody 4735 (IGHV3-33)
ARSPYDILTGYSYYFDY

SEQ ID NO: 9471 - protein, 9 aa, Homo sapiens
  Light chain CDR3 for antibody 4736 (IGKV1D-16)
QQYNSYPYT

SEQ ID NO: 9472 - protein, 10 aa, Homo sapiens
  Heavy chain CDR3 for antibody 4736 (IGHV3-33)
VRDVVVYFDY

SEQ ID NO: 9473 - protein, 10 aa, Homo sapiens
  Light chain CDR3 for antibody 4737 (IGKV3-11)
QQRSNWPIFT

SEQ ID NO: 9474 - protein, 12 aa, Homo sapiens
  Heavy chain CDR3 for antibody 4737 (IGHV3-23)
AKEGLGSDYEPY

SEQ ID NO: 9475 - protein, 9 aa, Homo sapiens
  Light chain CDR3 for antibody 4738 (IGKV1-33)
QQYDNLPFT

SEQ ID NO: 9476 - protein, 18 aa, Homo sapiens
  Heavy chain CDR3 for antibody 4738 (IGHV3-33)
ARDRDRYGSGTYPDAIDI

SEQ ID NO: 9477 - protein, 9 aa, Homo sapiens
  Light chain CDR3 for antibody 4739 (IGKV1-16)
QQYNRYPYT

SEQ ID NO: 9478 - protein, 17 aa, Homo sapiens
  Heavy chain CDR3 for antibody 4739 (IGHV4-34)
AGLRFFDWLFDYYGMDV

SEQ ID NO: 9479 - protein, 9 aa, Homo sapiens
  Light chain CDR3 for antibody 4740 (IGKV3-15)
QQYNNWPRT

SEQ ID NO: 9480 - protein, 9 aa, Homo sapiens
  Heavy chain CDR3 for antibody 4740 (IGHV3-13)
ARDRWYFDL

SEQ ID NO: 9481 - protein, 8 aa, Homo sapiens
  Light chain CDR3 for antibody 4741 (IGKV1D-13)
QQFNNYPT

SEQ ID NO: 9482 - protein, 12 aa, Homo sapiens
  Heavy chain CDR3 for antibody 4741 (IGHV3-33)
ARDRAYRGSLDY

SEQ ID NO: 9483 - protein, 9 aa, Homo sapiens
  Light chain CDR3 for antibody 4742 (IGKV6-21)
HQSTSLPFT

SEQ ID NO: 9484 - protein, 16 aa, Homo sapiens
  Heavy chain CDR3 for antibody 4742 (IGHV1-8)
AREGTMVRGVTYAFDI

SEQ ID NO: 9485 - protein, 9 aa, Homo sapiens
  Light chain CDR3 for antibody 4743 (IGKV3-20)
QQYGSSPYT

SEQ ID NO: 9486 - protein, 10 aa, Homo sapiens
  Heavy chain CDR3 for antibody 4743 (IGHV3-30)
ARDNFEGMDV

SEQ ID NO: 9487 - protein, 8 aa, Homo sapiens
  Light chain CDR3 for antibody 4744 (IGKV3D-7)
QQDYNLLT

SEQ ID NO: 9488 - protein, 19 aa, Homo sapiens
  Heavy chain CDR3 for antibody 4744 (IGHV1-18)
ARDDILTGYSLYYYYGMDV

SEQ ID NO: 9489 - protein, 10 aa, Homo sapiens
  Light chain CDR3 for antibody 4745 (IGKV1-9)
QQLDSYPMYT

SEQ ID NO: 9490 - protein, 13 aa, Homo sapiens
  Heavy chain CDR3 for antibody 4745 (IGHV3-11)
ARDGGAAAGTWDS

SEQ ID NO: 9491 - protein, 11 aa, Homo sapiens
  Light chain CDR3 for antibody 4746 (IGKV3-11)
QQRSNWPPTWT

SEQ ID NO: 9492 - protein, 9 aa, Homo sapiens
  Heavy chain CDR3 for antibody 4746 (IGHV1-18)
ARGKDWFDP

SEQ ID NO: 9493 - protein, 9 aa, Homo sapiens
  Light chain CDR3 for antibody 4747 (IGKV2-30)
MQGTHWPLT

SEQ ID NO: 9494 - protein, 13 aa, Homo sapiens
  Heavy chain CDR3 for antibody 4747 (IGHV4-28)
ARKGATGYYGMDV

SEQ ID NO: 9495 - protein, 9 aa, Homo sapiens
  Light chain CDR3 for antibody 4748 (IGKV1-27)
QKYNSAPYT

SEQ ID NO: 9496 - protein, 9 aa, Homo sapiens
  Heavy chain CDR3 for antibody 4748 (IGHV4-59)
ARGGASFDY

SEQ ID NO: 9497 - protein, 9 aa, Homo sapiens
  Light chain CDR3 for antibody 4749 (IGKV1-17)
LQHNSYPYT

SEQ ID NO: 9498 - protein, 14 aa, Homo sapiens
  Heavy chain CDR3 for antibody 4749 (IGHV3-23)
VRDRIAAASSDFDN

SEQ ID NO: 9499 - protein, 9 aa, Homo sapiens
  Light chain CDR3 for antibody 4750 (IGKV3D-7)
QQDYNLPLT

SEQ ID NO: 9500 - protein, 20 aa, Homo sapiens
  Heavy chain CDR3 for antibody 4750 (IGHV1-f)
ATGLITFVRGVILTYRSFDY

SEQ ID NO: 9501 - protein, 9 aa, Homo sapiens
  Light chain CDR3 for antibody 4751 (IGKV3-11)
QQRSNWPWT

SEQ ID NO: 9502 - protein, 11 aa, Homo sapiens
  Heavy chain CDR3 for antibody 4751 (IGHV1-46)
AREEDLGAFDI

SEQ ID NO: 9503 - protein, 9 aa, Homo sapiens
  Light chain CDR3 for antibody 4752 (IGKV3-15)
QQYHNWPLT

SEQ ID NO: 9504 - protein, 16 aa, Homo sapiens
  Heavy chain CDR3 for antibody 4752 (IGHV3-33)
ARAVYYGSGSSLIMDV

SEQ ID NO: 9505 - protein, 9 aa, Homo sapiens
  Light chain CDR3 for antibody 4753 (IGKV1-6)
QQEYNYPLT

SEQ ID NO: 9506 - protein, 17 aa, Homo sapiens
  Heavy chain CDR3 for antibody 4753 (IGHV1-18)
ARERYYGSGSYKYNMDV

SEQ ID NO: 9507 - protein, 9 aa, Homo sapiens
  Light chain CDR3 for antibody 4754 (IGKV1-17)
LQHNSYPYT

SEQ ID NO: 9508 - protein, 9 aa, Homo sapiens
  Heavy chain CDR3 for antibody 4754 (IGHV3-30)
ARGRVSLDV

SEQ ID NO: 9509 - protein, 8 aa, Homo sapiens
  Light chain CDR3 for antibody 4755 (IGKV3-11)
QQRSNWLT

SEQ ID NO: 9510 - protein, 14 aa, Homo sapiens
  Heavy chain CDR3 for antibody 4755 (IGHV3-23)
AKSRIVGALYYFDY

SEQ ID NO: 9511 - protein, 10 aa, Homo sapiens
  Light chain CDR3 for antibody 4756 (IGKV1-39)
QQSYSTPMYT

SEQ ID NO: 9512 - protein, 9 aa, Homo sapiens
  Heavy chain CDR3 for antibody 4756 (IGHV3-33)
ARATVGVDY

SEQ ID NO: 9513 - protein, 9 aa, Homo sapiens
  Light chain CDR3 for antibody 4757 (IGKV5-2)
LQHDNFPWT

SEQ ID NO: 9514 - protein, 17 aa, Homo sapiens
  Heavy chain CDR3 for antibody 4757 (IGHV4-39)
ARERILWFGEFTYYFDY

SEQ ID NO: 9515 - protein, 9 aa, Homo sapiens
  Light chain CDR3 for antibody 4758 (IGKV5-2)
LQHDKFPYT

SEQ ID NO: 9516 - protein, 12 aa, Homo sapiens
  Heavy chain CDR3 for antibody 4758 (IGHV3-33)
ARDLVRGIRMDV

SEQ ID NO: 9517 - protein, 9 aa, Homo sapiens
  Light chain CDR3 for antibody 4759 (IGKV1D-16)
QQYDSYPYT

SEQ ID NO: 9518 - protein, 12 aa, Homo sapiens
  Heavy chain CDR3 for antibody 4759 (IGHV3-33)
ARKGYDMHAFDI

SEQ ID NO: 9519 - protein, 9 aa, Homo sapiens
  Light chain CDR3 for antibody 4760 (IGKV1-6)
LQDYNYPRT

SEQ ID NO: 9520 - protein, 9 aa, Homo sapiens
  Heavy chain CDR3 for antibody 4760 (IGHV3-20)
ARDGGGGSY

SEQ ID NO: 9521 - protein, 9 aa, Homo sapiens
  Light chain CDR3 for antibody 4761 (IGKV1-17)
LQHNSYPYT

SEQ ID NO: 9522 - protein, 11 aa, Homo sapiens
  Heavy chain CDR3 for antibody 4761 (IGHV4-39)
ARLLVGATTDY

SEQ ID NO: 9523 - protein, 11 aa, Homo sapiens
  Light chain CDR3 for antibody 4762 (IGKV3-11)
QQRSNWPPTWT

SEQ ID NO: 9524 - protein, 16 aa, Homo sapiens
  Heavy chain CDR3 for antibody 4762 (IGHV4-39)
ARDTPYYSGSGRPFDY

SEQ ID NO: 9525 - protein, 8 aa, Homo sapiens
  Light chain CDR3 for antibody 4763 (IGKV1D-13)
QQFNNYPT

SEQ ID NO: 9526 - protein, 17 aa, Homo sapiens
  Heavy chain CDR3 for antibody 4763 (IGHV3-33)
ARGEQWLGYYYYYGMDV

SEQ ID NO: 9527 - protein, 9 aa, Homo sapiens
  Light chain CDR3 for antibody 4764 (IGKV3D-7)
QQDYNLPFT

SEQ ID NO: 9528 - protein, 14 aa, Homo sapiens
  Heavy chain CDR3 for antibody 4764 (IGHV3-23)
AKDRYRGYEGLFDY

SEQ ID NO: 9529 - protein, 9 aa, Homo sapiens
  Light chain CDR3 for antibody 4765 (IGKV1-27)
QKYNSAPYT

SEQ ID NO: 9530 - protein, 17 aa, Homo sapiens
  Heavy chain CDR3 for antibody 4765 (IGHV3-33)
ARQGVLLWFGELYYFDY

SEQ ID NO: 9531 - protein, 9 aa, Homo sapiens
  Light chain CDR3 for antibody 4766 (IGKV3-11)
QQRSNWMYT

SEQ ID NO: 9532 - protein, 15 aa, Homo sapiens
  Heavy chain CDR3 for antibody 4766 (IGHV3-33)
ARDTGYSSSWNWFDP

SEQ ID NO: 9533 - protein, 9 aa, Homo sapiens
  Light chain CDR3 for antibody 4767 (IGKV1-39)
QQSYSTPIT

SEQ ID NO: 9534 - protein, 24 aa, Homo sapiens
  Heavy chain CDR3 for antibody 4767 (IGHV1-46)
ARDEARGLLTGYYNMREYYYGMDV

SEQ ID NO: 9535 - protein, 8 aa, Homo sapiens
  Light chain CDR3 for antibody 4768 (IGKV3D-7)
QQDYNLLT

SEQ ID NO: 9536 - protein, 12 aa, Homo sapiens
  Heavy chain CDR3 for antibody 4768 (IGHV3-33)
ARDRAYRGSLDY

SEQ ID NO: 9537 - protein, 9 aa, Homo sapiens
  Light chain CDR3 for antibody 4769 (IGKV3D-7)
QQDYEFPLT

SEQ ID NO: 9538 - protein, 11 aa, Homo sapiens
  Heavy chain CDR3 for antibody 4769 (IGHV4-59)
ARSLRYSVFDY

SEQ ID NO: 9539 - protein, 9 aa, Homo sapiens
  Light chain CDR3 for antibody 4770 (IGKV1-39)
QQSYSTPLT

SEQ ID NO: 9540 - protein, 10 aa, Homo sapiens
  Heavy chain CDR3 for antibody 4770 (IGHV4-39)
ARQLGNWFDP

SEQ ID NO: 9541 - protein, 9 aa, Homo sapiens
  Light chain CDR3 for antibody 4771 (IGKV5-2)
LQHDNFPWT

SEQ ID NO: 9542 - protein, 17 aa, Homo sapiens
  Heavy chain CDR3 for antibody 4771 (IGHV3-33)
AREGYYYGSGSYHFFDY

SEQ ID NO: 9543 - protein, 9 aa, Homo sapiens
  Light chain CDR3 for antibody 4772 (IGKV1-9)
QQLISYPLT

SEQ ID NO: 9544 - protein, 17 aa, Homo sapiens
  Heavy chain CDR3 for antibody 4772 (IGHV3-33)
ARGFSGYDGYYYYGMDV

SEQ ID NO: 9545 - protein, 9 aa, Homo sapiens
  Light chain CDR3 for antibody 4773 (IGKV2-30)
MQGTHWPLT

SEQ ID NO: 9546 - protein, 14 aa, Homo sapiens
  Heavy chain CDR3 for antibody 4773 (IGHV4-39)
ARDSGYDYYYGMDV

SEQ ID NO: 9547 - protein, 9 aa, Homo sapiens
  Light chain CDR3 for antibody 4774 (IGKV1-16)
QHYNDYPFT

SEQ ID NO: 9548 - protein, 18 aa, Homo sapiens
  Heavy chain CDR3 for antibody 4774 (IGHV4-59)
AREGDYVWGSYRPNWFDP

SEQ ID NO: 9549 - protein, 8 aa, Homo sapiens
  Light chain CDR3 for antibody 4775 (IGKV1D-13)
QQFNNYPT

SEQ ID NO: 9550 - protein, 9 aa, Homo sapiens
  Heavy chain CDR3 for antibody 4775 (IGHV3-30)
ARDNWGFDY

SEQ ID NO: 9551 - protein, 9 aa, Homo sapiens
  Light chain CDR3 for antibody 4776 (IGKV1-9)
QQLNSYPLT

SEQ ID NO: 9552 - protein, 19 aa, Homo sapiens
  Heavy chain CDR3 for antibody 4776 (IGHV1-24)
ATEGGIVGGTRYYYYGMDV

SEQ ID NO: 9553 - protein, 8 aa, Homo sapiens
  Light chain CDR3 for antibody 4777 (IGKV3-20)
QQYGRSFT

SEQ ID NO: 9554 - protein, 13 aa, Homo sapiens
  Heavy chain CDR3 for antibody 4777 (IGHV3-33)
ARRYRSGWYPFDY

SEQ ID NO: 9555 - protein, 8 aa, Homo sapiens
  Light chain CDR3 for antibody 4778 (IGKV1-5)
QQYNSYYT

SEQ ID NO: 9556 - protein, 8 aa, Homo sapiens
  Heavy chain CDR3 for antibody 4778 (IGHV3-23)
AKETGNNY

SEQ ID NO: 9557 - protein, 8 aa, Homo sapiens
  Light chain CDR3 for antibody 4779 (IGKV6-21)
HQSSSLPT

SEQ ID NO: 9558 - protein, 15 aa, Homo sapiens
  Heavy chain CDR3 for antibody 4779 (IGHV3-20)
ARDRGSSGWRDWFDP

SEQ ID NO: 9559 - protein, 9 aa, Homo sapiens
  Light chain CDR3 for antibody 4780 (IGKV1-17)
LQHNSYPYT

SEQ ID NO: 9560 - protein, 14 aa, Homo sapiens
  Heavy chain CDR3 for antibody 4780 (IGHV1-46)
ARGAVDDYYYGMDV

SEQ ID NO: 9561 - protein, 9 aa, Homo sapiens
  Light chain CDR3 for antibody 4781 (IGKV1D-13)
QQFNNYPYT

SEQ ID NO: 9562 - protein, 18 aa, Homo sapiens
  Heavy chain CDR3 for antibody 4781 (IGHV3-33)
AREGSYYGSGSFPNWFDP

SEQ ID NO: 9563 - protein, 9 aa, Homo sapiens
  Light chain CDR3 for antibody 4782 (IGKV1-6)
LQDYKSPFT

SEQ ID NO: 9564 - protein, 18 aa, Homo sapiens
  Heavy chain CDR3 for antibody 4782 (IGHV3-23)
AKEGNYYGSGSYWGYFDP

SEQ ID NO: 9565 - protein, 9 aa, Homo sapiens
  Light chain CDR3 for antibody 4783 (IGKV5-2)
LQHDNFPWT

SEQ ID NO: 9566 - protein, 17 aa, Homo sapiens
  Heavy chain CDR3 for antibody 4783 (IGHV3-33)
ARDSYDILTGYYKPFDY

SEQ ID NO: 9567 - protein, 8 aa, Homo sapiens
  Light chain CDR3 for antibody 4784 (IGKV1D-13)
QQFNNYYT

SEQ ID NO: 9568 - protein, 20 aa, Homo sapiens
  Heavy chain CDR3 for antibody 4784 (IGHV1-f)
ATGLITFVRGVILTYRSFDY

SEQ ID NO: 9569 - protein, 9 aa, Homo sapiens
  Light chain CDR3 for antibody 4785 (IGKV4-1)
QQYYSTPWT

SEQ ID NO: 9570 - protein, 14 aa, Homo sapiens
  Heavy chain CDR3 for antibody 4785 (IGHV3-23)
AKSRIVGALYYFDY

SEQ ID NO: 9571 - protein, 9 aa, Homo sapiens
  Light chain CDR3 for antibody 4786 (IGKV1-27)
QKYNSAPYT

SEQ ID NO: 9572 - protein, 16 aa, Homo sapiens
  Heavy chain CDR3 for antibody 4786 (IGHV3-13)
ARDRSYESYYYYGMDV

SEQ ID NO: 9573 - protein, 10 aa, Homo sapiens
  Light chain CDR3 for antibody 4787 (IGKV3-15)
QQYNNWPPIT

SEQ ID NO: 9574 - protein, 17 aa, Homo sapiens
  Heavy chain CDR3 for antibody 4787 (IGHV3-33)
ARGYCSRTSCYLYYFDY

SEQ ID NO: 9575 - protein, 11 aa, Homo sapiens
  Light chain CDR3 for antibody 4788 (IGKV3-11)
QQRSNWPPTWT

SEQ ID NO: 9576 - protein, 17 aa, Homo sapiens
  Heavy chain CDR3 for antibody 4788 (IGHV3-33)
ARGYCSRTSCYLYYFDY

SEQ ID NO: 9577 - protein, 8 aa, Homo sapiens
  Light chain CDR3 for antibody 4789 (IGKV3-11)
QQRSNWLT

SEQ ID NO: 9578 - protein, 16 aa, Homo sapiens
  Heavy chain CDR3 for antibody 4789 (IGHV1-18)
ARYFDWLLRDYYGMDV

SEQ ID NO: 9579 - protein, 8 aa, Homo sapiens
  Light chain CDR3 for antibody 4790 (IGKV1-5)
QQYNSYWT

SEQ ID NO: 9580 - protein, 13 aa, Homo sapiens
  Heavy chain CDR3 for antibody 4790 (IGHV3-33)
ARRATLVRGVFDP

SEQ ID NO: 9581 - protein, 9 aa, Homo sapiens
  Light chain CDR3 for antibody 4791 (IGKV1D-13)
QQFNNYPHT

SEQ ID NO: 9582 - protein, 8 aa, Homo sapiens
  Heavy chain CDR3 for antibody 4791 (IGHV3-23)
EKSAGEDV

SEQ ID NO: 9583 - protein, 9 aa, Homo sapiens
  Light chain CDR3 for antibody 4792 (IGKV1-16)
QHYNDYPFT

SEQ ID NO: 9584 - protein, 11 aa, Homo sapiens
  Heavy chain CDR3 for antibody 4792 (IGHV3-33)
ARDKSSGWSDY

SEQ ID NO: 9585 - protein, 9 aa, Homo sapiens
  Light chain CDR3 for antibody 4793 (IGKV1-17)
LQHNSYPYT

SEQ ID NO: 9586 - protein, 13 aa, Homo sapiens
  Heavy chain CDR3 for antibody 4793 (IGHV3-15)
TTDRLLLFGAFDY

SEQ ID NO: 9587 - protein, 9 aa, Homo sapiens
  Light chain CDR3 for antibody 4794 (IGKV3-15)
QQYNNWPLT

SEQ ID NO: 9588 - protein, 18 aa, Homo sapiens
  Heavy chain CDR3 for antibody 4794 (IGHV1-46)
ARDLTGRTENYYYYGMDV

SEQ ID NO: 9589 - protein, 9 aa, Homo sapiens
  Light chain CDR3 for antibody 4795 (IGKV1-27)
QKYNSAPYT

SEQ ID NO: 9590 - protein, 13 aa, Homo sapiens
  Heavy chain CDR3 for antibody 4795 (IGHV3-33)
ARDQRYSSGWYDY

SEQ ID NO: 9591 - protein, 9 aa, Homo sapiens
  Light chain CDR3 for antibody 4796 (IGKV3-15)
QQYNNWPLT

SEQ ID NO: 9592 - protein, 17 aa, Homo sapiens
  Heavy chain CDR3 for antibody 4796 (IGHV3-33)
ARESLKLGIYYYYGMDV

SEQ ID NO: 9593 - protein, 8 aa, Homo sapiens
  Light chain CDR3 for antibody 4797 (IGKV3D-7)
QQDYNLLT

SEQ ID NO: 9594 - protein, 14 aa, Homo sapiens
  Heavy chain CDR3 for antibody 4797 (IGHV1-18)
ARCFGSGSYGWFDP

SEQ ID NO: 9595 - protein, 9 aa, Homo sapiens
  Light chain CDR3 for antibody 4798 (IGKV1-27)
QKYNSAPYT

SEQ ID NO: 9596 - protein, 13 aa, Homo sapiens
  Heavy chain CDR3 for antibody 4798 (IGHV4-59)
ARTMVRGVAPFDY

SEQ ID NO: 9597 - protein, 9 aa, Homo sapiens
  Light chain CDR3 for antibody 4799 (IGKV1-6)
LQDYKSPFT

SEQ ID NO: 9598 - protein, 14 aa, Homo sapiens
  Heavy chain CDR3 for antibody 4799 (IGHV3-33)
ARDRIAAASSDFDC

SEQ ID NO: 9599 - protein, 10 aa, Homo sapiens
  Light chain CDR3 for antibody 4800 (IGKV3-11)
QQRSNWPIFT

SEQ ID NO: 9600 - protein, 13 aa, Homo sapiens
  Heavy chain CDR3 for antibody 4800 (IGHV4-59)
ARTMVRGVAPFDY

SEQ ID NO: 9601 - protein, 9 aa, Homo sapiens
  Light chain CDR3 for antibody 4801 (IGKV1-39)
QQSYSTPLT

SEQ ID NO: 9602 - protein, 12 aa, Homo sapiens
  Heavy chain CDR3 for antibody 4801 (IGHV3-33)
ARGYFTSGSAHY

SEQ ID NO: 9603 - protein, 9 aa, Homo sapiens
  Light chain CDR3 for antibody 4802 (IGKV1D-13)
QQFNNYPHT

SEQ ID NO: 9604 - protein, 13 aa, Homo sapiens
  Heavy chain CDR3 for antibody 4802 (IGHV3-23)
AKDRGGSYSYFDF

SEQ ID NO: 9605 - protein, 9 aa, Homo sapiens
  Light chain CDR3 for antibody 4803 (IGKV3-11)
QQRSNWPRT

SEQ ID NO: 9606 - protein, 13 aa, Homo sapiens
  Heavy chain CDR3 for antibody 4803 (IGHV3-33)
ANTGDSYYYDMDV

SEQ ID NO: 9607 - protein, 9 aa, Homo sapiens
  Light chain CDR3 for antibody 4804 (IGKV1-39)
QQSYRTPLT

SEQ ID NO: 9608 - protein, 13 aa, Homo sapiens
  Heavy chain CDR3 for antibody 4804 (IGHV3-23)
AKDRGLRYYGMDV

SEQ ID NO: 9609 - protein, 9 aa, Homo sapiens
  Light chain CDR3 for antibody 4805 (IGKV3-20)
HQSSSLPYT

SEQ ID NO: 9610 - protein, 19 aa, Homo sapiens
  Heavy chain CDR3 for antibody 4805 (IGHV3-33)
ARIPGIAVAGGYYYYGMDV

SEQ ID NO: 9611 - protein, 9 aa, Homo sapiens
  Light chain CDR3 for antibody 4806 (IGKV3-15)
QQYNNWPRT

SEQ ID NO: 9612 - protein, 11 aa, Homo sapiens
  Heavy chain CDR3 for antibody 4806 (IGHV3-33)
ARGTTVTHFDY

SEQ ID NO: 9613 - protein, 9 aa, Homo sapiens
  Light chain CDR3 for antibody 4807 (IGKV1-16)
QQYISYPFT

SEQ ID NO: 9614 - protein, 13 aa, Homo sapiens
  Heavy chain CDR3 for antibody 4807 (IGHV1-24)
AADYGDYQYYFDY

SEQ ID NO: 9615 - protein, 9 aa, Homo sapiens
  Light chain CDR3 for antibody 4808 (IGKV1D-13)
QQFNNYPHT

SEQ ID NO: 9616 - protein, 18 aa, Homo sapiens
  Heavy chain CDR3 for antibody 4808 (IGHV6-1)
ARDQYSYGPYYYYYGMDV

SEQ ID NO: 9617 - protein, 8 aa, Homo sapiens
  Light chain CDR3 for antibody 4809 (IGKV1D-13)
QQFNNYPT

SEQ ID NO: 9618 - protein, 12 aa, Homo sapiens
  Heavy chain CDR3 for antibody 4809 (IGHV3-33)
ARDLVGATPFDY

SEQ ID NO: 9619 - protein, 8 aa, Homo sapiens
  Light chain CDR3 for antibody 4810 (IGKV3-20)
QQYGRSFT

SEQ ID NO: 9620 - protein, 13 aa, Homo sapiens
  Heavy chain CDR3 for antibody 4810 (IGHV4-59)
ARTMVRGVAPFDY

SEQ ID NO: 9621 - protein, 8 aa, Homo sapiens
  Light chain CDR3 for antibody 4811 (IGKV1-13)
QQFNTYPT

SEQ ID NO: 9622 - protein, 18 aa, Homo sapiens
  Heavy chain CDR3 for antibody 4811 (IGHV3-33)
ARDRYHDILTGYYMGFDY

SEQ ID NO: 9623 - protein, 9 aa, Homo sapiens
  Light chain CDR3 for antibody 4812 (IGKV1-9)
QQLNSYPYT

SEQ ID NO: 9624 - protein, 13 aa, Homo sapiens
  Heavy chain CDR3 for antibody 4812 (IGHV3-13)
ARAITMVRGVIDY

SEQ ID NO: 9625 - protein, 9 aa, Homo sapiens
  Light chain CDR3 for antibody 4813 (IGKV3D-7)
QQDYNLPYS

SEQ ID NO: 9626 - protein, 12 aa, Homo sapiens
  Heavy chain CDR3 for antibody 4813 (IGHV1-46)
ARGLTGDHAVDI

SEQ ID NO: 9627 - protein, 9 aa, Homo sapiens
  Light chain CDR3 for antibody 4814 (IGKV1-6)
LQDYNYPWT

SEQ ID NO: 9628 - protein, 13 aa, Homo sapiens
  Heavy chain CDR3 for antibody 4814 (IGHV3-66)
AREYSGYDAHFDY

SEQ ID NO: 9629 - protein, 9 aa, Homo sapiens
  Light chain CDR3 for antibody 4815 (IGKV1-39)
QQSYSTPLT

SEQ ID NO: 9630 - protein, 15 aa, Homo sapiens
  Heavy chain CDR3 for antibody 4815 (IGHV3-33)
AREGLRYFHYYGMDV

SEQ ID NO: 9631 - protein, 9 aa, Homo sapiens
  Light chain CDR3 for antibody 4816 (IGKV1-9)
QQLNSYPLT

SEQ ID NO: 9632 - protein, 6 aa, Homo sapiens
  Heavy chain CDR3 for antibody 4816 (IGHV1-8)
AREGTY

SEQ ID NO: 9633 - protein, 11 aa, Homo sapiens
  Light chain CDR3 for antibody 4817 (IGKV3-11)
QQRSNWPPTWT

SEQ ID NO: 9634 - protein, 13 aa, Homo sapiens
  Heavy chain CDR3 for antibody 4817 (IGHV4-39)
ARRGVVAPAAFDY

SEQ ID NO: 9635 - protein, 10 aa, Homo sapiens
  Light chain CDR3 for antibody 4818 (IGKV3-11)
QQRSNWPIFT

SEQ ID NO: 9636 - protein, 14 aa, Homo sapiens
  Heavy chain CDR3 for antibody 4818 (IGHV3-33)
ARTTAAAGPRDFQH

SEQ ID NO: 9637 - protein, 9 aa, Homo sapiens
  Light chain CDR3 for antibody 4819 (IGKV1-27)
QKYNSAPYT

SEQ ID NO: 9638 - protein, 17 aa, Homo sapiens
  Heavy chain CDR3 for antibody 4819 (IGHV3-33)
ARCGYSSSWYDPYYFDY

SEQ ID NO: 9639 - protein, 9 aa, Homo sapiens
  Light chain CDR3 for antibody 4820 (IGKV3D-7)
QQDYNLPLT

SEQ ID NO: 9640 - protein, 14 aa, Homo sapiens
  Heavy chain CDR3 for antibody 4820 (IGHV3-33)
ARQYSYGYPYYFDY

SEQ ID NO: 9641 - protein, 8 aa, Homo sapiens
  Light chain CDR3 for antibody 4821 (IGKV1-5)
QQYNSYWT

SEQ ID NO: 9642 - protein, 14 aa, Homo sapiens
  Heavy chain CDR3 for antibody 4821 (IGHV3-33)
VRDQGSMVRGGGDY

SEQ ID NO: 9643 - protein, 9 aa, Homo sapiens
  Light chain CDR3 for antibody 4822 (IGKV1-16)
QHYNDYPFT

SEQ ID NO: 9644 - protein, 12 aa, Homo sapiens
  Heavy chain CDR3 for antibody 4822 (IGHV1-46)
ARGLTGDHAVDI

SEQ ID NO: 9645 - protein, 9 aa, Homo sapiens
  Light chain CDR3 for antibody 4823 (IGKV1-33)
QQYDNLPFT

SEQ ID NO: 9646 - protein, 17 aa, Homo sapiens
  Heavy chain CDR3 for antibody 4823 (IGHV3-64)
ARERYYGSGSYYNWFDP

SEQ ID NO: 9647 - protein, 9 aa, Homo sapiens
  Light chain CDR3 for antibody 4824 (IGKV3-11)
QQRINWPWT

SEQ ID NO: 9648 - protein, 16 aa, Homo sapiens
  Heavy chain CDR3 for antibody 4824 (IGHV3-23)
AKEGMVLRYFDWLWDY

SEQ ID NO: 9649 - protein, 9 aa, Homo sapiens
  Light chain CDR3 for antibody 4825 (IGKV1-6)
LQDYNHPFT

SEQ ID NO: 9650 - protein, 12 aa, Homo sapiens
  Heavy chain CDR3 for antibody 4825 (IGHV3-13)
VREAGIPDAFDI

SEQ ID NO: 9651 - protein, 9 aa, Homo sapiens
  Light chain CDR3 for antibody 4826 (IGKV1-39)
QQSYSTPFT

SEQ ID NO: 9652 - protein, 16 aa, Homo sapiens
  Heavy chain CDR3 for antibody 4826 (IGHV4-59)
ARFYFGSGSYYWYFDL

SEQ ID NO: 9653 - protein, 9 aa, Homo sapiens
  Light chain CDR3 for antibody 4827 (IGKV1D-13)
QHFNNYMYT

SEQ ID NO: 9654 - protein, 16 aa, Homo sapiens
  Heavy chain CDR3 for antibody 4827 (IGHV4-59)
ARGRYFEWLLGDVFDI

SEQ ID NO: 9655 - protein, 9 aa, Homo sapiens
  Light chain CDR3 for antibody 4828 (IGKV3D-20)
QQYGYSPLT

SEQ ID NO: 9656 - protein, 13 aa, Homo sapiens
  Heavy chain CDR3 for antibody 4828 (IGHV3-33)
ARTDYYFYYGLDV

SEQ ID NO: 9657 - protein, 9 aa, Homo sapiens
  Light chain CDR3 for antibody 4829 (IGKV1-17)
LQHNSFPLT

SEQ ID NO: 9658 - protein, 14 aa, Homo sapiens
  Heavy chain CDR3 for antibody 4829 (IGHV3-33)
ARDKSYPLSYGMDV

SEQ ID NO: 9659 - protein, 9 aa, Homo sapiens
  Light chain CDR3 for antibody 4830 (IGKV2D-28)
MQALQTPFT

SEQ ID NO: 9660 - protein, 15 aa, Homo sapiens
  Heavy chain CDR3 for antibody 4830 (IGHV3-33)
VCVLYDYGDYVGFDY

SEQ ID NO: 9661 - protein, 8 aa, Homo sapiens
  Light chain CDR3 for antibody 4831 (IGKV6-21)
HQSSSLPT

SEQ ID NO: 9662 - protein, 12 aa, Homo sapiens
  Heavy chain CDR3 for antibody 4831 (IGHV3-h)
ARESGGSYSFDY

SEQ ID NO: 9663 - protein, 8 aa, Homo sapiens
  Light chain CDR3 for antibody 4832 (IGKV3-20)
QQYGRSFT

SEQ ID NO: 9664 - protein, 8 aa, Homo sapiens
  Heavy chain CDR3 for antibody 4832 (IGHV3-23)
AKETGNNY

SEQ ID NO: 9665 - protein, 9 aa, Homo sapiens
  Light chain CDR3 for antibody 4833 (IGKV1D-16)
QQYNSYPYT

SEQ ID NO: 9666 - protein, 17 aa, Homo sapiens
  Heavy chain CDR3 for antibody 4833 (IGHV4-39)
ARERILWFGEFTYYFDY

SEQ ID NO: 9667 - protein, 9 aa, Homo sapiens
  Light chain CDR3 for antibody 4834 (IGKV5-2)
LQHDNFPWT

SEQ ID NO: 9668 - protein, 15 aa, Homo sapiens
  Heavy chain CDR3 for antibody 4834 (IGHV3-74)
ARGSGSHYHYYGMDV

SEQ ID NO: 9669 - protein, 9 aa, Homo sapiens
  Light chain CDR3 for antibody 4835 (IGKV5-2)
LQHDNFPYT

SEQ ID NO: 9670 - protein, 12 aa, Homo sapiens
  Heavy chain CDR3 for antibody 4835 (IGHV4-34)
ARDYGSGSFFDY

SEQ ID NO: 9671 - protein, 9 aa, Homo sapiens
  Light chain CDR3 for antibody 4836 (IGKV2-30)
MQGTHWPLT

SEQ ID NO: 9672 - protein, 24 aa, Homo sapiens
  Heavy chain CDR3 for antibody 4836 (IGHV3-20)
ARGRITMVRGVIINPLDYYNGMDV

SEQ ID NO: 9673 - protein, 9 aa, Homo sapiens
  Light chain CDR3 for antibody 4837 (IGKV1-27)
QKYNSAPYT

SEQ ID NO: 9674 - protein, 9 aa, Homo sapiens
  Heavy chain CDR3 for antibody 4837 (IGHV3-23)
ARIWWLKDY

SEQ ID NO: 9675 - protein, 9 aa, Homo sapiens
  Light chain CDR3 for antibody 4838 (IGKV3-20)
QQYGSSPYT

SEQ ID NO: 9676 - protein, 15 aa, Homo sapiens
  Heavy chain CDR3 for antibody 4838 (IGHV3-20)
AREGPYYYGSGSLDY

SEQ ID NO: 9677 - protein, 9 aa, Homo sapiens
  Light chain CDR3 for antibody 4839 (IGKV3-15)
QQYNNWPYT

SEQ ID NO: 9678 - protein, 14 aa, Homo sapiens
  Heavy chain CDR3 for antibody 4839 (IGHV1-2)
ARDYYGSGNYYMGY

SEQ ID NO: 9679 - protein, 9 aa, Homo sapiens
  Light chain CDR3 for antibody 4840 (IGKV3-15)
QQYNNWPLT

SEQ ID NO: 9680 - protein, 12 aa, Homo sapiens
  Heavy chain CDR3 for antibody 4840 (IGHV3-23)
AKDGWFGESLDY

SEQ ID NO: 9681 - protein, 9 aa, Homo sapiens
  Light chain CDR3 for antibody 4841 (IGKV3-20)
QQYGSSPRT

SEQ ID NO: 9682 - protein, 18 aa, Homo sapiens
  Heavy chain CDR3 for antibody 4841 (IGHV1-18)
ARDPTFYYVSGSYYKFDY

SEQ ID NO: 9683 - protein, 8 aa, Homo sapiens
  Light chain CDR3 for antibody 4842 (IGKV3D-7)
QQDYNLLT

SEQ ID NO: 9684 - protein, 18 aa, Homo sapiens
  Heavy chain CDR3 for antibody 4842 (IGHV3-33)
ARGYYGSGNFYKDSGMDV

SEQ ID NO: 9685 - protein, 9 aa, Homo sapiens
  Light chain CDR3 for antibody 4843 (IGKV2-30)
MQGTHWPLT

SEQ ID NO: 9686 - protein, 13 aa, Homo sapiens
  Heavy chain CDR3 for antibody 4843 (IGHV3-23)
AKDRGLRYYGMDV

SEQ ID NO: 9687 - protein, 9 aa, Homo sapiens
  Light chain CDR3 for antibody 4844 (IGKV3-20)
QQYGSSPYT

SEQ ID NO: 9688 - protein, 12 aa, Homo sapiens
  Heavy chain CDR3 for antibody 4844 (IGHV3-33)
ARGGIAVDVCDI

SEQ ID NO: 9689 - protein, 9 aa, Homo sapiens
  Light chain CDR3 for antibody 4845 (IGKV5-2)
LQHDNFPYT

SEQ ID NO: 9690 - protein, 9 aa, Homo sapiens
  Heavy chain CDR3 for antibody 4845 (IGHV3-33)
AANSYGLDY

SEQ ID NO: 9691 - protein, 9 aa, Homo sapiens
  Light chain CDR3 for antibody 4846 (IGKV2-30)
MQGTHWPLT

SEQ ID NO: 9692 - protein, 13 aa, Homo sapiens
  Heavy chain CDR3 for antibody 4846 (IGHV4-39)
ARHVLLWFGEFDP

SEQ ID NO: 9693 - protein, 9 aa, Homo sapiens
  Light chain CDR3 for antibody 4847 (IGKV1-6)
LQDYNYPYT

SEQ ID NO: 9694 - protein, 14 aa, Homo sapiens
  Heavy chain CDR3 for antibody 4847 (IGHV3-33)
ARDKSYPRSYGMDV

SEQ ID NO: 9695 - protein, 9 aa, Homo sapiens
  Light chain CDR3 for antibody 4848 (IGKV1-9)
QQYNSYPWT

SEQ ID NO: 9696 - protein, 15 aa, Homo sapiens
  Heavy chain CDR3 for antibody 4848 (IGHV3-11)
AREYSSGWYGDAFDI

SEQ ID NO: 9697 - protein, 9 aa, Homo sapiens
  Light chain CDR3 for antibody 4849 (IGKV5-2)
LQHDNFPYT

SEQ ID NO: 9698 - protein, 13 aa, Homo sapiens
  Heavy chain CDR3 for antibody 4849 (IGHV3-15)
TTDRLLLFGAFDY

SEQ ID NO: 9699 - protein, 8 aa, Homo sapiens
  Light chain CDR3 for antibody 4850 (IGKV3-11)
QQRSNWLT

SEQ ID NO: 9700 - protein, 13 aa, Homo sapiens
  Heavy chain CDR3 for antibody 4850 (IGHV4-39)
ARHVLLWFGEFDP

SEQ ID NO: 9701 - protein, 9 aa, Homo sapiens
  Light chain CDR3 for antibody 4851 (IGKV1-17)
LQHNSYPYT

SEQ ID NO: 9702 - protein, 17 aa, Homo sapiens
  Heavy chain CDR3 for antibody 4851 (IGHV1-24)
TTVVLYYDILPGYSFDY

SEQ ID NO: 9703 - protein, 9 aa, Homo sapiens
  Light chain CDR3 for antibody 4852 (IGKV1-17)
QQYNNWPLT

SEQ ID NO: 9704 - protein, 16 aa, Homo sapiens
  Heavy chain CDR3 for antibody 4852 (IGHV4-59)
ARDTPYYSGSGRPFDS

SEQ ID NO: 9705 - protein, 9 aa, Homo sapiens
  Light chain CDR3 for antibody 4853 (IGKV1D-13)
QHFNNYMYT

SEQ ID NO: 9706 - protein, 13 aa, Homo sapiens
  Heavy chain CDR3 for antibody 4853 (IGHV4-39)
ARHEVMVRGVFDY

SEQ ID NO: 9707 - protein, 9 aa, Homo sapiens
  Light chain CDR3 for antibody 4854 (IGKV1D-13)
QQFNNYPYT

SEQ ID NO: 9708 - protein, 11 aa, Homo sapiens
  Heavy chain CDR3 for antibody 4854 (IGHV4-59)
TRDRGLGSFDY

SEQ ID NO: 9709 - protein, 9 aa, Homo sapiens
  Light chain CDR3 for antibody 4855 (IGKV1D-16)
QQYNSYPYT

SEQ ID NO: 9710 - protein, 13 aa, Homo sapiens
  Heavy chain CDR3 for antibody 4855 (IGHV3-33)
ARDSGSYSYYFNY

SEQ ID NO: 9711 - protein, 9 aa, Homo sapiens
  Light chain CDR3 for antibody 4856 (IGKV6-21)
HQSSSLPLT

SEQ ID NO: 9712 - protein, 19 aa, Homo sapiens
  Heavy chain CDR3 for antibody 4856 (IGHV3-33)
ARGVRLRFFDPYYYYGLDV

SEQ ID NO: 9713 - protein, 8 aa, Homo sapiens
  Light chain CDR3 for antibody 4857 (IGKV1-5)
QQYNSYWT

SEQ ID NO: 9714 - protein, 17 aa, Homo sapiens
  Heavy chain CDR3 for antibody 4857 (IGHV4-59)
ARDFLVRGEGSYYGMDV

SEQ ID NO: 9715 - protein, 9 aa, Homo sapiens
  Light chain CDR3 for antibody 4858 (IGKV5-2)
LQHDNFPYT

SEQ ID NO: 9716 - protein, 13 aa, Homo sapiens
  Heavy chain CDR3 for antibody 4858 (IGHV4-39)
ARRGVVAPAAFDY

SEQ ID NO: 9717 - protein, 9 aa, Homo sapiens
  Light chain CDR3 for antibody 4859 (IGKV2-30)
MQGTHWPLT

SEQ ID NO: 9718 - protein, 14 aa, Homo sapiens
  Heavy chain CDR3 for antibody 4859 (IGHV3-23)
ANWAYDILTGYLDY

SEQ ID NO: 9719 - protein, 9 aa, Homo sapiens
  Light chain CDR3 for antibody 4860 (IGKV1D-13)
QQFNNYPHT

SEQ ID NO: 9720 - protein, 18 aa, Homo sapiens
  Heavy chain CDR3 for antibody 4860 (IGHV3-33)
ARDQYSGYDFYYYYGMDV

SEQ ID NO: 9721 - protein, 9 aa, Homo sapiens
  Light chain CDR3 for antibody 4861 (IGKV1D-13)
QQFNNYPYT

SEQ ID NO: 9722 - protein, 8 aa, Homo sapiens
  Heavy chain CDR3 for antibody 4861 (IGHV3-20)
APHWIFDY

SEQ ID NO: 9723 - protein, 8 aa, Homo sapiens
  Light chain CDR3 for antibody 4862 (IGKV6-21)
HQSSSLPT

SEQ ID NO: 9724 - protein, 9 aa, Homo sapiens
  Heavy chain CDR3 for antibody 4862 (IGHV4-34)
AREKYYFDH

SEQ ID NO: 9725 - protein, 9 aa, Homo sapiens
  Light chain CDR3 for antibody 4863 (IGKV2-30)
MQGTHWPLT

SEQ ID NO: 9726 - protein, 12 aa, Homo sapiens
  Heavy chain CDR3 for antibody 4863 (IGHV4-59)
ARDRSGWAYFDY

SEQ ID NO: 9727 - protein, 8 aa, Homo sapiens
  Light chain CDR3 for antibody 4864 (IGKV3-11)
LQRGNWPT

SEQ ID NO: 9728 - protein, 14 aa, Homo sapiens
  Heavy chain CDR3 for antibody 4864 (IGHV3-23)
AKSRIVGALYYFDY

SEQ ID NO: 9729 - protein, 8 aa, Homo sapiens
  Light chain CDR3 for antibody 4865 (IGKV1D-13)
QQFNNYPT

SEQ ID NO: 9730 - protein, 9 aa, Homo sapiens
  Heavy chain CDR3 for antibody 4865 (IGHV3-13)
ARDRWYFDL

SEQ ID NO: 9731 - protein, 9 aa, Homo sapiens
  Light chain CDR3 for antibody 4866 (IGKV1-6)
LQDYNYPRT

SEQ ID NO: 9732 - protein, 11 aa, Homo sapiens
  Heavy chain CDR3 for antibody 4866 (IGHV4-59)
ARESFYGSGNL

SEQ ID NO: 9733 - protein, 9 aa, Homo sapiens
  Light chain CDR3 for antibody 4867 (IGKV1-6)
LQDFHYPWT

SEQ ID NO: 9734 - protein, 13 aa, Homo sapiens
  Heavy chain CDR3 for antibody 4867 (IGHV3-33)
ARDWGYSHGYFDY

SEQ ID NO: 9735 - protein, 9 aa, Homo sapiens
  Light chain CDR3 for antibody 4868 (IGKV6-21)
HQSSSLPLT

SEQ ID NO: 9736 - protein, 12 aa, Homo sapiens
  Heavy chain CDR3 for antibody 4868 (IGHV3-33)
ARNYDILDYFDY

SEQ ID NO: 9737 - protein, 9 aa, Homo sapiens
  Light chain CDR3 for antibody 4869 (IGKV1-9)
QQLNSYPYT

SEQ ID NO: 9738 - protein, 18 aa, Homo sapiens
  Heavy chain CDR3 for antibody 4869 (IGHV3-11)
ARDGYSSGWNYYYFGLDV

SEQ ID NO: 9739 - protein, 10 aa, Homo sapiens
  Light chain CDR3 for antibody 4870 (IGKV1-17)
LQHNSYPMYT

SEQ ID NO: 9740 - protein, 12 aa, Homo sapiens
  Heavy chain CDR3 for antibody 4870 (IGHV3-33)
TRGYSSKSYFDY

SEQ ID NO: 9741 - protein, 9 aa, Homo sapiens
  Light chain CDR3 for antibody 4871 (IGKV3-11)
QQRSNWMYT

SEQ ID NO: 9742 - protein, 10 aa, Homo sapiens
  Heavy chain CDR3 for antibody 4871 (IGHV3-23)
AKGDRWRFDP

SEQ ID NO: 9743 - protein, 9 aa, Homo sapiens
  Light chain CDR3 for antibody 4872 (IGKV6-21)
HQSSSLPYT

SEQ ID NO: 9744 - protein, 18 aa, Homo sapiens
  Heavy chain CDR3 for antibody 4872 (IGHV3-33)
ARRTAAGTGDYYYYGMDV

SEQ ID NO: 9745 - protein, 9 aa, Homo sapiens
  Light chain CDR3 for antibody 4873 (IGKV1D-13)
QQFNNYPHT

SEQ ID NO: 9746 - protein, 17 aa, Homo sapiens
  Heavy chain CDR3 for antibody 4873 (IGHV3-33)
ARSGIVGATDYYYGLDV

SEQ ID NO: 9747 - protein, 9 aa, Homo sapiens
  Light chain CDR3 for antibody 4874 (IGKV1-6)
LQDYKSPFT

SEQ ID NO: 9748 - protein, 10 aa, Homo sapiens
  Heavy chain CDR3 for antibody 4874 (IGHV3-33)
ARENSTPLDY

SEQ ID NO: 9749 - protein, 9 aa, Homo sapiens
  Light chain CDR3 for antibody 4875 (IGKV1-17)
LQHNSYPYT

SEQ ID NO: 9750 - protein, 12 aa, Homo sapiens
  Heavy chain CDR3 for antibody 4875 (IGHV3-23)
AKGAVVTAIFDY

SEQ ID NO: 9751 - protein, 11 aa, Homo sapiens
  Light chain CDR3 for antibody 4876 (IGKV3-11)
QQRSNWPPTWT

SEQ ID NO: 9752 - protein, 13 aa, Homo sapiens
  Heavy chain CDR3 for antibody 4876 (IGHV3-53)
ARSGSYWGYYFDY

SEQ ID NO: 9753 - protein, 9 aa, Homo sapiens
  Light chain CDR3 for antibody 4877 (IGKV1-9)
QQLNTYPWT

SEQ ID NO: 9754 - protein, 17 aa, Homo sapiens
  Heavy chain CDR3 for antibody 4877 (IGHV1-18)
ARDRAFTMVRGVPPFDY

SEQ ID NO: 9755 - protein, 9 aa, Homo sapiens
  Light chain CDR3 for antibody 4878 (IGKV1-6)
LQDYNYPYT

SEQ ID NO: 9756 - protein, 13 aa, Homo sapiens
  Heavy chain CDR3 for antibody 4878 (IGHV4-39)
ARPGIVAAGWFDP

SEQ ID NO: 9757 - protein, 9 aa, Homo sapiens
  Light chain CDR3 for antibody 4879 (IGKV5-2)
LQHDNFPLT

SEQ ID NO: 9758 - protein, 12 aa, Homo sapiens
  Heavy chain CDR3 for antibody 4879 (IGHV3-23)
AKGYTSFWYFDL

SEQ ID NO: 9759 - protein, 9 aa, Homo sapiens
  Light chain CDR3 for antibody 4880 (IGKV1D-13)
QQFNNYPHT

SEQ ID NO: 9760 - protein, 17 aa, Homo sapiens
  Heavy chain CDR3 for antibody 4880 (IGHV3-30)
AREGVRGLIYYYYGMDV

SEQ ID NO: 9761 - protein, 9 aa, Homo sapiens
  Light chain CDR3 for antibody 4881 (IGKV2-30)
MQGTHWPLT

SEQ ID NO: 9762 - protein, 18 aa, Homo sapiens
  Heavy chain CDR3 for antibody 4881 (IGHV3-23)
ARYHLYFGSGFGSDGMDV

SEQ ID NO: 9763 - protein, 9 aa, Homo sapiens
  Light chain CDR3 for antibody 4882 (IGKV5-2)
LQHDNFPYT

SEQ ID NO: 9764 - protein, 14 aa, Homo sapiens
  Heavy chain CDR3 for antibody 4882 (IGHV3-64)
ARGGGAVTGTNFDY

SEQ ID NO: 9765 - protein, 9 aa, Homo sapiens
  Light chain CDR3 for antibody 4883 (IGKV1D-13)
QQFNNYPHT

SEQ ID NO: 9766 - protein, 15 aa, Homo sapiens
  Heavy chain CDR3 for antibody 4883 (IGHV3-23)
AKDRDYDFLSGPFDY

SEQ ID NO: 9767 - protein, 9 aa, Homo sapiens
  Light chain CDR3 for antibody 4884 (IGKV1-27)
QKYNSAPYT

SEQ ID NO: 9768 - protein, 19 aa, Homo sapiens
  Heavy chain CDR3 for antibody 4884 (IGHV4-59)
ARDRVVGATTYYYYYGMDV

SEQ ID NO: 9769 - protein, 9 aa, Homo sapiens
  Light chain CDR3 for antibody 4885 (IGKV5-2)
LQHDNFPYT

SEQ ID NO: 9770 - protein, 14 aa, Homo sapiens
  Heavy chain CDR3 for antibody 4885 (IGHV3-23)
AKCDYDILTGILDY

SEQ ID NO: 9771 - protein, 10 aa, Homo sapiens
  Light chain CDR3 for antibody 4886 (IGKV3-11)
QQRSNWPIFT

SEQ ID NO: 9772 - protein, 17 aa, Homo sapiens
  Heavy chain CDR3 for antibody 4886 (IGHV3-33)
ARDLIGPLSSSWYPFDY

SEQ ID NO: 9773 - protein, 9 aa, Homo sapiens
  Light chain CDR3 for antibody 4887 (IGKV1-6)
LQVYSYPWT

SEQ ID NO: 9774 - protein, 11 aa, Homo sapiens
  Heavy chain CDR3 for antibody 4887 (IGHV3-33)
ARDRSSGPFDY

SEQ ID NO: 9775 - protein, 9 aa, Homo sapiens
  Light chain CDR3 for antibody 4888 (IGKV6-21)
HQSSSLPYT

SEQ ID NO: 9776 - protein, 14 aa, Homo sapiens
  Heavy chain CDR3 for antibody 4888 (IGHV3-23)
ATWLPLYYYYGMDV

SEQ ID NO: 9777 - protein, 9 aa, Homo sapiens
  Light chain CDR3 for antibody 4889 (IGKV1-6)
LQDFNYPRT

SEQ ID NO: 9778 - protein, 15 aa, Homo sapiens
  Heavy chain CDR3 for antibody 4889 (IGHV4-59)
ARDLGYYGSGSPLAY

SEQ ID NO: 9779 - protein, 9 aa, Homo sapiens
  Light chain CDR3 for antibody 4890 (IGKV1D-13)
QQFNNYPHT

SEQ ID NO: 9780 - protein, 14 aa, Homo sapiens
  Heavy chain CDR3 for antibody 4890 (IGHV1-46)
ARDGVGAKEGGFDY

SEQ ID NO: 9781 - protein, 9 aa, Homo sapiens
  Light chain CDR3 for antibody 4891 (IGKV1-6)
LQDYNYPWT

SEQ ID NO: 9782 - protein, 18 aa, Homo sapiens
  Heavy chain CDR3 for antibody 4891 (IGHV3-11)
ARDGYSSGWNYYYFGLDV

SEQ ID NO: 9783 - protein, 9 aa, Homo sapiens
  Light chain CDR3 for antibody 4892 (IGKV1-17)
LHSNNYPWT

SEQ ID NO: 9784 - protein, 16 aa, Homo sapiens
  Heavy chain CDR3 for antibody 4892 (IGHV3-23)
AKEGMVLRYFDWLWDY

SEQ ID NO: 9785 - protein, 8 aa, Homo sapiens
  Light chain CDR3 for antibody 4893 (IGKV3D-7)
QQDYNLLT

SEQ ID NO: 9786 - protein, 20 aa, Homo sapiens
  Heavy chain CDR3 for antibody 4893 (IGHV1-f)
ATGLITFVRGVILTYRSFDY

SEQ ID NO: 9787 - protein, 11 aa, Homo sapiens
  Light chain CDR3 for antibody 4894 (IGKV3-11)
QQRSNWPPTWT

SEQ ID NO: 9788 - protein, 14 aa, Homo sapiens
  Heavy chain CDR3 for antibody 4894 (IGHV3-33)
ARDGYDFLTGPFDY

SEQ ID NO: 9789 - protein, 9 aa, Homo sapiens
  Light chain CDR3 for antibody 4895 (IGKV1-27)
QKYNSAPYT

SEQ ID NO: 9790 - protein, 18 aa, Homo sapiens
  Heavy chain CDR3 for antibody 4895 (IGHV4-39)
ARQYYFGSGNYYRGWFDP

SEQ ID NO: 9791 - protein, 10 aa, Homo sapiens
  Light chain CDR3 for antibody 4896 (IGKV1-17)
LQHNSYPMYT

SEQ ID NO: 9792 - protein, 14 aa, Homo sapiens
  Heavy chain CDR3 for antibody 4896 (IGHV3-33)
ARASSGSSYWYFDL

SEQ ID NO: 9793 - protein, 9 aa, Homo sapiens
  Light chain CDR3 for antibody 4897 (IGKV1-6)
LQDYNYPYT

SEQ ID NO: 9794 - protein, 15 aa, Homo sapiens
  Heavy chain CDR3 for antibody 4897 (IGHV3-23)
AKAGGRYFDWFPFDY

SEQ ID NO: 9795 - protein, 9 aa, Homo sapiens
  Light chain CDR3 for antibody 4898 (IGKV3-20)
QQYGSSPYT

SEQ ID NO: 9796 - protein, 17 aa, Homo sapiens
  Heavy chain CDR3 for antibody 4898 (IGHV3-33)
ARSMVTTYGYYYYGMDV

SEQ ID NO: 9797 - protein, 9 aa, Homo sapiens
  Light chain CDR3 for antibody 4899 (IGKV3-15)
QQYNNWPLT

SEQ ID NO: 9798 - protein, 14 aa, Homo sapiens
  Heavy chain CDR3 for antibody 4899 (IGHV3-33)
ARGGYSGYRYYFDY

SEQ ID NO: 9799 - protein, 9 aa, Homo sapiens
  Light chain CDR3 for antibody 4900 (IGKV1-9)
QQLNTYPWT

SEQ ID NO: 9800 - protein, 13 aa, Homo sapiens
  Heavy chain CDR3 for antibody 4900 (IGHV3-33)
AKEDGDYHHYFDY

SEQ ID NO: 9801 - protein, 8 aa, Homo sapiens
  Light chain CDR3 for antibody 4901 (IGKV1-5)
QQYNSYWT

SEQ ID NO: 9802 - protein, 11 aa, Homo sapiens
  Heavy chain CDR3 for antibody 4901 (IGHV3-33)
ARDILTGFLDH

SEQ ID NO: 9803 - protein, 9 aa, Homo sapiens
  Light chain CDR3 for antibody 4902 (IGKV1D-16)
QQYDSYPWT

SEQ ID NO: 9804 - protein, 12 aa, Homo sapiens
  Heavy chain CDR3 for antibody 4902 (IGHV4-61)
ARVYSSGWLFDY

SEQ ID NO: 9805 - protein, 9 aa, Homo sapiens
  Light chain CDR3 for antibody 4903 (IGKV5-2)
LQHDNFPYT

SEQ ID NO: 9806 - protein, 18 aa, Homo sapiens
  Heavy chain CDR3 for antibody 4903 (IGHV3-11)
ARDGYSSGWNYYYFGLDV

SEQ ID NO: 9807 - protein, 9 aa, Homo sapiens
  Light chain CDR3 for antibody 4904 (IGKV6-21)
HQSSSLPYT

SEQ ID NO: 9808 - protein, 18 aa, Homo sapiens
  Heavy chain CDR3 for antibody 4904 (IGHV3-11)
ARDGYSSGWNYYYFGLDV

SEQ ID NO: 9809 - protein, 10 aa, Homo sapiens
  Light chain CDR3 for antibody 4905 (IGKV3-11)
QQRSNWPIFT

SEQ ID NO: 9810 - protein, 13 aa, Homo sapiens
  Heavy chain CDR3 for antibody 4905 (IGHV4-28)
ARKGATGYYGMDV

SEQ ID NO: 9811 - protein, 9 aa, Homo sapiens
  Light chain CDR3 for antibody 4906 (IGKV1-6)
LQDFNYPRT

SEQ ID NO: 9812 - protein, 12 aa, Homo sapiens
  Heavy chain CDR3 for antibody 4906 (IGHV3-13)
VREAGIPDAFDI

SEQ ID NO: 9813 - protein, 10 aa, Homo sapiens
  Light chain CDR3 for antibody 4907 (IGKV3-11)
QQRSNWPIFT

SEQ ID NO: 9814 - protein, 14 aa, Homo sapiens
  Heavy chain CDR3 for antibody 4907 (IGHV3-33)
VRDQGSMVRGGGDY

SEQ ID NO: 9815 - protein, 9 aa, Homo sapiens
  Light chain CDR3 for antibody 4908 (IGKV2-30)
MQGTHWPLT

SEQ ID NO: 9816 - protein, 20 aa, Homo sapiens
  Heavy chain CDR3 for antibody 4908 (IGHV3-11)
ARGGATLIRGLIDYYYGMDV

SEQ ID NO: 9817 - protein, 9 aa, Homo sapiens
  Light chain CDR3 for antibody 4909 (IGKV1-33)
QQYDNLPFT

SEQ ID NO: 9818 - protein, 20 aa, Homo sapiens
  Heavy chain CDR3 for antibody 4909 (IGHV3-23)
AKGMGGLRYFDWPHYYGMDV

SEQ ID NO: 9819 - protein, 9 aa, Homo sapiens
  Light chain CDR3 for antibody 4910 (IGKV5-2)
LQHDNFPYT

SEQ ID NO: 9820 - protein, 13 aa, Homo sapiens
  Heavy chain CDR3 for antibody 4910 (IGHV3-33)
TRRIAVAGAEGDY

SEQ ID NO: 9821 - protein, 9 aa, Homo sapiens
  Light chain CDR3 for antibody 4911 (IGKV1-33)
QQYDNLPFT

SEQ ID NO: 9822 - protein, 14 aa, Homo sapiens
  Heavy chain CDR3 for antibody 4911 (IGHV3-33)
ARAGSGYDRDWFDP

SEQ ID NO: 9823 - protein, 9 aa, Homo sapiens
  Light chain CDR3 for antibody 4912 (IGKV3-11)
QQRSNWPPT

SEQ ID NO: 9824 - protein, 17 aa, Homo sapiens
  Heavy chain CDR3 for antibody 4912 (IGHV3-33)
ARGEQWLGYYYYYGMDV

SEQ ID NO: 9825 - protein, 9 aa, Homo sapiens
  Light chain CDR3 for antibody 4913 (IGKV5-2)
LQHDNFPWT

SEQ ID NO: 9826 - protein, 14 aa, Homo sapiens
  Heavy chain CDR3 for antibody 4913 (IGHV3-20)
ARDRGSSFFDAFDI

SEQ ID NO: 9827 - protein, 11 aa, Homo sapiens
  Light chain CDR3 for antibody 4914 (IGKV3-11)
QQRSNWPPTWT

SEQ ID NO: 9828 - protein, 14 aa, Homo sapiens
  Heavy chain CDR3 for antibody 4914 (IGHV4-39)
ARRGVVVPPGGMDV

SEQ ID NO: 9829 - protein, 8 aa, Homo sapiens
  Light chain CDR3 for antibody 4915 (IGKV1-5)
QQYNSYWT

SEQ ID NO: 9830 - protein, 15 aa, Homo sapiens
  Heavy chain CDR3 for antibody 4915 (IGHV3-23)
AKDGSYYDYYYGMDV

SEQ ID NO: 9831 - protein, 9 aa, Homo sapiens
  Light chain CDR3 for antibody 4916 (IGKV3-7)
QQDYELPLT

SEQ ID NO: 9832 - protein, 18 aa, Homo sapiens
  Heavy chain CDR3 for antibody 4916 (IGHV6-1)
ARDQYSYGPYYYYYGMDV

SEQ ID NO: 9833 - protein, 8 aa, Homo sapiens
  Light chain CDR3 for antibody 4917 (IGKV1D-13)
QQFNNYPT

SEQ ID NO: 9834 - protein, 11 aa, Homo sapiens
  Heavy chain CDR3 for antibody 4917 (IGHV3-33)
ARARYTTGLDY

SEQ ID NO: 9835 - protein, 9 aa, Homo sapiens
  Light chain CDR3 for antibody 4918 (IGKV1-39)
QQSYSTPLT

SEQ ID NO: 9836 - protein, 14 aa, Homo sapiens
  Heavy chain CDR3 for antibody 4918 (IGHV4-39)
ARHGYYGSSNWFDP

SEQ ID NO: 9837 - protein, 8 aa, Homo sapiens
  Light chain CDR3 for antibody 4919 (IGKV3D-7)
QQDYNLLT

SEQ ID NO: 9838 - protein, 11 aa, Homo sapiens
  Heavy chain CDR3 for antibody 4919 (IGHV3-33)
ARARYTTGLDY

SEQ ID NO: 9839 - protein, 9 aa, Homo sapiens
  Light chain CDR3 for antibody 4920 (IGKV1-16)
QHYNDYPFT

SEQ ID NO: 9840 - protein, 13 aa, Homo sapiens
  Heavy chain CDR3 for antibody 4920 (IGHV3-33)
ARDYCGGDCYLDY

SEQ ID NO: 9841 - protein, 9 aa, Homo sapiens
  Light chain CDR3 for antibody 4921 (IGKV6-21)
HQSSSLPYT

SEQ ID NO: 9842 - protein, 15 aa, Homo sapiens
  Heavy chain CDR3 for antibody 4921 (IGHV1-46)
ARGRFFDWLLSPFDY

SEQ ID NO: 9843 - protein, 6 aa, Homo sapiens
  Light chain CDR3 for antibody 4922 (IGKV3-20)
QQYGST

SEQ ID NO: 9844 - protein, 11 aa, Homo sapiens
  Heavy chain CDR3 for antibody 4922 (IGHV3-33)
ARDRSSGPFDY

SEQ ID NO: 9845 - protein, 8 aa, Homo sapiens
  Light chain CDR3 for antibody 4923 (IGKV3D-7)
QQDYNLLT

SEQ ID NO: 9846 - protein, 17 aa, Homo sapiens
  Heavy chain CDR3 for antibody 4923 (IGHV3-33)
ARGEQWLGYYYYYGMDV

SEQ ID NO: 9847 - protein, 8 aa, Homo sapiens
  Light chain CDR3 for antibody 4924 (IGKV3D-7)
QQDYNLLT

SEQ ID NO: 9848 - protein, 17 aa, Homo sapiens
  Heavy chain CDR3 for antibody 4924 (IGHV1-18)
ARERYYGSGSYKYNMDV

SEQ ID NO: 9849 - protein, 8 aa, Homo sapiens
  Light chain CDR3 for antibody 4925 (IGKV1-5)
QQYNSYYT

SEQ ID NO: 9850 - protein, 13 aa, Homo sapiens
  Heavy chain CDR3 for antibody 4925 (IGHV3-33)
AREYCSGGSCYDY

SEQ ID NO: 9851 - protein, 8 aa, Homo sapiens
  Light chain CDR3 for antibody 4926 (IGKV3D-7)
QQDYNLLT

SEQ ID NO: 9852 - protein, 18 aa, Homo sapiens
  Heavy chain CDR3 for antibody 4926 (IGHV4-39)
ARQYYFGSGNYYRGWFDP

SEQ ID NO: 9853 - protein, 9 aa, Homo sapiens
  Light chain CDR3 for antibody 4927 (IGKV4-1)
QQYYSTPWT

SEQ ID NO: 9854 - protein, 13 aa, Homo sapiens
  Heavy chain CDR3 for antibody 4927 (IGHV3-11)
ARDGGAAAGTWDS

SEQ ID NO: 9855 - protein, 9 aa, Homo sapiens
  Light chain CDR3 for antibody 4928 (IGKV1-17)
LQHNSYPWT

SEQ ID NO: 9856 - protein, 14 aa, Homo sapiens
  Heavy chain CDR3 for antibody 4928 (IGHV3-33)
ARASSGSSYWYIDL

SEQ ID NO: 9857 - protein, 9 aa, Homo sapiens
  Light chain CDR3 for antibody 4929 (IGKV1-6)
LQDYNYPWT

SEQ ID NO: 9858 - protein, 17 aa, Homo sapiens
  Heavy chain CDR3 for antibody 4929 (IGHV3-66)
ARVQYDILTGYSPYFDN

SEQ ID NO: 9859 - protein, 9 aa, Homo sapiens
  Light chain CDR3 for antibody 4930 (IGKV1-9)
QQLKSYLYT

SEQ ID NO: 9860 - protein, 20 aa, Homo sapiens
  Heavy chain CDR3 for antibody 4930 (IGHV1-f)
ATGLITFVRGVILTYRSFDY

SEQ ID NO: 9861 - protein, 9 aa, Homo sapiens
  Light chain CDR3 for antibody 4931 (IGKV1-9)
QQLISYPLT

SEQ ID NO: 9862 - protein, 9 aa, Homo sapiens
  Heavy chain CDR3 for antibody 4931 (IGHV3-33)
AREYKEFDY

SEQ ID NO: 9863 - protein, 9 aa, Homo sapiens
  Light chain CDR3 for antibody 4932 (IGKV1-27)
QKYNSAPYT

SEQ ID NO: 9864 - protein, 10 aa, Homo sapiens
  Heavy chain CDR3 for antibody 4932 (IGHV3-33)
ARNILTPLDY

SEQ ID NO: 9865 - protein, 9 aa, Homo sapiens
  Light chain CDR3 for antibody 4933 (IGKV2-30)
MQGTHWPLT

SEQ ID NO: 9866 - protein, 14 aa, Homo sapiens
  Heavy chain CDR3 for antibody 4933 (IGHV3-20)
ARDGGSTCYDWFDP

SEQ ID NO: 9867 - protein, 10 aa, Homo sapiens
  Light chain CDR3 for antibody 4934 (IGKV1-39)
QQSYSTPMYT

SEQ ID NO: 9868 - protein, 10 aa, Homo sapiens
  Heavy chain CDR3 for antibody 4934 (IGHV3-23)
AKEQWLVLDY

SEQ ID NO: 9869 - protein, 9 aa, Homo sapiens
  Light chain CDR3 for antibody 4935 (IGKV5-2)
LQHDNFPWT

SEQ ID NO: 9870 - protein, 14 aa, Homo sapiens
  Heavy chain CDR3 for antibody 4935 (IGHV4-39)
ARQGDILTGYSFDN

SEQ ID NO: 9871 - protein, 9 aa, Homo sapiens
  Light chain CDR3 for antibody 4936 (IGKV1-6)
LQDYNYPRT

SEQ ID NO: 9872 - protein, 14 aa, Homo sapiens
  Heavy chain CDR3 for antibody 4936 (IGHV1-46)
ARDGVGAKEGGSDY

SEQ ID NO: 9873 - protein, 9 aa, Homo sapiens
  Light chain CDR3 for antibody 4937 (IGKV1D-16)
QQYNSYPYT

SEQ ID NO: 9874 - protein, 13 aa, Homo sapiens
  Heavy chain CDR3 for antibody 4937 (IGHV3-33)
ARQSSGWFDVFDI

SEQ ID NO: 9875 - protein, 9 aa, Homo sapiens
  Light chain CDR3 for antibody 4938 (IGKV2-30)
MQGTHWPLT

SEQ ID NO: 9876 - protein, 15 aa, Homo sapiens
  Heavy chain CDR3 for antibody 4938 (IGHV3-33)
AREGLRYFHYYGMDV

SEQ ID NO: 9877 - protein, 9 aa, Homo sapiens
  Light chain CDR3 for antibody 4939 (IGKV1D-13)
QQFNNYPHT

SEQ ID NO: 9878 - protein, 18 aa, Homo sapiens
  Heavy chain CDR3 for antibody 4939 (IGHV3-33)
ARGGYDILTGYYRTGMDV

SEQ ID NO: 9879 - protein, 9 aa, Homo sapiens
  Light chain CDR3 for antibody 4940 (IGKV1-6)
LQDYNYPWT

SEQ ID NO: 9880 - protein, 13 aa, Homo sapiens
  Heavy chain CDR3 for antibody 4940 (IGHV3-33)
ARGGYYGSGSLDY

SEQ ID NO: 9881 - protein, 10 aa, Homo sapiens
  Light chain CDR3 for antibody 4941 (IGKV1-17)
LQHNSYPMYT

SEQ ID NO: 9882 - protein, 11 aa, Homo sapiens
  Heavy chain CDR3 for antibody 4941 (IGHV3-33)
ARDILTGFLDH

SEQ ID NO: 9883 - protein, 11 aa, Homo sapiens
  Light chain CDR3 for antibody 4942 (IGKV3-11)
QQRSNWPPTWT

SEQ ID NO: 9884 - protein, 17 aa, Homo sapiens
  Heavy chain CDR3 for antibody 4942 (IGHV3-33)
ARDLIGPLSSSWYPFDY

SEQ ID NO: 9885 - protein, 9 aa, Homo sapiens
  Light chain CDR3 for antibody 4943 (IGKV1-16)
QQYDSYPWT

SEQ ID NO: 9886 - protein, 17 aa, Homo sapiens
  Heavy chain CDR3 for antibody 4943 (IGHV4-34)
AGLRFFDWLFDYYGMDV

SEQ ID NO: 9887 - protein, 8 aa, Homo sapiens
  Light chain CDR3 for antibody 4944 (IGKV3-11)
QQRSNWLT

SEQ ID NO: 9888 - protein, 15 aa, Homo sapiens
  Heavy chain CDR3 for antibody 4944 (IGHV3-30)
ARGAMVRGVDYGMDV

SEQ ID NO: 9889 - protein, 8 aa, Homo sapiens
  Light chain CDR3 for antibody 4945 (IGKV3D-7)
QQDYNLLT

SEQ ID NO: 9890 - protein, 10 aa, Homo sapiens
  Heavy chain CDR3 for antibody 4945 (IGHV3-23)
AKDHYGDYPY

SEQ ID NO: 9891 - protein, 8 aa, Homo sapiens
  Light chain CDR3 for antibody 4946 (IGKV6-21)
HQSSSLPT

SEQ ID NO: 9892 - protein, 11 aa, Homo sapiens
  Heavy chain CDR3 for antibody 4946 (IGHV3-33)
ARDRVLTPFDY

SEQ ID NO: 9893 - protein, 10 aa, Homo sapiens
  Light chain CDR3 for antibody 4947 (IGKV1-17)
LQHNSYPMYT

SEQ ID NO: 9894 - protein, 12 aa, Homo sapiens
  Heavy chain CDR3 for antibody 4947 (IGHV1-18)
ARILFYGDYFDY

SEQ ID NO: 9895 - protein, 9 aa, Homo sapiens
  Light chain CDR3 for antibody 4948 (IGKV3-11)
QQRSNWPLT

SEQ ID NO: 9896 - protein, 14 aa, Homo sapiens
  Heavy chain CDR3 for antibody 4948 (IGHV3-33)
ARRGYSGYDWYFDY

SEQ ID NO: 9897 - protein, 9 aa, Homo sapiens
  Light chain CDR3 for antibody 4949 (IGKV2-30)
MQGTHWPLT

SEQ ID NO: 9898 - protein, 17 aa, Homo sapiens
  Heavy chain CDR3 for antibody 4949 (IGHV3-23)
AKDTITMVRGALFGMDV

SEQ ID NO: 9899 - protein, 9 aa, Homo sapiens
  Light chain CDR3 for antibody 4950 (IGKV1-16)
QHYNDYPFT

SEQ ID NO: 9900 - protein, 14 aa, Homo sapiens
  Heavy chain CDR3 for antibody 4950 (IGHV3-23)
AKSRIVGALYYFDY

SEQ ID NO: 9901 - protein, 9 aa, Homo sapiens
  Light chain CDR3 for antibody 4951 (IGKV3-11)
QQRSNWPLT

SEQ ID NO: 9902 - protein, 14 aa, Homo sapiens
  Heavy chain CDR3 for antibody 4951 (IGHV3-23)
ARDRRDFYYYGMDV

SEQ ID NO: 9903 - protein, 9 aa, Homo sapiens
  Light chain CDR3 for antibody 4952 (IGKV6-21)
HQSSSLPYT

SEQ ID NO: 9904 - protein, 17 aa, Homo sapiens
  Heavy chain CDR3 for antibody 4952 (IGHV4-39)
ARNTMVGTWQRQGNLDH

SEQ ID NO: 9905 - protein, 10 aa, Homo sapiens
  Light chain CDR3 for antibody 4953 (IGKV1-17)
LQHNSYPMYT

SEQ ID NO: 9906 - protein, 11 aa, Homo sapiens
  Heavy chain CDR3 for antibody 4953 (IGHV3-33)
AREAANWGFDY

SEQ ID NO: 9907 - protein, 10 aa, Homo sapiens
  Light chain CDR3 for antibody 4954 (IGKV3-15)
QQYNNWPPYT

SEQ ID NO: 9908 - protein, 17 aa, Homo sapiens
  Heavy chain CDR3 for antibody 4954 (IGHV1-18)
ARDRAFTMVRGVPPFDY

SEQ ID NO: 9909 - protein, 9 aa, Homo sapiens
  Light chain CDR3 for antibody 4955 (IGKV3-11)
QQRSNWPPT

SEQ ID NO: 9910 - protein, 17 aa, Homo sapiens
  Heavy chain CDR3 for antibody 4955 (IGHV3-33)
ARGDGDILTGYYEWFDP

SEQ ID NO: 9911 - protein, 8 aa, Homo sapiens
  Light chain CDR3 for antibody 4956 (IGKV1-5)
QQYNSYWT

SEQ ID NO: 9912 - protein, 20 aa, Homo sapiens
  Heavy chain CDR3 for antibody 4956 (IGHV3-23)
AKDREMAATSHYYYYYGMDV

SEQ ID NO: 9913 - protein, 9 aa, Homo sapiens
  Light chain CDR3 for antibody 4957 (IGKV6-21)
HQSSSLPYT

SEQ ID NO: 9914 - protein, 13 aa, Homo sapiens
  Heavy chain CDR3 for antibody 4957 (IGHV3-33)
ARAFTMVRGVIDY

SEQ ID NO: 9915 - protein, 9 aa, Homo sapiens
  Light chain CDR3 for antibody 4958 (IGKV1-33)
QQYDNLPFT

SEQ ID NO: 9916 - protein, 9 aa, Homo sapiens
  Heavy chain CDR3 for antibody 4958 (IGHV3-30)
ARDNWGFDY

SEQ ID NO: 9917 - protein, 8 aa, Homo sapiens
  Light chain CDR3 for antibody 4959 (IGKV1D-13)
QQFNNYPT

SEQ ID NO: 9918 - protein, 14 aa, Homo sapiens
  Heavy chain CDR3 for antibody 4959 (IGHV3-33)
ARDRRDFYYYGMDV

SEQ ID NO: 9919 - protein, 9 aa, Homo sapiens
  Light chain CDR3 for antibody 4960 (IGKV1D-13)
QQFNNYPYT

SEQ ID NO: 9920 - protein, 15 aa, Homo sapiens
  Heavy chain CDR3 for antibody 4960 (IGHV3-33)
ARDGSGSYSLYGMDV

SEQ ID NO: 9921 - protein, 9 aa, Homo sapiens
  Light chain CDR3 for antibody 4961 (IGKV1-9)
QQYGSSPYT

SEQ ID NO: 9922 - protein, 17 aa, Homo sapiens
  Heavy chain CDR3 for antibody 4961 (IGHV3-33)
ARSPYDILTGYSYYFDY

SEQ ID NO: 9923 - protein, 8 aa, Homo sapiens
  Light chain CDR3 for antibody 4962 (IGKV3D-7)
QQDYNLLT

SEQ ID NO: 9924 - protein, 14 aa, Homo sapiens
  Heavy chain CDR3 for antibody 4962 (IGHV3-33)
ARGGYSGYRYYFDY

SEQ ID NO: 9925 - protein, 10 aa, Homo sapiens
  Light chain CDR3 for antibody 4963 (IGKV3-11)
QQRSNWPIFT

SEQ ID NO: 9926 - protein, 13 aa, Homo sapiens
  Heavy chain CDR3 for antibody 4963 (IGHV3-33)
VSTGDSYYYVMDV

SEQ ID NO: 9927 - protein, 11 aa, Homo sapiens
  Light chain CDR3 for antibody 4964 (IGKV3-11)
QQRSNWPPTWT

SEQ ID NO: 9928 - protein, 11 aa, Homo sapiens
  Heavy chain CDR3 for antibody 4964 (IGHV3-33)
ARDRSSGPFDY

SEQ ID NO: 9929 - protein, 9 aa, Homo sapiens
  Light chain CDR3 for antibody 4965 (IGKV6-21)
HQSTSLPFT

SEQ ID NO: 9930 - protein, 12 aa, Homo sapiens
  Heavy chain CDR3 for antibody 4965 (IGHV1-46)
ARGLTGDHAFDI

SEQ ID NO: 9931 - protein, 9 aa, Homo sapiens
  Light chain CDR3 for antibody 4966 (IGKV6-21)
HQSSSLPYT

SEQ ID NO: 9932 - protein, 15 aa, Homo sapiens
  Heavy chain CDR3 for antibody 4966 (IGHV1-2)
ARDLGYYGSGSRMDV

SEQ ID NO: 9933 - protein, 9 aa, Homo sapiens
  Light chain CDR3 for antibody 4967 (IGKV1-6)
LQDYNYPYT

SEQ ID NO: 9934 - protein, 13 aa, Homo sapiens
  Heavy chain CDR3 for antibody 4967 (IGHV3-33)
ARGRGYNYGYGDY

SEQ ID NO: 9935 - protein, 9 aa, Homo sapiens
  Light chain CDR3 for antibody 4968 (IGKV1-9)
QQLKSYLYT

SEQ ID NO: 9936 - protein, 19 aa, Homo sapiens
  Heavy chain CDR3 for antibody 4968 (IGHV1-18)
ARDDILTGYSLYYYYGMDV

SEQ ID NO: 9937 - protein, 9 aa, Homo sapiens
  Light chain CDR3 for antibody 4969 (IGKV3D-7)
QQDSNLPYT

SEQ ID NO: 9938 - protein, 13 aa, Homo sapiens
  Heavy chain CDR3 for antibody 4969 (IGHV4-34)
ASNFYYYYYGMDV

SEQ ID NO: 9939 - protein, 9 aa, Homo sapiens
  Light chain CDR3 for antibody 4970 (IGKV1-6)
LQDYNYPWT

SEQ ID NO: 9940 - protein, 14 aa, Homo sapiens
  Heavy chain CDR3 for antibody 4970 (IGHV3-11)
AGRHYDILTGFSDY

SEQ ID NO: 9941 - protein, 9 aa, Homo sapiens
  Light chain CDR3 for antibody 4971 (IGKV1-33)
QQYDNLPFT

SEQ ID NO: 9942 - protein, 17 aa, Homo sapiens
  Heavy chain CDR3 for antibody 4971 (IGHV3-33)
ARGFSGYDGYYYYGMDV

SEQ ID NO: 9943 - protein, 9 aa, Homo sapiens
  Light chain CDR3 for antibody 4972 (IGKV1-17)
LQHNSYPWT

SEQ ID NO: 9944 - protein, 23 aa, Homo sapiens
  Heavy chain CDR3 for antibody 4972 (IGHV3-11)
ARDRGITMVRGVITYYYFYGMDV

SEQ ID NO: 9945 - protein, 9 aa, Homo sapiens
  Light chain CDR3 for antibody 4973 (IGKV3D-7)
QQDYNLPLT

SEQ ID NO: 9946 - protein, 13 aa, Homo sapiens
  Heavy chain CDR3 for antibody 4973 (IGHV3-33)
ARDYTMVRGVMNY

SEQ ID NO: 9947 - protein, 10 aa, Homo sapiens
  Light chain CDR3 for antibody 4974 (IGKV3-11)
QQRSNWPTWT

SEQ ID NO: 9948 - protein, 17 aa, Homo sapiens
  Heavy chain CDR3 for antibody 4974 (IGHV3-33)
ARGFSGYDGYYYYGMDV

SEQ ID NO: 9949 - protein, 9 aa, Homo sapiens
  Light chain CDR3 for antibody 4975 (IGKV1-39)
QQSYSTPLT

SEQ ID NO: 9950 - protein, 14 aa, Homo sapiens
  Heavy chain CDR3 for antibody 4975 (IGHV3-20)
ARDEGSGGYDVFDI

SEQ ID NO: 9951 - protein, 9 aa, Homo sapiens
  Light chain CDR3 for antibody 4976 (IGKV1-39)
QQSYSTPWT

SEQ ID NO: 9952 - protein, 15 aa, Homo sapiens
  Heavy chain CDR3 for antibody 4976 (IGHV4-39)
ARQGLVATIKGYFQH

SEQ ID NO: 9953 - protein, 9 aa, Homo sapiens
  Light chain CDR3 for antibody 4977 (IGKV3-11)
QQRSNWPLT

SEQ ID NO: 9954 - protein, 12 aa, Homo sapiens
  Heavy chain CDR3 for antibody 4977 (IGHV3-23)
AKESLYTPTDDY

SEQ ID NO: 9955 - protein, 9 aa, Homo sapiens
  Light chain CDR3 for antibody 4978 (IGKV1-9)
QQLISYPLT

SEQ ID NO: 9956 - protein, 14 aa, Homo sapiens
  Heavy chain CDR3 for antibody 4978 (IGHV1-46)
ARDGVGAKEGGSDY

SEQ ID NO: 9957 - protein, 9 aa, Homo sapiens
  Light chain CDR3 for antibody 4979 (IGKV1-9)
QQLKSYLYT

SEQ ID NO: 9958 - protein, 12 aa, Homo sapiens
  Heavy chain CDR3 for antibody 4979 (IGHV1-24)
ASDWAYYYGMDV

SEQ ID NO: 9959 - protein, 9 aa, Homo sapiens
  Light chain CDR3 for antibody 4980 (IGKV3-11)
QQRSNWPPT

SEQ ID NO: 9960 - protein, 13 aa, Homo sapiens
  Heavy chain CDR3 for antibody 4980 (IGHV4-61)
ARRYSSGWYPFDY

SEQ ID NO: 9961 - protein, 9 aa, Homo sapiens
  Light chain CDR3 for antibody 4981 (IGKV3-15)
QQYNNWPLT

SEQ ID NO: 9962 - protein, 19 aa, Homo sapiens
  Heavy chain CDR3 for antibody 4981 (IGHV1-18)
ARDDILTGYSLYYYYGMDV

SEQ ID NO: 9963 - protein, 9 aa, Homo sapiens
  Light chain CDR3 for antibody 4982 (IGKV1-39)
QQSYRTPLT

SEQ ID NO: 9964 - protein, 13 aa, Homo sapiens
  Heavy chain CDR3 for antibody 4982 (IGHV3-11)
AREGIAVAGDFDH

SEQ ID NO: 9965 - protein, 10 aa, Homo sapiens
  Light chain CDR3 for antibody 4983 (IGKV1-17)
LQHNSYPMYT

SEQ ID NO: 9966 - protein, 16 aa, Homo sapiens
  Heavy chain CDR3 for antibody 4983 (IGHV3-23)
AKEGEVLRYFDWLFNY

SEQ ID NO: 9967 - protein, 9 aa, Homo sapiens
  Light chain CDR3 for antibody 4984 (IGKV1D-13)
QQFNNYMYT

SEQ ID NO: 9968 - protein, 14 aa, Homo sapiens
  Heavy chain CDR3 for antibody 4984 (IGHV4-39)
ARQGTMIRGGYFDY

SEQ ID NO: 9969 - protein, 9 aa, Homo sapiens
  Light chain CDR3 for antibody 4985 (IGKV5-2)
LQHDNFPWT

SEQ ID NO: 9970 - protein, 13 aa, Homo sapiens
  Heavy chain CDR3 for antibody 4985 (IGHV1-18)
ARSYYGSGSPFDY

SEQ ID NO: 9971 - protein, 9 aa, Homo sapiens
  Light chain CDR3 for antibody 4986 (IGKV3D-7)
QQDYKLPLT

SEQ ID NO: 9972 - protein, 10 aa, Homo sapiens
  Heavy chain CDR3 for antibody 4986 (IGHV1-18)
AREQRLGFDY

SEQ ID NO: 9973 - protein, 9 aa, Homo sapiens
  Light chain CDR3 for antibody 4987 (IGKV3-11)
QQRSNWPLT

SEQ ID NO: 9974 - protein, 17 aa, Homo sapiens
  Heavy chain CDR3 for antibody 4987 (IGHV1-18)
ARERYYGSGIYKYAMDV

SEQ ID NO: 9975 - protein, 9 aa, Homo sapiens
  Light chain CDR3 for antibody 4988 (IGKV1-6)
LQDYNYPYT

SEQ ID NO: 9976 - protein, 16 aa, Homo sapiens
  Heavy chain CDR3 for antibody 4988 (IGHV3-33)
ARAPGGDYYFYFGMDV

SEQ ID NO: 9977 - protein, 9 aa, Homo sapiens
  Light chain CDR3 for antibody 4989 (IGKV1-39)
QQSYSTPLT

SEQ ID NO: 9978 - protein, 19 aa, Homo sapiens
  Heavy chain CDR3 for antibody 4989 (IGHV3-33)
TRDPHYDILTGYAYYGMDV

SEQ ID NO: 9979 - protein, 9 aa, Homo sapiens
  Light chain CDR3 for antibody 4990 (IGKV1D-16)
QQYNSYPLT

SEQ ID NO: 9980 - protein, 18 aa, Homo sapiens
  Heavy chain CDR3 for antibody 4990 (IGHV3-33)
AREGYFGSGSYYRNWFDP

SEQ ID NO: 9981 - protein, 9 aa, Homo sapiens
  Light chain CDR3 for antibody 4991 (IGKV6-21)
HQSSSLPLT

SEQ ID NO: 9982 - protein, 13 aa, Homo sapiens
  Heavy chain CDR3 for antibody 4991 (IGHV3-33)
ARVDYYNYYGLDV

SEQ ID NO: 9983 - protein, 9 aa, Homo sapiens
  Light chain CDR3 for antibody 4992 (IGKV5-2)
LQHDNFPYT

SEQ ID NO: 9984 - protein, 23 aa, Homo sapiens
  Heavy chain CDR3 for antibody 4992 (IGHV3-11)
ARDRGITMVRGVITYYYFYGMDV

SEQ ID NO: 9985 - protein, 9 aa, Homo sapiens
  Light chain CDR3 for antibody 4993 (IGKV1-6)
LQDYNYPYT

SEQ ID NO: 9986 - protein, 12 aa, Homo sapiens
  Heavy chain CDR3 for antibody 4993 (IGHV1-18)
ARKGIEVGGFDY

SEQ ID NO: 9987 - protein, 9 aa, Homo sapiens
  Light chain CDR3 for antibody 4994 (IGKV1-39)
QQGFSTPWT

SEQ ID NO: 9988 - protein, 13 aa, Homo sapiens
  Heavy chain CDR3 for antibody 4994 (IGHV4-34)
ASNFYYYYYGMDV

SEQ ID NO: 9989 - protein, 9 aa, Homo sapiens
  Light chain CDR3 for antibody 4995 (IGKV1-17)
QQHNSYPYT

SEQ ID NO: 9990 - protein, 18 aa, Homo sapiens
  Heavy chain CDR3 for antibody 4995 (IGHV4-39)
VKYITMVRGDIITGPFAY

SEQ ID NO: 9991 - protein, 9 aa, Homo sapiens
  Light chain CDR3 for antibody 4996 (IGKV3-15)
QQYNNWPLT

SEQ ID NO: 9992 - protein, 10 aa, Homo sapiens
  Heavy chain CDR3 for antibody 4996 (IGHV1-18)
AREQRLGFDY

SEQ ID NO: 9993 - protein, 9 aa, Homo sapiens
  Light chain CDR3 for antibody 4997 (IGKV5-2)
LQHDNFPYT

SEQ ID NO: 9994 - protein, 18 aa, Homo sapiens
  Heavy chain CDR3 for antibody 4997 (IGHV3-33)
ARRTAAGTGDYYYYGMDV

SEQ ID NO: 9995 - protein, 9 aa, Homo sapiens
  Light chain CDR3 for antibody 4998 (IGKV3D-7)
QQDYNLPLT

SEQ ID NO: 9996 - protein, 8 aa, Homo sapiens
  Heavy chain CDR3 for antibody 4998 (IGHV3-23)
AKESLLDY

SEQ ID NO: 9997 - protein, 8 aa, Homo sapiens
  Light chain CDR3 for antibody 4999 (IGKV3D-7)
QQDYNLYT

SEQ ID NO: 9998 - protein, 22 aa, Homo sapiens
  Heavy chain CDR3 for antibody 4999 (IGHV3-33)
ARREHIVVVTAIPGYYYYGMDV

SEQ ID NO: 9999 - protein, 9 aa, Homo sapiens
  Light chain CDR3 for antibody 5000 (IGKV3D-7)
QQDYNLPLT

SEQ ID NO: 10000 - protein, 11 aa, Homo sapiens
  Heavy chain CDR3 for antibody 5000 (IGHV3-33)
ARGSGSYAFDY

SEQ ID NO: 10001 - protein, 8 aa, Homo sapiens
  Light chain CDR3 for antibody 5001 (IGKV3D-7)
QQDYNLLT

SEQ ID NO: 10002 - protein, 11 aa, Homo sapiens
  Heavy chain CDR3 for antibody 5001 (IGHV3-13)
AREAIIGPFDY

SEQ ID NO: 10003 - protein, 9 aa, Homo sapiens
  Light chain CDR3 for antibody 5002 (IGKV1-39)
QQSYSTPLT

SEQ ID NO: 10004 - protein, 14 aa, Homo sapiens
  Heavy chain CDR3 for antibody 5002 (IGHV3-33)
AREGYSSGWDYFDH

SEQ ID NO: 10005 - protein, 9 aa, Homo sapiens
  Light chain CDR3 for antibody 5003 (IGKV1D-16)
QQYDSYPWT

SEQ ID NO: 10006 - protein, 15 aa, Homo sapiens
  Heavy chain CDR3 for antibody 5003 (IGHV3-23)
AKDLSSGWFAYFFDY

SEQ ID NO: 10007 - protein, 9 aa, Homo sapiens
  Light chain CDR3 for antibody 5004 (IGKV3-11)
QQRSNWPLT

SEQ ID NO: 10008 - protein, 14 aa, Homo sapiens
  Heavy chain CDR3 for antibody 5004 (IGHV3-33)
ARDGYDILTGPFDY

SEQ ID NO: 10009 - protein, 8 aa, Homo sapiens
  Light chain CDR3 for antibody 5005 (IGKV3D-7)
QQDYNLLT

SEQ ID NO: 10010 - protein, 7 aa, Homo sapiens
  Heavy chain CDR3 for antibody 5005 (IGHV3-33)
ARELVDY

SEQ ID NO: 10011 - protein, 9 aa, Homo sapiens
  Light chain CDR3 for antibody 5006 (IGKV1-6)
LQDYKSPFT

SEQ ID NO: 10012 - protein, 13 aa, Homo sapiens
  Heavy chain CDR3 for antibody 5006 (IGHV3-23)
ARAFFMVRGVIDF

SEQ ID NO: 10013 - protein, 9 aa, Homo sapiens
  Light chain CDR3 for antibody 5007 (IGKV1-6)
LQDYNYPWT

SEQ ID NO: 10014 - protein, 9 aa, Homo sapiens
  Heavy chain CDR3 for antibody 5007 (IGHV3-33)
ARDAVYFDY

SEQ ID NO: 10015 - protein, 9 aa, Homo sapiens
  Light chain CDR3 for antibody 5008 (IGKV2-30)
MQGTHWPLT

SEQ ID NO: 10016 - protein, 18 aa, Homo sapiens
  Heavy chain CDR3 for antibody 5008 (IGHV3-33)
ARREGITLIFYYYYGMDV

SEQ ID NO: 10017 - protein, 9 aa, Homo sapiens
  Light chain CDR3 for antibody 5009 (IGKV1D-13)
QQFNNYPHT

SEQ ID NO: 10018 - protein, 9 aa, Homo sapiens
  Heavy chain CDR3 for antibody 5009 (IGHV3-23)
AKEQQLFDY

SEQ ID NO: 10019 - protein, 9 aa, Homo sapiens
  Light chain CDR3 for antibody 5010 (IGKV1-16)
QQYNRYPYT

SEQ ID NO: 10020 - protein, 22 aa, Homo sapiens
  Heavy chain CDR3 for antibody 5010 (IGHV4-59)
AREINYGSGSYYNEDYYYGMDV

SEQ ID NO: 10021 - protein, 9 aa, Homo sapiens
  Light chain CDR3 for antibody 5011 (IGKV1-9)
QQLNTYPWT

SEQ ID NO: 10022 - protein, 14 aa, Homo sapiens
  Heavy chain CDR3 for antibody 5011 (IGHV3-33)
ARQYSYGYPYYFDY

SEQ ID NO: 10023 - protein, 9 aa, Homo sapiens
  Light chain CDR3 for antibody 5012 (IGKV5-2)
LQHDKFPYT

SEQ ID NO: 10024 - protein, 13 aa, Homo sapiens
  Heavy chain CDR3 for antibody 5012 (IGHV4-34)
ASNFYYYYYGMDV

SEQ ID NO: 10025 - protein, 9 aa, Homo sapiens
  Light chain CDR3 for antibody 5013 (IGKV1-5)
QQYNTYSRT

SEQ ID NO: 10026 - protein, 13 aa, Homo sapiens
  Heavy chain CDR3 for antibody 5013 (IGHV3-23)
ASPFNWNDGFFDY

SEQ ID NO: 10027 - protein, 9 aa, Homo sapiens
  Light chain CDR3 for antibody 5014 (IGKV3D-7)
QQDYNLPLT

SEQ ID NO: 10028 - protein, 9 aa, Homo sapiens
  Heavy chain CDR3 for antibody 5014 (IGHV1-18)
ARGGWGFEY

SEQ ID NO: 10029 - protein, 9 aa, Homo sapiens
  Light chain CDR3 for antibody 5015 (IGKV5-2)
LQHDNFPYT

SEQ ID NO: 10030 - protein, 14 aa, Homo sapiens
  Heavy chain CDR3 for antibody 5015 (IGHV3-33)
ARDGAAAALDAFDI

SEQ ID NO: 10031 - protein, 9 aa, Homo sapiens
  Light chain CDR3 for antibody 5016 (IGKV1-17)
LQHNSYPLT

SEQ ID NO: 10032 - protein, 22 aa, Homo sapiens
  Heavy chain CDR3 for antibody 5016 (IGHV3-48)
ARGDYDILTGYRGYYSYYGMDV

SEQ ID NO: 10033 - protein, 9 aa, Homo sapiens
  Light chain CDR3 for antibody 5017 (IGKV3-20)
QQYGSSPYT

SEQ ID NO: 10034 - protein, 19 aa, Homo sapiens
  Heavy chain CDR3 for antibody 5017 (IGHV3-33)
ARGVRLRFFDPYYYYGLDV

SEQ ID NO: 10035 - protein, 9 aa, Homo sapiens
  Light chain CDR3 for antibody 5018 (IGKV6-21)
HQSSSLPYT

SEQ ID NO: 10036 - protein, 16 aa, Homo sapiens
  Heavy chain CDR3 for antibody 5018 (IGHV3-64)
ARGRYFDWLLGDWFDP

SEQ ID NO: 10037 - protein, 9 aa, Homo sapiens
  Light chain CDR3 for antibody 5019 (IGKV6-21)
HQSSSLPYT

SEQ ID NO: 10038 - protein, 17 aa, Homo sapiens
  Heavy chain CDR3 for antibody 5019 (IGHV3-33)
ARKDYGILSGYYSPFDY

SEQ ID NO: 10039 - protein, 10 aa, Homo sapiens
  Light chain CDR3 for antibody 5020 (IGKV1-17)
LQHNSYPMYT

SEQ ID NO: 10040 - protein, 13 aa, Homo sapiens
  Heavy chain CDR3 for antibody 5020 (IGHV3-11)
ARDEGYRGYVLDT

SEQ ID NO: 10041 - protein, 9 aa, Homo sapiens
  Light chain CDR3 for antibody 5021 (IGKV6-21)
HQSSSLPYT

SEQ ID NO: 10042 - protein, 20 aa, Homo sapiens
  Heavy chain CDR3 for antibody 5021 (IGHV3-23)
AKDRMTTVTSYYYYSYGMDV

SEQ ID NO: 10043 - protein, 9 aa, Homo sapiens
  Light chain CDR3 for antibody 5022 (IGKV1-6)
LQDFHYPWT

SEQ ID NO: 10044 - protein, 12 aa, Homo sapiens
  Heavy chain CDR3 for antibody 5022 (IGHV3-13)
AREAGIPDAFDI

SEQ ID NO: 10045 - protein, 9 aa, Homo sapiens
  Light chain CDR3 for antibody 5023 (IGKV3-20)
QQYGSSPWT

SEQ ID NO: 10046 - protein, 14 aa, Homo sapiens
  Heavy chain CDR3 for antibody 5023 (IGHV3-23)
AKGGDILTGYYTDY

SEQ ID NO: 10047 - protein, 10 aa, Homo sapiens
  Light chain CDR3 for antibody 5024 (IGKV3-11)
QQRSNWPIFT

SEQ ID NO: 10048 - protein, 12 aa, Homo sapiens
  Heavy chain CDR3 for antibody 5024 (IGHV3-33)
ARVDTAAPYFDY

SEQ ID NO: 10049 - protein, 8 aa, Homo sapiens
  Light chain CDR3 for antibody 5025 (IGKV1D-13)
QQFNNYPT

SEQ ID NO: 10050 - protein, 10 aa, Homo sapiens
  Heavy chain CDR3 for antibody 5025 (IGHV3-23)
AKGDRWRFDP

SEQ ID NO: 10051 - protein, 9 aa, Homo sapiens
  Light chain CDR3 for antibody 5026 (IGKV1D-13)
QQFNNYPYT

SEQ ID NO: 10052 - protein, 15 aa, Homo sapiens
  Heavy chain CDR3 for antibody 5026 (IGHV1-18)
ARRSPNWGHYYGMDV

SEQ ID NO: 10053 - protein, 8 aa, Homo sapiens
  Light chain CDR3 for antibody 5027 (IGKV1-13)
QQYNSYYT

SEQ ID NO: 10054 - protein, 18 aa, Homo sapiens
  Heavy chain CDR3 for antibody 5027 (IGHV3-33)
ARERDYYGSGSYPDAFDI

SEQ ID NO: 10055 - protein, 9 aa, Homo sapiens
  Light chain CDR3 for antibody 5028 (IGKV1-9)
QQLKSYLYT

SEQ ID NO: 10056 - protein, 16 aa, Homo sapiens
  Heavy chain CDR3 for antibody 5028 (IGHV3-23)
AKEGMVLRYFDWLWDY

SEQ ID NO: 10057 - protein, 9 aa, Homo sapiens
  Light chain CDR3 for antibody 5029 (IGKV6-21)
HQSSSLPYT

SEQ ID NO: 10058 - protein, 17 aa, Homo sapiens
  Heavy chain CDR3 for antibody 5029 (IGHV3-33)
ARDRDDILTGFYTYFDY

SEQ ID NO: 10059 - protein, 9 aa, Homo sapiens
  Light chain CDR3 for antibody 5030 (IGKV1D-13)
QQFNNYPYT

SEQ ID NO: 10060 - protein, 18 aa, Homo sapiens
  Heavy chain CDR3 for antibody 5030 (IGHV3-23)
AKVGDFFASGNYWDYFDY

SEQ ID NO: 10061 - protein, 9 aa, Homo sapiens
  Light chain CDR3 for antibody 5031 (IGKV1-9)
QQLISYPLT

SEQ ID NO: 10062 - protein, 17 aa, Homo sapiens
  Heavy chain CDR3 for antibody 5031 (IGHV3-33)
ARGEQWLGYYYYYGMDV

SEQ ID NO: 10063 - protein, 9 aa, Homo sapiens
  Light chain CDR3 for antibody 5032 (IGKV1-6)
LQDYKSPFT

SEQ ID NO: 10064 - protein, 9 aa, Homo sapiens
  Heavy chain CDR3 for antibody 5032 (IGHV3-13)
ARDRWYFDL

SEQ ID NO: 10065 - protein, 9 aa, Homo sapiens
  Light chain CDR3 for antibody 5033 (IGKV5-2)
LQHDNFPYT

SEQ ID NO: 10066 - protein, 14 aa, Homo sapiens
  Heavy chain CDR3 for antibody 5033 (IGHV3-23)
AKGGDVLTGYYPDY

SEQ ID NO: 10067 - protein, 9 aa, Homo sapiens
  Light chain CDR3 for antibody 5034 (IGKV3-15)
QQYNNWPLT

SEQ ID NO: 10068 - protein, 13 aa, Homo sapiens
  Heavy chain CDR3 for antibody 5034 (IGHV3-21)
ARDSTLVRGVFPY

SEQ ID NO: 10069 - protein, 9 aa, Homo sapiens
  Light chain CDR3 for antibody 5035 (IGKV1-16)
QQYNSYPYT

SEQ ID NO: 10070 - protein, 10 aa, Homo sapiens
  Heavy chain CDR3 for antibody 5035 (IGHV3-72)
CRDREGFGDV

SEQ ID NO: 10071 - protein, 9 aa, Homo sapiens
  Light chain CDR3 for antibody 5036 (IGKV1D-13)
QHFNNYMYT

SEQ ID NO: 10072 - protein, 15 aa, Homo sapiens
  Heavy chain CDR3 for antibody 5036 (IGHV1-18)
ARGYCSSTSCYYFDY

SEQ ID NO: 10073 - protein, 9 aa, Homo sapiens
  Light chain CDR3 for antibody 5037 (IGKV5-2)
LQHDNFPWT

SEQ ID NO: 10074 - protein, 15 aa, Homo sapiens
  Heavy chain CDR3 for antibody 5037 (IGHV3-33)
ARDEHYDILTGYWGY

SEQ ID NO: 10075 - protein, 10 aa, Homo sapiens
  Light chain CDR3 for antibody 5038 (IGKV1-17)
LQHNSYPMYT

SEQ ID NO: 10076 - protein, 14 aa, Homo sapiens
  Heavy chain CDR3 for antibody 5038 (IGHV3-33)
ARDKSYPLSYGMDV

SEQ ID NO: 10077 - protein, 9 aa, Homo sapiens
  Light chain CDR3 for antibody 5039 (IGKV1-37)
QRTSNAPYT

SEQ ID NO: 10078 - protein, 16 aa, Homo sapiens
  Heavy chain CDR3 for antibody 5039 (IGHV3-23)
AKEGMVLRYFDWLWDY

SEQ ID NO: 10079 - protein, 9 aa, Homo sapiens
  Light chain CDR3 for antibody 5040 (IGKV1-27)
QKYNSAPYT

SEQ ID NO: 10080 - protein, 9 aa, Homo sapiens
  Heavy chain CDR3 for antibody 5040 (IGHV3-30)
ARDDYGVDV

SEQ ID NO: 10081 - protein, 9 aa, Homo sapiens
  Light chain CDR3 for antibody 5041 (IGKV1D-16)
QQYNSYPFT

SEQ ID NO: 10082 - protein, 10 aa, Homo sapiens
  Heavy chain CDR3 for antibody 5041 (IGHV3-33)
ARDHGYYFDY

SEQ ID NO: 10083 - protein, 9 aa, Homo sapiens
  Light chain CDR3 for antibody 5042 (IGKV1-17)
LQHNSYPWT

SEQ ID NO: 10084 - protein, 21 aa, Homo sapiens
  Heavy chain CDR3 for antibody 5042 (IGHV4-59)
AAGVLLWFGEPNYYYYYGMDV

SEQ ID NO: 10085 - protein, 11 aa, Homo sapiens
  Light chain CDR3 for antibody 5043 (IGKV3-11)
QQRSNWPPTWT

SEQ ID NO: 10086 - protein, 17 aa, Homo sapiens
  Heavy chain CDR3 for antibody 5043 (IGHV4-59)
ARRITMVREIIITAFDY

SEQ ID NO: 10087 - protein, 8 aa, Homo sapiens
  Light chain CDR3 for antibody 5044 (IGKV1D-13)
QQFNNYPT

SEQ ID NO: 10088 - protein, 15 aa, Homo sapiens
  Heavy chain CDR3 for antibody 5044 (IGHV3-30)
ARRGYGSGSPDAFDL

SEQ ID NO: 10089 - protein, 9 aa, Homo sapiens
  Light chain CDR3 for antibody 5045 (IGKV1-9)
QQLISYPLT

SEQ ID NO: 10090 - protein, 9 aa, Homo sapiens
  Heavy chain CDR3 for antibody 5045 (IGHV3-33)
ARATVGVDY

SEQ ID NO: 10091 - protein, 9 aa, Homo sapiens
  Light chain CDR3 for antibody 5046 (IGKV2-30)
MQGTHWPLT

SEQ ID NO: 10092 - protein, 20 aa, Homo sapiens
  Heavy chain CDR3 for antibody 5046 (IGHV3-23)
AKDREMAATSHYYYYYGMDV

SEQ ID NO: 10093 - protein, 10 aa, Homo sapiens
  Light chain CDR3 for antibody 5047 (IGKV3-11)
QQRSNWPTWT

SEQ ID NO: 10094 - protein, 9 aa, Homo sapiens
  Heavy chain CDR3 for antibody 5047 (IGHV3-30)
ARDYFHYDY

SEQ ID NO: 10095 - protein, 10 aa, Homo sapiens
  Light chain CDR3 for antibody 5048 (IGKV3-15)
QQYNNWPPLT

SEQ ID NO: 10096 - protein, 12 aa, Homo sapiens
  Heavy chain CDR3 for antibody 5048 (IGHV3-33)
AREKGGSYSFDY

SEQ ID NO: 10097 - protein, 9 aa, Homo sapiens
  Light chain CDR3 for antibody 5049 (IGKV2-30)
MQGTHWPLT

SEQ ID NO: 10098 - protein, 16 aa, Homo sapiens
  Heavy chain CDR3 for antibody 5049 (IGHV3-30)
ARDIAVAGHVYYGMDV

SEQ ID NO: 10099 - protein, 9 aa, Homo sapiens
  Light chain CDR3 for antibody 5050 (IGKV1-9)
QQLISYPLT

SEQ ID NO: 10100 - protein, 20 aa, Homo sapiens
  Heavy chain CDR3 for antibody 5050 (IGHV3-11)
ARGGATLIRGLIDYYYGMDV

SEQ ID NO: 10101 - protein, 9 aa, Homo sapiens
  Light chain CDR3 for antibody 5051 (IGKV1-39)
QQSYSTPFT

SEQ ID NO: 10102 - protein, 19 aa, Homo sapiens
  Heavy chain CDR3 for antibody 5051 (IGHV4-39)
ARQGDVLRYFDWLLGAFDI

SEQ ID NO: 10103 - protein, 9 aa, Homo sapiens
  Light chain CDR3 for antibody 5052 (IGKV1D-16)
QQYNSYPLT

SEQ ID NO: 10104 - protein, 12 aa, Homo sapiens
  Heavy chain CDR3 for antibody 5052 (IGHV1-46)
ARALTVGASFDY

SEQ ID NO: 10105 - protein, 9 aa, Homo sapiens
  Light chain CDR3 for antibody 5053 (IGKV1D-16)
QQYNSWPLT

SEQ ID NO: 10106 - protein, 15 aa, Homo sapiens
  Heavy chain CDR3 for antibody 5053 (IGHV3-33)
ARRICSGGSCSLFDY

SEQ ID NO: 10107 - protein, 10 aa, Homo sapiens
  Light chain CDR3 for antibody 5054 (IGKV3-11)
QQRSNWPMYT

SEQ ID NO: 10108 - protein, 13 aa, Homo sapiens
  Heavy chain CDR3 for antibody 5054 (IGHV3-33)
AREYCSGGSCYDY

SEQ ID NO: 10109 - protein, 9 aa, Homo sapiens
  Light chain CDR3 for antibody 5055 (IGKV1-6)
LQDYKSPFT

SEQ ID NO: 10110 - protein, 15 aa, Homo sapiens
  Heavy chain CDR3 for antibody 5055 (IGHV3-33)
ARDRGWKAPGYGMDV

SEQ ID NO: 10111 - protein, 9 aa, Homo sapiens
  Light chain CDR3 for antibody 5056 (IGKV1-39)
QQSYSTPLT

SEQ ID NO: 10112 - protein, 9 aa, Homo sapiens
  Heavy chain CDR3 for antibody 5056 (IGHV3-33)
ARELAYFDY

SEQ ID NO: 10113 - protein, 9 aa, Homo sapiens
  Light chain CDR3 for antibody 5057 (IGKV3-20)
QQYGSSPYT

SEQ ID NO: 10114 - protein, 19 aa, Homo sapiens
  Heavy chain CDR3 for antibody 5057 (IGHV1-18)
ARGGHIGVVTAFHGYGMDV

SEQ ID NO: 10115 - protein, 9 aa, Homo sapiens
  Light chain CDR3 for antibody 5058 (IGKV2D-24)
TQATQFPHT

SEQ ID NO: 10116 - protein, 18 aa, Homo sapiens
  Heavy chain CDR3 for antibody 5058 (IGHV4-59)
AREGDYVWGSYRPNWFDP

SEQ ID NO: 10117 - protein, 8 aa, Homo sapiens
  Light chain CDR3 for antibody 5059 (IGKV1-5)
QQYNSYYT

SEQ ID NO: 10118 - protein, 17 aa, Homo sapiens
  Heavy chain CDR3 for antibody 5059 (IGHV3-33)
ARESLKLGIYYYYGMDV

SEQ ID NO: 10119 - protein, 10 aa, Homo sapiens
  Light chain CDR3 for antibody 5060 (IGKV3-11)
QQRSNWPIFT

SEQ ID NO: 10120 - protein, 17 aa, Homo sapiens
  Heavy chain CDR3 for antibody 5060 (IGHV1-24)
ATEGYDILPGYYNVLDY

SEQ ID NO: 10121 - protein, 8 aa, Homo sapiens
  Light chain CDR3 for antibody 5061 (IGKV3-11)
QQRSNWLT

SEQ ID NO: 10122 - protein, 12 aa, Homo sapiens
  Heavy chain CDR3 for antibody 5061 (IGHV1-18)
ARVLFDGDYFDY

SEQ ID NO: 10123 - protein, 9 aa, Homo sapiens
  Light chain CDR3 for antibody 5062 (IGKV3D-7)
QQDYNLPLT

SEQ ID NO: 10124 - protein, 18 aa, Homo sapiens
  Heavy chain CDR3 for antibody 5062 (IGHV3-23)
AKVGDFFASGNYWDYFDY

SEQ ID NO: 10125 - protein, 9 aa, Homo sapiens
  Light chain CDR3 for antibody 5063 (IGKV1-16)
QHYNDYPFT

SEQ ID NO: 10126 - protein, 12 aa, Homo sapiens
  Heavy chain CDR3 for antibody 5063 (IGHV3-33)
ARGYFGSGYAHF

SEQ ID NO: 10127 - protein, 9 aa, Homo sapiens
  Light chain CDR3 for antibody 5064 (IGKV5-2)
LQHDNFPWT

SEQ ID NO: 10128 - protein, 15 aa, Homo sapiens
  Heavy chain CDR3 for antibody 5064 (IGHV3-33)
ARDGSGSYSLYGMDV

SEQ ID NO: 10129 - protein, 9 aa, Homo sapiens
  Light chain CDR3 for antibody 5065 (IGKV3D-11)
QQRSNWPYT

SEQ ID NO: 10130 - protein, 7 aa, Homo sapiens
  Heavy chain CDR3 for antibody 5065 (IGHV1-46)
AREGGDY

SEQ ID NO: 10131 - protein, 10 aa, Homo sapiens
  Light chain CDR3 for antibody 5066 (IGKV3-20)
QQYGSSPPYT

SEQ ID NO: 10132 - protein, 18 aa, Homo sapiens
  Heavy chain CDR3 for antibody 5066 (IGHV3-11)
ARDGYFSGWNYYYCGMDV

SEQ ID NO: 10133 - protein, 9 aa, Homo sapiens
  Light chain CDR3 for antibody 5067 (IGKV1-6)
LQDYKSPFT

SEQ ID NO: 10134 - protein, 18 aa, Homo sapiens
  Heavy chain CDR3 for antibody 5067 (IGHV3-33)
ARGYYGSGNFYKDSGMDV

SEQ ID NO: 10135 - protein, 9 aa, Homo sapiens
  Light chain CDR3 for antibody 5068 (IGKV3-11)
QQRSNWPWT

SEQ ID NO: 10136 - protein, 23 aa, Homo sapiens
  Heavy chain CDR3 for antibody 5068 (IGHV4-59)
ARERTYSGILPGYYEDYYYGMDV

SEQ ID NO: 10137 - protein, 9 aa, Homo sapiens
  Light chain CDR3 for antibody 5069 (IGKV1-9)
QQLISYPLT

SEQ ID NO: 10138 - protein, 9 aa, Homo sapiens
  Heavy chain CDR3 for antibody 5069 (IGHV1-18)
ARGKDWFDP

SEQ ID NO: 10139 - protein, 9 aa, Homo sapiens
  Light chain CDR3 for antibody 5070 (IGKV2-30)
MQGTHWPLT

SEQ ID NO: 10140 - protein, 12 aa, Homo sapiens
  Heavy chain CDR3 for antibody 5070 (IGHV3-h)
AREDYYYYGMDV

SEQ ID NO: 10141 - protein, 9 aa, Homo sapiens
  Light chain CDR3 for antibody 5071 (IGKV1-17)
LQHNSYPIT

SEQ ID NO: 10142 - protein, 12 aa, Homo sapiens
  Heavy chain CDR3 for antibody 5071 (IGHV3-13)
AIGTMVRGIPDY

SEQ ID NO: 10143 - protein, 9 aa, Homo sapiens
  Light chain CDR3 for antibody 5072 (IGKV3-11)
QQRSNWPLT

SEQ ID NO: 10144 - protein, 11 aa, Homo sapiens
  Heavy chain CDR3 for antibody 5072 (IGHV3-33)
ARGTTVTHFDY

SEQ ID NO: 10145 - protein, 8 aa, Homo sapiens
  Light chain CDR3 for antibody 5073 (IGKV1D-16)
QQDYNLLT

SEQ ID NO: 10146 - protein, 12 aa, Homo sapiens
  Heavy chain CDR3 for antibody 5073 (IGHV4-39)
ARHGSGSSYFDY

SEQ ID NO: 10147 - protein, 9 aa, Homo sapiens
  Light chain CDR3 for antibody 5074 (IGKV1-9)
QQLISYPLT

SEQ ID NO: 10148 - protein, 11 aa, Homo sapiens
  Heavy chain CDR3 for antibody 5074 (IGHV3-33)
ARGSGSYAFDS

SEQ ID NO: 10149 - protein, 9 aa, Homo sapiens
  Light chain CDR3 for antibody 5075 (IGKV3-20)
QQYGSSPRT

SEQ ID NO: 10150 - protein, 15 aa, Homo sapiens
  Heavy chain CDR3 for antibody 5075 (IGHV3-23)
AKDRGWYDYYYGMDV

SEQ ID NO: 10151 - protein, 9 aa, Homo sapiens
  Light chain CDR3 for antibody 5076 (IGKV5-2)
LQHDNFPYT

SEQ ID NO: 10152 - protein, 15 aa, Homo sapiens
  Heavy chain CDR3 for antibody 5076 (IGHV3-33)
ARDRGMVRGDGYLDY

SEQ ID NO: 10153 - protein, 9 aa, Homo sapiens
  Light chain CDR3 for antibody 5077 (IGKV1-39)
QQSYSTPLT

SEQ ID NO: 10154 - protein, 12 aa, Homo sapiens
  Heavy chain CDR3 for antibody 5077 (IGHV3-33)
ARDYISTYGMDV

SEQ ID NO: 10155 - protein, 10 aa, Homo sapiens
  Light chain CDR3 for antibody 5078 (IGKV3-11)
QQRSNWPIFT

SEQ ID NO: 10156 - protein, 21 aa, Homo sapiens
  Heavy chain CDR3 for antibody 5078 (IGHV3-33)
ARDEYYEIVTGYGYYHYGMDV

SEQ ID NO: 10157 - protein, 9 aa, Homo sapiens
  Light chain CDR3 for antibody 5079 (IGKV2-30)
MQGTHWPLT

SEQ ID NO: 10158 - protein, 15 aa, Homo sapiens
  Heavy chain CDR3 for antibody 5079 (IGHV3-33)
VCVLYDYGDYVGFDY

SEQ ID NO: 10159 - protein, 9 aa, Homo sapiens
  Light chain CDR3 for antibody 5080 (IGKV1D-13)
QQFNNYPHT

SEQ ID NO: 10160 - protein, 14 aa, Homo sapiens
  Heavy chain CDR3 for antibody 5080 (IGHV1-46)
ARSYYDILTGAFDI

SEQ ID NO: 10161 - protein, 9 aa, Homo sapiens
  Light chain CDR3 for antibody 5081 (IGKV1-6)
LQDYKSPFT

SEQ ID NO: 10162 - protein, 18 aa, Homo sapiens
  Heavy chain CDR3 for antibody 5081 (IGHV3-33)
ARDRDRYGSGTYPDAIDI

SEQ ID NO: 10163 - protein, 9 aa, Homo sapiens
  Light chain CDR3 for antibody 5082 (IGKV1-39)
QQSYSTPLT

SEQ ID NO: 10164 - protein, 11 aa, Homo sapiens
  Heavy chain CDR3 for antibody 5082 (IGHV4-39)
ARLLVGATTDY

SEQ ID NO: 10165 - protein, 9 aa, Homo sapiens
  Light chain CDR3 for antibody 5083 (IGKV1-6)
LQDYNYPWT

SEQ ID NO: 10166 - protein, 21 aa, Homo sapiens
  Heavy chain CDR3 for antibody 5083 (IGHV3-33)
ARDGGITMGRGVYYYYYGMDV

SEQ ID NO: 10167 - protein, 9 aa, Homo sapiens
  Light chain CDR3 for antibody 5084 (IGKV2-30)
MQGTHWPLT

SEQ ID NO: 10168 - protein, 12 aa, Homo sapiens
  Heavy chain CDR3 for antibody 5084 (IGHV3-23)
AKEYDILTGYFH

SEQ ID NO: 10169 - protein, 9 aa, Homo sapiens
  Light chain CDR3 for antibody 5085 (IGKV1D-13)
QQFNNYPYT

SEQ ID NO: 10170 - protein, 16 aa, Homo sapiens
  Heavy chain CDR3 for antibody 5085 (IGHV3-30)
ARDSSYYGSGYYGMDV

SEQ ID NO: 10171 - protein, 9 aa, Homo sapiens
  Light chain CDR3 for antibody 5086 (IGKV1-9)
QQGNTYSRT

SEQ ID NO: 10172 - protein, 14 aa, Homo sapiens
  Heavy chain CDR3 for antibody 5086 (IGHV4-39)
ARDSGYDYYYGMDV

SEQ ID NO: 10173 - protein, 9 aa, Homo sapiens
  Light chain CDR3 for antibody 5087 (IGKV5-2)
LQHDNFPYT

SEQ ID NO: 10174 - protein, 13 aa, Homo sapiens
  Heavy chain CDR3 for antibody 5087 (IGHV3-23)
ARGELLWFGEFAC

SEQ ID NO: 10175 - protein, 9 aa, Homo sapiens
  Light chain CDR3 for antibody 5088 (IGKV6-21)
HQSSSLPYT

SEQ ID NO: 10176 - protein, 15 aa, Homo sapiens
  Heavy chain CDR3 for antibody 5088 (IGHV3-23)
AKDRGWYDYYYGMDV

SEQ ID NO: 10177 - protein, 9 aa, Homo sapiens
  Light chain CDR3 for antibody 5089 (IGKV1-16)
QKYNSAPLT

SEQ ID NO: 10178 - protein, 18 aa, Homo sapiens
  Heavy chain CDR3 for antibody 5089 (IGHV4-59)
AREGDYVWGSYRPNWFDP

SEQ ID NO: 10179 - protein, 9 aa, Homo sapiens
  Light chain CDR3 for antibody 5090 (IGKV3-15)
QQYNNWPFT

SEQ ID NO: 10180 - protein, 13 aa, Homo sapiens
  Heavy chain CDR3 for antibody 5090 (IGHV1-2)
ARDGVRGSFGMDV

SEQ ID NO: 10181 - protein, 9 aa, Homo sapiens
  Light chain CDR3 for antibody 5091 (IGKV6-21)
HQSRGLPQT

SEQ ID NO: 10182 - protein, 13 aa, Homo sapiens
  Heavy chain CDR3 for antibody 5091 (IGHV3-66)
VRDGVNGYNDLDS

SEQ ID NO: 10183 - protein, 9 aa, Homo sapiens
  Light chain CDR3 for antibody 5092 (IGKV1-33)
QQYDNLPFT

SEQ ID NO: 10184 - protein, 13 aa, Homo sapiens
  Heavy chain CDR3 for antibody 5092 (IGHV3-33)
ARDWGYSHGYFDY

SEQ ID NO: 10185 - protein, 8 aa, Homo sapiens
  Light chain CDR3 for antibody 5093 (IGKV3-20)
QQYGRSFT

SEQ ID NO: 10186 - protein, 18 aa, Homo sapiens
  Heavy chain CDR3 for antibody 5093 (IGHV4-39)
ARQYYFGSGNYYRGWFDP

SEQ ID NO: 10187 - protein, 9 aa, Homo sapiens
  Light chain CDR3 for antibody 5094 (IGKV1-6)
LQDYKSPFT

SEQ ID NO: 10188 - protein, 12 aa, Homo sapiens
  Heavy chain CDR3 for antibody 5094 (IGHV3-33)
ARDRAYRGSLDY

SEQ ID NO: 10189 - protein, 9 aa, Homo sapiens
  Light chain CDR3 for antibody 5095 (IGKV1-17)
LQHNSYPYT

SEQ ID NO: 10190 - protein, 15 aa, Homo sapiens
  Heavy chain CDR3 for antibody 5095 (IGHV3-33)
AREYSSGWYGDAFDI

SEQ ID NO: 10191 - protein, 10 aa, Homo sapiens
  Light chain CDR3 for antibody 5096 (IGKV1-17)
LQHNSYPMYT

SEQ ID NO: 10192 - protein, 11 aa, Homo sapiens
  Heavy chain CDR3 for antibody 5096 (IGHV3-33)
ARAGIAAVFDY

SEQ ID NO: 10193 - protein, 9 aa, Homo sapiens
  Light chain CDR3 for antibody 5097 (IGKV1-33)
QQYDNLPFT

SEQ ID NO: 10194 - protein, 12 aa, Homo sapiens
  Heavy chain CDR3 for antibody 5097 (IGHV4-59)
ARDRSGWAYFDY

SEQ ID NO: 10195 - protein, 11 aa, Homo sapiens
  Light chain CDR3 for antibody 5098 (IGKV3-11)
QQRSNWPPTWT

SEQ ID NO: 10196 - protein, 13 aa, Homo sapiens
  Heavy chain CDR3 for antibody 5098 (IGHV3-23)
ASPFNWNDGFFDY

SEQ ID NO: 10197 - protein, 9 aa, Homo sapiens
  Light chain CDR3 for antibody 5099 (IGKV1-16)
QQYNSYPLT

SEQ ID NO: 10198 - protein, 17 aa, Homo sapiens
  Heavy chain CDR3 for antibody 5099 (IGHV3-33)
ARSMVTTYGYYYYGMDV

SEQ ID NO: 10199 - protein, 10 aa, Homo sapiens
  Light chain CDR3 for antibody 5100 (IGKV1-9)
QQLDSYPMYT

SEQ ID NO: 10200 - protein, 14 aa, Homo sapiens
  Heavy chain CDR3 for antibody 5100 (IGHV3-33)
ARGAAAGNFYGLDV

SEQ ID NO: 10201 - protein, 9 aa, Homo sapiens
  Light chain CDR3 for antibody 5101 (IGKV1D-13)
QQFNNYPYT

SEQ ID NO: 10202 - protein, 18 aa, Homo sapiens
  Heavy chain CDR3 for antibody 5101 (IGHV3-33)
ARGGVLYDILTGFYGMDV

SEQ ID NO: 10203 - protein, 9 aa, Homo sapiens
  Light chain CDR3 for antibody 5102 (IGKV1-33)
QQYDNLPFT

SEQ ID NO: 10204 - protein, 12 aa, Homo sapiens
  Heavy chain CDR3 for antibody 5102 (IGHV3-64)
ARDLVGATPFDY

SEQ ID NO: 10205 - protein, 9 aa, Homo sapiens
  Light chain CDR3 for antibody 5103 (IGKV1-9)
QQLNSYPRT

SEQ ID NO: 10206 - protein, 18 aa, Homo sapiens
  Heavy chain CDR3 for antibody 5103 (IGHV3-23)
AKDQHILTGLYYYYGMDV

SEQ ID NO: 10207 - protein, 9 aa, Homo sapiens
  Light chain CDR3 for antibody 5104 (IGKV3-15)
QQYNNWPWT

SEQ ID NO: 10208 - protein, 13 aa, Homo sapiens
  Heavy chain CDR3 for antibody 5104 (IGHV3-33)
ARRATLVRGVFDP

SEQ ID NO: 10209 - protein, 8 aa, Homo sapiens
  Light chain CDR3 for antibody 5105 (IGKV1D-13)
QQFNNYPT

SEQ ID NO: 10210 - protein, 14 aa, Homo sapiens
  Heavy chain CDR3 for antibody 5105 (IGHV3-33)
ARAGSGYDRDWFDP

SEQ ID NO: 10211 - protein, 9 aa, Homo sapiens
  Light chain CDR3 for antibody 5106 (IGKV1D-13)
QQFNNYPHT

SEQ ID NO: 10212 - protein, 8 aa, Homo sapiens
  Heavy chain CDR3 for antibody 5106 (IGHV4-39)
ARRGGLDY

SEQ ID NO: 10213 - protein, 9 aa, Homo sapiens
  Light chain CDR3 for antibody 5107 (IGKV2-30)
MQGTHWPLT

SEQ ID NO: 10214 - protein, 11 aa, Homo sapiens
  Heavy chain CDR3 for antibody 5107 (IGHV3-23)
GEFSSGWSFDY

SEQ ID NO: 10215 - protein, 8 aa, Homo sapiens
  Light chain CDR3 for antibody 5108 (IGKV1-5)
QQYNSYYT

SEQ ID NO: 10216 - protein, 21 aa, Homo sapiens
  Heavy chain CDR3 for antibody 5108 (IGHV3-33)
ARDEYYEIVTGYGYYHYGMDV

SEQ ID NO: 10217 - protein, 10 aa, Homo sapiens
  Light chain CDR3 for antibody 5109 (IGKV3-20)
QQYGRSPPVT

SEQ ID NO: 10218 - protein, 13 aa, Homo sapiens
  Heavy chain CDR3 for antibody 5109 (IGHV3-23)
ASPFNWNDGFFDY

SEQ ID NO: 10219 - protein, 9 aa, Homo sapiens
  Light chain CDR3 for antibody 5110 (IGKV1-39)
QQSYSTPFT

SEQ ID NO: 10220 - protein, 13 aa, Homo sapiens
  Heavy chain CDR3 for antibody 5110 (IGHV4-4)
ARERGIAAAGPDY

SEQ ID NO: 10221 - protein, 10 aa, Homo sapiens
  Light chain CDR3 for antibody 5111 (IGKV1-39)
QQSYSTPMYT

SEQ ID NO: 10222 - protein, 21 aa, Homo sapiens
  Heavy chain CDR3 for antibody 5111 (IGHV3-33)
ARDEYYEIVTGYGYYHYGMDV

SEQ ID NO: 10223 - protein, 9 aa, Homo sapiens
  Light chain CDR3 for antibody 5112 (IGKV1-6)
LQDYNYPRT

SEQ ID NO: 10224 - protein, 17 aa, Homo sapiens
  Heavy chain CDR3 for antibody 5112 (IGHV3-64)
ARVQYDILTGYSPYFDN

SEQ ID NO: 10225 - protein, 9 aa, Homo sapiens
  Light chain CDR3 for antibody 5113 (IGKV1-16)
QHYNDYPFT

SEQ ID NO: 10226 - protein, 14 aa, Homo sapiens
  Heavy chain CDR3 for antibody 5113 (IGHV3-33)
ARAGSGYDRDWFDP

SEQ ID NO: 10227 - protein, 9 aa, Homo sapiens
  Light chain CDR3 for antibody 5114 (IGKV3D-7)
QQDYNLPLT

SEQ ID NO: 10228 - protein, 18 aa, Homo sapiens
  Heavy chain CDR3 for antibody 5114 (IGHV3-33)
ARGLLWFGVSYYYYGMDV

SEQ ID NO: 10229 - protein, 9 aa, Homo sapiens
  Light chain CDR3 for antibody 5115 (IGKV2-30)
MQGTHWPLT

SEQ ID NO: 10230 - protein, 12 aa, Homo sapiens
  Heavy chain CDR3 for antibody 5115 (IGHV3-23)
AKDGWFGESLDY

SEQ ID NO: 10231 - protein, 9 aa, Homo sapiens
  Light chain CDR3 for antibody 5116 (IGKV1-33)
QQYDNLPFT

SEQ ID NO: 10232 - protein, 12 aa, Homo sapiens
  Heavy chain CDR3 for antibody 5116 (IGHV3-23)
AKDGWFGESLDY

SEQ ID NO: 10233 - protein, 9 aa, Homo sapiens
  Light chain CDR3 for antibody 5117 (IGKV6-21)
HQSSSLPYT

SEQ ID NO: 10234 - protein, 19 aa, Homo sapiens
  Heavy chain CDR3 for antibody 5117 (IGHV3-33)
ARRKNYYGSGSWHYYGMDV

SEQ ID NO: 10235 - protein, 8 aa, Homo sapiens
  Light chain CDR3 for antibody 5118 (IGKV3D-7)
QQDYNLLT

SEQ ID NO: 10236 - protein, 14 aa, Homo sapiens
  Heavy chain CDR3 for antibody 5118 (IGHV3-33)
ARAISGSSYWYFDL

SEQ ID NO: 10237 - protein, 8 aa, Homo sapiens
  Light chain CDR3 for antibody 5119 (IGKV1-5)
QQYNSYYT

SEQ ID NO: 10238 - protein, 12 aa, Homo sapiens
  Heavy chain CDR3 for antibody 5119 (IGHV3-33)
ARVDAAAPYFDY

SEQ ID NO: 10239 - protein, 9 aa, Homo sapiens
  Light chain CDR3 for antibody 5120 (IGKV1-9)
QQLISYPLT

SEQ ID NO: 10240 - protein, 18 aa, Homo sapiens
  Heavy chain CDR3 for antibody 5120 (IGHV3-33)
ARDEYYGSGIYYNYGMDV

SEQ ID NO: 10241 - protein, 9 aa, Homo sapiens
  Light chain CDR3 for antibody 5121 (IGKV3D-7)
QQDYNLPWT

SEQ ID NO: 10242 - protein, 15 aa, Homo sapiens
  Heavy chain CDR3 for antibody 5121 (IGHV3-33)
ARGYYYGSGSFPVDY

SEQ ID NO: 10243 - protein, 9 aa, Homo sapiens
  Light chain CDR3 for antibody 5122 (IGKV6-21)
HQSSSLPYT

SEQ ID NO: 10244 - protein, 18 aa, Homo sapiens
  Heavy chain CDR3 for antibody 5122 (IGHV3-33)
VRERGHYGSGSFPDAFDI

SEQ ID NO: 10245 - protein, 10 aa, Homo sapiens
  Light chain CDR3 for antibody 5123 (IGKV3-11)
QQRSNWPIFT

SEQ ID NO: 10246 - protein, 14 aa, Homo sapiens
  Heavy chain CDR3 for antibody 5123 (IGHV3-15)
SIYYYGSGRDFFDY

SEQ ID NO: 10247 - protein, 9 aa, Homo sapiens
  Light chain CDR3 for antibody 5124 (IGKV1-16)
QHYNDYPFT

SEQ ID NO: 10248 - protein, 15 aa, Homo sapiens
  Heavy chain CDR3 for antibody 5124 (IGHV3-33)
ARDRGSSGWRDWFDP

SEQ ID NO: 10249 - protein, 9 aa, Homo sapiens
  Light chain CDR3 for antibody 5125 (IGKV3D-20)
QQYGSSPYT

SEQ ID NO: 10250 - protein, 15 aa, Homo sapiens
  Heavy chain CDR3 for antibody 5125 (IGHV3-23)
AKDLSSGWYAYFFDY

SEQ ID NO: 10251 - protein, 9 aa, Homo sapiens
  Light chain CDR3 for antibody 5126 (IGKV3-11)
QQRSNWPLT

SEQ ID NO: 10252 - protein, 13 aa, Homo sapiens
  Heavy chain CDR3 for antibody 5126 (IGHV3-33)
AREYCSGGSCYDY

SEQ ID NO: 10253 - protein, 11 aa, Homo sapiens
  Light chain CDR3 for antibody 5127 (IGKV3-11)
QQRSNWPPTWT

SEQ ID NO: 10254 - protein, 13 aa, Homo sapiens
  Heavy chain CDR3 for antibody 5127 (IGHV3-11)
ARDGGAAAGTWDS

SEQ ID NO: 10255 - protein, 8 aa, Homo sapiens
  Light chain CDR3 for antibody 5128 (IGKV3D-7)
QQDYNLLT

SEQ ID NO: 10256 - protein, 18 aa, Homo sapiens
  Heavy chain CDR3 for antibody 5128 (IGHV3-33)
ARERDYYGSGSYPDAFDI

SEQ ID NO: 10257 - protein, 9 aa, Homo sapiens
  Light chain CDR3 for antibody 5129 (IGKV1-27)
QKYNSAPYT

SEQ ID NO: 10258 - protein, 14 aa, Homo sapiens
  Heavy chain CDR3 for antibody 5129 (IGHV3-33)
AREDYYGPLNWFDP

SEQ ID NO: 10259 - protein, 8 aa, Homo sapiens
  Light chain CDR3 for antibody 5130 (IGKV3D-7)
QQDYNLLT

SEQ ID NO: 10260 - protein, 20 aa, Homo sapiens
  Heavy chain CDR3 for antibody 5130 (IGHV3-23)
AKDREMAATSHYYYYYGMDV

SEQ ID NO: 10261 - protein, 9 aa, Homo sapiens
  Light chain CDR3 for antibody 5131 (IGKV2-30)
MQGTHWPLT

SEQ ID NO: 10262 - protein, 15 aa, Homo sapiens
  Heavy chain CDR3 for antibody 5131 (IGHV3-33)
ARGYYYGSGSFPVDY

SEQ ID NO: 10263 - protein, 8 aa, Homo sapiens
  Light chain CDR3 for antibody 5132 (IGKV3D-7)
QQDYNLLT

SEQ ID NO: 10264 - protein, 10 aa, Homo sapiens
  Heavy chain CDR3 for antibody 5132 (IGHV3-33)
ARDVVVYFDY

SEQ ID NO: 10265 - protein, 9 aa, Homo sapiens
  Light chain CDR3 for antibody 5133 (IGKV1-6)
LQDYNYPYT

SEQ ID NO: 10266 - protein, 14 aa, Homo sapiens
  Heavy chain CDR3 for antibody 5133 (IGHV3-23)
ANWAYDILTGYLDY

SEQ ID NO: 10267 - protein, 9 aa, Homo sapiens
  Light chain CDR3 for antibody 5134 (IGKV3-15)
QQYNNWPLT

SEQ ID NO: 10268 - protein, 15 aa, Homo sapiens
  Heavy chain CDR3 for antibody 5134 (IGHV4-39)
ARQGLVATIKGYFQH

SEQ ID NO: 10269 - protein, 8 aa, Homo sapiens
  Light chain CDR3 for antibody 5135 (IGKV1-5)
QQYNSYWT

SEQ ID NO: 10270 - protein, 12 aa, Homo sapiens
  Heavy chain CDR3 for antibody 5135 (IGHV4-59)
ARDSGSYYYFDY

SEQ ID NO: 10271 - protein, 9 aa, Homo sapiens
  Light chain CDR3 for antibody 5136 (IGKV1-17)
LQHNSYPYT

SEQ ID NO: 10272 - protein, 14 aa, Homo sapiens
  Heavy chain CDR3 for antibody 5136 (IGHV3-20)
ARDRGSSFFDAFDI

SEQ ID NO: 10273 - protein, 9 aa, Homo sapiens
  Light chain CDR3 for antibody 5137 (IGKV1-6)
QQEYNYPLT

SEQ ID NO: 10274 - protein, 11 aa, Homo sapiens
  Heavy chain CDR3 for antibody 5137 (IGHV3-33)
ARDRSSGPFDY

SEQ ID NO: 10275 - protein, 9 aa, Homo sapiens
  Light chain CDR3 for antibody 5138 (IGKV3-20)
QQYGSSPYT

SEQ ID NO: 10276 - protein, 12 aa, Homo sapiens
  Heavy chain CDR3 for antibody 5138 (IGHV4-39)
ARQGAYSRFFDY

SEQ ID NO: 10277 - protein, 9 aa, Homo sapiens
  Light chain CDR3 for antibody 5139 (IGKV1D-16)
QQYNSYPLT

SEQ ID NO: 10278 - protein, 18 aa, Homo sapiens
  Heavy chain CDR3 for antibody 5139 (IGHV4-59)
ARDRVVGATTYYYYGMDV

SEQ ID NO: 10279 - protein, 9 aa, Homo sapiens
  Light chain CDR3 for antibody 5140 (IGKV2D-28)
MQALQTPPT

SEQ ID NO: 10280 - protein, 13 aa, Homo sapiens
  Heavy chain CDR3 for antibody 5140 (IGHV3-33)
ARDWGYSHGYFDY

SEQ ID NO: 10281 - protein, 9 aa, Homo sapiens
  Light chain CDR3 for antibody 5141 (IGKV1-39)
QQSYRTPLT

SEQ ID NO: 10282 - protein, 10 aa, Homo sapiens
  Heavy chain CDR3 for antibody 5141 (IGHV3-30)
AREWYGGMDV

SEQ ID NO: 10283 - protein, 9 aa, Homo sapiens
  Light chain CDR3 for antibody 5142 (IGKV1-6)
LQDYNYPRT

SEQ ID NO: 10284 - protein, 16 aa, Homo sapiens
  Heavy chain CDR3 for antibody 5142 (IGHV3-33)
ARGYDMLTGDYHCMDV

SEQ ID NO: 10285 - protein, 9 aa, Homo sapiens
  Light chain CDR3 for antibody 5143 (IGKV3-11)
QQRSNWPLT

SEQ ID NO: 10286 - protein, 14 aa, Homo sapiens
  Heavy chain CDR3 for antibody 5143 (IGHV3-33)
ARDRDIMATSYFDY

SEQ ID NO: 10287 - protein, 10 aa, Homo sapiens
  Light chain CDR3 for antibody 5144 (IGKV3-20)
QQYGRSPPVT

SEQ ID NO: 10288 - protein, 14 aa, Homo sapiens
  Heavy chain CDR3 for antibody 5144 (IGHV3-53)
ARAISGSSYWYFDL

SEQ ID NO: 10289 - protein, 9 aa, Homo sapiens
  Light chain CDR3 for antibody 5145 (IGKV1-9)
QQLKSYPYT

SEQ ID NO: 10290 - protein, 9 aa, Homo sapiens
  Heavy chain CDR3 for antibody 5145 (IGHV1-8)
ARGPRIMDV

SEQ ID NO: 10291 - protein, 9 aa, Homo sapiens
  Light chain CDR3 for antibody 5146 (IGKV1-6)
LQDYNYPYT

SEQ ID NO: 10292 - protein, 15 aa, Homo sapiens
  Heavy chain CDR3 for antibody 5146 (IGHV3-33)
ARDRGSSGYDRYFDY

SEQ ID NO: 10293 - protein, 9 aa, Homo sapiens
  Light chain CDR3 for antibody 5147 (IGKV1-6)
LQDFNYPRT

SEQ ID NO: 10294 - protein, 18 aa, Homo sapiens
  Heavy chain CDR3 for antibody 5147 (IGHV3-33)
ARREGITLIFYYYYGMDV

SEQ ID NO: 10295 - protein, 9 aa, Homo sapiens
  Light chain CDR3 for antibody 5148 (IGKV1-6)
LQDFHYPWT

SEQ ID NO: 10296 - protein, 15 aa, Homo sapiens
  Heavy chain CDR3 for antibody 5148 (IGHV3-30)
ARGAMVRGVDYGMDV

SEQ ID NO: 10297 - protein, 11 aa, Homo sapiens
  Light chain CDR3 for antibody 5149 (IGKV3-11)
QQRSNWPPTWT

SEQ ID NO: 10298 - protein, 12 aa, Homo sapiens
  Heavy chain CDR3 for antibody 5149 (IGHV3-33)
ARESGGSYSFDY

SEQ ID NO: 10299 - protein, 9 aa, Homo sapiens
  Light chain CDR3 for antibody 5150 (IGKV2-30)
MQGTHWPLT

SEQ ID NO: 10300 - protein, 12 aa, Homo sapiens
  Heavy chain CDR3 for antibody 5150 (IGHV1-46)
AREDYDIDGMDV

SEQ ID NO: 10301 - protein, 9 aa, Homo sapiens
  Light chain CDR3 for antibody 5151 (IGKV3D-7)
QQDYNLPLT

SEQ ID NO: 10302 - protein, 18 aa, Homo sapiens
  Heavy chain CDR3 for antibody 5151 (IGHV1-8)
AREGAAAGSYYYYNGMDV

SEQ ID NO: 10303 - protein, 9 aa, Homo sapiens
  Light chain CDR3 for antibody 5152 (IGKV1-39)
QQSYSTPLT

SEQ ID NO: 10304 - protein, 13 aa, Homo sapiens
  Heavy chain CDR3 for antibody 5152 (IGHV4-39)
ARRDVLAPAAFDY

SEQ ID NO: 10305 - protein, 9 aa, Homo sapiens
  Light chain CDR3 for antibody 5153 (IGKV4-1)
QQYYSTPWT

SEQ ID NO: 10306 - protein, 18 aa, Homo sapiens
  Heavy chain CDR3 for antibody 5153 (IGHV3-33)
ARREGIVGATTYYYGMDV

SEQ ID NO: 10307 - protein, 9 aa, Homo sapiens
  Light chain CDR3 for antibody 5154 (IGKV5-2)
LQHDNFPWT

SEQ ID NO: 10308 - protein, 14 aa, Homo sapiens
  Heavy chain CDR3 for antibody 5154 (IGHV1-18)
AREGGSYFYYGVDV

SEQ ID NO: 10309 - protein, 9 aa, Homo sapiens
  Light chain CDR3 for antibody 5155 (IGKV1-5)
QQYNTYSRT

SEQ ID NO: 10310 - protein, 14 aa, Homo sapiens
  Heavy chain CDR3 for antibody 5155 (IGHV3-33)
AREGYSSNWYDFDY

SEQ ID NO: 10311 - protein, 9 aa, Homo sapiens
  Light chain CDR3 for antibody 5156 (IGKV3-11)
QQRSNWPPT

SEQ ID NO: 10312 - protein, 16 aa, Homo sapiens
  Heavy chain CDR3 for antibody 5156 (IGHV3-33)
ARDRGGMTMVRGGFDY

SEQ ID NO: 10313 - protein, 9 aa, Homo sapiens
  Light chain CDR3 for antibody 5157 (IGKV1-39)
QQSYRTPLT

SEQ ID NO: 10314 - protein, 9 aa, Homo sapiens
  Heavy chain CDR3 for antibody 5157 (IGHV3-20)
ASIRGYFDY

SEQ ID NO: 10315 - protein, 9 aa, Homo sapiens
  Light chain CDR3 for antibody 5158 (IGKV2-30)
MQGTHWPLT

SEQ ID NO: 10316 - protein, 15 aa, Homo sapiens
  Heavy chain CDR3 for antibody 5158 (IGHV3-33)
ARRGYNDYDPYGMDV

SEQ ID NO: 10317 - protein, 8 aa, Homo sapiens
  Light chain CDR3 for antibody 5159 (IGKV1D-16)
QQFNNYPT

SEQ ID NO: 10318 - protein, 17 aa, Homo sapiens
  Heavy chain CDR3 for antibody 5159 (IGHV3-33)
ARESLKLGIYYYYGMDV

SEQ ID NO: 10319 - protein, 9 aa, Homo sapiens
  Light chain CDR3 for antibody 5160 (IGKV6-21)
HQSSSLPYT

SEQ ID NO: 10320 - protein, 10 aa, Homo sapiens
  Heavy chain CDR3 for antibody 5160 (IGHV3-23)
ATIVGPFLDV

SEQ ID NO: 10321 - protein, 9 aa, Homo sapiens
  Light chain CDR3 for antibody 5161 (IGKV1D-16)
QQYNSFPLT

SEQ ID NO: 10322 - protein, 9 aa, Homo sapiens
  Heavy chain CDR3 for antibody 5161 (IGHV3-13)
ARDHWYFDL

SEQ ID NO: 10323 - protein, 9 aa, Homo sapiens
  Light chain CDR3 for antibody 5162 (IGKV1-17)
LQHNSYPYT

SEQ ID NO: 10324 - protein, 19 aa, Homo sapiens
  Heavy chain CDR3 for antibody 5162 (IGHV3-33)
ARDKYYDILTGYPWNGMDV

SEQ ID NO: 10325 - protein, 10 aa, Homo sapiens
  Light chain CDR3 for antibody 5163 (IGKV3-15)
QQYNNWPPLT

SEQ ID NO: 10326 - protein, 12 aa, Homo sapiens
  Heavy chain CDR3 for antibody 5163 (IGHV1-18)
ARILFYGDYFDY

SEQ ID NO: 10327 - protein, 9 aa, Homo sapiens
  Light chain CDR3 for antibody 5164 (IGKV3D-7)
QQDYNLPYT

SEQ ID NO: 10328 - protein, 14 aa, Homo sapiens
  Heavy chain CDR3 for antibody 5164 (IGHV4-39)
ARQGGWYLYWYFDL

SEQ ID NO: 10329 - protein, 9 aa, Homo sapiens
  Light chain CDR3 for antibody 5165 (IGKV1-39)
QQSYSTPYT

SEQ ID NO: 10330 - protein, 14 aa, Homo sapiens
  Heavy chain CDR3 for antibody 5165 (IGHV1-46)
ARKGIVGAFDAFDI

SEQ ID NO: 10331 - protein, 9 aa, Homo sapiens
  Light chain CDR3 for antibody 5166 (IGKV3-15)
QQYNNWPFT

SEQ ID NO: 10332 - protein, 20 aa, Homo sapiens
  Heavy chain CDR3 for antibody 5166 (IGHV1-18)
AREVGIAVAGTLYYYYGMDV

SEQ ID NO: 10333 - protein, 8 aa, Homo sapiens
  Light chain CDR3 for antibody 5167 (IGKV1-5)
QQYNSYYT

SEQ ID NO: 10334 - protein, 13 aa, Homo sapiens
  Heavy chain CDR3 for antibody 5167 (IGHV3-33)
AKEDGDYHHYFDY

SEQ ID NO: 10335 - protein, 8 aa, Homo sapiens
  Light chain CDR3 for antibody 5168 (IGKV3D-7)
QQDYNLLT

SEQ ID NO: 10336 - protein, 21 aa, Homo sapiens
  Heavy chain CDR3 for antibody 5168 (IGHV3-33)
ARDEYYEIVTGYGYYHYGMDV

SEQ ID NO: 10337 - protein, 8 aa, Homo sapiens
  Light chain CDR3 for antibody 5169 (IGKV1-13)
QQFNDYYT

SEQ ID NO: 10338 - protein, 10 aa, Homo sapiens
  Heavy chain CDR3 for antibody 5169 (IGHV4-59)
ARINSGRFDY

SEQ ID NO: 10339 - protein, 9 aa, Homo sapiens
  Light chain CDR3 for antibody 5170 (IGKV6-21)
HQSSSLPYT

SEQ ID NO: 10340 - protein, 16 aa, Homo sapiens
  Heavy chain CDR3 for antibody 5170 (IGHV1-24)
ATDWNDRGYYYYGMDV

SEQ ID NO: 10341 - protein, 9 aa, Homo sapiens
  Light chain CDR3 for antibody 5171 (IGKV3-15)
QQYNNWPYT

SEQ ID NO: 10342 - protein, 18 aa, Homo sapiens
  Heavy chain CDR3 for antibody 5171 (IGHV3-23)
AKDRITGTTYGYYSGLDV

SEQ ID NO: 10343 - protein, 8 aa, Homo sapiens
  Light chain CDR3 for antibody 5172 (IGKV3-11)
LQRGNWPT

SEQ ID NO: 10344 - protein, 12 aa, Homo sapiens
  Heavy chain CDR3 for antibody 5172 (IGHV1-46)
ARGLTGDHAVDI

SEQ ID NO: 10345 - protein, 8 aa, Homo sapiens
  Light chain CDR3 for antibody 5173 (IGKV3D-7)
QQDYNLLT

SEQ ID NO: 10346 - protein, 21 aa, Homo sapiens
  Heavy chain CDR3 for antibody 5173 (IGHV3-33)
ARKRLYDILTGYYKAYYGMDV

SEQ ID NO: 10347 - protein, 9 aa, Homo sapiens
  Light chain CDR3 for antibody 5174 (IGKV3D-7)
QQDYEFPLT

SEQ ID NO: 10348 - protein, 16 aa, Homo sapiens
  Heavy chain CDR3 for antibody 5174 (IGHV4-59)
ARYSGSYYGDYYGMDV

SEQ ID NO: 10349 - protein, 9 aa, Homo sapiens
  Light chain CDR3 for antibody 5175 (IGKV1-9)
QQLKSYLYT

SEQ ID NO: 10350 - protein, 9 aa, Homo sapiens
  Heavy chain CDR3 for antibody 5175 (IGHV4-59)
AREGGSGSL

SEQ ID NO: 10351 - protein, 9 aa, Homo sapiens
  Light chain CDR3 for antibody 5176 (IGKV6-21)
HQSSSLPYT

SEQ ID NO: 10352 - protein, 12 aa, Homo sapiens
  Heavy chain CDR3 for antibody 5176 (IGHV3-33)
ARDGPVAGLFDY

SEQ ID NO: 10353 - protein, 8 aa, Homo sapiens
  Light chain CDR3 for antibody 5177 (IGKV1D-13)
QQFNNYPT

SEQ ID NO: 10354 - protein, 15 aa, Homo sapiens
  Heavy chain CDR3 for antibody 5177 (IGHV3-33)
ARRICSGGSCSLFDY

SEQ ID NO: 10355 - protein, 9 aa, Homo sapiens
  Light chain CDR3 for antibody 5178 (IGKV2-30)
MQGTHWPLT

SEQ ID NO: 10356 - protein, 10 aa, Homo sapiens
  Heavy chain CDR3 for antibody 5178 (IGHV3-74)
ARENWGGFDY

SEQ ID NO: 10357 - protein, 10 aa, Homo sapiens
  Light chain CDR3 for antibody 5179 (IGKV1-27)
QKYNSAPMYT

SEQ ID NO: 10358 - protein, 11 aa, Homo sapiens
  Heavy chain CDR3 for antibody 5179 (IGHV4-59)
AREMGHDTFDI

SEQ ID NO: 10359 - protein, 8 aa, Homo sapiens
  Light chain CDR3 for antibody 5180 (IGKV1D-13)
QQFNNYPT

SEQ ID NO: 10360 - protein, 14 aa, Homo sapiens
  Heavy chain CDR3 for antibody 5180 (IGHV4-39)
ARRGVVVPPGGMDV

SEQ ID NO: 10361 - protein, 10 aa, Homo sapiens
  Light chain CDR3 for antibody 5181 (IGKV3-11)
QQRSNWPPFT

SEQ ID NO: 10362 - protein, 14 aa, Homo sapiens
  Heavy chain CDR3 for antibody 5181 (IGHV3-33)
ARATSGSSYWYFDL

SEQ ID NO: 10363 - protein, 10 aa, Homo sapiens
  Light chain CDR3 for antibody 5182 (IGKV3-15)
QQYNNWPPLT

SEQ ID NO: 10364 - protein, 15 aa, Homo sapiens
  Heavy chain CDR3 for antibody 5182 (IGHV3-20)
ARDRGSSGWRDWFDP

SEQ ID NO: 10365 - protein, 9 aa, Homo sapiens
  Light chain CDR3 for antibody 5183 (IGKV1D-13)
QQFNNYPHT

SEQ ID NO: 10366 - protein, 17 aa, Homo sapiens
  Heavy chain CDR3 for antibody 5183 (IGHV3-33)
TRDSGMVRGIIIYGMDV

SEQ ID NO: 10367 - protein, 9 aa, Homo sapiens
  Light chain CDR3 for antibody 5184 (IGKV5-2)
LQHDKFPYT

SEQ ID NO: 10368 - protein, 12 aa, Homo sapiens
  Heavy chain CDR3 for antibody 5184 (IGHV3-13)
AIGTMVRGIPDY

SEQ ID NO: 10369 - protein, 10 aa, Homo sapiens
  Light chain CDR3 for antibody 5185 (IGKV1-39)
QQSYSTPMYT

SEQ ID NO: 10370 - protein, 12 aa, Homo sapiens
  Heavy chain CDR3 for antibody 5185 (IGHV3-33)
ARDRAYRGSLDY

SEQ ID NO: 10371 - protein, 9 aa, Homo sapiens
  Light chain CDR3 for antibody 5186 (IGKV1D-13)
QQFNNYLYT

SEQ ID NO: 10372 - protein, 14 aa, Homo sapiens
  Heavy chain CDR3 for antibody 5186 (IGHV3-23)
AKDRYRGYEGLFDY

SEQ ID NO: 10373 - protein, 9 aa, Homo sapiens
  Light chain CDR3 for antibody 5187 (IGKV1-39)
QQGFSTPWT

SEQ ID NO: 10374 - protein, 12 aa, Homo sapiens
  Heavy chain CDR3 for antibody 5187 (IGHV4-39)
ARHGSGSSYFDY

SEQ ID NO: 10375 - protein, 9 aa, Homo sapiens
  Light chain CDR3 for antibody 5188 (IGKV1-16)
QQYNSYPLT

SEQ ID NO: 10376 - protein, 15 aa, Homo sapiens
  Heavy chain CDR3 for antibody 5188 (IGHV3-64)
ARDSHHDLLTGHYEY

SEQ ID NO: 10377 - protein, 9 aa, Homo sapiens
  Light chain CDR3 for antibody 5189 (IGKV3-11)
QQRINWPWT

SEQ ID NO: 10378 - protein, 17 aa, Homo sapiens
  Heavy chain CDR3 for antibody 5189 (IGHV4-59)
AREGADSGIYYHWYFDL

SEQ ID NO: 10379 - protein, 9 aa, Homo sapiens
  Light chain CDR3 for antibody 5190 (IGKV3-15)
QQYNSWPLT

SEQ ID NO: 10380 - protein, 15 aa, Homo sapiens
  Heavy chain CDR3 for antibody 5190 (IGHV3-33)
ARGGTGYYSYWYFDL

SEQ ID NO: 10381 - protein, 9 aa, Homo sapiens
  Light chain CDR3 for antibody 5191 (IGKV1D-16)
QQYYSYPRT

SEQ ID NO: 10382 - protein, 14 aa, Homo sapiens
  Heavy chain CDR3 for antibody 5191 (IGHV3-33)
ARDNILTAYYLFDY

SEQ ID NO: 10383 - protein, 9 aa, Homo sapiens
  Light chain CDR3 for antibody 5192 (IGKV5-2)
LQHDNFPWT

SEQ ID NO: 10384 - protein, 11 aa, Homo sapiens
  Heavy chain CDR3 for antibody 5192 (IGHV1-18)
SRGGFSVGYDS

SEQ ID NO: 10385 - protein, 9 aa, Homo sapiens
  Light chain CDR3 for antibody 5193 (IGKV1-9)
QQLKSYLYT

SEQ ID NO: 10386 - protein, 13 aa, Homo sapiens
  Heavy chain CDR3 for antibody 5193 (IGHV4-39)
ARQWPSGYWYFDL

SEQ ID NO: 10387 - protein, 9 aa, Homo sapiens
  Light chain CDR3 for antibody 5194 (IGKV1D-13)
QQFNNYPYT

SEQ ID NO: 10388 - protein, 11 aa, Homo sapiens
  Heavy chain CDR3 for antibody 5194 (IGHV3-33)
ARDQGGSSFDY

SEQ ID NO: 10389 - protein, 9 aa, Homo sapiens
  Light chain CDR3 for antibody 5195 (IGKV1-9)
QQLNGYPFT

SEQ ID NO: 10390 - protein, 18 aa, Homo sapiens
  Heavy chain CDR3 for antibody 5195 (IGHV3-33)
ARREGIVGATTYYYGMDV

SEQ ID NO: 10391 - protein, 9 aa, Homo sapiens
  Light chain CDR3 for antibody 5196 (IGKV1-27)
QKYNSAPYT

SEQ ID NO: 10392 - protein, 15 aa, Homo sapiens
  Heavy chain CDR3 for antibody 5196 (IGHV3-33)
ARDEHYDILTGYWGY

SEQ ID NO: 10393 - protein, 9 aa, Homo sapiens
  Light chain CDR3 for antibody 5197 (IGKV3-11)
QQRSNWMYT

SEQ ID NO: 10394 - protein, 18 aa, Homo sapiens
  Heavy chain CDR3 for antibody 5197 (IGHV4-59)
AREGHYYTSGSYYKAFDY

SEQ ID NO: 10395 - protein, 9 aa, Homo sapiens
  Light chain CDR3 for antibody 5198 (IGKV2D-28)
MQALQTPPT

SEQ ID NO: 10396 - protein, 15 aa, Homo sapiens
  Heavy chain CDR3 for antibody 5198 (IGHV3-33)
ARDTGYSSSWNWFDP

SEQ ID NO: 10397 - protein, 9 aa, Homo sapiens
  Light chain CDR3 for antibody 5199 (IGKV2-30)
MQGTHWPLT

SEQ ID NO: 10398 - protein, 14 aa, Homo sapiens
  Heavy chain CDR3 for antibody 5199 (IGHV3-33)
ARAGSGYDRDWFDP

SEQ ID NO: 10399 - protein, 9 aa, Homo sapiens
  Light chain CDR3 for antibody 5200 (IGKV1-17)
LQHNSYPYT

SEQ ID NO: 10400 - protein, 12 aa, Homo sapiens
  Heavy chain CDR3 for antibody 5200 (IGHV4-39)
ARREVILGAFDY

SEQ ID NO: 10401 - protein, 9 aa, Homo sapiens
  Light chain CDR3 for antibody 5201 (IGKV1-39)
QQSYRTPLT

SEQ ID NO: 10402 - protein, 18 aa, Homo sapiens
  Heavy chain CDR3 for antibody 5201 (IGHV3-33)
ARRTAAGTGDYYYYGMDV

SEQ ID NO: 10403 - protein, 9 aa, Homo sapiens
  Light chain CDR3 for antibody 5202 (IGKV1-17)
LQHNSYPYT

SEQ ID NO: 10404 - protein, 16 aa, Homo sapiens
  Heavy chain CDR3 for antibody 5202 (IGHV3-33)
ARDAGYPNYDYYGMDV

SEQ ID NO: 10405 - protein, 9 aa, Homo sapiens
  Light chain CDR3 for antibody 5203 (IGKV1-16)
QHYNDYPFT

SEQ ID NO: 10406 - protein, 17 aa, Homo sapiens
  Heavy chain CDR3 for antibody 5203 (IGHV1-18)
ARERYYGSGIYKYAMDV

SEQ ID NO: 10407 - protein, 9 aa, Homo sapiens
  Light chain CDR3 for antibody 5204 (IGKV1-39)
QQSYSTPLT

SEQ ID NO: 10408 - protein, 15 aa, Homo sapiens
  Heavy chain CDR3 for antibody 5204 (IGHV3-23)
AKDRDYDFLSGPFDY

SEQ ID NO: 10409 - protein, 8 aa, Homo sapiens
  Light chain CDR3 for antibody 5205 (IGKV3D-7)
QQDYNLLT

SEQ ID NO: 10410 - protein, 21 aa, Homo sapiens
  Heavy chain CDR3 for antibody 5205 (IGHV3-23)
AKDIDYYGSGSYPLYYYGMDV

SEQ ID NO: 10411 - protein, 10 aa, Homo sapiens
  Light chain CDR3 for antibody 5206 (IGKV1-39)
QQSYSTPMYT

SEQ ID NO: 10412 - protein, 17 aa, Homo sapiens
  Heavy chain CDR3 for antibody 5206 (IGHV3-33)
VREGGLLWVGELSLFDY

SEQ ID NO: 10413 - protein, 9 aa, Homo sapiens
  Light chain CDR3 for antibody 5207 (IGKV6-21)
HQSSSLPYT

SEQ ID NO: 10414 - protein, 18 aa, Homo sapiens
  Heavy chain CDR3 for antibody 5207 (IGHV3-64)
ARDEYYYGSGSYYNYFDW

SEQ ID NO: 10415 - protein, 9 aa, Homo sapiens
  Light chain CDR3 for antibody 5208 (IGKV1-6)
LQDYKSPFT

SEQ ID NO: 10416 - protein, 18 aa, Homo sapiens
  Heavy chain CDR3 for antibody 5208 (IGHV3-33)
ARDRYYDILTGYYMGFDY

SEQ ID NO: 10417 - protein, 8 aa, Homo sapiens
  Light chain CDR3 for antibody 5209 (IGKV3-20)
QQYGRSFT

SEQ ID NO: 10418 - protein, 12 aa, Homo sapiens
  Heavy chain CDR3 for antibody 5209 (IGHV4-61)
ARVYSSGWLFDY

SEQ ID NO: 10419 - protein, 9 aa, Homo sapiens
  Light chain CDR3 for antibody 5210 (IGKV3-20)
QQYGSSPYT

SEQ ID NO: 10420 - protein, 18 aa, Homo sapiens
  Heavy chain CDR3 for antibody 5210 (IGHV3-33)
ARGALTYYDILTGYFFDY

SEQ ID NO: 10421 - protein, 9 aa, Homo sapiens
  Light chain CDR3 for antibody 5211 (IGKV3-11)
QQRINWPWT

SEQ ID NO: 10422 - protein, 15 aa, Homo sapiens
  Heavy chain CDR3 for antibody 5211 (IGHV4-39)
ARHSGYSSGWYPFDY

SEQ ID NO: 10423 - protein, 9 aa, Homo sapiens
  Light chain CDR3 for antibody 5212 (IGKV1D-13)
QQFNNYPHT

SEQ ID NO: 10424 - protein, 14 aa, Homo sapiens
  Heavy chain CDR3 for antibody 5212 (IGHV3-20)
ARDEGSGGYDVFDI

SEQ ID NO: 10425 - protein, 9 aa, Homo sapiens
  Light chain CDR3 for antibody 5213 (IGKV3D-7)
QQDYNLPYT

SEQ ID NO: 10426 - protein, 13 aa, Homo sapiens
  Heavy chain CDR3 for antibody 5213 (IGHV3-33)
ANTGDSYYYDMDV

SEQ ID NO: 10427 - protein, 9 aa, Homo sapiens
  Light chain CDR3 for antibody 5214 (IGKV3-20)
QQYGSSPYT

SEQ ID NO: 10428 - protein, 11 aa, Homo sapiens
  Heavy chain CDR3 for antibody 5214 (IGHV3-33)
ASWDILTGSGY

SEQ ID NO: 10429 - protein, 9 aa, Homo sapiens
  Light chain CDR3 for antibody 5215 (IGKV1D-13)
QQFNNYPHT

SEQ ID NO: 10430 - protein, 16 aa, Homo sapiens
  Heavy chain CDR3 for antibody 5215 (IGHV3-33)
ARDQGILTGYYTALDY

SEQ ID NO: 10431 - protein, 9 aa, Homo sapiens
  Light chain CDR3 for antibody 5216 (IGKV1-9)
QQLNSYPRT

SEQ ID NO: 10432 - protein, 16 aa, Homo sapiens
  Heavy chain CDR3 for antibody 5216 (IGHV3-33)
ARIAAPGSEYYYGMDV

SEQ ID NO: 10433 - protein, 9 aa, Homo sapiens
  Light chain CDR3 for antibody 5217 (IGKV1-6)
LQDYNYPWT

SEQ ID NO: 10434 - protein, 15 aa, Homo sapiens
  Heavy chain CDR3 for antibody 5217 (IGHV3-33)
ARGYYYGSGSFPFDY

SEQ ID NO: 10435 - protein, 9 aa, Homo sapiens
  Light chain CDR3 for antibody 5218 (IGKV1D-16)
QQYDSYPYT

SEQ ID NO: 10436 - protein, 11 aa, Homo sapiens
  Heavy chain CDR3 for antibody 5218 (IGHV3-33)
ARDRSSGPFDY

SEQ ID NO: 10437 - protein, 9 aa, Homo sapiens
  Light chain CDR3 for antibody 5219 (IGKV1-27)
QKYNSAPYT

SEQ ID NO: 10438 - protein, 15 aa, Homo sapiens
  Heavy chain CDR3 for antibody 5219 (IGHV3-23)
AKDGGWNYYYYGMDV

SEQ ID NO: 10439 - protein, 9 aa, Homo sapiens
  Light chain CDR3 for antibody 5220 (IGKV5-2)
LQHDNFPWT

SEQ ID NO: 10440 - protein, 11 aa, Homo sapiens
  Heavy chain CDR3 for antibody 5220 (IGHV4-39)
ARLSGEGHFDS

SEQ ID NO: 10441 - protein, 9 aa, Homo sapiens
  Light chain CDR3 for antibody 5221 (IGKV3-15)
QQYNNWPFT

SEQ ID NO: 10442 - protein, 16 aa, Homo sapiens
  Heavy chain CDR3 for antibody 5221 (IGHV1-8)
AREGTMVRGVTYAFDI

SEQ ID NO: 10443 - protein, 9 aa, Homo sapiens
  Light chain CDR3 for antibody 5222 (IGKV1-6)
LQDYKSPFT

SEQ ID NO: 10444 - protein, 9 aa, Homo sapiens
  Heavy chain CDR3 for antibody 5222 (IGHV3-23)
AREGGSGSL

SEQ ID NO: 10445 - protein, 10 aa, Homo sapiens
  Light chain CDR3 for antibody 5223 (IGKV1-39)
QQSYSTPMYT

SEQ ID NO: 10446 - protein, 11 aa, Homo sapiens
  Heavy chain CDR3 for antibody 5223 (IGHV3-33)
AREGAVASFDY

SEQ ID NO: 10447 - protein, 8 aa, Homo sapiens
  Light chain CDR3 for antibody 5224 (IGKV3D-7)
QQDYNLLT

SEQ ID NO: 10448 - protein, 17 aa, Homo sapiens
  Heavy chain CDR3 for antibody 5224 (IGHV3-33)
ARDLIGPLSSSWYPFDY

SEQ ID NO: 10449 - protein, 9 aa, Homo sapiens
  Light chain CDR3 for antibody 5225 (IGKV3D-7)
QQDYNLPWT

SEQ ID NO: 10450 - protein, 16 aa, Homo sapiens
  Heavy chain CDR3 for antibody 5225 (IGHV3-23)
AKEGEVLRYFDWLFNY

SEQ ID NO: 10451 - protein, 9 aa, Homo sapiens
  Light chain CDR3 for antibody 5226 (IGKV1-39)
QQSYSTPLT

SEQ ID NO: 10452 - protein, 8 aa, Homo sapiens
  Heavy chain CDR3 for antibody 5226 (IGHV3-20)
APHWIFDY

SEQ ID NO: 10453 - protein, 10 aa, Homo sapiens
  Light chain CDR3 for antibody 5227 (IGKV3-11)
QQRSNWPIFT

SEQ ID NO: 10454 - protein, 13 aa, Homo sapiens
  Heavy chain CDR3 for antibody 5227 (IGHV3-13)
ARAITMVRGVIDY

SEQ ID NO: 10455 - protein, 9 aa, Homo sapiens
  Light chain CDR3 for antibody 5228 (IGKV3D-7)
QQDYNLPFT

SEQ ID NO: 10456 - protein, 13 aa, Homo sapiens
  Heavy chain CDR3 for antibody 5228 (IGHV3-33)
ARGDNWNDGGFDY

SEQ ID NO: 10457 - protein, 9 aa, Homo sapiens
  Light chain CDR3 for antibody 5229 (IGKV3-11)
QQRSNWMYT

SEQ ID NO: 10458 - protein, 12 aa, Homo sapiens
  Heavy chain CDR3 for antibody 5229 (IGHV3-23)
AKEYDILTGYFH

SEQ ID NO: 10459 - protein, 9 aa, Homo sapiens
  Light chain CDR3 for antibody 5230 (IGKV1-6)
LQDYKSPFT

SEQ ID NO: 10460 - protein, 17 aa, Homo sapiens
  Heavy chain CDR3 for antibody 5230 (IGHV1-18)
ARDRAFTMVRGVPPFDY

SEQ ID NO: 10461 - protein, 8 aa, Homo sapiens
  Light chain CDR3 for antibody 5231 (IGKV3D-7)
QQDYNLLT

SEQ ID NO: 10462 - protein, 14 aa, Homo sapiens
  Heavy chain CDR3 for antibody 5231 (IGHV3-33)
ARRGSPLRPSHLDV

SEQ ID NO: 10463 - protein, 9 aa, Homo sapiens
  Light chain CDR3 for antibody 5232 (IGKV3D-7)
QQDYNLPLT

SEQ ID NO: 10464 - protein, 14 aa, Homo sapiens
  Heavy chain CDR3 for antibody 5232 (IGHV4-39)
ARHGYYGSSNWFDP

SEQ ID NO: 10465 - protein, 9 aa, Homo sapiens
  Light chain CDR3 for antibody 5233 (IGKV1-6)
LQDYNYPYT

SEQ ID NO: 10466 - protein, 19 aa, Homo sapiens
  Heavy chain CDR3 for antibody 5233 (IGHV3-33)
ARDNDSSGYYDYYYYGMDV

SEQ ID NO: 10467 - protein, 8 aa, Homo sapiens
  Light chain CDR3 for antibody 5234 (IGKV1D-13)
QQFNNYPT

SEQ ID NO: 10468 - protein, 11 aa, Homo sapiens
  Heavy chain CDR3 for antibody 5234 (IGHV3-33)
ARDRATATVDY

SEQ ID NO: 10469 - protein, 9 aa, Homo sapiens
  Light chain CDR3 for antibody 5235 (IGKV1-9)
QQLNTYPYT

SEQ ID NO: 10470 - protein, 18 aa, Homo sapiens
  Heavy chain CDR3 for antibody 5235 (IGHV1-46)
ARDGDYVWGSYRSNWFDP

SEQ ID NO: 10471 - protein, 9 aa, Homo sapiens
  Light chain CDR3 for antibody 5236 (IGKV1-6)
LQDYKSPFT

SEQ ID NO: 10472 - protein, 14 aa, Homo sapiens
  Heavy chain CDR3 for antibody 5236 (IGHV3-33)
ARDWNDVYYYGMDV

SEQ ID NO: 10473 - protein, 9 aa, Homo sapiens
  Light chain CDR3 for antibody 5237 (IGKV3D-7)
QQDYNLPYT

SEQ ID NO: 10474 - protein, 14 aa, Homo sapiens
  Heavy chain CDR3 for antibody 5237 (IGHV3-23)
ANWAYDILTGYLDY

SEQ ID NO: 10475 - protein, 9 aa, Homo sapiens
  Light chain CDR3 for antibody 5238 (IGKV1-39)
QQSYRTPLT

SEQ ID NO: 10476 - protein, 16 aa, Homo sapiens
  Heavy chain CDR3 for antibody 5238 (IGHV3-33)
ARDKNTDYDILTGFDY

SEQ ID NO: 10477 - protein, 9 aa, Homo sapiens
  Light chain CDR3 for antibody 5239 (IGKV1D-13)
QRFNNYLYT

SEQ ID NO: 10478 - protein, 10 aa, Homo sapiens
  Heavy chain CDR3 for antibody 5239 (IGHV3-33)
ARENSTPLDY

SEQ ID NO: 10479 - protein, 9 aa, Homo sapiens
  Light chain CDR3 for antibody 5240 (IGKV1-39)
QQSYSTPLT

SEQ ID NO: 10480 - protein, 14 aa, Homo sapiens
  Heavy chain CDR3 for antibody 5240 (IGHV3-15)
SIYYYGSGRDFFDY

SEQ ID NO: 10481 - protein, 8 aa, Homo sapiens
  Light chain CDR3 for antibody 5241 (IGKV1-5)
QQYNSYYT

SEQ ID NO: 10482 - protein, 10 aa, Homo sapiens
  Heavy chain CDR3 for antibody 5241 (IGHV3-23)
AKDHYGDYPY

SEQ ID NO: 10483 - protein, 9 aa, Homo sapiens
  Light chain CDR3 for antibody 5242 (IGKV3-11)
QQRSNWPYT

SEQ ID NO: 10484 - protein, 15 aa, Homo sapiens
  Heavy chain CDR3 for antibody 5242 (IGHV3-33)
ARDHLTGYYYYGMDV

SEQ ID NO: 10485 - protein, 9 aa, Homo sapiens
  Light chain CDR3 for antibody 5243 (IGKV1-33)
QQYDNLPFT

SEQ ID NO: 10486 - protein, 15 aa, Homo sapiens
  Heavy chain CDR3 for antibody 5243 (IGHV3-33)
ARDHLTGYYYYGMDV

SEQ ID NO: 10487 - protein, 9 aa, Homo sapiens
  Light chain CDR3 for antibody 5244 (IGKV3-11)
QQRSNWPLT

SEQ ID NO: 10488 - protein, 11 aa, Homo sapiens
  Heavy chain CDR3 for antibody 5244 (IGHV4-59)
ARETGDDAFDI

SEQ ID NO: 10489 - protein, 9 aa, Homo sapiens
  Light chain CDR3 for antibody 5245 (IGKV1-39)
QQSYSTPLT

SEQ ID NO: 10490 - protein, 17 aa, Homo sapiens
  Heavy chain CDR3 for antibody 5245 (IGHV3-33)
ARDSYDILTGYYKPFDY

SEQ ID NO: 10491 - protein, 9 aa, Homo sapiens
  Light chain CDR3 for antibody 5246 (IGKV1-27)
QKYNSAPYT

SEQ ID NO: 10492 - protein, 8 aa, Homo sapiens
  Heavy chain CDR3 for antibody 5246 (IGHV4-39)
ARRGGLDY

SEQ ID NO: 10493 - protein, 9 aa, Homo sapiens
  Light chain CDR3 for antibody 5247 (IGKV3D-7)
QQDYNLPWT

SEQ ID NO: 10494 - protein, 23 aa, Homo sapiens
  Heavy chain CDR3 for antibody 5247 (IGHV3-11)
ARDEGVTMVRGVISYYYYYGMDV

SEQ ID NO: 10495 - protein, 10 aa, Homo sapiens
  Light chain CDR3 for antibody 5248 (IGKV1-39)
QQSYSTPMYT

SEQ ID NO: 10496 - protein, 13 aa, Homo sapiens
  Heavy chain CDR3 for antibody 5248 (IGHV3-33)
ARKAYGDYFYFDY

SEQ ID NO: 10497 - protein, 9 aa, Homo sapiens
  Light chain CDR3 for antibody 5249 (IGKV1-17)
LQHNSYPYT

SEQ ID NO: 10498 - protein, 14 aa, Homo sapiens
  Heavy chain CDR3 for antibody 5249 (IGHV1-18)
ARDDILTGYPHFDY

SEQ ID NO: 10499 - protein, 9 aa, Homo sapiens
  Light chain CDR3 for antibody 5250 (IGKV1-39)
QQSYSTPLT

SEQ ID NO: 10500 - protein, 15 aa, Homo sapiens
  Heavy chain CDR3 for antibody 5250 (IGHV3-21)
ARDGLRYFDWLFPWY

SEQ ID NO: 10501 - protein, 9 aa, Homo sapiens
  Light chain CDR3 for antibody 5251 (IGKV1D-13)
QQFNNYPHT

SEQ ID NO: 10502 - protein, 14 aa, Homo sapiens
  Heavy chain CDR3 for antibody 5251 (IGHV3-33)
ARGYGSGSYYSFDY

SEQ ID NO: 10503 - protein, 9 aa, Homo sapiens
  Light chain CDR3 for antibody 5252 (IGKV6-21)
HQSSSLPYT

SEQ ID NO: 10504 - protein, 22 aa, Homo sapiens
  Heavy chain CDR3 for antibody 5252 (IGHV3-11)
AREAYYDILTGYYTGYYYGMDV

SEQ ID NO: 10505 - protein, 9 aa, Homo sapiens
  Light chain CDR3 for antibody 5253 (IGKV3D-7)
QQDYNLPLT

SEQ ID NO: 10506 - protein, 19 aa, Homo sapiens
  Heavy chain CDR3 for antibody 5253 (IGHV3-23)
AKDGRSGSYDYYYYYGMDV

SEQ ID NO: 10507 - protein, 10 aa, Homo sapiens
  Light chain CDR3 for antibody 5254 (IGKV3-11)
QQRSNWPALT

SEQ ID NO: 10508 - protein, 10 aa, Homo sapiens
  Heavy chain CDR3 for antibody 5254 (IGHV3-33)
ARDVVVYFDY

SEQ ID NO: 10509 - protein, 9 aa, Homo sapiens
  Light chain CDR3 for antibody 5255 (IGKV6-21)
HQSSSLPYT

SEQ ID NO: 10510 - protein, 12 aa, Homo sapiens
  Heavy chain CDR3 for antibody 5255 (IGHV3-23)
AKGAVVTAIFDY

SEQ ID NO: 10511 - protein, 10 aa, Homo sapiens
  Light chain CDR3 for antibody 5256 (IGKV3-11)
QQRSNWPIFT

SEQ ID NO: 10512 - protein, 12 aa, Homo sapiens
  Heavy chain CDR3 for antibody 5256 (IGHV3-33)
ARDGYSSRNFDY

SEQ ID NO: 10513 - protein, 9 aa, Homo sapiens
  Light chain CDR3 for antibody 5257 (IGKV3D-7)
QQDYNLPWT

SEQ ID NO: 10514 - protein, 12 aa, Homo sapiens
  Heavy chain CDR3 for antibody 5257 (IGHV4-61)
ARVDSSGWYFDY

SEQ ID NO: 10515 - protein, 11 aa, Homo sapiens
  Light chain CDR3 for antibody 5258 (IGKV3-11)
QQRSNWPPTWT

SEQ ID NO: 10516 - protein, 12 aa, Homo sapiens
  Heavy chain CDR3 for antibody 5258 (IGHV4-39)
ARQMVREGWFDP

SEQ ID NO: 10517 - protein, 10 aa, Homo sapiens
  Light chain CDR3 for antibody 5259 (IGKV3-20)
QQYGRSPPVT

SEQ ID NO: 10518 - protein, 15 aa, Homo sapiens
  Heavy chain CDR3 for antibody 5259 (IGHV1-18)
ARGYCSSTSCYYFDY

SEQ ID NO: 10519 - protein, 9 aa, Homo sapiens
  Light chain CDR3 for antibody 5260 (IGKV3D-7)
QQDYNLPLT

SEQ ID NO: 10520 - protein, 21 aa, Homo sapiens
  Heavy chain CDR3 for antibody 5260 (IGHV3-33)
ARKRLYDILTGYYKAYYGMDV

SEQ ID NO: 10521 - protein, 10 aa, Homo sapiens
  Light chain CDR3 for antibody 5261 (IGKV3-11)
QQRSNWPMYT

SEQ ID NO: 10522 - protein, 15 aa, Homo sapiens
  Heavy chain CDR3 for antibody 5261 (IGHV3-33)
ARRVCSGGSCSLFDY

SEQ ID NO: 10523 - protein, 9 aa, Homo sapiens
  Light chain CDR3 for antibody 5262 (IGKV3D-7)
QQDYNLPWT

SEQ ID NO: 10524 - protein, 20 aa, Homo sapiens
  Heavy chain CDR3 for antibody 5262 (IGHV3-33)
ARDPAQLERRYYYFYYGMDV

SEQ ID NO: 10525 - protein, 9 aa, Homo sapiens
  Light chain CDR3 for antibody 5263 (IGKV6-21)
HQSSSLPYT

SEQ ID NO: 10526 - protein, 15 aa, Homo sapiens
  Heavy chain CDR3 for antibody 5263 (IGHV3-23)
AKDRNYDFLTGPFDP

SEQ ID NO: 10527 - protein, 8 aa, Homo sapiens
  Light chain CDR3 for antibody 5264 (IGKV1D-13)
QQFNNYPT

SEQ ID NO: 10528 - protein, 18 aa, Homo sapiens
  Heavy chain CDR3 for antibody 5264 (IGHV3-33)
ARGLLWFGVSYYYYGMDV

SEQ ID NO: 10529 - protein, 10 aa, Homo sapiens
  Light chain CDR3 for antibody 5265 (IGKV3-11)
QQRSNWPIFT

SEQ ID NO: 10530 - protein, 18 aa, Homo sapiens
  Heavy chain CDR3 for antibody 5265 (IGHV3-33)
ARGYYGSGNFYKDSGMDV

SEQ ID NO: 10531 - protein, 9 aa, Homo sapiens
  Light chain CDR3 for antibody 5266 (IGKV2-30)
LQYAHWPHT

SEQ ID NO: 10532 - protein, 10 aa, Homo sapiens
  Heavy chain CDR3 for antibody 5266 (IGHV3-h)
ARDVWWSFDY

SEQ ID NO: 10533 - protein, 9 aa, Homo sapiens
  Light chain CDR3 for antibody 5267 (IGKV3-15)
QQYNNWPYT

SEQ ID NO: 10534 - protein, 14 aa, Homo sapiens
  Heavy chain CDR3 for antibody 5267 (IGHV3-33)
ARTTAAAGPRDFQH

SEQ ID NO: 10535 - protein, 8 aa, Homo sapiens
  Light chain CDR3 for antibody 5268 (IGKV1-5)
QQYNSYWT

SEQ ID NO: 10536 - protein, 14 aa, Homo sapiens
  Heavy chain CDR3 for antibody 5268 (IGHV3-33)
ARDNILTAYYLFDY

SEQ ID NO: 10537 - protein, 9 aa, Homo sapiens
  Light chain CDR3 for antibody 5269 (IGKV5-2)
LQHDNFPYT

SEQ ID NO: 10538 - protein, 20 aa, Homo sapiens
  Heavy chain CDR3 for antibody 5269 (IGHV3-23)
AKDRMTTVTSYYYYSYGMDV

SEQ ID NO: 10539 - protein, 9 aa, Homo sapiens
  Light chain CDR3 for antibody 5270 (IGKV1-17)
LQHNSYPWT

SEQ ID NO: 10540 - protein, 17 aa, Homo sapiens
  Heavy chain CDR3 for antibody 5270 (IGHV3-23)
AKGNYGSGSYYNGDFQH

SEQ ID NO: 10541 - protein, 10 aa, Homo sapiens
  Light chain CDR3 for antibody 5271 (IGKV1-39)
QQSYSTPMYT

SEQ ID NO: 10542 - protein, 17 aa, Homo sapiens
  Heavy chain CDR3 for antibody 5271 (IGHV3-33)
ARVYYDILTGYSPAFDI

SEQ ID NO: 10543 - protein, 9 aa, Homo sapiens
  Light chain CDR3 for antibody 5272 (IGKV1D-16)
QQYNSYPYT

SEQ ID NO: 10544 - protein, 10 aa, Homo sapiens
  Heavy chain CDR3 for antibody 5272 (IGHV1-18)
ARGPTSDVDY

SEQ ID NO: 10545 - protein, 9 aa, Homo sapiens
  Light chain CDR3 for antibody 5273 (IGKV3D-7)
QQDYNLPWT

SEQ ID NO: 10546 - protein, 20 aa, Homo sapiens
  Heavy chain CDR3 for antibody 5273 (IGHV3-23)
AKDREMAATSHYYYYYGMDV

SEQ ID NO: 10547 - protein, 9 aa, Homo sapiens
  Light chain CDR3 for antibody 5274 (IGKV3D-7)
QQDYKLPLT

SEQ ID NO: 10548 - protein, 15 aa, Homo sapiens
  Heavy chain CDR3 for antibody 5274 (IGHV1-46)
ARGAVDDYYYYGMDV

SEQ ID NO: 10549 - protein, 9 aa, Homo sapiens
  Light chain CDR3 for antibody 5275 (IGKV2-30)
MQGTHWPLT

SEQ ID NO: 10550 - protein, 17 aa, Homo sapiens
  Heavy chain CDR3 for antibody 5275 (IGHV3-33)
ARGGAAAGPYLYYGLDV

SEQ ID NO: 10551 - protein, 9 aa, Homo sapiens
  Light chain CDR3 for antibody 5276 (IGKV3-11)
QQRSNWMYT

SEQ ID NO: 10552 - protein, 20 aa, Homo sapiens
  Heavy chain CDR3 for antibody 5276 (IGHV1-f)
ATHYDILTGSPYYYYCALDV

SEQ ID NO: 10553 - protein, 9 aa, Homo sapiens
  Light chain CDR3 for antibody 5277 (IGKV2-30)
MQGTHWPLT

SEQ ID NO: 10554 - protein, 11 aa, Homo sapiens
  Heavy chain CDR3 for antibody 5277 (IGHV4-4)
AREAYYYGLDV

SEQ ID NO: 10555 - protein, 9 aa, Homo sapiens
  Light chain CDR3 for antibody 5278 (IGKV1-39)
QQSYSTPLT

SEQ ID NO: 10556 - protein, 14 aa, Homo sapiens
  Heavy chain CDR3 for antibody 5278 (IGHV3-33)
ARGYGSGSYYSFDY

SEQ ID NO: 10557 - protein, 9 aa, Homo sapiens
  Light chain CDR3 for antibody 5279 (IGKV3D-7)
QQDYNLPLT

SEQ ID NO: 10558 - protein, 15 aa, Homo sapiens
  Heavy chain CDR3 for antibody 5279 (IGHV4-39)
ARQGLVATIKGYFQH

SEQ ID NO: 10559 - protein, 9 aa, Homo sapiens
  Light chain CDR3 for antibody 5280 (IGKV1-33)
QQYDNLPFT

SEQ ID NO: 10560 - protein, 17 aa, Homo sapiens
  Heavy chain CDR3 for antibody 5280 (IGHV1-18)
ARDRAFTMVRGVPPFDY

SEQ ID NO: 10561 - protein, 9 aa, Homo sapiens
  Light chain CDR3 for antibody 5281 (IGKV1D-16)
QQYITYPYT

SEQ ID NO: 10562 - protein, 15 aa, Homo sapiens
  Heavy chain CDR3 for antibody 5281 (IGHV3-30)
ARGAMVRGVDYGMDV

SEQ ID NO: 10563 - protein, 9 aa, Homo sapiens
  Light chain CDR3 for antibody 5282 (IGKV2-30)
MQGTHWPLT

SEQ ID NO: 10564 - protein, 20 aa, Homo sapiens
  Heavy chain CDR3 for antibody 5282 (IGHV3-33)
AREDYYGSGSYYPAYNWFDP

SEQ ID NO: 10565 - protein, 9 aa, Homo sapiens
  Light chain CDR3 for antibody 5283 (IGKV2-30)
MQGTHWPLT

SEQ ID NO: 10566 - protein, 11 aa, Homo sapiens
  Heavy chain CDR3 for antibody 5283 (IGHV3-33)
ARDKSSGWSDY

SEQ ID NO: 10567 - protein, 9 aa, Homo sapiens
  Light chain CDR3 for antibody 5284 (IGKV3D-7)
QQDYNLPYT

SEQ ID NO: 10568 - protein, 14 aa, Homo sapiens
  Heavy chain CDR3 for antibody 5284 (IGHV3-33)
AREDYYGPLNWFDP

SEQ ID NO: 10569 - protein, 8 aa, Homo sapiens
  Light chain CDR3 for antibody 5285 (IGKV3D-7)
QQDYNLLT

SEQ ID NO: 10570 - protein, 10 aa, Homo sapiens
  Heavy chain CDR3 for antibody 5285 (IGHV3-33)
ARDGSGSQPI

SEQ ID NO: 10571 - protein, 9 aa, Homo sapiens
  Light chain CDR3 for antibody 5286 (IGKV3-11)
QQRSNWPYT

SEQ ID NO: 10572 - protein, 13 aa, Homo sapiens
  Heavy chain CDR3 for antibody 5286 (IGHV1-46)
ARRQVGYYYGMDV

SEQ ID NO: 10573 - protein, 9 aa, Homo sapiens
  Light chain CDR3 for antibody 5287 (IGKV1-6)
LQDYNYPYT

SEQ ID NO: 10574 - protein, 19 aa, Homo sapiens
  Heavy chain CDR3 for antibody 5287 (IGHV3-33)
AGTYPTFYDGSGNYYDFDY

SEQ ID NO: 10575 - protein, 9 aa, Homo sapiens
  Light chain CDR3 for antibody 5288 (IGKV6-21)
HQSSSLPLT

SEQ ID NO: 10576 - protein, 19 aa, Homo sapiens
  Heavy chain CDR3 for antibody 5288 (IGHV3-33)
ARDRYYDILTGYSSYYFDY

SEQ ID NO: 10577 - protein, 8 aa, Homo sapiens
  Light chain CDR3 for antibody 5289 (IGKV3-20)
QQYGSSLT

SEQ ID NO: 10578 - protein, 15 aa, Homo sapiens
  Heavy chain CDR3 for antibody 5289 (IGHV3-20)
ARDRGSSGWRDWFDP

SEQ ID NO: 10579 - protein, 9 aa, Homo sapiens
  Light chain CDR3 for antibody 5290 (IGKV3-20)
QQYGSSPYT

SEQ ID NO: 10580 - protein, 12 aa, Homo sapiens
  Heavy chain CDR3 for antibody 5290 (IGHV4-34)
ARGYSSSWYFDY

SEQ ID NO: 10581 - protein, 9 aa, Homo sapiens
  Light chain CDR3 for antibody 5291 (IGKV1-9)
QQYNSYPLT

SEQ ID NO: 10582 - protein, 15 aa, Homo sapiens
  Heavy chain CDR3 for antibody 5291 (IGHV3-33)
ARHSSGFYYYYGMDV

SEQ ID NO: 10583 - protein, 9 aa, Homo sapiens
  Light chain CDR3 for antibody 5292 (IGKV3D-7)
QQDYNLPLT

SEQ ID NO: 10584 - protein, 15 aa, Homo sapiens
  Heavy chain CDR3 for antibody 5292 (IGHV1-24)
ATHWDLRYYYYGMDV

SEQ ID NO: 10585 - protein, 9 aa, Homo sapiens
  Light chain CDR3 for antibody 5293 (IGKV3D-7)
QQDYNLPYT

SEQ ID NO: 10586 - protein, 21 aa, Homo sapiens
  Heavy chain CDR3 for antibody 5293 (IGHV4-59)
AAGVLLWFGEPNYYYYYGMDV

SEQ ID NO: 10587 - protein, 9 aa, Homo sapiens
  Light chain CDR3 for antibody 5294 (IGKV1-39)
QQSYSTPLT

SEQ ID NO: 10588 - protein, 15 aa, Homo sapiens
  Heavy chain CDR3 for antibody 5294 (IGHV3-23)
AKDLSSGWYAYFFDY

SEQ ID NO: 10589 - protein, 10 aa, Homo sapiens
  Light chain CDR3 for antibody 5295 (IGKV3-11)
QQRSNWPTWT

SEQ ID NO: 10590 - protein, 17 aa, Homo sapiens
  Heavy chain CDR3 for antibody 5295 (IGHV1-18)
ARERYYGSGSYKYNMDV

SEQ ID NO: 10591 - protein, 8 aa, Homo sapiens
  Light chain CDR3 for antibody 5296 (IGKV1-5)
QQYNSYWT

SEQ ID NO: 10592 - protein, 9 aa, Homo sapiens
  Heavy chain CDR3 for antibody 5296 (IGHV3-30)
ARDNWGFDY

SEQ ID NO: 10593 - protein, 9 aa, Homo sapiens
  Light chain CDR3 for antibody 5297 (IGKV1-6)
LQDYNYPWT

SEQ ID NO: 10594 - protein, 16 aa, Homo sapiens
  Heavy chain CDR3 for antibody 5297 (IGHV4-59)
ARGRYFDWLLGDVFDI

SEQ ID NO: 10595 - protein, 9 aa, Homo sapiens
  Light chain CDR3 for antibody 5298 (IGKV1-9)
QQLNSYPLT

SEQ ID NO: 10596 - protein, 9 aa, Homo sapiens
  Heavy chain CDR3 for antibody 5298 (IGHV3-20)
ASIRGYFDY

SEQ ID NO: 10597 - protein, 8 aa, Homo sapiens
  Light chain CDR3 for antibody 5299 (IGKV1D-13)
QQFNNYPT

SEQ ID NO: 10598 - protein, 10 aa, Homo sapiens
  Heavy chain CDR3 for antibody 5299 (IGHV3-33)
ARENSTPLDY

SEQ ID NO: 10599 - protein, 9 aa, Homo sapiens
  Light chain CDR3 for antibody 5300 (IGKV1-33)
QQYDNLPFT

SEQ ID NO: 10600 - protein, 21 aa, Homo sapiens
  Heavy chain CDR3 for antibody 5300 (IGHV3-23)
AKDIDYYGSGSYPLYYYGMDV

SEQ ID NO: 10601 - protein, 9 aa, Homo sapiens
  Light chain CDR3 for antibody 5301 (IGKV1-9)
QQLNRYPYT

SEQ ID NO: 10602 - protein, 14 aa, Homo sapiens
  Heavy chain CDR3 for antibody 5301 (IGHV3-23)
AKSRIVGALYYFDY

SEQ ID NO: 10603 - protein, 9 aa, Homo sapiens
  Light chain CDR3 for antibody 5302 (IGKV1-9)
QQGNTYSRT

SEQ ID NO: 10604 - protein, 12 aa, Homo sapiens
  Heavy chain CDR3 for antibody 5302 (IGHV4-39)
ARHGSGSSYFDY

SEQ ID NO: 10605 - protein, 10 aa, Homo sapiens
  Light chain CDR3 for antibody 5303 (IGKV1-17)
LQHNSYPMYT

SEQ ID NO: 10606 - protein, 9 aa, Homo sapiens
  Heavy chain CDR3 for antibody 5303 (IGHV3-30)
ARDNWGFDY

SEQ ID NO: 10607 - protein, 9 aa, Homo sapiens
  Light chain CDR3 for antibody 5304 (IGKV2-30)
MQGTHWPLT

SEQ ID NO: 10608 - protein, 16 aa, Homo sapiens
  Heavy chain CDR3 for antibody 5304 (IGHV3-33)
ARGYDMLTGDYYGMDV

SEQ ID NO: 10609 - protein, 9 aa, Homo sapiens
  Light chain CDR3 for antibody 5305 (IGKV1-39)
QQSYSTPLT

SEQ ID NO: 10610 - protein, 20 aa, Homo sapiens
  Heavy chain CDR3 for antibody 5305 (IGHV4-59)
ARDRGYDILTGYYGYYGMDV

SEQ ID NO: 10611 - protein, 9 aa, Homo sapiens
  Light chain CDR3 for antibody 5306 (IGKV6-21)
HQSSSLPHT

SEQ ID NO: 10612 - protein, 13 aa, Homo sapiens
  Heavy chain CDR3 for antibody 5306 (IGHV4-39)
ARRGVVAPAAFDY

SEQ ID NO: 10613 - protein, 9 aa, Homo sapiens
  Light chain CDR3 for antibody 5307 (IGKV1-39)
QQSYRTPLT

SEQ ID NO: 10614 - protein, 14 aa, Homo sapiens
  Heavy chain CDR3 for antibody 5307 (IGHV3-33)
ARDGYDILTGPFDY

SEQ ID NO: 10615 - protein, 9 aa, Homo sapiens
  Light chain CDR3 for antibody 5308 (IGKV3-11)
QQRSNWPPT

SEQ ID NO: 10616 - protein, 10 aa, Homo sapiens
  Heavy chain CDR3 for antibody 5308 (IGHV3-33)
ARDGSGSQPI

SEQ ID NO: 10617 - protein, 9 aa, Homo sapiens
  Light chain CDR3 for antibody 5309 (IGKV3D-7)
QQDYNLPWT

SEQ ID NO: 10618 - protein, 14 aa, Homo sapiens
  Heavy chain CDR3 for antibody 5309 (IGHV3-64)
ARDHAAGGYSHSDY

SEQ ID NO: 10619 - protein, 9 aa, Homo sapiens
  Light chain CDR3 for antibody 5310 (IGKV1-39)
QQSYSTPFT

SEQ ID NO: 10620 - protein, 13 aa, Homo sapiens
  Heavy chain CDR3 for antibody 5310 (IGHV4-39)
ARRDGSYYGYFGY

SEQ ID NO: 10621 - protein, 9 aa, Homo sapiens
  Light chain CDR3 for antibody 5311 (IGKV1-6)
LQDYKSPFT

SEQ ID NO: 10622 - protein, 16 aa, Homo sapiens
  Heavy chain CDR3 for antibody 5311 (IGHV4-59)
ARGRYFEWLLGDVFDI

SEQ ID NO: 10623 - protein, 9 aa, Homo sapiens
  Light chain CDR3 for antibody 5312 (IGKV3-11)
QQRSNWPYT

SEQ ID NO: 10624 - protein, 14 aa, Homo sapiens
  Heavy chain CDR3 for antibody 5312 (IGHV1-46)
ARRGIVGALDAFDI

SEQ ID NO: 10625 - protein, 9 aa, Homo sapiens
  Light chain CDR3 for antibody 5313 (IGKV3-11)
QQRSNWPLT

SEQ ID NO: 10626 - protein, 13 aa, Homo sapiens
  Heavy chain CDR3 for antibody 5313 (IGHV3-23)
AKDRGYSSTSTAY

SEQ ID NO: 10627 - protein, 9 aa, Homo sapiens
  Light chain CDR3 for antibody 5314 (IGKV3-20)
QQYGSSPRT

SEQ ID NO: 10628 - protein, 16 aa, Homo sapiens
  Heavy chain CDR3 for antibody 5314 (IGHV1-24)
ATEDSSSYYYCCGMDV

SEQ ID NO: 10629 - protein, 11 aa, Homo sapiens
  Light chain CDR3 for antibody 5315 (IGKV3-11)
QQRSNWPPTWT

SEQ ID NO: 10630 - protein, 13 aa, Homo sapiens
  Heavy chain CDR3 for antibody 5315 (IGHV4-59)
ARTMVRGVAPFDY

SEQ ID NO: 10631 - protein, 10 aa, Homo sapiens
  Light chain CDR3 for antibody 5316 (IGKV1-17)
LQHNSYPMYT

SEQ ID NO: 10632 - protein, 9 aa, Homo sapiens
  Heavy chain CDR3 for antibody 5316 (IGHV3-30)
ARDYFHYDY

SEQ ID NO: 10633 - protein, 9 aa, Homo sapiens
  Light chain CDR3 for antibody 5317 (IGKV1-9)
QQYNSYPWT

SEQ ID NO: 10634 - protein, 13 aa, Homo sapiens
  Heavy chain CDR3 for antibody 5317 (IGHV3-33)
ARDDDYGDYPFDY

SEQ ID NO: 10635 - protein, 8 aa, Homo sapiens
  Light chain CDR3 for antibody 5318 (IGKV3-15)
QQYNNWPT

SEQ ID NO: 10636 - protein, 12 aa, Homo sapiens
  Heavy chain CDR3 for antibody 5318 (IGHV3-23)
AKDGWFGESLDY

SEQ ID NO: 10637 - protein, 9 aa, Homo sapiens
  Light chain CDR3 for antibody 5319 (IGKV1-6)
LQDYNYPWT

SEQ ID NO: 10638 - protein, 14 aa, Homo sapiens
  Heavy chain CDR3 for antibody 5319 (IGHV3-33)
AGDGYYILTGPFDY

SEQ ID NO: 10639 - protein, 9 aa, Homo sapiens
  Light chain CDR3 for antibody 5320 (IGKV1-27)
QKYNSAPYT

SEQ ID NO: 10640 - protein, 17 aa, Homo sapiens
  Heavy chain CDR3 for antibody 5320 (IGHV3-33)
ARDWFGELSDYYYGMDV

SEQ ID NO: 10641 - protein, 9 aa, Homo sapiens
  Light chain CDR3 for antibody 5321 (IGKV2-30)
MQGTHWPLT

SEQ ID NO: 10642 - protein, 16 aa, Homo sapiens
  Heavy chain CDR3 for antibody 5321 (IGHV3-13)
ARDRSYESYYYYGMDV

SEQ ID NO: 10643 - protein, 8 aa, Homo sapiens
  Light chain CDR3 for antibody 5322 (IGKV3D-7)
QQDYNLLT

SEQ ID NO: 10644 - protein, 24 aa, Homo sapiens
  Heavy chain CDR3 for antibody 5322 (IGHV3-20)
ARGRITMVRGVIINPLDYYNGMDV

SEQ ID NO: 10645 - protein, 10 aa, Homo sapiens
  Light chain CDR3 for antibody 5323 (IGKV3D-7)
QQRSNWPMYT

SEQ ID NO: 10646 - protein, 18 aa, Homo sapiens
  Heavy chain CDR3 for antibody 5323 (IGHV3-33)
ARGLLWFGVSYYYYGMDV

SEQ ID NO: 10647 - protein, 9 aa, Homo sapiens
  Light chain CDR3 for antibody 5324 (IGKV3-15)
QQYNNWPLT

SEQ ID NO: 10648 - protein, 12 aa, Homo sapiens
  Heavy chain CDR3 for antibody 5324 (IGHV3-23)
AKEGLGSDYEPY

SEQ ID NO: 10649 - protein, 9 aa, Homo sapiens
  Light chain CDR3 for antibody 5325 (IGKV3-15)
QQYNNWPLT

SEQ ID NO: 10650 - protein, 18 aa, Homo sapiens
  Heavy chain CDR3 for antibody 5325 (IGHV3-33)
ARDQYSGYDFYYYYGMDV

SEQ ID NO: 10651 - protein, 9 aa, Homo sapiens
  Light chain CDR3 for antibody 5326 (IGKV1-6)
QQEYNYPLT

SEQ ID NO: 10652 - protein, 18 aa, Homo sapiens
  Heavy chain CDR3 for antibody 5326 (IGHV3-23)
AKDRITGTTYGYYSGLDV

SEQ ID NO: 10653 - protein, 9 aa, Homo sapiens
  Light chain CDR3 for antibody 5327 (IGKV1-39)
QQSYRTPLT

SEQ ID NO: 10654 - protein, 16 aa, Homo sapiens
  Heavy chain CDR3 for antibody 5327 (IGHV3-11)
ARDSELRYFDWFGMDV

SEQ ID NO: 10655 - protein, 8 aa, Homo sapiens
  Light chain CDR3 for antibody 5328 (IGKV3D-7)
QQDYNLLT

SEQ ID NO: 10656 - protein, 12 aa, Homo sapiens
  Heavy chain CDR3 for antibody 5328 (IGHV3-33)
AREGDILTGYSL

SEQ ID NO: 10657 - protein, 9 aa, Homo sapiens
  Light chain CDR3 for antibody 5329 (IGKV3-20)
QQYGSSPYT

SEQ ID NO: 10658 - protein, 14 aa, Homo sapiens
  Heavy chain CDR3 for antibody 5329 (IGHV3-23)
AKDRYRGYEGLFDY

SEQ ID NO: 10659 - protein, 10 aa, Homo sapiens
  Light chain CDR3 for antibody 5330 (IGKV3-11)
QQRSNWPIFT

SEQ ID NO: 10660 - protein, 15 aa, Homo sapiens
  Heavy chain CDR3 for antibody 5330 (IGHV1-18)
ARGYCSSTSCYYFDY

SEQ ID NO: 10661 - protein, 8 aa, Homo sapiens
  Light chain CDR3 for antibody 5331 (IGKV3-11)
LQRGNWPT

SEQ ID NO: 10662 - protein, 16 aa, Homo sapiens
  Heavy chain CDR3 for antibody 5331 (IGHV3-23)
AKEGMVLRYFDWLWDY

SEQ ID NO: 10663 - protein, 10 aa, Homo sapiens
  Light chain CDR3 for antibody 5332 (IGKV1-17)
LQHNSYPMYT

SEQ ID NO: 10664 - protein, 13 aa, Homo sapiens
  Heavy chain CDR3 for antibody 5332 (IGHV3-33)
ARGDNWNDGGFDY

SEQ ID NO: 10665 - protein, 10 aa, Homo sapiens
  Light chain CDR3 for antibody 5333 (IGKV1-17)
LQHNSYPMYT

SEQ ID NO: 10666 - protein, 11 aa, Homo sapiens
  Heavy chain CDR3 for antibody 5333 (IGHV3-33)
ARDRVLTPFDY

SEQ ID NO: 10667 - protein, 9 aa, Homo sapiens
  Light chain CDR3 for antibody 5334 (IGKV1D-16)
LQHNSYPRT

SEQ ID NO: 10668 - protein, 13 aa, Homo sapiens
  Heavy chain CDR3 for antibody 5334 (IGHV1-18)
ARSYYGSGSPFDY

SEQ ID NO: 10669 - protein, 9 aa, Homo sapiens
  Light chain CDR3 for antibody 5335 (IGKV1-17)
QQLKSYLYT

SEQ ID NO: 10670 - protein, 13 aa, Homo sapiens
  Heavy chain CDR3 for antibody 5335 (IGHV3-23)
ASTGDSYYYGMDV

SEQ ID NO: 10671 - protein, 9 aa, Homo sapiens
  Light chain CDR3 for antibody 5336 (IGKV3-20)
QQYGSSPLT

SEQ ID NO: 10672 - protein, 17 aa, Homo sapiens
  Heavy chain CDR3 for antibody 5336 (IGHV1-24)
TTVVLYYDILPGYSFDY

SEQ ID NO: 10673 - protein, 10 aa, Homo sapiens
  Light chain CDR3 for antibody 5337 (IGKV3-11)
QQRSNWPALT

SEQ ID NO: 10674 - protein, 14 aa, Homo sapiens
  Heavy chain CDR3 for antibody 5337 (IGHV1-18)
ARCFGSGSYGWFDP

SEQ ID NO: 10675 - protein, 9 aa, Homo sapiens
  Light chain CDR3 for antibody 5338 (IGKV6-21)
HQSSSLPLT

SEQ ID NO: 10676 - protein, 13 aa, Homo sapiens
  Heavy chain CDR3 for antibody 5338 (IGHV3-33)
ARTDYYYYYGMDV

SEQ ID NO: 10677 - protein, 8 aa, Homo sapiens
  Light chain CDR3 for antibody 5339 (IGKV1D-13)
QQFNNYPT

SEQ ID NO: 10678 - protein, 12 aa, Homo sapiens
  Heavy chain CDR3 for antibody 5339 (IGHV3-33)
AKDPGWQQLAEY

SEQ ID NO: 10679 - protein, 9 aa, Homo sapiens
  Light chain CDR3 for antibody 5340 (IGKV1-17)
LQQNSYPWT

SEQ ID NO: 10680 - protein, 11 aa, Homo sapiens
  Heavy chain CDR3 for antibody 5340 (IGHV4-59)
ARDRGHYGMDV

SEQ ID NO: 10681 - protein, 10 aa, Homo sapiens
  Light chain CDR3 for antibody 5341 (IGKV3-15)
QQYNNWPPYT

SEQ ID NO: 10682 - protein, 18 aa, Homo sapiens
  Heavy chain CDR3 for antibody 5341 (IGHV3-33)
ARREGIVGATTYYYGMDV

SEQ ID NO: 10683 - protein, 9 aa, Homo sapiens
  Light chain CDR3 for antibody 5342 (IGKV3-20)
QQYGSSPYT

SEQ ID NO: 10684 - protein, 18 aa, Homo sapiens
  Heavy chain CDR3 for antibody 5342 (IGHV3-64)
ARDEYYYGSGSYYNYFDW

SEQ ID NO: 10685 - protein, 9 aa, Homo sapiens
  Light chain CDR3 for antibody 5343 (IGKV1-17)
LQHNSYPYT

SEQ ID NO: 10686 - protein, 13 aa, Homo sapiens
  Heavy chain CDR3 for antibody 5343 (IGHV3-33)
ARDDDYGDYPFDY

SEQ ID NO: 10687 - protein, 10 aa, Homo sapiens
  Light chain CDR3 for antibody 5344 (IGKV1-39)
QQSYSTPMYT

SEQ ID NO: 10688 - protein, 16 aa, Homo sapiens
  Heavy chain CDR3 for antibody 5344 (IGHV3-33)
ARDNFGSGSYYSHFHY

SEQ ID NO: 10689 - protein, 9 aa, Homo sapiens
  Light chain CDR3 for antibody 5345 (IGKV1-9)
QQLISYPLT

SEQ ID NO: 10690 - protein, 13 aa, Homo sapiens
  Heavy chain CDR3 for antibody 5345 (IGHV3-33)
ARGVLWFGELFDY

SEQ ID NO: 10691 - protein, 9 aa, Homo sapiens
  Light chain CDR3 for antibody 5346 (IGKV1-39)
QQSYSTPLT

SEQ ID NO: 10692 - protein, 14 aa, Homo sapiens
  Heavy chain CDR3 for antibody 5346 (IGHV3-20)
ARDRGSSFFDAFDI

SEQ ID NO: 10693 - protein, 9 aa, Homo sapiens
  Light chain CDR3 for antibody 5347 (IGKV1-39)
QQSYSTPLT

SEQ ID NO: 10694 - protein, 16 aa, Homo sapiens
  Heavy chain CDR3 for antibody 5347 (IGHV3-20)
ARDSSSLDYYYYGMDV

SEQ ID NO: 10695 - protein, 9 aa, Homo sapiens
  Light chain CDR3 for antibody 5348 (IGKV1D-13)
QQFNNYPYT

SEQ ID NO: 10696 - protein, 16 aa, Homo sapiens
  Heavy chain CDR3 for antibody 5348 (IGHV3-64)
ARGRYFDWLLGDWFDP

SEQ ID NO: 10697 - protein, 9 aa, Homo sapiens
  Light chain CDR3 for antibody 5349 (IGKV1-16)
QQYNSYPLT

SEQ ID NO: 10698 - protein, 19 aa, Homo sapiens
  Heavy chain CDR3 for antibody 5349 (IGHV3-33)
ARRKNYYGSGSWHYYGMDV

SEQ ID NO: 10699 - protein, 8 aa, Homo sapiens
  Light chain CDR3 for antibody 5350 (IGKV3-20)
QQYGRSFT

SEQ ID NO: 10700 - protein, 16 aa, Homo sapiens
  Heavy chain CDR3 for antibody 5350 (IGHV4-59)
ARGRYFDWLLGDVFDI

SEQ ID NO: 10701 - protein, 9 aa, Homo sapiens
  Light chain CDR3 for antibody 5351 (IGKV5-2)
LQHDNFPYT

SEQ ID NO: 10702 - protein, 17 aa, Homo sapiens
  Heavy chain CDR3 for antibody 5351 (IGHV3-23)
ANGGFGESHYNYYGMDV

SEQ ID NO: 10703 - protein, 9 aa, Homo sapiens
  Light chain CDR3 for antibody 5352 (IGKV1-39)
QQSYSTPLT

SEQ ID NO: 10704 - protein, 15 aa, Homo sapiens
  Heavy chain CDR3 for antibody 5352 (IGHV3-66)
ARDRDYYYYYYGMDV

SEQ ID NO: 10705 - protein, 10 aa, Homo sapiens
  Light chain CDR3 for antibody 5353 (IGKV3-11)
QQRSNWLMYT

SEQ ID NO: 10706 - protein, 13 aa, Homo sapiens
  Heavy chain CDR3 for antibody 5353 (IGHV4-59)
ARDAGYSSSWFDY

SEQ ID NO: 10707 - protein, 9 aa, Homo sapiens
  Light chain CDR3 for antibody 5354 (IGKV3D-7)
QQDYELPLT

SEQ ID NO: 10708 - protein, 16 aa, Homo sapiens
  Heavy chain CDR3 for antibody 5354 (IGHV4-59)
ARDTPYYSGSGRPFDH

SEQ ID NO: 10709 - protein, 8 aa, Homo sapiens
  Light chain CDR3 for antibody 5355 (IGKV3D-7)
QQDYNLLT

SEQ ID NO: 10710 - protein, 17 aa, Homo sapiens
  Heavy chain CDR3 for antibody 5355 (IGHV3-33)
ARAYYDILTGYSYYFDY

SEQ ID NO: 10711 - protein, 9 aa, Homo sapiens
  Light chain CDR3 for antibody 5356 (IGKV1D-16)
QQYSSYPYT

SEQ ID NO: 10712 - protein, 18 aa, Homo sapiens
  Heavy chain CDR3 for antibody 5356 (IGHV3-33)
ARREGIVGTTTYYYGMDV

SEQ ID NO: 10713 - protein, 9 aa, Homo sapiens
  Light chain CDR3 for antibody 5357 (IGKV3D-7)
QQDYSFPLT

SEQ ID NO: 10714 - protein, 13 aa, Homo sapiens
  Heavy chain CDR3 for antibody 5357 (IGHV3-33)
ARGVLWFGELFDY

SEQ ID NO: 10715 - protein, 9 aa, Homo sapiens
  Light chain CDR3 for antibody 5358 (IGKV1-17)
LQHNSYPYT

SEQ ID NO: 10716 - protein, 13 aa, Homo sapiens
  Heavy chain CDR3 for antibody 5358 (IGHV3-33)
GRTDYYSYYGVDV

SEQ ID NO: 10717 - protein, 11 aa, Homo sapiens
  Light chain CDR3 for antibody 5359 (IGKV3-11)
QQRSNWPPTWT

SEQ ID NO: 10718 - protein, 15 aa, Homo sapiens
  Heavy chain CDR3 for antibody 5359 (IGHV1-18)
ARGYCSSTSCYYFDY

SEQ ID NO: 10719 - protein, 8 aa, Homo sapiens
  Light chain CDR3 for antibody 5360 (IGKV1-5)
QQYNSYWT

SEQ ID NO: 10720 - protein, 11 aa, Homo sapiens
  Heavy chain CDR3 for antibody 5360 (IGHV3-74)
ARDRGNWGFDY

SEQ ID NO: 10721 - protein, 9 aa, Homo sapiens
  Light chain CDR3 for antibody 5361 (IGKV6-21)
HQSSSLPYT

SEQ ID NO: 10722 - protein, 15 aa, Homo sapiens
  Heavy chain CDR3 for antibody 5361 (IGHV3-23)
AKDRSGSGSYNLFDY

SEQ ID NO: 10723 - protein, 9 aa, Homo sapiens
  Light chain CDR3 for antibody 5362 (IGKV1-6)
LQDFHYPWT

SEQ ID NO: 10724 - protein, 22 aa, Homo sapiens
  Heavy chain CDR3 for antibody 5362 (IGHV3-11)
ARDEGVTMVRGVISYYYYGMDV

SEQ ID NO: 10725 - protein, 9 aa, Homo sapiens
  Light chain CDR3 for antibody 5363 (IGKV1D-13)
QQFNNYPHT

SEQ ID NO: 10726 - protein, 17 aa, Homo sapiens
  Heavy chain CDR3 for antibody 5363 (IGHV3-33)
ARGGGYENDHYYYGMDV

SEQ ID NO: 10727 - protein, 9 aa, Homo sapiens
  Light chain CDR3 for antibody 5364 (IGKV3D-7)
QQDYNLPFT

SEQ ID NO: 10728 - protein, 12 aa, Homo sapiens
  Heavy chain CDR3 for antibody 5364 (IGHV1-46)
ARGLTGDHAFDI

SEQ ID NO: 10729 - protein, 9 aa, Homo sapiens
  Light chain CDR3 for antibody 5365 (IGKV3-15)
QQYNNWPRT

SEQ ID NO: 10730 - protein, 14 aa, Homo sapiens
  Heavy chain CDR3 for antibody 5365 (IGHV3-23)
ANWAYDILTGYLDY

SEQ ID NO: 10731 - protein, 9 aa, Homo sapiens
  Light chain CDR3 for antibody 5366 (IGKV1-9)
QQLNTYPWT

SEQ ID NO: 10732 - protein, 14 aa, Homo sapiens
  Heavy chain CDR3 for antibody 5366 (IGHV3-33)
AREGYSSNWYDFDY

SEQ ID NO: 10733 - protein, 9 aa, Homo sapiens
  Light chain CDR3 for antibody 5367 (IGKV3-11)
QQRSNWPPT

SEQ ID NO: 10734 - protein, 16 aa, Homo sapiens
  Heavy chain CDR3 for antibody 5367 (IGHV3-33)
ARGYDMLTGDYHGMDV

SEQ ID NO: 10735 - protein, 9 aa, Homo sapiens
  Light chain CDR3 for antibody 5368 (IGKV1-9)
QQYNSYPLT

SEQ ID NO: 10736 - protein, 10 aa, Homo sapiens
  Heavy chain CDR3 for antibody 5368 (IGHV4-39)
ASSNWNDGPL

SEQ ID NO: 10737 - protein, 8 aa, Homo sapiens
  Light chain CDR3 for antibody 5369 (IGKV3D-7)
QQDYNLLT

SEQ ID NO: 10738 - protein, 13 aa, Homo sapiens
  Heavy chain CDR3 for antibody 5369 (IGHV4-39)
ARHEVMVRGVFDY

SEQ ID NO: 10739 - protein, 9 aa, Homo sapiens
  Light chain CDR3 for antibody 5370 (IGKV1-39)
QQSYRTPLT

SEQ ID NO: 10740 - protein, 20 aa, Homo sapiens
  Heavy chain CDR3 for antibody 5370 (IGHV3-33)
ARRMVRGVKKTYYYYYGLDV

SEQ ID NO: 10741 - protein, 8 aa, Homo sapiens
  Light chain CDR3 for antibody 5371 (IGKV1D-13)
QQFNNYPT

SEQ ID NO: 10742 - protein, 12 aa, Homo sapiens
  Heavy chain CDR3 for antibody 5371 (IGHV3-33)
ARDSSGWSHFDY

SEQ ID NO: 10743 - protein, 9 aa, Homo sapiens
  Light chain CDR3 for antibody 5372 (IGKV3-15)
QQYNNWPLT

SEQ ID NO: 10744 - protein, 12 aa, Homo sapiens
  Heavy chain CDR3 for antibody 5372 (IGHV3-66)
VREKDILTGSDY

SEQ ID NO: 10745 - protein, 9 aa, Homo sapiens
  Light chain CDR3 for antibody 5373 (IGKV1D-13)
QRFNNYLYT

SEQ ID NO: 10746 - protein, 12 aa, Homo sapiens
  Heavy chain CDR3 for antibody 5373 (IGHV3-33)
ARESGGSYSFDY

SEQ ID NO: 10747 - protein, 9 aa, Homo sapiens
  Light chain CDR3 for antibody 5374 (IGKV1-9)
QQLNSYPLT

SEQ ID NO: 10748 - protein, 19 aa, Homo sapiens
  Heavy chain CDR3 for antibody 5374 (IGHV4-39)
ARLDYDFLTDYYRPYFFAY

SEQ ID NO: 10749 - protein, 9 aa, Homo sapiens
  Light chain CDR3 for antibody 5375 (IGKV1-17)
LQRNSYPWT

SEQ ID NO: 10750 - protein, 15 aa, Homo sapiens
  Heavy chain CDR3 for antibody 5375 (IGHV3-33)
ARDGSSSWSPSWFDP

SEQ ID NO: 10751 - protein, 9 aa, Homo sapiens
  Light chain CDR3 for antibody 5376 (IGKV1-27)
QKYNSAPYT

SEQ ID NO: 10752 - protein, 17 aa, Homo sapiens
  Heavy chain CDR3 for antibody 5376 (IGHV3-33)
ARGDGDILTGYYEWFDP

SEQ ID NO: 10753 - protein, 9 aa, Homo sapiens
  Light chain CDR3 for antibody 5377 (IGKV3D-7)
QQDYNLPLT

SEQ ID NO: 10754 - protein, 19 aa, Homo sapiens
  Heavy chain CDR3 for antibody 5377 (IGHV3-33)
ARGPYYDILTGYGYYGMDV

SEQ ID NO: 10755 - protein, 9 aa, Homo sapiens
  Light chain CDR3 for antibody 5378 (IGKV3-15)
QQYNNWPYT

SEQ ID NO: 10756 - protein, 19 aa, Homo sapiens
  Heavy chain CDR3 for antibody 5378 (IGHV3-33)
ARGPYYDILTGYGYYGMDV

SEQ ID NO: 10757 - protein, 7 aa, Homo sapiens
  Light chain CDR3 for antibody 5379 (IGKV1-17)
LQHNSYP

SEQ ID NO: 10758 - protein, 12 aa, Homo sapiens
  Heavy chain CDR3 for antibody 5379 (IGHV1-18)
ARILFYGDYFDY

SEQ ID NO: 10759 - protein, 10 aa, Homo sapiens
  Light chain CDR3 for antibody 5380 (IGKV3-11)
QQRSNWPIFT

SEQ ID NO: 10760 - protein, 19 aa, Homo sapiens
  Heavy chain CDR3 for antibody 5380 (IGHV3-33)
ARGVRLRYFDPYYYYGMDV

SEQ ID NO: 10761 - protein, 10 aa, Homo sapiens
  Light chain CDR3 for antibody 5381 (IGKV1-39)
QQSYSTPMYT

SEQ ID NO: 10762 - protein, 11 aa, Homo sapiens
  Heavy chain CDR3 for antibody 5381 (IGHV4-59)
AREMGHDTFDI

SEQ ID NO: 10763 - protein, 9 aa, Homo sapiens
  Light chain CDR3 for antibody 5382 (IGKV1-9)
QQLISYPLT

SEQ ID NO: 10764 - protein, 9 aa, Homo sapiens
  Heavy chain CDR3 for antibody 5382 (IGHV3-33)
ARKRLYDIL

SEQ ID NO: 10765 - protein, 9 aa, Homo sapiens
  Light chain CDR3 for antibody 5383 (IGKV3-11)
QQRINWPWT

SEQ ID NO: 10766 - protein, 18 aa, Homo sapiens
  Heavy chain CDR3 for antibody 5383 (IGHV1-46)
ARDGDYVWGSYRSDWFDP

SEQ ID NO: 10767 - protein, 9 aa, Homo sapiens
  Light chain CDR3 for antibody 5384 (IGKV1-6)
LQDYKSPFT

SEQ ID NO: 10768 - protein, 20 aa, Homo sapiens
  Heavy chain CDR3 for antibody 5384 (IGHV3-20)
ARDLCSSTSCYGYYYYGMDV

SEQ ID NO: 10769 - protein, 9 aa, Homo sapiens
  Light chain CDR3 for antibody 5385 (IGKV1D-13)
QQFNNYPYT

SEQ ID NO: 10770 - protein, 14 aa, Homo sapiens
  Heavy chain CDR3 for antibody 5385 (IGHV3-33)
AREEDYYYHYDMDV

SEQ ID NO: 10771 - protein, 9 aa, Homo sapiens
  Light chain CDR3 for antibody 5386 (IGKV6-21)
HQSSSLPYT

SEQ ID NO: 10772 - protein, 20 aa, Homo sapiens
  Heavy chain CDR3 for antibody 5386 (IGHV3-23)
AKEGMVLRYFDWPHYYGMDV

SEQ ID NO: 10773 - protein, 8 aa, Homo sapiens
  Light chain CDR3 for antibody 5387 (IGKV1D-13)
QQFNNYPT

SEQ ID NO: 10774 - protein, 14 aa, Homo sapiens
  Heavy chain CDR3 for antibody 5387 (IGHV3-33)
ARDGYDFLTGPFDY

SEQ ID NO: 10775 - protein, 9 aa, Homo sapiens
  Light chain CDR3 for antibody 5388 (IGKV2-30)
MQGTHWPLT

SEQ ID NO: 10776 - protein, 18 aa, Homo sapiens
  Heavy chain CDR3 for antibody 5388 (IGHV3-33)
ARDRYYDILTGYYMGFDY

SEQ ID NO: 10777 - protein, 9 aa, Homo sapiens
  Light chain CDR3 for antibody 5389 (IGKV1-27)
QKYNSAPYT

SEQ ID NO: 10778 - protein, 17 aa, Homo sapiens
  Heavy chain CDR3 for antibody 5389 (IGHV3-33)
AREGYYYGSGSYHFFDY

SEQ ID NO: 10779 - protein, 10 aa, Homo sapiens
  Light chain CDR3 for antibody 5390 (IGKV3-11)
QQRSNWPALT

SEQ ID NO: 10780 - protein, 12 aa, Homo sapiens
  Heavy chain CDR3 for antibody 5390 (IGHV1-46)
AREDYDIDGMDV

SEQ ID NO: 10781 - protein, 9 aa, Homo sapiens
  Light chain CDR3 for antibody 5391 (IGKV1-9)
QQLISYPLT

SEQ ID NO: 10782 - protein, 13 aa, Homo sapiens
  Heavy chain CDR3 for antibody 5391 (IGHV3-33)
ARRATLVRGVFDP

SEQ ID NO: 10783 - protein, 9 aa, Homo sapiens
  Light chain CDR3 for antibody 5392 (IGKV1-5)
QQYNSYSYT

SEQ ID NO: 10784 - protein, 18 aa, Homo sapiens
  Heavy chain CDR3 for antibody 5392 (IGHV4-39)
ARQYYFGSGNYYRGWFDP

SEQ ID NO: 10785 - protein, 9 aa, Homo sapiens
  Light chain CDR3 for antibody 5393 (IGKV3D-7)
QQDYNLPLT

SEQ ID NO: 10786 - protein, 18 aa, Homo sapiens
  Heavy chain CDR3 for antibody 5393 (IGHV3-33)
ARERGYYGSDIYPAAFDI

SEQ ID NO: 10787 - protein, 9 aa, Homo sapiens
  Light chain CDR3 for antibody 5394 (IGKV3-15)
QQYNNWPLT

SEQ ID NO: 10788 - protein, 9 aa, Homo sapiens
  Heavy chain CDR3 for antibody 5394 (IGHV3-33)
ARATVGVDY

SEQ ID NO: 10789 - protein, 8 aa, Homo sapiens
  Light chain CDR3 for antibody 5395 (IGKV1D-13)
QQYNSYYT

SEQ ID NO: 10790 - protein, 7 aa, Homo sapiens
  Heavy chain CDR3 for antibody 5395 (IGHV1-46)
AREGGDY

SEQ ID NO: 10791 - protein, 9 aa, Homo sapiens
  Light chain CDR3 for antibody 5396 (IGKV1-27)
QKYNSAPYT

SEQ ID NO: 10792 - protein, 17 aa, Homo sapiens
  Heavy chain CDR3 for antibody 5396 (IGHV3-33)
AREDYDILTGYPFYFDY

SEQ ID NO: 10793 - protein, 9 aa, Homo sapiens
  Light chain CDR3 for antibody 5397 (IGKV1-39)
QQSYRTPLT

SEQ ID NO: 10794 - protein, 11 aa, Homo sapiens
  Heavy chain CDR3 for antibody 5397 (IGHV4-59)
ARSLRYSFFDY

SEQ ID NO: 10795 - protein, 10 aa, Homo sapiens
  Light chain CDR3 for antibody 5398 (IGKV1-39)
QQSYSTPMYT

SEQ ID NO: 10796 - protein, 14 aa, Homo sapiens
  Heavy chain CDR3 for antibody 5398 (IGHV3-23)
AKSRIVGALYYFDY

SEQ ID NO: 10797 - protein, 9 aa, Homo sapiens
  Light chain CDR3 for antibody 5399 (IGKV1-17)
LQHNSYPYT

SEQ ID NO: 10798 - protein, 13 aa, Homo sapiens
  Heavy chain CDR3 for antibody 5399 (IGHV3-33)
ARVHFDWLDAFDI

SEQ ID NO: 10799 - protein, 9 aa, Homo sapiens
  Light chain CDR3 for antibody 5400 (IGKV1-27)
QKYNSAPYT

SEQ ID NO: 10800 - protein, 16 aa, Homo sapiens
  Heavy chain CDR3 for antibody 5400 (IGHV3-33)
ARDQGILTGYYTALDY

SEQ ID NO: 10801 - protein, 8 aa, Homo sapiens
  Light chain CDR3 for antibody 5401 (IGKV6-21)
HQSSSLPT

SEQ ID NO: 10802 - protein, 14 aa, Homo sapiens
  Heavy chain CDR3 for antibody 5401 (IGHV3-33)
ARGAAAGNFYGLDV

SEQ ID NO: 10803 - protein, 9 aa, Homo sapiens
  Light chain CDR3 for antibody 5402 (IGKV1-27)
QKYNSAPYT

SEQ ID NO: 10804 - protein, 26 aa, Homo sapiens
  Heavy chain CDR3 for antibody 5402 (IGHV4-39)
ARQGLLWFGDLKAYDSSGYYYGYFHH

SEQ ID NO: 10805 - protein, 9 aa, Homo sapiens
  Light chain CDR3 for antibody 5403 (IGKV1D-13)
QRFNNYLYT

SEQ ID NO: 10806 - protein, 18 aa, Homo sapiens
  Heavy chain CDR3 for antibody 5403 (IGHV3-33)
ARGYYGSGNFYKDSGMDV

SEQ ID NO: 10807 - protein, 9 aa, Homo sapiens
  Light chain CDR3 for antibody 5404 (IGKV3-20)
QQYGSSPYT

SEQ ID NO: 10808 - protein, 13 aa, Homo sapiens
  Heavy chain CDR3 for antibody 5404 (IGHV3-11)
AREGIAVAGDFDH

SEQ ID NO: 10809 - protein, 9 aa, Homo sapiens
  Light chain CDR3 for antibody 5405 (IGKV1-33)
QQYDNLPFT

SEQ ID NO: 10810 - protein, 10 aa, Homo sapiens
  Heavy chain CDR3 for antibody 5405 (IGHV3-33)
ARENSTPLDY

SEQ ID NO: 10811 - protein, 8 aa, Homo sapiens
  Light chain CDR3 for antibody 5406 (IGKV3-11)
LQRGNWPT

SEQ ID NO: 10812 - protein, 13 aa, Homo sapiens
  Heavy chain CDR3 for antibody 5406 (IGHV3-11)
ARDGGAAAGTWDS

SEQ ID NO: 10813 - protein, 9 aa, Homo sapiens
  Light chain CDR3 for antibody 5407 (IGKV1-6)
LQDYKSPFT

SEQ ID NO: 10814 - protein, 13 aa, Homo sapiens
  Heavy chain CDR3 for antibody 5407 (IGHV3-33)
ARDQRYSSGWYDY

SEQ ID NO: 10815 - protein, 9 aa, Homo sapiens
  Light chain CDR3 for antibody 5408 (IGKV1-39)
QQSYSSPFT

SEQ ID NO: 10816 - protein, 17 aa, Homo sapiens
  Heavy chain CDR3 for antibody 5408 (IGHV1-18)
ARDEGYDILTGYPHFDY

SEQ ID NO: 10817 - protein, 10 aa, Homo sapiens
  Light chain CDR3 for antibody 5409 (IGKV3-11)
QQRSNWPIFT

SEQ ID NO: 10818 - protein, 11 aa, Homo sapiens
  Heavy chain CDR3 for antibody 5409 (IGHV3-23)
ARDPGSITGDY

SEQ ID NO: 10819 - protein, 9 aa, Homo sapiens
  Light chain CDR3 for antibody 5410 (IGKV1-17)
LQHNSYPYT

SEQ ID NO: 10820 - protein, 15 aa, Homo sapiens
  Heavy chain CDR3 for antibody 5410 (IGHV3-23)
AKDRSGSGSYNLLDY

SEQ ID NO: 10821 - protein, 8 aa, Homo sapiens
  Light chain CDR3 for antibody 5411 (IGKV1D-13)
QQFNNYPT

SEQ ID NO: 10822 - protein, 14 aa, Homo sapiens
  Heavy chain CDR3 for antibody 5411 (IGHV4-39)
ARQDYDILTGLFDY

SEQ ID NO: 10823 - protein, 9 aa, Homo sapiens
  Light chain CDR3 for antibody 5412 (IGKV3-11)
QQRSNWMYT

SEQ ID NO: 10824 - protein, 17 aa, Homo sapiens
  Heavy chain CDR3 for antibody 5412 (IGHV1-18)
ARERYYGSGNYKYNMDV

SEQ ID NO: 10825 - protein, 9 aa, Homo sapiens
  Light chain CDR3 for antibody 5413 (IGKV1D-13)
QQFNNYPHT

SEQ ID NO: 10826 - protein, 19 aa, Homo sapiens
  Heavy chain CDR3 for antibody 5413 (IGHV3-33)
ARRRDDILTGWDYYFGMDV

SEQ ID NO: 10827 - protein, 9 aa, Homo sapiens
  Light chain CDR3 for antibody 5414 (IGKV1-33)
QQYDNLPFT

SEQ ID NO: 10828 - protein, 13 aa, Homo sapiens
  Heavy chain CDR3 for antibody 5414 (IGHV3-23)
ARAFFMVRGVIDF

SEQ ID NO: 10829 - protein, 9 aa, Homo sapiens
  Light chain CDR3 for antibody 5415 (IGKV5-2)
LQHDNFPWT

SEQ ID NO: 10830 - protein, 13 aa, Homo sapiens
  Heavy chain CDR3 for antibody 5415 (IGHV3-33)
ARVDYYNYYGLDV

SEQ ID NO: 10831 - protein, 8 aa, Homo sapiens
  Light chain CDR3 for antibody 5416 (IGKV3-11)
QQRSNWLT

SEQ ID NO: 10832 - protein, 16 aa, Homo sapiens
  Heavy chain CDR3 for antibody 5416 (IGHV1-8)
AREGTMVRGVTYAFDI

SEQ ID NO: 10833 - protein, 9 aa, Homo sapiens
  Light chain CDR3 for antibody 5417 (IGKV1-17)
LQHNSYPYT

SEQ ID NO: 10834 - protein, 19 aa, Homo sapiens
  Heavy chain CDR3 for antibody 5417 (IGHV3-33)
ARGSDYDILTGYSSDAFDI

SEQ ID NO: 10835 - protein, 8 aa, Homo sapiens
  Light chain CDR3 for antibody 5418 (IGKV1-5)
QQYNSYYT

SEQ ID NO: 10836 - protein, 9 aa, Homo sapiens
  Heavy chain CDR3 for antibody 5418 (IGHV4-59)
AREGGSGSL

SEQ ID NO: 10837 - protein, 8 aa, Homo sapiens
  Light chain CDR3 for antibody 5419 (IGKV3D-7)
QQDYNLLT

SEQ ID NO: 10838 - protein, 15 aa, Homo sapiens
  Heavy chain CDR3 for antibody 5419 (IGHV3-30)
ARRGYGSGSPDAFDL

SEQ ID NO: 10839 - protein, 10 aa, Homo sapiens
  Light chain CDR3 for antibody 5420 (IGKV1-17)
LQHNSYPMYT

SEQ ID NO: 10840 - protein, 17 aa, Homo sapiens
  Heavy chain CDR3 for antibody 5420 (IGHV3-33)
ARGEQWLGYYYYYGMDV

SEQ ID NO: 10841 - protein, 9 aa, Homo sapiens
  Light chain CDR3 for antibody 5421 (IGKV1-16)
QQYNSYPLT

SEQ ID NO: 10842 - protein, 14 aa, Homo sapiens
  Heavy chain CDR3 for antibody 5421 (IGHV3-23)
AKCDYDILTGILDY

SEQ ID NO: 10843 - protein, 10 aa, Homo sapiens
  Light chain CDR3 for antibody 5422 (IGKV1-9)
QQLDSYPMYT

SEQ ID NO: 10844 - protein, 13 aa, Homo sapiens
  Heavy chain CDR3 for antibody 5422 (IGHV3-23)
ASPFNWNDGFFDY

SEQ ID NO: 10845 - protein, 9 aa, Homo sapiens
  Light chain CDR3 for antibody 5423 (IGKV1D-13)
QQFNNYPYT

SEQ ID NO: 10846 - protein, 14 aa, Homo sapiens
  Heavy chain CDR3 for antibody 5423 (IGHV3-33)
ARGLEWGGDNWFDP

SEQ ID NO: 10847 - protein, 9 aa, Homo sapiens
  Light chain CDR3 for antibody 5424 (IGKV1-9)
QQLKSYLYT

SEQ ID NO: 10848 - protein, 18 aa, Homo sapiens
  Heavy chain CDR3 for antibody 5424 (IGHV4-59)
AREGHYYTSGSYYKAFDY

SEQ ID NO: 10849 - protein, 9 aa, Homo sapiens
  Light chain CDR3 for antibody 5425 (IGKV1D-13)
QQFNNYPHT

SEQ ID NO: 10850 - protein, 15 aa, Homo sapiens
  Heavy chain CDR3 for antibody 5425 (IGHV4-39)
ARHSGYSSGWYPFDY

SEQ ID NO: 10851 - protein, 9 aa, Homo sapiens
  Light chain CDR3 for antibody 5426 (IGKV1-16)
QQYNSYPYT

SEQ ID NO: 10852 - protein, 11 aa, Homo sapiens
  Heavy chain CDR3 for antibody 5426 (IGHV4-59)
VRERGYYGMDV

SEQ ID NO: 10853 - protein, 8 aa, Homo sapiens
  Light chain CDR3 for antibody 5427 (IGKV1D-13)
QQFNNYPT

SEQ ID NO: 10854 - protein, 17 aa, Homo sapiens
  Heavy chain CDR3 for antibody 5427 (IGHV1-18)
ARERYYGSGIYKYAMDV

SEQ ID NO: 10855 - protein, 9 aa, Homo sapiens
  Light chain CDR3 for antibody 5428 (IGKV1-17)
LQHNSYPYT

SEQ ID NO: 10856 - protein, 11 aa, Homo sapiens
  Heavy chain CDR3 for antibody 5428 (IGHV4-59)
ARDGSWEPFDY

SEQ ID NO: 10857 - protein, 9 aa, Homo sapiens
  Light chain CDR3 for antibody 5429 (IGKV1-9)
QQLISYPLT

SEQ ID NO: 10858 - protein, 11 aa, Homo sapiens
  Heavy chain CDR3 for antibody 5429 (IGHV3-33)
AREGAVARFDY

SEQ ID NO: 10859 - protein, 10 aa, Homo sapiens
  Light chain CDR3 for antibody 5430 (IGKV1-39)
QQSYSTPMYT

SEQ ID NO: 10860 - protein, 18 aa, Homo sapiens
  Heavy chain CDR3 for antibody 5430 (IGHV3-33)
ARGYYGSGNFYKDSGMDV

SEQ ID NO: 10861 - protein, 9 aa, Homo sapiens
  Light chain CDR3 for antibody 5431 (IGKV3D-7)
QQDYNLPLT

SEQ ID NO: 10862 - protein, 16 aa, Homo sapiens
  Heavy chain CDR3 for antibody 5431 (IGHV1-24)
ATEDSSSYYYYYGMDV

SEQ ID NO: 10863 - protein, 9 aa, Homo sapiens
  Light chain CDR3 for antibody 5432 (IGKV5-2)
LQHDNFPWT

SEQ ID NO: 10864 - protein, 9 aa, Homo sapiens
  Heavy chain CDR3 for antibody 5432 (IGHV4-59)
ARGRSNFRI

SEQ ID NO: 10865 - protein, 9 aa, Homo sapiens
  Light chain CDR3 for antibody 5433 (IGKV1-9)
QQLNSYPLT

SEQ ID NO: 10866 - protein, 11 aa, Homo sapiens
  Heavy chain CDR3 for antibody 5433 (IGHV3-33)
ARDRSTGWLDY

SEQ ID NO: 10867 - protein, 9 aa, Homo sapiens
  Light chain CDR3 for antibody 5434 (IGKV1-6)
LQDYNYPYT

SEQ ID NO: 10868 - protein, 12 aa, Homo sapiens
  Heavy chain CDR3 for antibody 5434 (IGHV1-18)
AGVLFDGDYSDY

SEQ ID NO: 10869 - protein, 8 aa, Homo sapiens
  Light chain CDR3 for antibody 5435 (IGKV1-5)
QQYNSYYT

SEQ ID NO: 10870 - protein, 17 aa, Homo sapiens
  Heavy chain CDR3 for antibody 5435 (IGHV3-23)
AKDGSFYSSGWYDAFDI

SEQ ID NO: 10871 - protein, 9 aa, Homo sapiens
  Light chain CDR3 for antibody 5436 (IGKV3-20)
QQYGSSPRT

SEQ ID NO: 10872 - protein, 14 aa, Homo sapiens
  Heavy chain CDR3 for antibody 5436 (IGHV1-18)
AREGGSYFYYGVDV

SEQ ID NO: 10873 - protein, 9 aa, Homo sapiens
  Light chain CDR3 for antibody 5437 (IGKV3-20)
QQYGSSPYT

SEQ ID NO: 10874 - protein, 17 aa, Homo sapiens
  Heavy chain CDR3 for antibody 5437 (IGHV3-23)
AKERNWNDGYYYYGMDV

SEQ ID NO: 10875 - protein, 9 aa, Homo sapiens
  Light chain CDR3 for antibody 5438 (IGKV1-16)
QHYNDYPFT

SEQ ID NO: 10876 - protein, 7 aa, Homo sapiens
  Heavy chain CDR3 for antibody 5438 (IGHV3-33)
ARELVDY

SEQ ID NO: 10877 - protein, 9 aa, Homo sapiens
  Light chain CDR3 for antibody 5439 (IGKV3D-20)
QQYGSSPYT

SEQ ID NO: 10878 - protein, 18 aa, Homo sapiens
  Heavy chain CDR3 for antibody 5439 (IGHV3-11)
ARDGYFSGWNYYYFGMDV

SEQ ID NO: 10879 - protein, 9 aa, Homo sapiens
  Light chain CDR3 for antibody 5440 (IGKV3-20)
QQYGSSPYT

SEQ ID NO: 10880 - protein, 11 aa, Homo sapiens
  Heavy chain CDR3 for antibody 5440 (IGHV3-33)
ARDRATAGLDY

SEQ ID NO: 10881 - protein, 9 aa, Homo sapiens
  Light chain CDR3 for antibody 5441 (IGKV1-9)
QQLNGYPFT

SEQ ID NO: 10882 - protein, 18 aa, Homo sapiens
  Heavy chain CDR3 for antibody 5441 (IGHV1-46)
ARDGDYVWGSYRSDWFDP

SEQ ID NO: 10883 - protein, 9 aa, Homo sapiens
  Light chain CDR3 for antibody 5442 (IGKV3-15)
QQYNNWPLT

SEQ ID NO: 10884 - protein, 21 aa, Homo sapiens
  Heavy chain CDR3 for antibody 5442 (IGHV4-59)
AAGVLLWFGEPNYYYYYGMDV

SEQ ID NO: 10885 - protein, 9 aa, Homo sapiens
  Light chain CDR3 for antibody 5443 (IGKV3D-7)
QQDYEFPLT

SEQ ID NO: 10886 - protein, 17 aa, Homo sapiens
  Heavy chain CDR3 for antibody 5443 (IGHV1-24)
ATEGYDILPGYYNVLDY

SEQ ID NO: 10887 - protein, 9 aa, Homo sapiens
  Light chain CDR3 for antibody 5444 (IGKV1-17)
LQHNGYPLT

SEQ ID NO: 10888 - protein, 12 aa, Homo sapiens
  Heavy chain CDR3 for antibody 5444 (IGHV3-33)
ARVDAAAPYFDY

SEQ ID NO: 10889 - protein, 9 aa, Homo sapiens
  Light chain CDR3 for antibody 5445 (IGKV1-9)
QQLISYPLT

SEQ ID NO: 10890 - protein, 9 aa, Homo sapiens
  Heavy chain CDR3 for antibody 5445 (IGHV3-33)
ARELAYFDY

SEQ ID NO: 10891 - protein, 9 aa, Homo sapiens
  Light chain CDR3 for antibody 5446 (IGKV1-27)
QKYNSAPYT

SEQ ID NO: 10892 - protein, 17 aa, Homo sapiens
  Heavy chain CDR3 for antibody 5446 (IGHV3-33)
ARDSYDILTGYYKPFDY

SEQ ID NO: 10893 - protein, 9 aa, Homo sapiens
  Light chain CDR3 for antibody 5447 (IGKV2-30)
MQGTHWPLT

SEQ ID NO: 10894 - protein, 12 aa, Homo sapiens
  Heavy chain CDR3 for antibody 5447 (IGHV3-33)
AREGTRWVYFDY

SEQ ID NO: 10895 - protein, 9 aa, Homo sapiens
  Light chain CDR3 for antibody 5448 (IGKV1-39)
QQSYSTPLT

SEQ ID NO: 10896 - protein, 17 aa, Homo sapiens
  Heavy chain CDR3 for antibody 5448 (IGHV3-23)
AKDRPVTTLYYYFGMDV

SEQ ID NO: 10897 - protein, 10 aa, Homo sapiens
  Light chain CDR3 for antibody 5449 (IGKV1-17)
LQHNSYPMYT

SEQ ID NO: 10898 - protein, 21 aa, Homo sapiens
  Heavy chain CDR3 for antibody 5449 (IGHV3-23)
AKDIDYYGSGSYPLYYYGMDV

SEQ ID NO: 10899 - protein, 9 aa, Homo sapiens
  Light chain CDR3 for antibody 5450 (IGKV2-30)
MQGTHWPLT

SEQ ID NO: 10900 - protein, 17 aa, Homo sapiens
  Heavy chain CDR3 for antibody 5450 (IGHV3-23)
AKDGIGELSYYYYGMDV

SEQ ID NO: 10901 - protein, 8 aa, Homo sapiens
  Light chain CDR3 for antibody 5451 (IGKV1D-13)
QQFNNYPT

SEQ ID NO: 10902 - protein, 14 aa, Homo sapiens
  Heavy chain CDR3 for antibody 5451 (IGHV3-33)
ARDKSYPLSYGMDV

SEQ ID NO: 10903 - protein, 9 aa, Homo sapiens
  Light chain CDR3 for antibody 5452 (IGKV3-11)
QQRSNWPRT

SEQ ID NO: 10904 - protein, 12 aa, Homo sapiens
  Heavy chain CDR3 for antibody 5452 (IGHV1-18)
ARVLFDGDYFDY

SEQ ID NO: 10905 - protein, 9 aa, Homo sapiens
  Light chain CDR3 for antibody 5453 (IGKV1D-16)
QQYNSYPLT

SEQ ID NO: 10906 - protein, 12 aa, Homo sapiens
  Heavy chain CDR3 for antibody 5453 (IGHV3-33)
ARNYDILDYFDY

SEQ ID NO: 10907 - protein, 9 aa, Homo sapiens
  Light chain CDR3 for antibody 5454 (IGKV3D-20)
QQYGSSPYT

SEQ ID NO: 10908 - protein, 9 aa, Homo sapiens
  Heavy chain CDR3 for antibody 5454 (IGHV4-34)
ARDLYYFDY

SEQ ID NO: 10909 - protein, 8 aa, Homo sapiens
  Light chain CDR3 for antibody 5455 (IGKV3-20)
QQYGSSLT

SEQ ID NO: 10910 - protein, 14 aa, Homo sapiens
  Heavy chain CDR3 for antibody 5455 (IGHV3-23)
AKSRIVGALYYFDY

SEQ ID NO: 10911 - protein, 10 aa, Homo sapiens
  Light chain CDR3 for antibody 5456 (IGKV1-17)
LQHNSYPMYT

SEQ ID NO: 10912 - protein, 13 aa, Homo sapiens
  Heavy chain CDR3 for antibody 5456 (IGHV3-33)
ARRYRSGWYPFDY

SEQ ID NO: 10913 - protein, 9 aa, Homo sapiens
  Light chain CDR3 for antibody 5457 (IGKV2D-28)
MQVLQTPFT

SEQ ID NO: 10914 - protein, 14 aa, Homo sapiens
  Heavy chain CDR3 for antibody 5457 (IGHV4-39)
ARQDYDILTGLFDY

SEQ ID NO: 10915 - protein, 10 aa, Homo sapiens
  Light chain CDR3 for antibody 5458 (IGKV1-17)
LQHNSYPMYT

SEQ ID NO: 10916 - protein, 14 aa, Homo sapiens
  Heavy chain CDR3 for antibody 5458 (IGHV3-33)
AREGYSSNWYDFDY

SEQ ID NO: 10917 - protein, 9 aa, Homo sapiens
  Light chain CDR3 for antibody 5459 (IGKV1-6)
LQDYNYPWT

SEQ ID NO: 10918 - protein, 11 aa, Homo sapiens
  Heavy chain CDR3 for antibody 5459 (IGHV3-33)
ARDRATAGLDY

SEQ ID NO: 10919 - protein, 8 aa, Homo sapiens
  Light chain CDR3 for antibody 5460 (IGKV3D-7)
QQDYNLLT

SEQ ID NO: 10920 - protein, 18 aa, Homo sapiens
  Heavy chain CDR3 for antibody 5460 (IGHV1-46)
ARDLTGRTENYYYYGMDV

SEQ ID NO: 10921 - protein, 9 aa, Homo sapiens
  Light chain CDR3 for antibody 5461 (IGKV2-30)
MQGTHWPLT

SEQ ID NO: 10922 - protein, 20 aa, Homo sapiens
  Heavy chain CDR3 for antibody 5461 (IGHV3-23)
AKGMGGLRYFDWPHYYGMDV

SEQ ID NO: 10923 - protein, 9 aa, Homo sapiens
  Light chain CDR3 for antibody 5462 (IGKV3-20)
QQYGSSPRT

SEQ ID NO: 10924 - protein, 14 aa, Homo sapiens
  Heavy chain CDR3 for antibody 5462 (IGHV3-20)
ARDRGSSGHDAFDI

SEQ ID NO: 10925 - protein, 9 aa, Homo sapiens
  Light chain CDR3 for antibody 5463 (IGKV1-16)
QHYNDYPFT

SEQ ID NO: 10926 - protein, 13 aa, Homo sapiens
  Heavy chain CDR3 for antibody 5463 (IGHV4-59)
ARDAGYSSSWFDY

SEQ ID NO: 10927 - protein, 8 aa, Homo sapiens
  Light chain CDR3 for antibody 5464 (IGKV3-15)
QQYNNWPT

SEQ ID NO: 10928 - protein, 12 aa, Homo sapiens
  Heavy chain CDR3 for antibody 5464 (IGHV4-61)
ARVYSSGWLFDY

SEQ ID NO: 10929 - protein, 9 aa, Homo sapiens
  Light chain CDR3 for antibody 5465 (IGKV6-21)
HQSSSLPYT

SEQ ID NO: 10930 - protein, 18 aa, Homo sapiens
  Heavy chain CDR3 for antibody 5465 (IGHV3-23)
AKDGDYFGSGSYWGYFDL

SEQ ID NO: 10931 - protein, 9 aa, Homo sapiens
  Light chain CDR3 for antibody 5466 (IGKV3D-7)
QQDYNLPFT

SEQ ID NO: 10932 - protein, 15 aa, Homo sapiens
  Heavy chain CDR3 for antibody 5466 (IGHV3-33)
ARDRRGIAAAGTGDY

SEQ ID NO: 10933 - protein, 9 aa, Homo sapiens
  Light chain CDR3 for antibody 5467 (IGKV3D-7)
QQDYNLPLT

SEQ ID NO: 10934 - protein, 11 aa, Homo sapiens
  Heavy chain CDR3 for antibody 5467 (IGHV3-33)
ARDRATATVDY

SEQ ID NO: 10935 - protein, 9 aa, Homo sapiens
  Light chain CDR3 for antibody 5468 (IGKV2-30)
MQGTHWPLT

SEQ ID NO: 10936 - protein, 17 aa, Homo sapiens
  Heavy chain CDR3 for antibody 5468 (IGHV3-23)
AKDYDILTGYSHNWFDP

SEQ ID NO: 10937 - protein, 9 aa, Homo sapiens
  Light chain CDR3 for antibody 5469 (IGKV1-6)
LQVYSYPWT

SEQ ID NO: 10938 - protein, 14 aa, Homo sapiens
  Heavy chain CDR3 for antibody 5469 (IGHV3-33)
ARGAAAGNFYGLDV

SEQ ID NO: 10939 - protein, 9 aa, Homo sapiens
  Light chain CDR3 for antibody 5470 (IGKV1-16)
QHYNDYPFT

SEQ ID NO: 10940 - protein, 13 aa, Homo sapiens
  Heavy chain CDR3 for antibody 5470 (IGHV3-53)
ARSGSYWGYYFDY

SEQ ID NO: 10941 - protein, 9 aa, Homo sapiens
  Light chain CDR3 for antibody 5471 (IGKV3D-7)
QQDYNLPWT

SEQ ID NO: 10942 - protein, 18 aa, Homo sapiens
  Heavy chain CDR3 for antibody 5471 (IGHV1-18)
ARDPNYYGSGSYYNYFDY

SEQ ID NO: 10943 - protein, 10 aa, Homo sapiens
  Light chain CDR3 for antibody 5472 (IGKV1-17)
LQHNSYPMYT

SEQ ID NO: 10944 - protein, 17 aa, Homo sapiens
  Heavy chain CDR3 for antibody 5472 (IGHV1-18)
ARDRAFTMVRGVPPFDY

SEQ ID NO: 10945 - protein, 8 aa, Homo sapiens
  Light chain CDR3 for antibody 5473 (IGKV3D-7)
QQDYNLLT

SEQ ID NO: 10946 - protein, 12 aa, Homo sapiens
  Heavy chain CDR3 for antibody 5473 (IGHV3-33)
ASRDILTGYLGY

SEQ ID NO: 10947 - protein, 9 aa, Homo sapiens
  Light chain CDR3 for antibody 5474 (IGKV1D-13)
QQFNNYPHT

SEQ ID NO: 10948 - protein, 13 aa, Homo sapiens
  Heavy chain CDR3 for antibody 5474 (IGHV3-33)
ARALYSSSWPGDY

SEQ ID NO: 10949 - protein, 9 aa, Homo sapiens
  Light chain CDR3 for antibody 5475 (IGKV1D-16)
QQFNNYPRT

SEQ ID NO: 10950 - protein, 10 aa, Homo sapiens
  Heavy chain CDR3 for antibody 5475 (IGHV1-18)
AREQRLGFDY

SEQ ID NO: 10951 - protein, 8 aa, Homo sapiens
  Light chain CDR3 for antibody 5476 (IGKV6-21)
HQSSSLPT

SEQ ID NO: 10952 - protein, 13 aa, Homo sapiens
  Heavy chain CDR3 for antibody 5476 (IGHV3-53)
ARSGSYWGYYFDY

SEQ ID NO: 10953 - protein, 9 aa, Homo sapiens
  Light chain CDR3 for antibody 5477 (IGKV1-6)
QQFNNYPYT

SEQ ID NO: 10954 - protein, 18 aa, Homo sapiens
  Heavy chain CDR3 for antibody 5477 (IGHV4-59)
ARERGNWNDVDYYYGMDV

SEQ ID NO: 10955 - protein, 9 aa, Homo sapiens
  Light chain CDR3 for antibody 5478 (IGKV1-16)
QHYNDYPFT

SEQ ID NO: 10956 - protein, 17 aa, Homo sapiens
  Heavy chain CDR3 for antibody 5478 (IGHV3-33)
ARGFSGYDGYYYYGMDV

SEQ ID NO: 10957 - protein, 9 aa, Homo sapiens
  Light chain CDR3 for antibody 5479 (IGKV1-39)
QQSYSTPLT

SEQ ID NO: 10958 - protein, 13 aa, Homo sapiens
  Heavy chain CDR3 for antibody 5479 (IGHV1-24)
ATGYSINWYEFDY

SEQ ID NO: 10959 - protein, 9 aa, Homo sapiens
  Light chain CDR3 for antibody 5480 (IGKV3-20)
QQYGSSPYT

SEQ ID NO: 10960 - protein, 16 aa, Homo sapiens
  Heavy chain CDR3 for antibody 5480 (IGHV4-39)
ARHPLIWTGYPNWFDP

SEQ ID NO: 10961 - protein, 9 aa, Homo sapiens
  Light chain CDR3 for antibody 5481 (IGKV3-20)
QQFGRSPRT

SEQ ID NO: 10962 - protein, 12 aa, Homo sapiens
  Heavy chain CDR3 for antibody 5481 (IGHV1-46)
ARGLTGDHAVDI

SEQ ID NO: 10963 - protein, 8 aa, Homo sapiens
  Light chain CDR3 for antibody 5482 (IGKV1-5)
QQYNSYYT

SEQ ID NO: 10964 - protein, 11 aa, Homo sapiens
  Heavy chain CDR3 for antibody 5482 (IGHV3-13)
AREAIIGPFDY

SEQ ID NO: 10965 - protein, 9 aa, Homo sapiens
  Light chain CDR3 for antibody 5483 (IGKV3D-7)
QQDYNLPLT

SEQ ID NO: 10966 - protein, 19 aa, Homo sapiens
  Heavy chain CDR3 for antibody 5483 (IGHV3-33)
TRDPHYDILTGYAYYGMDV

SEQ ID NO: 10967 - protein, 10 aa, Homo sapiens
  Light chain CDR3 for antibody 5484 (IGKV1-17)
LQHNSYPMYT

SEQ ID NO: 10968 - protein, 10 aa, Homo sapiens
  Heavy chain CDR3 for antibody 5484 (IGHV3-33)
ARDGSGSQPI

SEQ ID NO: 10969 - protein, 9 aa, Homo sapiens
  Light chain CDR3 for antibody 5485 (IGKV1-33)
QQYDNLPFT

SEQ ID NO: 10970 - protein, 13 aa, Homo sapiens
  Heavy chain CDR3 for antibody 5485 (IGHV3-33)
ANTGDSYYYDMDV

SEQ ID NO: 10971 - protein, 9 aa, Homo sapiens
  Light chain CDR3 for antibody 5486 (IGKV1D-13)
QQFNNYPYT

SEQ ID NO: 10972 - protein, 17 aa, Homo sapiens
  Heavy chain CDR3 for antibody 5486 (IGHV3-33)
AREGYYYGSGSYHFFDY

SEQ ID NO: 10973 - protein, 9 aa, Homo sapiens
  Light chain CDR3 for antibody 5487 (IGKV1-39)
QQSYSTPLT

SEQ ID NO: 10974 - protein, 17 aa, Homo sapiens
  Heavy chain CDR3 for antibody 5487 (IGHV3-23)
AKDYDILTGYSHNWFDP

SEQ ID NO: 10975 - protein, 9 aa, Homo sapiens
  Light chain CDR3 for antibody 5488 (IGKV1-16)
QQYNSYPYT

SEQ ID NO: 10976 - protein, 16 aa, Homo sapiens
  Heavy chain CDR3 for antibody 5488 (IGHV1-24)
ATDGYYYGSGSYLFDY

SEQ ID NO: 10977 - protein, 9 aa, Homo sapiens
  Light chain CDR3 for antibody 5489 (IGKV3-15)
QQYNNWPRT

SEQ ID NO: 10978 - protein, 17 aa, Homo sapiens
  Heavy chain CDR3 for antibody 5489 (IGHV3-33)
VREGGLLWVGELSLFDY

SEQ ID NO: 10979 - protein, 10 aa, Homo sapiens
  Light chain CDR3 for antibody 5490 (IGKV3-11)
QQRSNWPALT

SEQ ID NO: 10980 - protein, 11 aa, Homo sapiens
  Heavy chain CDR3 for antibody 5490 (IGHV3-23)
AKKVYDYGSDY

SEQ ID NO: 10981 - protein, 10 aa, Homo sapiens
  Light chain CDR3 for antibody 5491 (IGKV1-39)
QQSYSTPMYT

SEQ ID NO: 10982 - protein, 15 aa, Homo sapiens
  Heavy chain CDR3 for antibody 5491 (IGHV4-59)
ARDLGHYYGSVSIDY

SEQ ID NO: 10983 - protein, 9 aa, Homo sapiens
  Light chain CDR3 for antibody 5492 (IGKV3-15)
QQYNNWPYT

SEQ ID NO: 10984 - protein, 13 aa, Homo sapiens
  Heavy chain CDR3 for antibody 5492 (IGHV3-33)
ARQSSGWFDAFDI

SEQ ID NO: 10985 - protein, 8 aa, Homo sapiens
  Light chain CDR3 for antibody 5493 (IGKV6-21)
HQSSSLPT

SEQ ID NO: 10986 - protein, 17 aa, Homo sapiens
  Heavy chain CDR3 for antibody 5493 (IGHV1-18)
ARDRAFTMVRGVPPFDY

SEQ ID NO: 10987 - protein, 9 aa, Homo sapiens
  Light chain CDR3 for antibody 5494 (IGKV1D-16)
QQYNSYPLT

SEQ ID NO: 10988 - protein, 11 aa, Homo sapiens
  Heavy chain CDR3 for antibody 5494 (IGHV3-33)
ASWDILTGSGY

SEQ ID NO: 10989 - protein, 10 aa, Homo sapiens
  Light chain CDR3 for antibody 5495 (IGKV3-11)
QQRSNWPMYT

SEQ ID NO: 10990 - protein, 14 aa, Homo sapiens
  Heavy chain CDR3 for antibody 5495 (IGHV3-20)
ARDGGSTCYDWFDP

SEQ ID NO: 10991 - protein, 9 aa, Homo sapiens
  Light chain CDR3 for antibody 5496 (IGKV1-9)
QQLKSYLYT

SEQ ID NO: 10992 - protein, 13 aa, Homo sapiens
  Heavy chain CDR3 for antibody 5496 (IGHV3-33)
ARDWGYSHGYFDY

SEQ ID NO: 10993 - protein, 10 aa, Homo sapiens
  Light chain CDR3 for antibody 5497 (IGKV1-9)
QQLDSYPMYT

SEQ ID NO: 10994 - protein, 15 aa, Homo sapiens
  Heavy chain CDR3 for antibody 5497 (IGHV3-20)
ARDRGSSGWRDWFDP

SEQ ID NO: 10995 - protein, 9 aa, Homo sapiens
  Light chain CDR3 for antibody 5498 (IGKV1-16)
QQYNSYPLT

SEQ ID NO: 10996 - protein, 17 aa, Homo sapiens
  Heavy chain CDR3 for antibody 5498 (IGHV3-23)
AREGWFGELWGYYGMDV

SEQ ID NO: 10997 - protein, 9 aa, Homo sapiens
  Light chain CDR3 for antibody 5499 (IGKV1-33)
QQYDNLPFT

SEQ ID NO: 10998 - protein, 17 aa, Homo sapiens
  Heavy chain CDR3 for antibody 5499 (IGHV3-33)
ARVYYDILTGYSPAFDI

SEQ ID NO: 10999 - protein, 9 aa, Homo sapiens
  Light chain CDR3 for antibody 5500 (IGKV3-20)
QQYGSSPYT

SEQ ID NO: 11000 - protein, 10 aa, Homo sapiens
  Heavy chain CDR3 for antibody 5500 (IGHV3-33)
ARDLRADFDY

SEQ ID NO: 11001 - protein, 9 aa, Homo sapiens
  Light chain CDR3 for antibody 5501 (IGKV1-6)
LQDYNYPFT

SEQ ID NO: 11002 - protein, 18 aa, Homo sapiens
  Heavy chain CDR3 for antibody 5501 (IGHV4-59)
AREGHYYTSGGYYKAFDY

SEQ ID NO: 11003 - protein, 9 aa, Homo sapiens
  Light chain CDR3 for antibody 5502 (IGKV1-17)
LQHNSYPWT

SEQ ID NO: 11004 - protein, 18 aa, Homo sapiens
  Heavy chain CDR3 for antibody 5502 (IGHV1-24)
ATGLRYFDWPIISNLFDY

SEQ ID NO: 11005 - protein, 9 aa, Homo sapiens
  Light chain CDR3 for antibody 5503 (IGKV1-27)
QKYNSAPYT

SEQ ID NO: 11006 - protein, 14 aa, Homo sapiens
  Heavy chain CDR3 for antibody 5503 (IGHV3-23)
AKDDIVRATGAFDI

SEQ ID NO: 11007 - protein, 9 aa, Homo sapiens
  Light chain CDR3 for antibody 5504 (IGKV1-27)
QKYNSAPYT

SEQ ID NO: 11008 - protein, 11 aa, Homo sapiens
  Heavy chain CDR3 for antibody 5504 (IGHV3-33)
ARDRSTGWLDY

SEQ ID NO: 11009 - protein, 9 aa, Homo sapiens
  Light chain CDR3 for antibody 5505 (IGKV2-30)
MQGTHWPLT

SEQ ID NO: 11010 - protein, 11 aa, Homo sapiens
  Heavy chain CDR3 for antibody 5505 (IGHV3-33)
ARDILTGFLDH

SEQ ID NO: 11011 - protein, 10 aa, Homo sapiens
  Light chain CDR3 for antibody 5506 (IGKV3-11)
QQRSNWPIWT

SEQ ID NO: 11012 - protein, 12 aa, Homo sapiens
  Heavy chain CDR3 for antibody 5506 (IGHV1-46)
ARGLTGDHAFDI

SEQ ID NO: 11013 - protein, 9 aa, Homo sapiens
  Light chain CDR3 for antibody 5507 (IGKV1-27)
QKYNSAPHT

SEQ ID NO: 11014 - protein, 17 aa, Homo sapiens
  Heavy chain CDR3 for antibody 5507 (IGHV3-33)
ARGEQWLGYYYYYGMDV

SEQ ID NO: 11015 - protein, 9 aa, Homo sapiens
  Light chain CDR3 for antibody 5508 (IGKV3-11)
QQRSNWMYT

SEQ ID NO: 11016 - protein, 17 aa, Homo sapiens
  Heavy chain CDR3 for antibody 5508 (IGHV3-33)
ARAYYDILTGYSYYFDY

SEQ ID NO: 11017 - protein, 9 aa, Homo sapiens
  Light chain CDR3 for antibody 5509 (IGKV1-17)
LQHNSYPYT

SEQ ID NO: 11018 - protein, 10 aa, Homo sapiens
  Heavy chain CDR3 for antibody 5509 (IGHV3-33)
ARENSTPLDY

SEQ ID NO: 11019 - protein, 9 aa, Homo sapiens
  Light chain CDR3 for antibody 5510 (IGKV3D-20)
QQYGYSPLT

SEQ ID NO: 11020 - protein, 18 aa, Homo sapiens
  Heavy chain CDR3 for antibody 5510 (IGHV3-23)
AKPDYYGSGSYYNVPFDY

SEQ ID NO: 11021 - protein, 9 aa, Homo sapiens
  Light chain CDR3 for antibody 5511 (IGKV3D-7)
QQDSNLPYT

SEQ ID NO: 11022 - protein, 11 aa, Homo sapiens
  Heavy chain CDR3 for antibody 5511 (IGHV4-59)
ARSLRYSFFDY

SEQ ID NO: 11023 - protein, 10 aa, Homo sapiens
  Light chain CDR3 for antibody 5512 (IGKV1-39)
QQSYSTPMYT

SEQ ID NO: 11024 - protein, 11 aa, Homo sapiens
  Heavy chain CDR3 for antibody 5512 (IGHV3-33)
ARAGIAALFDY

SEQ ID NO: 11025 - protein, 9 aa, Homo sapiens
  Light chain CDR3 for antibody 5513 (IGKV3-15)
QQYNNWPLT

SEQ ID NO: 11026 - protein, 15 aa, Homo sapiens
  Heavy chain CDR3 for antibody 5513 (IGHV4-39)
ARGYYYGSGSFPVDY

SEQ ID NO: 11027 - protein, 9 aa, Homo sapiens
  Light chain CDR3 for antibody 5514 (IGKV1-9)
QQLNSYPRT

SEQ ID NO: 11028 - protein, 11 aa, Homo sapiens
  Heavy chain CDR3 for antibody 5514 (IGHV3-33)
ARDRVLAPFDY

SEQ ID NO: 11029 - protein, 9 aa, Homo sapiens
  Light chain CDR3 for antibody 5515 (IGKV1-39)
QQSYSTPYT

SEQ ID NO: 11030 - protein, 13 aa, Homo sapiens
  Heavy chain CDR3 for antibody 5515 (IGHV3-33)
ARDGYSYGPYFDY

SEQ ID NO: 11031 - protein, 9 aa, Homo sapiens
  Light chain CDR3 for antibody 5516 (IGKV2-30)
MQGTHWPLT

SEQ ID NO: 11032 - protein, 17 aa, Homo sapiens
  Heavy chain CDR3 for antibody 5516 (IGHV1-24)
ATEGYDILPGYYNVLDY

SEQ ID NO: 11033 - protein, 8 aa, Homo sapiens
  Light chain CDR3 for antibody 5517 (IGKV3D-7)
QQDYNLLT

SEQ ID NO: 11034 - protein, 19 aa, Homo sapiens
  Heavy chain CDR3 for antibody 5517 (IGHV5-51)
ARHGEKGKRITMVRGSLDV

SEQ ID NO: 11035 - protein, 10 aa, Homo sapiens
  Light chain CDR3 for antibody 5518 (IGKV3-11)
QQRSNWPIFT

SEQ ID NO: 11036 - protein, 17 aa, Homo sapiens
  Heavy chain CDR3 for antibody 5518 (IGHV4-34)
AGLRFFDWLFDYYGMDV

SEQ ID NO: 11037 - protein, 10 aa, Homo sapiens
  Light chain CDR3 for antibody 5519 (IGKV3-11)
QQRSNWPIFT

SEQ ID NO: 11038 - protein, 12 aa, Homo sapiens
  Heavy chain CDR3 for antibody 5519 (IGHV3-13)
ARDRGYSGYFDY

SEQ ID NO: 11039 - protein, 9 aa, Homo sapiens
  Light chain CDR3 for antibody 5520 (IGKV3-15)
QQYNNWPRT

SEQ ID NO: 11040 - protein, 14 aa, Homo sapiens
  Heavy chain CDR3 for antibody 5520 (IGHV3-33)
ARDGYDFLTGPFDY

SEQ ID NO: 11041 - protein, 9 aa, Homo sapiens
  Light chain CDR3 for antibody 5521 (IGKV1-6)
LQDYNYPYT

SEQ ID NO: 11042 - protein, 9 aa, Homo sapiens
  Heavy chain CDR3 for antibody 5521 (IGHV3-20)
ATWGSAFDV

SEQ ID NO: 11043 - protein, 9 aa, Homo sapiens
  Light chain CDR3 for antibody 5522 (IGKV1D-13)
QQFNNYPYT

SEQ ID NO: 11044 - protein, 13 aa, Homo sapiens
  Heavy chain CDR3 for antibody 5522 (IGHV3-33)
ARGRGYNYGYGDY

SEQ ID NO: 11045 - protein, 9 aa, Homo sapiens
  Light chain CDR3 for antibody 5523 (IGKV1-9)
QQLNSYPWT

SEQ ID NO: 11046 - protein, 19 aa, Homo sapiens
  Heavy chain CDR3 for antibody 5523 (IGHV3-33)
ARDSGYSGYDYYYYYGMDV

SEQ ID NO: 11047 - protein, 9 aa, Homo sapiens
  Light chain CDR3 for antibody 5524 (IGKV1D-13)
QQFNNYPST

SEQ ID NO: 11048 - protein, 12 aa, Homo sapiens
  Heavy chain CDR3 for antibody 5524 (IGHV3-23)
AKEGIVGVPFDY

SEQ ID NO: 11049 - protein, 9 aa, Homo sapiens
  Light chain CDR3 for antibody 5525 (IGKV3D-11)
QQRSNWPYT

SEQ ID NO: 11050 - protein, 11 aa, Homo sapiens
  Heavy chain CDR3 for antibody 5525 (IGHV3-64)
ARERGSYAFDI

SEQ ID NO: 11051 - protein, 8 aa, Homo sapiens
  Light chain CDR3 for antibody 5526 (IGKV3-11)
QQRSNWLT

SEQ ID NO: 11052 - protein, 20 aa, Homo sapiens
  Heavy chain CDR3 for antibody 5526 (IGHV1-f)
ATGLITFVRGVILTYRSFDY

SEQ ID NO: 11053 - protein, 9 aa, Homo sapiens
  Light chain CDR3 for antibody 5527 (IGKV1-39)
QQSYSTPLT

SEQ ID NO: 11054 - protein, 13 aa, Homo sapiens
  Heavy chain CDR3 for antibody 5527 (IGHV1-18)
ARGGGVRGAPLDY

SEQ ID NO: 11055 - protein, 10 aa, Homo sapiens
  Light chain CDR3 for antibody 5528 (IGKV1-39)
QQSYSTPMYT

SEQ ID NO: 11056 - protein, 15 aa, Homo sapiens
  Heavy chain CDR3 for antibody 5528 (IGHV1-18)
ARGYCSSTSCYYFDY

SEQ ID NO: 11057 - protein, 9 aa, Homo sapiens
  Light chain CDR3 for antibody 5529 (IGKV5-2)
LQHDNFPYT

SEQ ID NO: 11058 - protein, 16 aa, Homo sapiens
  Heavy chain CDR3 for antibody 5529 (IGHV3-33)
AREGGLIAAAGTGFDY

SEQ ID NO: 11059 - protein, 8 aa, Homo sapiens
  Light chain CDR3 for antibody 5530 (IGKV6-21)
HQSSSLPT

SEQ ID NO: 11060 - protein, 11 aa, Homo sapiens
  Heavy chain CDR3 for antibody 5530 (IGHV3-33)
AREAANWGFDY

SEQ ID NO: 11061 - protein, 10 aa, Homo sapiens
  Light chain CDR3 for antibody 5531 (IGKV1-17)
LQHNSYPMYT

SEQ ID NO: 11062 - protein, 18 aa, Homo sapiens
  Heavy chain CDR3 for antibody 5531 (IGHV3-33)
ARDRDRYGSGTYPDAIDI

SEQ ID NO: 11063 - protein, 9 aa, Homo sapiens
  Light chain CDR3 for antibody 5532 (IGKV3-11)
QQRSNWPPT

SEQ ID NO: 11064 - protein, 12 aa, Homo sapiens
  Heavy chain CDR3 for antibody 5532 (IGHV3-33)
ARDRAYRGSLDY

SEQ ID NO: 11065 - protein, 9 aa, Homo sapiens
  Light chain CDR3 for antibody 5533 (IGKV3-11)
QQRSNWPYT

SEQ ID NO: 11066 - protein, 17 aa, Homo sapiens
  Heavy chain CDR3 for antibody 5533 (IGHV3-33)
ARESLKLGIYYYYGMDV

SEQ ID NO: 11067 - protein, 9 aa, Homo sapiens
  Light chain CDR3 for antibody 5534 (IGKV1-27)
QKYNSAPYT

SEQ ID NO: 11068 - protein, 15 aa, Homo sapiens
  Heavy chain CDR3 for antibody 5534 (IGHV3-33)
ARDRVVRGVMGYFDY

SEQ ID NO: 11069 - protein, 9 aa, Homo sapiens
  Light chain CDR3 for antibody 5535 (IGKV3D-7)
QQDYNLPWT

SEQ ID NO: 11070 - protein, 17 aa, Homo sapiens
  Heavy chain CDR3 for antibody 5535 (IGHV3-23)
AKDGIGELSYYYYGMDV

SEQ ID NO: 11071 - protein, 9 aa, Homo sapiens
  Light chain CDR3 for antibody 5536 (IGKV3-15)
QQYNNWPRT

SEQ ID NO: 11072 - protein, 12 aa, Homo sapiens
  Heavy chain CDR3 for antibody 5536 (IGHV3-33)
ASRDILTGYLGY

SEQ ID NO: 11073 - protein, 10 aa, Homo sapiens
  Light chain CDR3 for antibody 5537 (IGKV1-17)
LQHNSYPMYT

SEQ ID NO: 11074 - protein, 24 aa, Homo sapiens
  Heavy chain CDR3 for antibody 5537 (IGHV3-20)
ARGRITMVRGVIINPLDYYNGMDV

SEQ ID NO: 11075 - protein, 9 aa, Homo sapiens
  Light chain CDR3 for antibody 5538 (IGKV3-11)
QQRSNWPPT

SEQ ID NO: 11076 - protein, 15 aa, Homo sapiens
  Heavy chain CDR3 for antibody 5538 (IGHV3-33)
ARAYDLPHYYYGMDV

SEQ ID NO: 11077 - protein, 9 aa, Homo sapiens
  Light chain CDR3 for antibody 5539 (IGKV1-6)
LQDYKSPFT

SEQ ID NO: 11078 - protein, 13 aa, Homo sapiens
  Heavy chain CDR3 for antibody 5539 (IGHV3-33)
ANTGDSYYYDMDV

SEQ ID NO: 11079 - protein, 9 aa, Homo sapiens
  Light chain CDR3 for antibody 5540 (IGKV3D-20)
QQYGSSPWT

SEQ ID NO: 11080 - protein, 9 aa, Homo sapiens
  Heavy chain CDR3 for antibody 5540 (IGHV3-33)
ARELGYFDF

SEQ ID NO: 11081 - protein, 9 aa, Homo sapiens
  Light chain CDR3 for antibody 5541 (IGKV3-20)
QQYGSSPYT

SEQ ID NO: 11082 - protein, 9 aa, Homo sapiens
  Heavy chain CDR3 for antibody 5541 (IGHV3-30)
ARDDYGVDV

SEQ ID NO: 11083 - protein, 9 aa, Homo sapiens
  Light chain CDR3 for antibody 5542 (IGKV3-11)
QQRSNWPYT

SEQ ID NO: 11084 - protein, 18 aa, Homo sapiens
  Heavy chain CDR3 for antibody 5542 (IGHV6-1)
ARDQYSYGPYYYYYGMDV

SEQ ID NO: 11085 - protein, 10 aa, Homo sapiens
  Light chain CDR3 for antibody 5543 (IGKV3-11)
QQRSNWPPFT

SEQ ID NO: 11086 - protein, 18 aa, Homo sapiens
  Heavy chain CDR3 for antibody 5543 (IGHV3-33)
ARERDYYGSGSYPDAFDI

SEQ ID NO: 11087 - protein, 9 aa, Homo sapiens
  Light chain CDR3 for antibody 5544 (IGKV1-6)
LQDYNYPYT

SEQ ID NO: 11088 - protein, 19 aa, Homo sapiens
  Heavy chain CDR3 for antibody 5544 (IGHV3-33)
ARDSSYYDILTGSPYGMDV

SEQ ID NO: 11089 - protein, 10 aa, Homo sapiens
  Light chain CDR3 for antibody 5545 (IGKV3-11)
QQRSNWPALT

SEQ ID NO: 11090 - protein, 7 aa, Homo sapiens
  Heavy chain CDR3 for antibody 5545 (IGHV1-46)
AREGGDY

SEQ ID NO: 11091 - protein, 9 aa, Homo sapiens
  Light chain CDR3 for antibody 5546 (IGKV3-11)
QQRSNWPPT

SEQ ID NO: 11092 - protein, 18 aa, Homo sapiens
  Heavy chain CDR3 for antibody 5546 (IGHV3-33)
ARDEYYGSGIYYNYGMDV

SEQ ID NO: 11093 - protein, 10 aa, Homo sapiens
  Light chain CDR3 for antibody 5547 (IGKV1-17)
LQHNSYPMYT

SEQ ID NO: 11094 - protein, 15 aa, Homo sapiens
  Heavy chain CDR3 for antibody 5547 (IGHV3-33)
ARRICSGGSCSLFDY

SEQ ID NO: 11095 - protein, 9 aa, Homo sapiens
  Light chain CDR3 for antibody 5548 (IGKV2D-28)
MQVLQTPFT

SEQ ID NO: 11096 - protein, 15 aa, Homo sapiens
  Heavy chain CDR3 for antibody 5548 (IGHV4-59)
ARDLGHYYGSVSIDY

SEQ ID NO: 11097 - protein, 9 aa, Homo sapiens
  Light chain CDR3 for antibody 5549 (IGKV1-39)
QQSYSTPYT

SEQ ID NO: 11098 - protein, 9 aa, Homo sapiens
  Heavy chain CDR3 for antibody 5549 (IGHV3-13)
ARDHWYFDL

SEQ ID NO: 11099 - protein, 8 aa, Homo sapiens
  Light chain CDR3 for antibody 5550 (IGKV1-5)
QQYNSYWT

SEQ ID NO: 11100 - protein, 11 aa, Homo sapiens
  Heavy chain CDR3 for antibody 5550 (IGHV4-59)
ARSLRYSVFDY

SEQ ID NO: 11101 - protein, 9 aa, Homo sapiens
  Light chain CDR3 for antibody 5551 (IGKV1-6)
LQDFHYPWT

SEQ ID NO: 11102 - protein, 11 aa, Homo sapiens
  Heavy chain CDR3 for antibody 5551 (IGHV3-33)
ARDRVLTPFDY

SEQ ID NO: 11103 - protein, 10 aa, Homo sapiens
  Light chain CDR3 for antibody 5552 (IGKV1-17)
LQHNSYPMYT

SEQ ID NO: 11104 - protein, 13 aa, Homo sapiens
  Heavy chain CDR3 for antibody 5552 (IGHV3-33)
ARKAYGDYFYFDY

SEQ ID NO: 11105 - protein, 10 aa, Homo sapiens
  Light chain CDR3 for antibody 5553 (IGKV1-39)
QQSYSTPMYT

SEQ ID NO: 11106 - protein, 17 aa, Homo sapiens
  Heavy chain CDR3 for antibody 5553 (IGHV3-33)
ARSPYDILTGYSYYFDY

SEQ ID NO: 11107 - protein, 9 aa, Homo sapiens
  Light chain CDR3 for antibody 5554 (IGKV1-6)
LQDYNYPYT

SEQ ID NO: 11108 - protein, 16 aa, Homo sapiens
  Heavy chain CDR3 for antibody 5554 (IGHV3-33)
ARGGLTGGGDYDAFDI

SEQ ID NO: 11109 - protein, 9 aa, Homo sapiens
  Light chain CDR3 for antibody 5555 (IGKV5-2)
LQHDNFPWT

SEQ ID NO: 11110 - protein, 18 aa, Homo sapiens
  Heavy chain CDR3 for antibody 5555 (IGHV3-23)
AKEGDYYSSGSYWGYFDL

SEQ ID NO: 11111 - protein, 9 aa, Homo sapiens
  Light chain CDR3 for antibody 5556 (IGKV3-20)
QQYGSSPWT

SEQ ID NO: 11112 - protein, 9 aa, Homo sapiens
  Heavy chain CDR3 for antibody 5556 (IGHV4-59)
ARGGVHFDS

SEQ ID NO: 11113 - protein, 9 aa, Homo sapiens
  Light chain CDR3 for antibody 5557 (IGKV1D-13)
QQFNNYPYT

SEQ ID NO: 11114 - protein, 13 aa, Homo sapiens
  Heavy chain CDR3 for antibody 5557 (IGHV4-4)
ARERGIAAAGPDY

SEQ ID NO: 11115 - protein, 10 aa, Homo sapiens
  Light chain CDR3 for antibody 5558 (IGKV3-20)
QQRSNWPPFT

SEQ ID NO: 11116 - protein, 18 aa, Homo sapiens
  Heavy chain CDR3 for antibody 5558 (IGHV1-46)
ARDLTGRTENYYYYGMDV

SEQ ID NO: 11117 - protein, 9 aa, Homo sapiens
  Light chain CDR3 for antibody 5559 (IGKV1D-16)
QQYDSYPWT

SEQ ID NO: 11118 - protein, 10 aa, Homo sapiens
  Heavy chain CDR3 for antibody 5559 (IGHV3-33)
ARDVVVYFDY

SEQ ID NO: 11119 - protein, 9 aa, Homo sapiens
  Light chain CDR3 for antibody 5560 (IGKV2-30)
MQGTHWPLT

SEQ ID NO: 11120 - protein, 19 aa, Homo sapiens
  Heavy chain CDR3 for antibody 5560 (IGHV3-33)
ARGPYYDILTGYGYYGMDV

SEQ ID NO: 11121 - protein, 9 aa, Homo sapiens
  Light chain CDR3 for antibody 5561 (IGKV1-27)
QKYNSAPYT

SEQ ID NO: 11122 - protein, 17 aa, Homo sapiens
  Heavy chain CDR3 for antibody 5561 (IGHV1-18)
ARDRAFTMVRGVPPFDY

SEQ ID NO: 11123 - protein, 9 aa, Homo sapiens
  Light chain CDR3 for antibody 5562 (IGKV1-6)
LQDYNYPWT

SEQ ID NO: 11124 - protein, 18 aa, Homo sapiens
  Heavy chain CDR3 for antibody 5562 (IGHV3-23)
AKERGYYGSGSYSNWFDP

SEQ ID NO: 11125 - protein, 9 aa, Homo sapiens
  Light chain CDR3 for antibody 5563 (IGKV3-11)
QQRSNWPPT

SEQ ID NO: 11126 - protein, 11 aa, Homo sapiens
  Heavy chain CDR3 for antibody 5563 (IGHV3-33)
AREGAVARFDY

SEQ ID NO: 11127 - protein, 10 aa, Homo sapiens
  Light chain CDR3 for antibody 5564 (IGKV3-11)
QQRSNWPIFT

SEQ ID NO: 11128 - protein, 15 aa, Homo sapiens
  Heavy chain CDR3 for antibody 5564 (IGHV3-23)
AKEFTMVRGVITPDY

SEQ ID NO: 11129 - protein, 9 aa, Homo sapiens
  Light chain CDR3 for antibody 5565 (IGKV3D-7)
QQDYNLPFT

SEQ ID NO: 11130 - protein, 17 aa, Homo sapiens
  Heavy chain CDR3 for antibody 5565 (IGHV3-23)
AKEYCSGGSCYVYYFDY

SEQ ID NO: 11131 - protein, 9 aa, Homo sapiens
  Light chain CDR3 for antibody 5566 (IGKV1-16)
QHYNDYPFT

SEQ ID NO: 11132 - protein, 10 aa, Homo sapiens
  Heavy chain CDR3 for antibody 5566 (IGHV3-23)
AKGDRWRFDP

SEQ ID NO: 11133 - protein, 9 aa, Homo sapiens
  Light chain CDR3 for antibody 5567 (IGKV1-5)
LQDYNYPYT

SEQ ID NO: 11134 - protein, 12 aa, Homo sapiens
  Heavy chain CDR3 for antibody 5567 (IGHV3-64)
AREFPWGDYFDY

SEQ ID NO: 11135 - protein, 9 aa, Homo sapiens
  Light chain CDR3 for antibody 5568 (IGKV3-15)
QQYNNWPYT

SEQ ID NO: 11136 - protein, 12 aa, Homo sapiens
  Heavy chain CDR3 for antibody 5568 (IGHV3-33)
ARKGYDMHEFDI

SEQ ID NO: 11137 - protein, 8 aa, Homo sapiens
  Light chain CDR3 for antibody 5569 (IGKV3-11)
QQRSNWWT

SEQ ID NO: 11138 - protein, 17 aa, Homo sapiens
  Heavy chain CDR3 for antibody 5569 (IGHV4-39)
ARVLRYFDWLSHDAFDI

SEQ ID NO: 11139 - protein, 9 aa, Homo sapiens
  Light chain CDR3 for antibody 5570 (IGKV5-2)
LQHDKFPYT

SEQ ID NO: 11140 - protein, 13 aa, Homo sapiens
  Heavy chain CDR3 for antibody 5570 (IGHV3-33)
AKRYSSGWYPFDF

SEQ ID NO: 11141 - protein, 9 aa, Homo sapiens
  Light chain CDR3 for antibody 5571 (IGKV1D-13)
QQFNNYPYT

SEQ ID NO: 11142 - protein, 10 aa, Homo sapiens
  Heavy chain CDR3 for antibody 5571 (IGHV3-33)
ARDYGDYFDY

SEQ ID NO: 11143 - protein, 9 aa, Homo sapiens
  Light chain CDR3 for antibody 5572 (IGKV1-39)
QQSYSTPFT

SEQ ID NO: 11144 - protein, 15 aa, Homo sapiens
  Heavy chain CDR3 for antibody 5572 (IGHV4-59)
ARRSKYSSAWYPFDY

SEQ ID NO: 11145 - protein, 9 aa, Homo sapiens
  Light chain CDR3 for antibody 5573 (IGKV6-21)
HQSSSLPYT

SEQ ID NO: 11146 - protein, 22 aa, Homo sapiens
  Heavy chain CDR3 for antibody 5573 (IGHV3-23)
AKDDLPYYDILTHSTTTGGMDV

SEQ ID NO: 11147 - protein, 9 aa, Homo sapiens
  Light chain CDR3 for antibody 5574 (IGKV6-21)
HQSTSLPFT

SEQ ID NO: 11148 - protein, 23 aa, Homo sapiens
  Heavy chain CDR3 for antibody 5574 (IGHV1-18)
ARNLHYDILTGYFPYYFYYGMDV

SEQ ID NO: 11149 - protein, 9 aa, Homo sapiens
  Light chain CDR3 for antibody 5575 (IGKV3-20)
QQYGSSPRT

SEQ ID NO: 11150 - protein, 12 aa, Homo sapiens
  Heavy chain CDR3 for antibody 5575 (IGHV1-18)
ARKGIEVGGFDY

SEQ ID NO: 11151 - protein, 9 aa, Homo sapiens
  Light chain CDR3 for antibody 5576 (IGKV1-27)
QKYNSAPYT

SEQ ID NO: 11152 - protein, 14 aa, Homo sapiens
  Heavy chain CDR3 for antibody 5576 (IGHV3-33)
ARDGAAAALDAFDI

SEQ ID NO: 11153 - protein, 9 aa, Homo sapiens
  Light chain CDR3 for antibody 5577 (IGKV1-16)
QQYDSYPPT

SEQ ID NO: 11154 - protein, 14 aa, Homo sapiens
  Heavy chain CDR3 for antibody 5577 (IGHV3-33)
ARAVSGSSYWYFDL

SEQ ID NO: 11155 - protein, 9 aa, Homo sapiens
  Light chain CDR3 for antibody 5578 (IGKV1D-13)
QHFNNYMYT

SEQ ID NO: 11156 - protein, 12 aa, Homo sapiens
  Heavy chain CDR3 for antibody 5578 (IGHV4-39)
ARHPRYLDAFDI

SEQ ID NO: 11157 - protein, 10 aa, Homo sapiens
  Light chain CDR3 for antibody 5579 (IGKV1-6)
LQDYNYPMYT

SEQ ID NO: 11158 - protein, 13 aa, Homo sapiens
  Heavy chain CDR3 for antibody 5579 (IGHV3-11)
ARDGGAAAGTWDS

SEQ ID NO: 11159 - protein, 10 aa, Homo sapiens
  Light chain CDR3 for antibody 5580 (IGKV1-17)
LQHNSYPMYT

SEQ ID NO: 11160 - protein, 18 aa, Homo sapiens
  Heavy chain CDR3 for antibody 5580 (IGHV3-33)
ARGGVLYDILTGFYGMDV

SEQ ID NO: 11161 - protein, 8 aa, Homo sapiens
  Light chain CDR3 for antibody 5581 (IGKV1D-13)
QQFNNYPT

SEQ ID NO: 11162 - protein, 17 aa, Homo sapiens
  Heavy chain CDR3 for antibody 5581 (IGHV3-23)
AKDGSFYSSGWYDAFDI

SEQ ID NO: 11163 - protein, 9 aa, Homo sapiens
  Light chain CDR3 for antibody 5582 (IGKV3-20)
QQYGSSPYT

SEQ ID NO: 11164 - protein, 14 aa, Homo sapiens
  Heavy chain CDR3 for antibody 5582 (IGHV3-64)
ARGGGAVTGTNFDY

SEQ ID NO: 11165 - protein, 9 aa, Homo sapiens
  Light chain CDR3 for antibody 5583 (IGKV5-2)
LQHDNFPWT

SEQ ID NO: 11166 - protein, 24 aa, Homo sapiens
  Heavy chain CDR3 for antibody 5583 (IGHV1-24)
ATEAHYDILTGYYNPHYYYYGMDV

SEQ ID NO: 11167 - protein, 9 aa, Homo sapiens
  Light chain CDR3 for antibody 5584 (IGKV1-39)
QQSYSTPLT

SEQ ID NO: 11168 - protein, 12 aa, Homo sapiens
  Heavy chain CDR3 for antibody 5584 (IGHV3-11)
VRKWFGELYFDY

SEQ ID NO: 11169 - protein, 9 aa, Homo sapiens
  Light chain CDR3 for antibody 5585 (IGKV1-6)
LQDYNYPWT

SEQ ID NO: 11170 - protein, 14 aa, Homo sapiens
  Heavy chain CDR3 for antibody 5585 (IGHV3-23)
AKDRNIPAAGPFDY

SEQ ID NO: 11171 - protein, 9 aa, Homo sapiens
  Light chain CDR3 for antibody 5586 (IGKV1-27)
QKYNSAPHT

SEQ ID NO: 11172 - protein, 17 aa, Homo sapiens
  Heavy chain CDR3 for antibody 5586 (IGHV1-18)
ARDEGYDILTGYPHFDY

SEQ ID NO: 11173 - protein, 11 aa, Homo sapiens
  Light chain CDR3 for antibody 5587 (IGKV3-11)
QQRSNWPPTWT

SEQ ID NO: 11174 - protein, 19 aa, Homo sapiens
  Heavy chain CDR3 for antibody 5587 (IGHV4-59)
ARDRVVGATTYYYYYGMDV

SEQ ID NO: 11175 - protein, 9 aa, Homo sapiens
  Light chain CDR3 for antibody 5588 (IGKV3-11)
QQRSNWPYT

SEQ ID NO: 11176 - protein, 17 aa, Homo sapiens
  Heavy chain CDR3 for antibody 5588 (IGHV4-59)
ARDRELLWFGEFGGMDV

SEQ ID NO: 11177 - protein, 9 aa, Homo sapiens
  Light chain CDR3 for antibody 5589 (IGKV3D-7)
QQDYKLPLT

SEQ ID NO: 11178 - protein, 15 aa, Homo sapiens
  Heavy chain CDR3 for antibody 5589 (IGHV1-46)
ARGRFFDWLLSPFDY

SEQ ID NO: 11179 - protein, 9 aa, Homo sapiens
  Light chain CDR3 for antibody 5590 (IGKV1-27)
QKYNSAPYT

SEQ ID NO: 11180 - protein, 11 aa, Homo sapiens
  Heavy chain CDR3 for antibody 5590 (IGHV3-33)
AREGAVARFDY

SEQ ID NO: 11181 - protein, 8 aa, Homo sapiens
  Light chain CDR3 for antibody 5591 (IGKV1-5)
QQYNSYYT

SEQ ID NO: 11182 - protein, 20 aa, Homo sapiens
  Heavy chain CDR3 for antibody 5591 (IGHV3-20)
ARDLCSSTSCYGYYYYGMDV

SEQ ID NO: 11183 - protein, 9 aa, Homo sapiens
  Light chain CDR3 for antibody 5592 (IGKV1-9)
QQLNTYPWT

SEQ ID NO: 11184 - protein, 17 aa, Homo sapiens
  Heavy chain CDR3 for antibody 5592 (IGHV3-33)
ARSPYDILTGYSYYFDY

SEQ ID NO: 11185 - protein, 9 aa, Homo sapiens
  Light chain CDR3 for antibody 5593 (IGKV3D-20)
QQYGSSPLT

SEQ ID NO: 11186 - protein, 12 aa, Homo sapiens
  Heavy chain CDR3 for antibody 5593 (IGHV4-28)
ARKDSGYDWFDY

SEQ ID NO: 11187 - protein, 7 aa, Homo sapiens
  Light chain CDR3 for antibody 5594 (IGKV1-17)
LQHNSYP

SEQ ID NO: 11188 - protein, 15 aa, Homo sapiens
  Heavy chain CDR3 for antibody 5594 (IGHV1-18)
ARGYCSSTSCYYFDY

SEQ ID NO: 11189 - protein, 9 aa, Homo sapiens
  Light chain CDR3 for antibody 5595 (IGKV1-6)
LQDYNYPWT

SEQ ID NO: 11190 - protein, 12 aa, Homo sapiens
  Heavy chain CDR3 for antibody 5595 (IGHV3-33)
ARVDTAAHYFDY

SEQ ID NO: 11191 - protein, 9 aa, Homo sapiens
  Light chain CDR3 for antibody 5596 (IGKV5-2)
LQHDNFPYT

SEQ ID NO: 11192 - protein, 14 aa, Homo sapiens
  Heavy chain CDR3 for antibody 5596 (IGHV3-33)
ARDGIVRATDAFAI

SEQ ID NO: 11193 - protein, 9 aa, Homo sapiens
  Light chain CDR3 for antibody 5597 (IGKV1-27)
QKYNSAPYT

SEQ ID NO: 11194 - protein, 12 aa, Homo sapiens
  Heavy chain CDR3 for antibody 5597 (IGHV3-23)
AKESLYTPTDDY

SEQ ID NO: 11195 - protein, 8 aa, Homo sapiens
  Light chain CDR3 for antibody 5598 (IGKV1-39)
QQYNSYWT

SEQ ID NO: 11196 - protein, 26 aa, Homo sapiens
  Heavy chain CDR3 for antibody 5598 (IGHV3-11)
ARQGLLWFGDLKAYDSSGYYYGYFHH

SEQ ID NO: 11197 - protein, 9 aa, Homo sapiens
  Light chain CDR3 for antibody 5599 (IGKV1-17)
LQHNSYPWT

SEQ ID NO: 11198 - protein, 17 aa, Homo sapiens
  Heavy chain CDR3 for antibody 5599 (IGHV3-23)
AKEGSSSSWYGGLYFDY

SEQ ID NO: 11199 - protein, 9 aa, Homo sapiens
  Light chain CDR3 for antibody 5600 (IGKV2-30)
MQGTHWPLT

SEQ ID NO: 11200 - protein, 12 aa, Homo sapiens
  Heavy chain CDR3 for antibody 5600 (IGHV3-33)
ASRDILTGYLGY

SEQ ID NO: 11201 - protein, 9 aa, Homo sapiens
  Light chain CDR3 for antibody 5601 (IGKV1-6)
LQDYNHPFT

SEQ ID NO: 11202 - protein, 9 aa, Homo sapiens
  Heavy chain CDR3 for antibody 5601 (IGHV3-30)
ARDYFHFDY

SEQ ID NO: 11203 - protein, 9 aa, Homo sapiens
  Light chain CDR3 for antibody 5602 (IGKV1-33)
QQYDNLPFT

SEQ ID NO: 11204 - protein, 11 aa, Homo sapiens
  Heavy chain CDR3 for antibody 5602 (IGHV3-33)
ARDRVLTPFDY

SEQ ID NO: 11205 - protein, 9 aa, Homo sapiens
  Light chain CDR3 for antibody 5603 (IGKV3D-7)
QQDYNLPLT

SEQ ID NO: 11206 - protein, 16 aa, Homo sapiens
  Heavy chain CDR3 for antibody 5603 (IGHV3-13)
ARDRSYESYYYYGMDV

SEQ ID NO: 11207 - protein, 9 aa, Homo sapiens
  Light chain CDR3 for antibody 5604 (IGKV1-27)
QKYNSAPYT

SEQ ID NO: 11208 - protein, 12 aa, Homo sapiens
  Heavy chain CDR3 for antibody 5604 (IGHV3-11)
ARVLLWFGETDY

SEQ ID NO: 11209 - protein, 9 aa, Homo sapiens
  Light chain CDR3 for antibody 5605 (IGKV1-9)
QQLNGYPFT

SEQ ID NO: 11210 - protein, 12 aa, Homo sapiens
  Heavy chain CDR3 for antibody 5605 (IGHV4-28)
ARDLVGATPFDY

SEQ ID NO: 11211 - protein, 10 aa, Homo sapiens
  Light chain CDR3 for antibody 5606 (IGKV1-9)
QQLDSYPMYT

SEQ ID NO: 11212 - protein, 14 aa, Homo sapiens
  Heavy chain CDR3 for antibody 5606 (IGHV3-33)
ARDKTYPLSYGMDV

SEQ ID NO: 11213 - protein, 9 aa, Homo sapiens
  Light chain CDR3 for antibody 5607 (IGKV1-33)
QQYDNLPFT

SEQ ID NO: 11214 - protein, 20 aa, Homo sapiens
  Heavy chain CDR3 for antibody 5607 (IGHV1-f)
ATGLITFVRGVILTYRSFDY

SEQ ID NO: 11215 - protein, 10 aa, Homo sapiens
  Light chain CDR3 for antibody 5608 (IGKV1-39)
QQSYSTPMYT

SEQ ID NO: 11216 - protein, 15 aa, Homo sapiens
  Heavy chain CDR3 for antibody 5608 (IGHV3-33)
ARDRGWKAPGYGMDV

SEQ ID NO: 11217 - protein, 9 aa, Homo sapiens
  Light chain CDR3 for antibody 5609 (IGKV3-11)
QQRSNWMYT

SEQ ID NO: 11218 - protein, 18 aa, Homo sapiens
  Heavy chain CDR3 for antibody 5609 (IGHV3-23)
ARYHLYFGSGFGSDGMDV

SEQ ID NO: 11219 - protein, 9 aa, Homo sapiens
  Light chain CDR3 for antibody 5610 (IGKV1-6)
LQDYNYPWT

SEQ ID NO: 11220 - protein, 18 aa, Homo sapiens
  Heavy chain CDR3 for antibody 5610 (IGHV2-5)
AHYSGYSYGYPRAYGMDV

SEQ ID NO: 11221 - protein, 9 aa, Homo sapiens
  Light chain CDR3 for antibody 5611 (IGKV1-17)
LQHNSYPRT

SEQ ID NO: 11222 - protein, 15 aa, Homo sapiens
  Heavy chain CDR3 for antibody 5611 (IGHV3-30)
ARRGYGSGSPDAFDL

SEQ ID NO: 11223 - protein, 9 aa, Homo sapiens
  Light chain CDR3 for antibody 5612 (IGKV1D-16)
QQYNSYPLT

SEQ ID NO: 11224 - protein, 13 aa, Homo sapiens
  Heavy chain CDR3 for antibody 5612 (IGHV3-53)
ARDRDSSGSYFDY

SEQ ID NO: 11225 - protein, 9 aa, Homo sapiens
  Light chain CDR3 for antibody 5613 (IGKV3-20)
QQYGSSPYT

SEQ ID NO: 11226 - protein, 16 aa, Homo sapiens
  Heavy chain CDR3 for antibody 5613 (IGHV3-23)
ARNDILTASGYYGMDV

SEQ ID NO: 11227 - protein, 9 aa, Homo sapiens
  Light chain CDR3 for antibody 5614 (IGKV3-15)
QQYNNWPLT

SEQ ID NO: 11228 - protein, 17 aa, Homo sapiens
  Heavy chain CDR3 for antibody 5614 (IGHV1-24)
ATEGYDILPGYYNVLDY

SEQ ID NO: 11229 - protein, 9 aa, Homo sapiens
  Light chain CDR3 for antibody 5615 (IGKV1-16)
QQYNSYPLT

SEQ ID NO: 11230 - protein, 17 aa, Homo sapiens
  Heavy chain CDR3 for antibody 5615 (IGHV3-23)
AKGDYYGSGTYSTFFDY

SEQ ID NO: 11231 - protein, 9 aa, Homo sapiens
  Light chain CDR3 for antibody 5616 (IGKV1-17)
LQHNSYPYT

SEQ ID NO: 11232 - protein, 17 aa, Homo sapiens
  Heavy chain CDR3 for antibody 5616 (IGHV3-11)
ARAGPRYDSSGHDAFDI

SEQ ID NO: 11233 - protein, 9 aa, Homo sapiens
  Light chain CDR3 for antibody 5617 (IGKV3D-7)
QQDYNLPYT

SEQ ID NO: 11234 - protein, 17 aa, Homo sapiens
  Heavy chain CDR3 for antibody 5617 (IGHV3-33)
ARSPYDILTGYSYYFDY

SEQ ID NO: 11235 - protein, 9 aa, Homo sapiens
  Light chain CDR3 for antibody 5618 (IGKV3-11)
QQRSNWPPT

SEQ ID NO: 11236 - protein, 12 aa, Homo sapiens
  Heavy chain CDR3 for antibody 5618 (IGHV3-13)
ARDRGYSGYFDY

SEQ ID NO: 11237 - protein, 9 aa, Homo sapiens
  Light chain CDR3 for antibody 5619 (IGKV3-15)
QQYNNWPLT

SEQ ID NO: 11238 - protein, 20 aa, Homo sapiens
  Heavy chain CDR3 for antibody 5619 (IGHV3-23)
AKDREMAATSHYYYYYGMDV

SEQ ID NO: 11239 - protein, 10 aa, Homo sapiens
  Light chain CDR3 for antibody 5620 (IGKV3-11)
QQRSNWPIFT

SEQ ID NO: 11240 - protein, 17 aa, Homo sapiens
  Heavy chain CDR3 for antibody 5620 (IGHV3-23)
AKDGSFYSSGWYDAFDI

SEQ ID NO: 11241 - protein, 9 aa, Homo sapiens
  Light chain CDR3 for antibody 5621 (IGKV1-5)
QQYNTYSRT

SEQ ID NO: 11242 - protein, 14 aa, Homo sapiens
  Heavy chain CDR3 for antibody 5621 (IGHV3-33)
ARGAAAGNFYGLDV

SEQ ID NO: 11243 - protein, 9 aa, Homo sapiens
  Light chain CDR3 for antibody 5622 (IGKV1-6)
LQDYNYPRT

SEQ ID NO: 11244 - protein, 17 aa, Homo sapiens
  Heavy chain CDR3 for antibody 5622 (IGHV3-33)
ARVYYDILTGYSPAFDI

SEQ ID NO: 11245 - protein, 10 aa, Homo sapiens
  Light chain CDR3 for antibody 5623 (IGKV1-17)
LQHNSYPMYT

SEQ ID NO: 11246 - protein, 15 aa, Homo sapiens
  Heavy chain CDR3 for antibody 5623 (IGHV3-33)
ARDTGYSSSWNWFDP

SEQ ID NO: 11247 - protein, 9 aa, Homo sapiens
  Light chain CDR3 for antibody 5624 (IGKV1-9)
QQLKSYLYT

SEQ ID NO: 11248 - protein, 13 aa, Homo sapiens
  Heavy chain CDR3 for antibody 5624 (IGHV3-33)
ARRYRSGWYPFDY

SEQ ID NO: 11249 - protein, 10 aa, Homo sapiens
  Light chain CDR3 for antibody 5625 (IGKV1-27)
QKYNSAPMYT

SEQ ID NO: 11250 - protein, 13 aa, Homo sapiens
  Heavy chain CDR3 for antibody 5625 (IGHV4-39)
ARHEVMVRGVFDY

SEQ ID NO: 11251 - protein, 9 aa, Homo sapiens
  Light chain CDR3 for antibody 5626 (IGKV1-17)
LQHNSYPPT

SEQ ID NO: 11252 - protein, 19 aa, Homo sapiens
  Heavy chain CDR3 for antibody 5626 (IGHV3-9)
AKDYYDVLTGYYNDEYFQY

SEQ ID NO: 11253 - protein, 9 aa, Homo sapiens
  Light chain CDR3 for antibody 5627 (IGKV1-17)
LQHNSYPWT

SEQ ID NO: 11254 - protein, 10 aa, Homo sapiens
  Heavy chain CDR3 for antibody 5627 (IGHV3-33)
AREGLRYFDH

SEQ ID NO: 11255 - protein, 9 aa, Homo sapiens
  Light chain CDR3 for antibody 5628 (IGKV3-15)
QQDYNLPLT

SEQ ID NO: 11256 - protein, 17 aa, Homo sapiens
  Heavy chain CDR3 for antibody 5628 (IGHV3-30)
ARDLIGPLSSSWYPFDY

SEQ ID NO: 11257 - protein, 9 aa, Homo sapiens
  Light chain CDR3 for antibody 5629 (IGKV1-39)
QQSYSTPYT

SEQ ID NO: 11258 - protein, 12 aa, Homo sapiens
  Heavy chain CDR3 for antibody 5629 (IGHV4-61)
ARVGSSGWYFDY

SEQ ID NO: 11259 - protein, 10 aa, Homo sapiens
  Light chain CDR3 for antibody 5630 (IGKV1-39)
QQSYSTPMYT

SEQ ID NO: 11260 - protein, 13 aa, Homo sapiens
  Heavy chain CDR3 for antibody 5630 (IGHV3-33)
ASGYSGYDWYFDL

SEQ ID NO: 11261 - protein, 9 aa, Homo sapiens
  Light chain CDR3 for antibody 5631 (IGKV3D-7)
QQDYNLPLT

SEQ ID NO: 11262 - protein, 17 aa, Homo sapiens
  Heavy chain CDR3 for antibody 5631 (IGHV3-33)
ARGGGYENDHYYYGMDV

SEQ ID NO: 11263 - protein, 9 aa, Homo sapiens
  Light chain CDR3 for antibody 5632 (IGKV3-11)
QQRSNWMYT

SEQ ID NO: 11264 - protein, 13 aa, Homo sapiens
  Heavy chain CDR3 for antibody 5632 (IGHV3-33)
ARGVLWFGELFDY

SEQ ID NO: 11265 - protein, 9 aa, Homo sapiens
  Light chain CDR3 for antibody 5633 (IGKV1-6)
LQDYNYPYT

SEQ ID NO: 11266 - protein, 14 aa, Homo sapiens
  Heavy chain CDR3 for antibody 5633 (IGHV3-33)
ARDGLVGASSWFDP

SEQ ID NO: 11267 - protein, 8 aa, Homo sapiens
  Light chain CDR3 for antibody 5634 (IGKV1D-13)
QQFNNYYT

SEQ ID NO: 11268 - protein, 19 aa, Homo sapiens
  Heavy chain CDR3 for antibody 5634 (IGHV1-18)
ARDDILTGYSLYYYYGMDV

SEQ ID NO: 11269 - protein, 9 aa, Homo sapiens
  Light chain CDR3 for antibody 5635 (IGKV1-9)
QQLKSYLYT

SEQ ID NO: 11270 - protein, 13 aa, Homo sapiens
  Heavy chain CDR3 for antibody 5635 (IGHV3-33)
ARDYCGGDCYLDY

SEQ ID NO: 11271 - protein, 8 aa, Homo sapiens
  Light chain CDR3 for antibody 5636 (IGKV3-20)
QQYGRSFT

SEQ ID NO: 11272 - protein, 11 aa, Homo sapiens
  Heavy chain CDR3 for antibody 5636 (IGHV4-59)
ARSIRYSVFDY

SEQ ID NO: 11273 - protein, 9 aa, Homo sapiens
  Light chain CDR3 for antibody 5637 (IGKV3-11)
QQRSNWPYT

SEQ ID NO: 11274 - protein, 15 aa, Homo sapiens
  Heavy chain CDR3 for antibody 5637 (IGHV3-33)
ARDGSGSYSLYGMDV

SEQ ID NO: 11275 - protein, 9 aa, Homo sapiens
  Light chain CDR3 for antibody 5638 (IGKV1-6)
LQDYNYPYT

SEQ ID NO: 11276 - protein, 18 aa, Homo sapiens
  Heavy chain CDR3 for antibody 5638 (IGHV3-33)
ARERYYYGSGSYPDAFDI

SEQ ID NO: 11277 - protein, 9 aa, Homo sapiens
  Light chain CDR3 for antibody 5639 (IGKV1-17)
LQHNSYPYT

SEQ ID NO: 11278 - protein, 12 aa, Homo sapiens
  Heavy chain CDR3 for antibody 5639 (IGHV3-66)
VRDRAAAPYFDL

SEQ ID NO: 11279 - protein, 9 aa, Homo sapiens
  Light chain CDR3 for antibody 5640 (IGKV1-6)
LQDYNYPRT

SEQ ID NO: 11280 - protein, 13 aa, Homo sapiens
  Heavy chain CDR3 for antibody 5640 (IGHV4-59)
ARGYYDIFGWFDP

SEQ ID NO: 11281 - protein, 9 aa, Homo sapiens
  Light chain CDR3 for antibody 5641 (IGKV1D-13)
QQFNNYPRT

SEQ ID NO: 11282 - protein, 15 aa, Homo sapiens
  Heavy chain CDR3 for antibody 5641 (IGHV3-66)
ARDRDYYYYYYGMDV

SEQ ID NO: 11283 - protein, 9 aa, Homo sapiens
  Light chain CDR3 for antibody 5642 (IGKV2-30)
MQGTHWPLT

SEQ ID NO: 11284 - protein, 17 aa, Homo sapiens
  Heavy chain CDR3 for antibody 5642 (IGHV3-33)
ARVYYDILTGYSPAFDI

SEQ ID NO: 11285 - protein, 8 aa, Homo sapiens
  Light chain CDR3 for antibody 5643 (IGKV2D-28)
MQALQTPT

SEQ ID NO: 11286 - protein, 13 aa, Homo sapiens
  Heavy chain CDR3 for antibody 5643 (IGHV3-23)
ASPFNWNDGFFDY

SEQ ID NO: 11287 - protein, 9 aa, Homo sapiens
  Light chain CDR3 for antibody 5644 (IGKV3D-7)
QQDYNLPLT

SEQ ID NO: 11288 - protein, 14 aa, Homo sapiens
  Heavy chain CDR3 for antibody 5644 (IGHV3-33)
ARDRRDFYYYGMDV

SEQ ID NO: 11289 - protein, 9 aa, Homo sapiens
  Light chain CDR3 for antibody 5645 (IGKV1-17)
LQHNSFPLT

SEQ ID NO: 11290 - protein, 13 aa, Homo sapiens
  Heavy chain CDR3 for antibody 5645 (IGHV3-33)
ARAFIMVRGVIDY

SEQ ID NO: 11291 - protein, 9 aa, Homo sapiens
  Light chain CDR3 for antibody 5646 (IGKV3-20)
QQYGSSPYT

SEQ ID NO: 11292 - protein, 14 aa, Homo sapiens
  Heavy chain CDR3 for antibody 5646 (IGHV3-33)
ARSTLVRGANWFDP

SEQ ID NO: 11293 - protein, 10 aa, Homo sapiens
  Light chain CDR3 for antibody 5647 (IGKV3-11)
QQRSNWPIFT

SEQ ID NO: 11294 - protein, 12 aa, Homo sapiens
  Heavy chain CDR3 for antibody 5647 (IGHV3-33)
AREGDILTGYSL

SEQ ID NO: 11295 - protein, 9 aa, Homo sapiens
  Light chain CDR3 for antibody 5648 (IGKV1-6)
LQDFHYPWT

SEQ ID NO: 11296 - protein, 21 aa, Homo sapiens
  Heavy chain CDR3 for antibody 5648 (IGHV3-33)
ARKRLYDILTGYYKAYYGMDV

SEQ ID NO: 11297 - protein, 9 aa, Homo sapiens
  Light chain CDR3 for antibody 5649 (IGKV1-39)
QQSYSTPLT

SEQ ID NO: 11298 - protein, 14 aa, Homo sapiens
  Heavy chain CDR3 for antibody 5649 (IGHV1-24)
ATWLPLYYYYGMDV

SEQ ID NO: 11299 - protein, 9 aa, Homo sapiens
  Light chain CDR3 for antibody 5650 (IGKV1D-16)
QQYNSYPYT

SEQ ID NO: 11300 - protein, 14 aa, Homo sapiens
  Heavy chain CDR3 for antibody 5650 (IGHV3-33)
AKSYDILTGEAFDI

SEQ ID NO: 11301 - protein, 9 aa, Homo sapiens
  Light chain CDR3 for antibody 5651 (IGKV4-1)
QQYYTTPPT

SEQ ID NO: 11302 - protein, 13 aa, Homo sapiens
  Heavy chain CDR3 for antibody 5651 (IGHV4-59)
ARDAGYSSSWFDY

SEQ ID NO: 11303 - protein, 9 aa, Homo sapiens
  Light chain CDR3 for antibody 5652 (IGKV2-30)
MQGTHWPLT

SEQ ID NO: 11304 - protein, 11 aa, Homo sapiens
  Heavy chain CDR3 for antibody 5652 (IGHV1-46)
AREEDLGAFDI

SEQ ID NO: 11305 - protein, 9 aa, Homo sapiens
  Light chain CDR3 for antibody 5653 (IGKV1-9)
QQGNTYSRT

SEQ ID NO: 11306 - protein, 14 aa, Homo sapiens
  Heavy chain CDR3 for antibody 5653 (IGHV3-33)
ARDWNDVYYYGMDV

SEQ ID NO: 11307 - protein, 10 aa, Homo sapiens
  Light chain CDR3 for antibody 5654 (IGKV1-39)
QQSYSTPMYT

SEQ ID NO: 11308 - protein, 20 aa, Homo sapiens
  Heavy chain CDR3 for antibody 5654 (IGHV3-33)
ARDPAQLERRYYYFYYGMDV

SEQ ID NO: 11309 - protein, 9 aa, Homo sapiens
  Light chain CDR3 for antibody 5655 (IGKV1-16)
QHYNDYPFT

SEQ ID NO: 11310 - protein, 19 aa, Homo sapiens
  Heavy chain CDR3 for antibody 5655 (IGHV3-33)
ARGVRLRYFDPYYYYGMDV

SEQ ID NO: 11311 - protein, 9 aa, Homo sapiens
  Light chain CDR3 for antibody 5656 (IGKV3-11)
QQRSNWPPT

SEQ ID NO: 11312 - protein, 14 aa, Homo sapiens
  Heavy chain CDR3 for antibody 5656 (IGHV3-33)
ARDLNYDILNGGGY

SEQ ID NO: 11313 - protein, 10 aa, Homo sapiens
  Light chain CDR3 for antibody 5657 (IGKV1-39)
QQSYSTPMYT

SEQ ID NO: 11314 - protein, 18 aa, Homo sapiens
  Heavy chain CDR3 for antibody 5657 (IGHV3-33)
AREGDYYGSGGFPNWFDP

SEQ ID NO: 11315 - protein, 10 aa, Homo sapiens
  Light chain CDR3 for antibody 5658 (IGKV3-20)
QQYGSSPPYT

SEQ ID NO: 11316 - protein, 15 aa, Homo sapiens
  Heavy chain CDR3 for antibody 5658 (IGHV3-33)
ARRICSGGSCSLFDY

SEQ ID NO: 11317 - protein, 9 aa, Homo sapiens
  Light chain CDR3 for antibody 5659 (IGKV1-9)
QQLISYPLT

SEQ ID NO: 11318 - protein, 15 aa, Homo sapiens
  Heavy chain CDR3 for antibody 5659 (IGHV3-30)
ARGAMVRGVDYGMDV

SEQ ID NO: 11319 - protein, 9 aa, Homo sapiens
  Light chain CDR3 for antibody 5660 (IGKV3-11)
QQRSNWPRT

SEQ ID NO: 11320 - protein, 9 aa, Homo sapiens
  Heavy chain CDR3 for antibody 5660 (IGHV3-23)
ARIWWLKDY

SEQ ID NO: 11321 - protein, 9 aa, Homo sapiens
  Light chain CDR3 for antibody 5661 (IGKV1-17)
LQHNSYPPT

SEQ ID NO: 11322 - protein, 15 aa, Homo sapiens
  Heavy chain CDR3 for antibody 5661 (IGHV1-2)
ARDLGYYGSGSRMDV

SEQ ID NO: 11323 - protein, 8 aa, Homo sapiens
  Light chain CDR3 for antibody 5662 (IGKV3-20)
QQYGSSLT

SEQ ID NO: 11324 - protein, 11 aa, Homo sapiens
  Heavy chain CDR3 for antibody 5662 (IGHV3-33)
ARDRVLTPFDY

SEQ ID NO: 11325 - protein, 8 aa, Homo sapiens
  Light chain CDR3 for antibody 5663 (IGKV3-15)
QQYNNWPT

SEQ ID NO: 11326 - protein, 9 aa, Homo sapiens
  Heavy chain CDR3 for antibody 5663 (IGHV3-33)
ARATVGVDY

SEQ ID NO: 11327 - protein, 9 aa, Homo sapiens
  Light chain CDR3 for antibody 5664 (IGKV2-30)
MQGTHWPLT

SEQ ID NO: 11328 - protein, 11 aa, Homo sapiens
  Heavy chain CDR3 for antibody 5664 (IGHV3-33)
ARARYTTGLDY

SEQ ID NO: 11329 - protein, 9 aa, Homo sapiens
  Light chain CDR3 for antibody 5665 (IGKV1-9)
QQLKSYPYT

SEQ ID NO: 11330 - protein, 10 aa, Homo sapiens
  Heavy chain CDR3 for antibody 5665 (IGHV3-23)
AKEQWLVLDY

SEQ ID NO: 11331 - protein, 9 aa, Homo sapiens
  Light chain CDR3 for antibody 5666 (IGKV6-21)
HQSSSLPYT

SEQ ID NO: 11332 - protein, 18 aa, Homo sapiens
  Heavy chain CDR3 for antibody 5666 (IGHV1-18)
ARDPTFYYVSGSYYKFDY

SEQ ID NO: 11333 - protein, 9 aa, Homo sapiens
  Light chain CDR3 for antibody 5667 (IGKV1-39)
QQGFSTPWT

SEQ ID NO: 11334 - protein, 13 aa, Homo sapiens
  Heavy chain CDR3 for antibody 5667 (IGHV4-39)
ARQWPSGYWYFDL

SEQ ID NO: 11335 - protein, 7 aa, Homo sapiens
  Light chain CDR3 for antibody 5668 (IGKV3-20)
QQYGSSL

SEQ ID NO: 11336 - protein, 11 aa, Homo sapiens
  Heavy chain CDR3 for antibody 5668 (IGHV3-53)
ARGHWEYYFDY

SEQ ID NO: 11337 - protein, 9 aa, Homo sapiens
  Light chain CDR3 for antibody 5669 (IGKV1-6)
LQDYNYPRT

SEQ ID NO: 11338 - protein, 17 aa, Homo sapiens
  Heavy chain CDR3 for antibody 5669 (IGHV3-23)
AKDRDWNDGQYYFGMDV

SEQ ID NO: 11339 - protein, 8 aa, Homo sapiens
  Light chain CDR3 for antibody 5670 (IGKV1D-13)
QQFNNYPT

SEQ ID NO: 11340 - protein, 11 aa, Homo sapiens
  Heavy chain CDR3 for antibody 5670 (IGHV3-33)
AREGAVARFDY

SEQ ID NO: 11341 - protein, 9 aa, Homo sapiens
  Light chain CDR3 for antibody 5671 (IGKV1D-13)
QRFNNYLYT

SEQ ID NO: 11342 - protein, 13 aa, Homo sapiens
  Heavy chain CDR3 for antibody 5671 (IGHV4-39)
ARHPPSRDYGMDV

SEQ ID NO: 11343 - protein, 9 aa, Homo sapiens
  Light chain CDR3 for antibody 5672 (IGKV1-39)
QQSYSSPFT

SEQ ID NO: 11344 - protein, 9 aa, Homo sapiens
  Heavy chain CDR3 for antibody 5672 (IGHV1-18)
ARGKDWFDP

SEQ ID NO: 11345 - protein, 9 aa, Homo sapiens
  Light chain CDR3 for antibody 5673 (IGKV1-9)
QQLNTYPLT

SEQ ID NO: 11346 - protein, 9 aa, Homo sapiens
  Heavy chain CDR3 for antibody 5673 (IGHV4-59)
ARKKGTFDY

SEQ ID NO: 11347 - protein, 10 aa, Homo sapiens
  Light chain CDR3 for antibody 5674 (IGKV1-39)
QQSYSTPMYT

SEQ ID NO: 11348 - protein, 9 aa, Homo sapiens
  Heavy chain CDR3 for antibody 5674 (IGHV3-30)
ARDYFHYDY

SEQ ID NO: 11349 - protein, 9 aa, Homo sapiens
  Light chain CDR3 for antibody 5675 (IGKV3-11)
QQRSNWPPT

SEQ ID NO: 11350 - protein, 11 aa, Homo sapiens
  Heavy chain CDR3 for antibody 5675 (IGHV4-59)
AREMGHDTFDI

SEQ ID NO: 11351 - protein, 9 aa, Homo sapiens
  Light chain CDR3 for antibody 5676 (IGKV6-21)
HQSSSLPYT

SEQ ID NO: 11352 - protein, 9 aa, Homo sapiens
  Heavy chain CDR3 for antibody 5676 (IGHV1-8)
ARGPRIMDV

SEQ ID NO: 11353 - protein, 10 aa, Homo sapiens
  Light chain CDR3 for antibody 5677 (IGKV3-11)
QQRSNWPMYT

SEQ ID NO: 11354 - protein, 11 aa, Homo sapiens
  Heavy chain CDR3 for antibody 5677 (IGHV1-24)
ATYFGSGSLDY

SEQ ID NO: 11355 - protein, 9 aa, Homo sapiens
  Light chain CDR3 for antibody 5678 (IGKV1D-13)
QQFNNYPYT

SEQ ID NO: 11356 - protein, 20 aa, Homo sapiens
  Heavy chain CDR3 for antibody 5678 (IGHV3-33)
ARDPAQLERRYYYFYYGMDV

SEQ ID NO: 11357 - protein, 8 aa, Homo sapiens
  Light chain CDR3 for antibody 5679 (IGKV3D-7)
QQDYNLLT

SEQ ID NO: 11358 - protein, 23 aa, Homo sapiens
  Heavy chain CDR3 for antibody 5679 (IGHV3-11)
ARDEGVTMVRGVISYYYYYGMDV

SEQ ID NO: 11359 - protein, 9 aa, Homo sapiens
  Light chain CDR3 for antibody 5680 (IGKV1-27)
QKYNSAPYT

SEQ ID NO: 11360 - protein, 11 aa, Homo sapiens
  Heavy chain CDR3 for antibody 5680 (IGHV3-74)
ARDRGNWGFDY

SEQ ID NO: 11361 - protein, 9 aa, Homo sapiens
  Light chain CDR3 for antibody 5681 (IGKV1-17)
LQHNSYPPT

SEQ ID NO: 11362 - protein, 11 aa, Homo sapiens
  Heavy chain CDR3 for antibody 5681 (IGHV3-23)
GEFSSGWSFDY

SEQ ID NO: 11363 - protein, 9 aa, Homo sapiens
  Light chain CDR3 for antibody 5682 (IGKV1-9)
QQLISYPLT

SEQ ID NO: 11364 - protein, 11 aa, Homo sapiens
  Heavy chain CDR3 for antibody 5682 (IGHV3-33)
ARDRATATVDY

SEQ ID NO: 11365 - protein, 9 aa, Homo sapiens
  Light chain CDR3 for antibody 5683 (IGKV1-39)
QQSYSTPLT

SEQ ID NO: 11366 - protein, 12 aa, Homo sapiens
  Heavy chain CDR3 for antibody 5683 (IGHV3-33)
ARGGIAVDVCDI

SEQ ID NO: 11367 - protein, 9 aa, Homo sapiens
  Light chain CDR3 for antibody 5684 (IGKV1-9)
QQLISYPLT

SEQ ID NO: 11368 - protein, 20 aa, Homo sapiens
  Heavy chain CDR3 for antibody 5684 (IGHV3-33)
ARDRCSSTSCYGYYYYGMDV

SEQ ID NO: 11369 - protein, 9 aa, Homo sapiens
  Light chain CDR3 for antibody 5685 (IGKV3-15)
QQYNNWPYT

SEQ ID NO: 11370 - protein, 16 aa, Homo sapiens
  Heavy chain CDR3 for antibody 5685 (IGHV4-59)
ARGRYFDWLLGDVFDI

SEQ ID NO: 11371 - protein, 8 aa, Homo sapiens
  Light chain CDR3 for antibody 5686 (IGKV3-11)
QQRSNWLT

SEQ ID NO: 11372 - protein, 13 aa, Homo sapiens
  Heavy chain CDR3 for antibody 5686 (IGHV3-11)
ARDGGAAAGTWDS

SEQ ID NO: 11373 - protein, 10 aa, Homo sapiens
  Light chain CDR3 for antibody 5687 (IGKV1-9)
QQLDSYPMYT

SEQ ID NO: 11374 - protein, 11 aa, Homo sapiens
  Heavy chain CDR3 for antibody 5687 (IGHV4-59)
AREMGHDTFDI

SEQ ID NO: 11375 - protein, 9 aa, Homo sapiens
  Light chain CDR3 for antibody 5688 (IGKV6-21)
HQSSSLPYT

SEQ ID NO: 11376 - protein, 10 aa, Homo sapiens
  Heavy chain CDR3 for antibody 5688 (IGHV3-23)
AKENWNDFDY

SEQ ID NO: 11377 - protein, 9 aa, Homo sapiens
  Light chain CDR3 for antibody 5689 (IGKV3D-7)
QQDYNLPLT

SEQ ID NO: 11378 - protein, 15 aa, Homo sapiens
  Heavy chain CDR3 for antibody 5689 (IGHV3-23)
AKEFTMVRGVITPDY

SEQ ID NO: 11379 - protein, 9 aa, Homo sapiens
  Light chain CDR3 for antibody 5690 (IGKV3D-7)
QQYHNWPLT

SEQ ID NO: 11380 - protein, 12 aa, Homo sapiens
  Heavy chain CDR3 for antibody 5690 (IGHV1-46)
ARGLTGDHAFDI

SEQ ID NO: 11381 - protein, 9 aa, Homo sapiens
  Light chain CDR3 for antibody 5691 (IGKV1-27)
QKYNSAPYT

SEQ ID NO: 11382 - protein, 15 aa, Homo sapiens
  Heavy chain CDR3 for antibody 5691 (IGHV3-33)
ARDALAVTGTGWFDP

SEQ ID NO: 11383 - protein, 9 aa, Homo sapiens
  Light chain CDR3 for antibody 5692 (IGKV3-11)
QQRINWPWT

SEQ ID NO: 11384 - protein, 9 aa, Homo sapiens
  Heavy chain CDR3 for antibody 5692 (IGHV3-30)
ARPNWGFDY

SEQ ID NO: 11385 - protein, 8 aa, Homo sapiens
  Light chain CDR3 for antibody 5693 (IGKV1-5)
QQYNSYWT

SEQ ID NO: 11386 - protein, 14 aa, Homo sapiens
  Heavy chain CDR3 for antibody 5693 (IGHV3-33)
AREDYYGPLNWFDP

SEQ ID NO: 11387 - protein, 8 aa, Homo sapiens
  Light chain CDR3 for antibody 5694 (IGKV6-21)
HQSSSLPT

SEQ ID NO: 11388 - protein, 9 aa, Homo sapiens
  Heavy chain CDR3 for antibody 5694 (IGHV1-18)
ARGKDWFDP

SEQ ID NO: 11389 - protein, 9 aa, Homo sapiens
  Light chain CDR3 for antibody 5695 (IGKV1-16)
QQYNSYPYT

SEQ ID NO: 11390 - protein, 20 aa, Homo sapiens
  Heavy chain CDR3 for antibody 5695 (IGHV3-33)
ARTMGSGSYYKAYYYYVMDV

SEQ ID NO: 11391 - protein, 9 aa, Homo sapiens
  Light chain CDR3 for antibody 5696 (IGKV1-6)
LQDYNYPYT

SEQ ID NO: 11392 - protein, 14 aa, Homo sapiens
  Heavy chain CDR3 for antibody 5696 (IGHV3-33)
ARDDILTGYSYFQH

SEQ ID NO: 11393 - protein, 9 aa, Homo sapiens
  Light chain CDR3 for antibody 5697 (IGKV3-11)
QQRSNWPLT

SEQ ID NO: 11394 - protein, 15 aa, Homo sapiens
  Heavy chain CDR3 for antibody 5697 (IGHV3-23)
AKDRDYDFLSGPFDY

SEQ ID NO: 11395 - protein, 9 aa, Homo sapiens
  Light chain CDR3 for antibody 5698 (IGKV1D-13)
QRFNNYLYT

SEQ ID NO: 11396 - protein, 15 aa, Homo sapiens
  Heavy chain CDR3 for antibody 5698 (IGHV3-30)
ARRGYGSGSPDAFDL

SEQ ID NO: 11397 - protein, 8 aa, Homo sapiens
  Light chain CDR3 for antibody 5699 (IGKV3-11)
LQRGNWPT

SEQ ID NO: 11398 - protein, 15 aa, Homo sapiens
  Heavy chain CDR3 for antibody 5699 (IGHV3-20)
ARDRGSSGWRDWFDP

SEQ ID NO: 11399 - protein, 9 aa, Homo sapiens
  Light chain CDR3 for antibody 5700 (IGKV1D-16)
QQLNSYPLT

SEQ ID NO: 11400 - protein, 8 aa, Homo sapiens
  Heavy chain CDR3 for antibody 5700 (IGHV3-20)
APHWIFDY

SEQ ID NO: 11401 - protein, 8 aa, Homo sapiens
  Light chain CDR3 for antibody 5701 (IGKV6-21)
HQSSSLPT

SEQ ID NO: 11402 - protein, 13 aa, Homo sapiens
  Heavy chain CDR3 for antibody 5701 (IGHV3-23)
ARAFFMVRGVIDF

SEQ ID NO: 11403 - protein, 9 aa, Homo sapiens
  Light chain CDR3 for antibody 5702 (IGKV3-11)
QQRSNWPLT

SEQ ID NO: 11404 - protein, 18 aa, Homo sapiens
  Heavy chain CDR3 for antibody 5702 (IGHV1-18)
ARDPTFYYVSGSYYKFDY

SEQ ID NO: 11405 - protein, 9 aa, Homo sapiens
  Light chain CDR3 for antibody 5703 (IGKV1-9)
QQLKSYLYT

SEQ ID NO: 11406 - protein, 17 aa, Homo sapiens
  Heavy chain CDR3 for antibody 5703 (IGHV1-18)
TTVVLYYDILPGYSFDY

SEQ ID NO: 11407 - protein, 9 aa, Homo sapiens
  Light chain CDR3 for antibody 5704 (IGKV3-15)
QQYNNWPRT

SEQ ID NO: 11408 - protein, 12 aa, Homo sapiens
  Heavy chain CDR3 for antibody 5704 (IGHV1-46)
AREDYDIDGMDV

SEQ ID NO: 11409 - protein, 9 aa, Homo sapiens
  Light chain CDR3 for antibody 5705 (IGKV5-2)
LQHDKFPYT

SEQ ID NO: 11410 - protein, 14 aa, Homo sapiens
  Heavy chain CDR3 for antibody 5705 (IGHV3-23)
VRDRIAAASSDFDN

SEQ ID NO: 11411 - protein, 9 aa, Homo sapiens
  Light chain CDR3 for antibody 5706 (IGKV1-39)
QQSYSTPYT

SEQ ID NO: 11412 - protein, 17 aa, Homo sapiens
  Heavy chain CDR3 for antibody 5706 (IGHV3-33)
ARDWFGELSDYYYGMDV

SEQ ID NO: 11413 - protein, 10 aa, Homo sapiens
  Light chain CDR3 for antibody 5707 (IGKV1-9)
QQLDSYPMYT

SEQ ID NO: 11414 - protein, 13 aa, Homo sapiens
  Heavy chain CDR3 for antibody 5707 (IGHV4-34)
ASNFYYYYYGMDV

SEQ ID NO: 11415 - protein, 9 aa, Homo sapiens
  Light chain CDR3 for antibody 5708 (IGKV1-9)
QQVKSYPYT

SEQ ID NO: 11416 - protein, 16 aa, Homo sapiens
  Heavy chain CDR3 for antibody 5708 (IGHV1-46)
ARGRYFEWLLGDVFDI

SEQ ID NO: 11417 - protein, 9 aa, Homo sapiens
  Light chain CDR3 for antibody 5709 (IGKV3-20)
QQYGSSPYT

SEQ ID NO: 11418 - protein, 16 aa, Homo sapiens
  Heavy chain CDR3 for antibody 5709 (IGHV4-59)
AREGYNWNDGVNWFDP

SEQ ID NO: 11419 - protein, 10 aa, Homo sapiens
  Light chain CDR3 for antibody 5710 (IGKV1-9)
QQLDSYPMYT

SEQ ID NO: 11420 - protein, 15 aa, Homo sapiens
  Heavy chain CDR3 for antibody 5710 (IGHV3-30)
ARGAMVRGVDYGMDV

SEQ ID NO: 11421 - protein, 9 aa, Homo sapiens
  Light chain CDR3 for antibody 5711 (IGKV3-11)
QQRSNWPLT

SEQ ID NO: 11422 - protein, 11 aa, Homo sapiens
  Heavy chain CDR3 for antibody 5711 (IGHV3-23)
ARDPGSITGDY

SEQ ID NO: 11423 - protein, 8 aa, Homo sapiens
  Light chain CDR3 for antibody 5712 (IGKV3-20)
QQYGSSFT

SEQ ID NO: 11424 - protein, 12 aa, Homo sapiens
  Heavy chain CDR3 for antibody 5712 (IGHV4-39)
ARQMVREGWFDP

SEQ ID NO: 11425 - protein, 9 aa, Homo sapiens
  Light chain CDR3 for antibody 5713 (IGKV5-2)
LQHDKFPYT

SEQ ID NO: 11426 - protein, 18 aa, Homo sapiens
  Heavy chain CDR3 for antibody 5713 (IGHV3-64)
ARDEYYYGSGSYYNYFDW

SEQ ID NO: 11427 - protein, 9 aa, Homo sapiens
  Light chain CDR3 for antibody 5714 (IGKV1-17)
LQHNSYPRT

SEQ ID NO: 11428 - protein, 18 aa, Homo sapiens
  Heavy chain CDR3 for antibody 5714 (IGHV3-33)
ARGAYSSGWDYYYYGLDV

SEQ ID NO: 11429 - protein, 9 aa, Homo sapiens
  Light chain CDR3 for antibody 5715 (IGKV1-9)
QQYNSYPLT

SEQ ID NO: 11430 - protein, 15 aa, Homo sapiens
  Heavy chain CDR3 for antibody 5715 (IGHV3-20)
AREGSSSWYLYYFDY

SEQ ID NO: 11431 - protein, 8 aa, Homo sapiens
  Light chain CDR3 for antibody 5716 (IGKV1D-13)
QQFNNYPT

SEQ ID NO: 11432 - protein, 14 aa, Homo sapiens
  Heavy chain CDR3 for antibody 5716 (IGHV1-18)
ARCFGSGSYGWFDP

SEQ ID NO: 11433 - protein, 10 aa, Homo sapiens
  Light chain CDR3 for antibody 5717 (IGKV3-15)
QQYNNWPPLT

SEQ ID NO: 11434 - protein, 8 aa, Homo sapiens
  Heavy chain CDR3 for antibody 5717 (IGHV3-23)
AKETGNNY

SEQ ID NO: 11435 - protein, 9 aa, Homo sapiens
  Light chain CDR3 for antibody 5718 (IGKV1D-13)
QHFNNYMYT

SEQ ID NO: 11436 - protein, 16 aa, Homo sapiens
  Heavy chain CDR3 for antibody 5718 (IGHV4-59)
ARYSGSYYGDYYGMDV

SEQ ID NO: 11437 - protein, 9 aa, Homo sapiens
  Light chain CDR3 for antibody 5719 (IGKV1-16)
QHYNDYPFT

SEQ ID NO: 11438 - protein, 13 aa, Homo sapiens
  Heavy chain CDR3 for antibody 5719 (IGHV3-23)
ARAFTMVRGVIDY

SEQ ID NO: 11439 - protein, 9 aa, Homo sapiens
  Light chain CDR3 for antibody 5720 (IGKV3-15)
QQYNNWPLT

SEQ ID NO: 11440 - protein, 9 aa, Homo sapiens
  Heavy chain CDR3 for antibody 5720 (IGHV1-18)
ARGGWGFEY

SEQ ID NO: 11441 - protein, 9 aa, Homo sapiens
  Light chain CDR3 for antibody 5721 (IGKV1-17)
LQHNSYPWT

SEQ ID NO: 11442 - protein, 11 aa, Homo sapiens
  Heavy chain CDR3 for antibody 5721 (IGHV4-59)
ARETGDDAFDI

SEQ ID NO: 11443 - protein, 9 aa, Homo sapiens
  Light chain CDR3 for antibody 5722 (IGKV1D-16)
QQYNSYPLT

SEQ ID NO: 11444 - protein, 22 aa, Homo sapiens
  Heavy chain CDR3 for antibody 5722 (IGHV3-33)
ARMYYDILTGYYKDYYYYGMDV

SEQ ID NO: 11445 - protein, 9 aa, Homo sapiens
  Light chain CDR3 for antibody 5723 (IGKV3-11)
QQRSNWMYT

SEQ ID NO: 11446 - protein, 20 aa, Homo sapiens
  Heavy chain CDR3 for antibody 5723 (IGHV3-23)
AKDREMAATSHYYYYYGMDV

SEQ ID NO: 11447 - protein, 9 aa, Homo sapiens
  Light chain CDR3 for antibody 5724 (IGKV6-21)
HQSSSLPLT

SEQ ID NO: 11448 - protein, 13 aa, Homo sapiens
  Heavy chain CDR3 for antibody 5724 (IGHV3-33)
TRRIAVAGAEGDY

SEQ ID NO: 11449 - protein, 9 aa, Homo sapiens
  Light chain CDR3 for antibody 5725 (IGKV1-9)
QQLNSYPLT

SEQ ID NO: 11450 - protein, 12 aa, Homo sapiens
  Heavy chain CDR3 for antibody 5725 (IGHV3-33)
ARAGMGAPYFDY

SEQ ID NO: 11451 - protein, 9 aa, Homo sapiens
  Light chain CDR3 for antibody 5726 (IGKV3D-7)
QQDYNLPLT

SEQ ID NO: 11452 - protein, 11 aa, Homo sapiens
  Heavy chain CDR3 for antibody 5726 (IGHV3-23)
AKAGIVGCLDV

SEQ ID NO: 11453 - protein, 9 aa, Homo sapiens
  Light chain CDR3 for antibody 5727 (IGKV1-39)
QQSYSTPLT

SEQ ID NO: 11454 - protein, 15 aa, Homo sapiens
  Heavy chain CDR3 for antibody 5727 (IGHV1-24)
ATHWDLRYYYYGMDV

SEQ ID NO: 11455 - protein, 9 aa, Homo sapiens
  Light chain CDR3 for antibody 5728 (IGKV1D-16)
QQYNSYPFT

SEQ ID NO: 11456 - protein, 12 aa, Homo sapiens
  Heavy chain CDR3 for antibody 5728 (IGHV4-28)
ARKDSGYDWFDY

SEQ ID NO: 11457 - protein, 9 aa, Homo sapiens
  Light chain CDR3 for antibody 5729 (IGKV6-21)
HQSSSLPYT

SEQ ID NO: 11458 - protein, 17 aa, Homo sapiens
  Heavy chain CDR3 for antibody 5729 (IGHV3-23)
AKERNWNDGYYYYGMDV

SEQ ID NO: 11459 - protein, 9 aa, Homo sapiens
  Light chain CDR3 for antibody 5730 (IGKV3-15)
QQYNNWPLT

SEQ ID NO: 11460 - protein, 12 aa, Homo sapiens
  Heavy chain CDR3 for antibody 5730 (IGHV3-33)
ARVDAAAPYFDY

SEQ ID NO: 11461 - protein, 9 aa, Homo sapiens
  Light chain CDR3 for antibody 5731 (IGKV3-15)
QQYNNWPLT

SEQ ID NO: 11462 - protein, 13 aa, Homo sapiens
  Heavy chain CDR3 for antibody 5731 (IGHV3-66)
ANTGDSYYYGFYV

SEQ ID NO: 11463 - protein, 9 aa, Homo sapiens
  Light chain CDR3 for antibody 5732 (IGKV1-9)
QQLISYPLT

SEQ ID NO: 11464 - protein, 13 aa, Homo sapiens
  Heavy chain CDR3 for antibody 5732 (IGHV3-53)
ARSGSYWGYYFDY

SEQ ID NO: 11465 - protein, 9 aa, Homo sapiens
  Light chain CDR3 for antibody 5733 (IGKV3D-20)
QQYGSSPRT

SEQ ID NO: 11466 - protein, 6 aa, Homo sapiens
  Heavy chain CDR3 for antibody 5733 (IGHV1-8)
AREGTY

SEQ ID NO: 11467 - protein, 9 aa, Homo sapiens
  Light chain CDR3 for antibody 5734 (IGKV6-21)
HQSSSLPYT

SEQ ID NO: 11468 - protein, 14 aa, Homo sapiens
  Heavy chain CDR3 for antibody 5734 (IGHV1-18)
AREGGSYFYYGVDV

SEQ ID NO: 11469 - protein, 9 aa, Homo sapiens
  Light chain CDR3 for antibody 5735 (IGKV1-9)
QQLNTYPYT

SEQ ID NO: 11470 - protein, 16 aa, Homo sapiens
  Heavy chain CDR3 for antibody 5735 (IGHV3-23)
AKEGMVLRYFDWFWDY

SEQ ID NO: 11471 - protein, 9 aa, Homo sapiens
  Light chain CDR3 for antibody 5736 (IGKV1-17)
LQHNSYPWT

SEQ ID NO: 11472 - protein, 16 aa, Homo sapiens
  Heavy chain CDR3 for antibody 5736 (IGHV3-33)
ARAPGGDYYFYFGMDV

SEQ ID NO: 11473 - protein, 9 aa, Homo sapiens
  Light chain CDR3 for antibody 5737 (IGKV1-6)
LQDYNHPFT

SEQ ID NO: 11474 - protein, 11 aa, Homo sapiens
  Heavy chain CDR3 for antibody 5737 (IGHV3-33)
ARGSGSYAFDY

SEQ ID NO: 11475 - protein, 9 aa, Homo sapiens
  Light chain CDR3 for antibody 5738 (IGKV5-2)
LQHDNFPYT

SEQ ID NO: 11476 - protein, 11 aa, Homo sapiens
  Heavy chain CDR3 for antibody 5738 (IGHV3-33)
ARDILTGYFDY

SEQ ID NO: 11477 - protein, 9 aa, Homo sapiens
  Light chain CDR3 for antibody 5739 (IGKV1D-13)
LQDYNYPYT

SEQ ID NO: 11478 - protein, 14 aa, Homo sapiens
  Heavy chain CDR3 for antibody 5739 (IGHV3-33)
ARDDYVSGSYYFDY

SEQ ID NO: 11479 - protein, 9 aa, Homo sapiens
  Light chain CDR3 for antibody 5740 (IGKV2-30)
MQGTHWPLT

SEQ ID NO: 11480 - protein, 14 aa, Homo sapiens
  Heavy chain CDR3 for antibody 5740 (IGHV3-33)
ARDREQQLVRYFDY

SEQ ID NO: 11481 - protein, 10 aa, Homo sapiens
  Light chain CDR3 for antibody 5741 (IGKV3-20)
QQYGRSPPVT

SEQ ID NO: 11482 - protein, 8 aa, Homo sapiens
  Heavy chain CDR3 for antibody 5741 (IGHV3-23)
AKETGNNY

SEQ ID NO: 11483 - protein, 9 aa, Homo sapiens
  Light chain CDR3 for antibody 5742 (IGKV1-27)
QKYNSAPYT

SEQ ID NO: 11484 - protein, 12 aa, Homo sapiens
  Heavy chain CDR3 for antibody 5742 (IGHV3-33)
ARKQWLVQAFDI

SEQ ID NO: 11485 - protein, 10 aa, Homo sapiens
  Light chain CDR3 for antibody 5743 (IGKV3-11)
QQRSNWPIFT

SEQ ID NO: 11486 - protein, 8 aa, Homo sapiens
  Heavy chain CDR3 for antibody 5743 (IGHV3-23)
AKEAGSDY

SEQ ID NO: 11487 - protein, 9 aa, Homo sapiens
  Light chain CDR3 for antibody 5744 (IGKV1-6)
LQDYNYPWT

SEQ ID NO: 11488 - protein, 14 aa, Homo sapiens
  Heavy chain CDR3 for antibody 5744 (IGHV3-33)
ARASSGSSYWYFDL

SEQ ID NO: 11489 - protein, 10 aa, Homo sapiens
  Light chain CDR3 for antibody 5745 (IGKV3-15)
QQYNNWPPLT

SEQ ID NO: 11490 - protein, 16 aa, Homo sapiens
  Heavy chain CDR3 for antibody 5745 (IGHV3-33)
ARGGRSDWLYYYGMDV

SEQ ID NO: 11491 - protein, 9 aa, Homo sapiens
  Light chain CDR3 for antibody 5746 (IGKV1D-16)
QQYYSYPRT

SEQ ID NO: 11492 - protein, 15 aa, Homo sapiens
  Heavy chain CDR3 for antibody 5746 (IGHV3-66)
ARDRDYYYYYYGMDV

SEQ ID NO: 11493 - protein, 9 aa, Homo sapiens
  Light chain CDR3 for antibody 5747 (IGKV1D-13)
QQFNNYPYT

SEQ ID NO: 11494 - protein, 14 aa, Homo sapiens
  Heavy chain CDR3 for antibody 5747 (IGHV3-23)
AKDGGWNYYYGMDV

SEQ ID NO: 11495 - protein, 9 aa, Homo sapiens
  Light chain CDR3 for antibody 5748 (IGKV1-17)
LQHNSYPWT

SEQ ID NO: 11496 - protein, 12 aa, Homo sapiens
  Heavy chain CDR3 for antibody 5748 (IGHV3-33)
ARDGPVAGLFDY

SEQ ID NO: 11497 - protein, 10 aa, Homo sapiens
  Light chain CDR3 for antibody 5749 (IGKV1-17)
LQHNSYPMYT

SEQ ID NO: 11498 - protein, 12 aa, Homo sapiens
  Heavy chain CDR3 for antibody 5749 (IGHV3-23)
AKEYDILTGYFH

SEQ ID NO: 11499 - protein, 9 aa, Homo sapiens
  Light chain CDR3 for antibody 5750 (IGKV3-15)
QQYNNWPRT

SEQ ID NO: 11500 - protein, 12 aa, Homo sapiens
  Heavy chain CDR3 for antibody 5750 (IGHV3-33)
ARDRAYRGSLDY

SEQ ID NO: 11501 - protein, 9 aa, Homo sapiens
  Light chain CDR3 for antibody 5751 (IGKV3-11)
QQRSNWPWT

SEQ ID NO: 11502 - protein, 18 aa, Homo sapiens
  Heavy chain CDR3 for antibody 5751 (IGHV4-39)
ARQYYFGSGNYYRGWFDP

SEQ ID NO: 11503 - protein, 9 aa, Homo sapiens
  Light chain CDR3 for antibody 5752 (IGKV1D-13)
QQFNNYPHT

SEQ ID NO: 11504 - protein, 18 aa, Homo sapiens
  Heavy chain CDR3 for antibody 5752 (IGHV1-18)
ARDPNYYGSGSYYNYFDY

SEQ ID NO: 11505 - protein, 8 aa, Homo sapiens
  Light chain CDR3 for antibody 5753 (IGKV1D-13)
QQFNNYPT

SEQ ID NO: 11506 - protein, 12 aa, Homo sapiens
  Heavy chain CDR3 for antibody 5753 (IGHV3-33)
ARVDTAAPYFDY

SEQ ID NO: 11507 - protein, 8 aa, Homo sapiens
  Light chain CDR3 for antibody 5754 (IGKV1-9)
QQFNSYPT

SEQ ID NO: 11508 - protein, 13 aa, Homo sapiens
  Heavy chain CDR3 for antibody 5754 (IGHV4-59)
ARDVTGTTSGFDY

SEQ ID NO: 11509 - protein, 9 aa, Homo sapiens
  Light chain CDR3 for antibody 5755 (IGKV3-20)
QQYGSSPYT

SEQ ID NO: 11510 - protein, 16 aa, Homo sapiens
  Heavy chain CDR3 for antibody 5755 (IGHV3-33)
AKDAFYYGSGSHLFDY

SEQ ID NO: 11511 - protein, 9 aa, Homo sapiens
  Light chain CDR3 for antibody 5756 (IGKV1-9)
QQLNTYPWT

SEQ ID NO: 11512 - protein, 14 aa, Homo sapiens
  Heavy chain CDR3 for antibody 5756 (IGHV3-33)
ARDWNDVYYYGMDV

SEQ ID NO: 11513 - protein, 9 aa, Homo sapiens
  Light chain CDR3 for antibody 5757 (IGKV3-20)
QQYGSSPYT

SEQ ID NO: 11514 - protein, 17 aa, Homo sapiens
  Heavy chain CDR3 for antibody 5757 (IGHV3-23)
SKERNWNDGYYYFGMDA

SEQ ID NO: 11515 - protein, 9 aa, Homo sapiens
  Light chain CDR3 for antibody 5758 (IGKV1-6)
LQDYNYPWT

SEQ ID NO: 11516 - protein, 11 aa, Homo sapiens
  Heavy chain CDR3 for antibody 5758 (IGHV3-23)
AKAGIVGCLDV

SEQ ID NO: 11517 - protein, 9 aa, Homo sapiens
  Light chain CDR3 for antibody 5759 (IGKV1D-16)
QQYNSYPYT

SEQ ID NO: 11518 - protein, 17 aa, Homo sapiens
  Heavy chain CDR3 for antibody 5759 (IGHV3-33)
AKGISVADYYYYYAFDV

SEQ ID NO: 11519 - protein, 9 aa, Homo sapiens
  Light chain CDR3 for antibody 5760 (IGKV3D-7)
QQDYNLPYT

SEQ ID NO: 11520 - protein, 18 aa, Homo sapiens
  Heavy chain CDR3 for antibody 5760 (IGHV3-33)
ARREGITLIFYYYYGMDV

SEQ ID NO: 11521 - protein, 10 aa, Homo sapiens
  Light chain CDR3 for antibody 5761 (IGKV3-15)
QQYNNWPPLT

SEQ ID NO: 11522 - protein, 15 aa, Homo sapiens
  Heavy chain CDR3 for antibody 5761 (IGHV3-33)
ARDRGWKAPGYGMDV

SEQ ID NO: 11523 - protein, 8 aa, Homo sapiens
  Light chain CDR3 for antibody 5762 (IGKV3-20)
QQYGSSFT

SEQ ID NO: 11524 - protein, 17 aa, Homo sapiens
  Heavy chain CDR3 for antibody 5762 (IGHV3-33)
ARESLKLGIYYYYGMDV

SEQ ID NO: 11525 - protein, 9 aa, Homo sapiens
  Light chain CDR3 for antibody 5763 (IGKV5-2)
LQHDNFPYT

SEQ ID NO: 11526 - protein, 13 aa, Homo sapiens
  Heavy chain CDR3 for antibody 5763 (IGHV1-18)
ARGGGVRGAPLDY

SEQ ID NO: 11527 - protein, 8 aa, Homo sapiens
  Light chain CDR3 for antibody 5764 (IGKV3-20)
QQYGRSFT

SEQ ID NO: 11528 - protein, 12 aa, Homo sapiens
  Heavy chain CDR3 for antibody 5764 (IGHV4-59)
ARDRSGWAYFDY

SEQ ID NO: 11529 - protein, 8 aa, Homo sapiens
  Light chain CDR3 for antibody 5765 (IGKV1D-13)
QQFNNYPT

SEQ ID NO: 11530 - protein, 18 aa, Homo sapiens
  Heavy chain CDR3 for antibody 5765 (IGHV3-23)
AKEGNYYGSGSYWGYFDP

SEQ ID NO: 11531 - protein, 9 aa, Homo sapiens
  Light chain CDR3 for antibody 5766 (IGKV1-16)
QHYNDYPFT

SEQ ID NO: 11532 - protein, 18 aa, Homo sapiens
  Heavy chain CDR3 for antibody 5766 (IGHV3-33)
ARDRDRYGSGTYPDAIDI

SEQ ID NO: 11533 - protein, 10 aa, Homo sapiens
  Light chain CDR3 for antibody 5767 (IGKV3-11)
QQRSNWPILT

SEQ ID NO: 11534 - protein, 13 aa, Homo sapiens
  Heavy chain CDR3 for antibody 5767 (IGHV3-21)
ARDSTLVRGVFPY

SEQ ID NO: 11535 - protein, 10 aa, Homo sapiens
  Light chain CDR3 for antibody 5768 (IGKV3-11)
QQRSNWPIFT

SEQ ID NO: 11536 - protein, 11 aa, Homo sapiens
  Heavy chain CDR3 for antibody 5768 (IGHV3-33)
ARDTWDDYFDY

SEQ ID NO: 11537 - protein, 9 aa, Homo sapiens
  Light chain CDR3 for antibody 5769 (IGKV1-9)
QQLKSYLYT

SEQ ID NO: 11538 - protein, 23 aa, Homo sapiens
  Heavy chain CDR3 for antibody 5769 (IGHV1-18)
ARNLHYDILTGYFPYYFYYGMDV

SEQ ID NO: 11539 - protein, 9 aa, Homo sapiens
  Light chain CDR3 for antibody 5770 (IGKV1-17)
LQHNSYPYT

SEQ ID NO: 11540 - protein, 14 aa, Homo sapiens
  Heavy chain CDR3 for antibody 5770 (IGHV3-33)
AREMVRGVPNWFDP

SEQ ID NO: 11541 - protein, 10 aa, Homo sapiens
  Light chain CDR3 for antibody 5771 (IGKV1-17)
LQHNSYPMYT

SEQ ID NO: 11542 - protein, 16 aa, Homo sapiens
  Heavy chain CDR3 for antibody 5771 (IGHV3-33)
ARGYDMLTGDYYGMDV

SEQ ID NO: 11543 - protein, 9 aa, Homo sapiens
  Light chain CDR3 for antibody 5772 (IGKV1-39)
QQSYSTPLT

SEQ ID NO: 11544 - protein, 12 aa, Homo sapiens
  Heavy chain CDR3 for antibody 5772 (IGHV3-33)
ARDLVRGIRMDV

SEQ ID NO: 11545 - protein, 9 aa, Homo sapiens
  Light chain CDR3 for antibody 5773 (IGKV1-17)
LQHNSYPRT

SEQ ID NO: 11546 - protein, 19 aa, Homo sapiens
  Heavy chain CDR3 for antibody 5773 (IGHV4-39)
ARQGDVLRYFDWLLGAFDI

SEQ ID NO: 11547 - protein, 9 aa, Homo sapiens
  Light chain CDR3 for antibody 5774 (IGKV1-6)
LQDYNYPLT

SEQ ID NO: 11548 - protein, 10 aa, Homo sapiens
  Heavy chain CDR3 for antibody 5774 (IGHV3-33)
VRMTTVIFDY

SEQ ID NO: 11549 - protein, 9 aa, Homo sapiens
  Light chain CDR3 for antibody 5775 (IGKV1-9)
QQGNTYSRT

SEQ ID NO: 11550 - protein, 13 aa, Homo sapiens
  Heavy chain CDR3 for antibody 5775 (IGHV4-59)
ARREVVGGRGFDY

SEQ ID NO: 11551 - protein, 9 aa, Homo sapiens
  Light chain CDR3 for antibody 5776 (IGKV3D-7)
QQDYNLPYT

SEQ ID NO: 11552 - protein, 18 aa, Homo sapiens
  Heavy chain CDR3 for antibody 5776 (IGHV3-33)
VREGGYYGSGSYPDAFDI

SEQ ID NO: 11553 - protein, 9 aa, Homo sapiens
  Light chain CDR3 for antibody 5777 (IGKV1-16)
QQYNSYPYT

SEQ ID NO: 11554 - protein, 11 aa, Homo sapiens
  Heavy chain CDR3 for antibody 5777 (IGHV3-33)
AREAANWGFDY

SEQ ID NO: 11555 - protein, 9 aa, Homo sapiens
  Light chain CDR3 for antibody 5778 (IGKV2D-28)
MQVLQTPFT

SEQ ID NO: 11556 - protein, 12 aa, Homo sapiens
  Heavy chain CDR3 for antibody 5778 (IGHV4-39)
ARHGSGSSYFDY

SEQ ID NO: 11557 - protein, 8 aa, Homo sapiens
  Light chain CDR3 for antibody 5779 (IGKV1-5)
QQYNSYYT

SEQ ID NO: 11558 - protein, 12 aa, Homo sapiens
  Heavy chain CDR3 for antibody 5779 (IGHV3-33)
ARDSSGWSHFDY

SEQ ID NO: 11559 - protein, 9 aa, Homo sapiens
  Light chain CDR3 for antibody 5780 (IGKV1-6)
LQDYKSPFT

SEQ ID NO: 11560 - protein, 12 aa, Homo sapiens
  Heavy chain CDR3 for antibody 5780 (IGHV3-23)
AKEYDILTGYFH

SEQ ID NO: 11561 - protein, 9 aa, Homo sapiens
  Light chain CDR3 for antibody 5781 (IGKV3D-7)
QQDYEFPLT

SEQ ID NO: 11562 - protein, 11 aa, Homo sapiens
  Heavy chain CDR3 for antibody 5781 (IGHV4-59)
TRDRGLGSFDY

SEQ ID NO: 11563 - protein, 9 aa, Homo sapiens
  Light chain CDR3 for antibody 5782 (IGKV6-21)
HQSSSLPYT

SEQ ID NO: 11564 - protein, 10 aa, Homo sapiens
  Heavy chain CDR3 for antibody 5782 (IGHV1-18)
ARGPTSDVDY

SEQ ID NO: 11565 - protein, 9 aa, Homo sapiens
  Light chain CDR3 for antibody 5783 (IGKV3D-20)
QQYGSGPWT

SEQ ID NO: 11566 - protein, 13 aa, Homo sapiens
  Heavy chain CDR3 for antibody 5783 (IGHV3-33)
ARTDYYFYYGLDV

SEQ ID NO: 11567 - protein, 9 aa, Homo sapiens
  Light chain CDR3 for antibody 5784 (IGKV1-27)
QKYNSAPYT

SEQ ID NO: 11568 - protein, 11 aa, Homo sapiens
  Heavy chain CDR3 for antibody 5784 (IGHV3-33)
ARGSGSYAFDY

SEQ ID NO: 11569 - protein, 9 aa, Homo sapiens
  Light chain CDR3 for antibody 5785 (IGKV1-9)
QQLNSYPLT

SEQ ID NO: 11570 - protein, 17 aa, Homo sapiens
  Heavy chain CDR3 for antibody 5785 (IGHV3-33)
VREGGLLWVGELALFDY

SEQ ID NO: 11571 - protein, 9 aa, Homo sapiens
  Light chain CDR3 for antibody 5786 (IGKV1D-13)
QQFNNYPYT

SEQ ID NO: 11572 - protein, 17 aa, Homo sapiens
  Heavy chain CDR3 for antibody 5786 (IGHV3-23)
AKDTITMVRGALFGMDV

SEQ ID NO: 11573 - protein, 9 aa, Homo sapiens
  Light chain CDR3 for antibody 5787 (IGKV3-11)
QQRSNWMYT

SEQ ID NO: 11574 - protein, 13 aa, Homo sapiens
  Heavy chain CDR3 for antibody 5787 (IGHV3-33)
ARIDYYSYYGMDV

SEQ ID NO: 11575 - protein, 9 aa, Homo sapiens
  Light chain CDR3 for antibody 5788 (IGKV5-2)
LQHDNFPYT

SEQ ID NO: 11576 - protein, 12 aa, Homo sapiens
  Heavy chain CDR3 for antibody 5788 (IGHV1-18)
ARVLFDGDYFDY

SEQ ID NO: 11577 - protein, 9 aa, Homo sapiens
  Light chain CDR3 for antibody 5789 (IGKV1D-13)
QQFNNYPHT

SEQ ID NO: 11578 - protein, 14 aa, Homo sapiens
  Heavy chain CDR3 for antibody 5789 (IGHV3-23)
ARDLNYDILNGGGY

SEQ ID NO: 11579 - protein, 9 aa, Homo sapiens
  Light chain CDR3 for antibody 5790 (IGKV1-17)
LQHNSYPRT

SEQ ID NO: 11580 - protein, 18 aa, Homo sapiens
  Heavy chain CDR3 for antibody 5790 (IGHV4-59)
ARDNHYYSSGTYSNWFDP

SEQ ID NO: 11581 - protein, 9 aa, Homo sapiens
  Light chain CDR3 for antibody 5791 (IGKV6-21)
HQSSSLPYT

SEQ ID NO: 11582 - protein, 11 aa, Homo sapiens
  Heavy chain CDR3 for antibody 5791 (IGHV3-64)
ARERGSYAFDI

SEQ ID NO: 11583 - protein, 9 aa, Homo sapiens
  Light chain CDR3 for antibody 5792 (IGKV3-11)
QQRSNWPLT

SEQ ID NO: 11584 - protein, 18 aa, Homo sapiens
  Heavy chain CDR3 for antibody 5792 (IGHV3-33)
VRDRERYGSGSYPDAFDI

SEQ ID NO: 11585 - protein, 8 aa, Homo sapiens
  Light chain CDR3 for antibody 5793 (IGKV1-5)
QQYNSYWT

SEQ ID NO: 11586 - protein, 14 aa, Homo sapiens
  Heavy chain CDR3 for antibody 5793 (IGHV3-33)
ARAGSGYDRDWFDP

SEQ ID NO: 11587 - protein, 9 aa, Homo sapiens
  Light chain CDR3 for antibody 5794 (IGKV3-11)
QQRSNWPYT

SEQ ID NO: 11588 - protein, 13 aa, Homo sapiens
  Heavy chain CDR3 for antibody 5794 (IGHV3-33)
ARDSSSWYHWFDP

SEQ ID NO: 11589 - protein, 9 aa, Homo sapiens
  Light chain CDR3 for antibody 5795 (IGKV3-11)
QQRSNWMYT

SEQ ID NO: 11590 - protein, 13 aa, Homo sapiens
  Heavy chain CDR3 for antibody 5795 (IGHV4-39)
ARHPPSRDYGMDV

SEQ ID NO: 11591 - protein, 9 aa, Homo sapiens
  Light chain CDR3 for antibody 5796 (IGKV1-6)
LQDYKSPFT

SEQ ID NO: 11592 - protein, 12 aa, Homo sapiens
  Heavy chain CDR3 for antibody 5796 (IGHV3-33)
ARGYFGSGYAHF

SEQ ID NO: 11593 - protein, 10 aa, Homo sapiens
  Light chain CDR3 for antibody 5797 (IGKV1-17)
LQHNSYPMYT

SEQ ID NO: 11594 - protein, 15 aa, Homo sapiens
  Heavy chain CDR3 for antibody 5797 (IGHV1-18)
ARGYCSSTSCYYFDY

SEQ ID NO: 11595 - protein, 9 aa, Homo sapiens
  Light chain CDR3 for antibody 5798 (IGKV3-15)
QQYNNWPRT

SEQ ID NO: 11596 - protein, 10 aa, Homo sapiens
  Heavy chain CDR3 for antibody 5798 (IGHV3-33)
ARDGSGSQPI

SEQ ID NO: 11597 - protein, 9 aa, Homo sapiens
  Light chain CDR3 for antibody 5799 (IGKV1-6)
LQDYNYPWT

SEQ ID NO: 11598 - protein, 13 aa, Homo sapiens
  Heavy chain CDR3 for antibody 5799 (IGHV4-61)
ARDGSSSGWDFDY

SEQ ID NO: 11599 - protein, 9 aa, Homo sapiens
  Light chain CDR3 for antibody 5800 (IGKV1-9)
QQLNSYPWP

SEQ ID NO: 11600 - protein, 11 aa, Homo sapiens
  Heavy chain CDR3 for antibody 5800 (IGHV3-33)
ARDRSSGPFDY

SEQ ID NO: 11601 - protein, 8 aa, Homo sapiens
  Light chain CDR3 for antibody 5801 (IGKV3-11)
QQRSNWWT

SEQ ID NO: 11602 - protein, 13 aa, Homo sapiens
  Heavy chain CDR3 for antibody 5801 (IGHV3-33)
ARDWGYSHGYFDY

SEQ ID NO: 11603 - protein, 9 aa, Homo sapiens
  Light chain CDR3 for antibody 5802 (IGKV1-5)
QQYNTYSRT

SEQ ID NO: 11604 - protein, 14 aa, Homo sapiens
  Heavy chain CDR3 for antibody 5802 (IGHV3-23)
AKSRIVGALYYFDY

SEQ ID NO: 11605 - protein, 9 aa, Homo sapiens
  Light chain CDR3 for antibody 5803 (IGKV3D-20)
QQYGSSPYT

SEQ ID NO: 11606 - protein, 16 aa, Homo sapiens
  Heavy chain CDR3 for antibody 5803 (IGHV3-33)
AREVGAKDYYYYGMDV

SEQ ID NO: 11607 - protein, 9 aa, Homo sapiens
  Light chain CDR3 for antibody 5804 (IGKV3-11)
QQRINWPWT

SEQ ID NO: 11608 - protein, 11 aa, Homo sapiens
  Heavy chain CDR3 for antibody 5804 (IGHV4-4)
AREAYYYGLDV

SEQ ID NO: 11609 - protein, 9 aa, Homo sapiens
  Light chain CDR3 for antibody 5805 (IGKV2D-28)
MQALQTPPT

SEQ ID NO: 11610 - protein, 12 aa, Homo sapiens
  Heavy chain CDR3 for antibody 5805 (IGHV3-23)
AKDGWFGESLDY

SEQ ID NO: 11611 - protein, 10 aa, Homo sapiens
  Light chain CDR3 for antibody 5806 (IGKV3-20)
QQYGRSPPVT

SEQ ID NO: 11612 - protein, 12 aa, Homo sapiens
  Heavy chain CDR3 for antibody 5806 (IGHV3-33)
ARGYFGSGYAHF

SEQ ID NO: 11613 - protein, 9 aa, Homo sapiens
  Light chain CDR3 for antibody 5807 (IGKV3D-7)
QQDYNLPWT

SEQ ID NO: 11614 - protein, 14 aa, Homo sapiens
  Heavy chain CDR3 for antibody 5807 (IGHV3-20)
ARDEGSGGYDVFDI

SEQ ID NO: 11615 - protein, 9 aa, Homo sapiens
  Light chain CDR3 for antibody 5808 (IGKV1-9)
QQLISYPLT

SEQ ID NO: 11616 - protein, 13 aa, Homo sapiens
  Heavy chain CDR3 for antibody 5808 (IGHV3-33)
ARVDTMVRGVMAY

SEQ ID NO: 11617 - protein, 9 aa, Homo sapiens
  Light chain CDR3 for antibody 5809 (IGKV5-2)
LQHDNFPWT

SEQ ID NO: 11618 - protein, 10 aa, Homo sapiens
  Heavy chain CDR3 for antibody 5809 (IGHV4-34)
ARHGVAGTNY

SEQ ID NO: 11619 - protein, 9 aa, Homo sapiens
  Light chain CDR3 for antibody 5810 (IGKV3-15)
QQYNNWPLT

SEQ ID NO: 11620 - protein, 26 aa, Homo sapiens
  Heavy chain CDR3 for antibody 5810 (IGHV4-39)
ARQGLLWFGDLKAYDSSGYYYGYFHH

SEQ ID NO: 11621 - protein, 10 aa, Homo sapiens
  Light chain CDR3 for antibody 5811 (IGKV3-11)
QQRSNWPALT

SEQ ID NO: 11622 - protein, 13 aa, Homo sapiens
  Heavy chain CDR3 for antibody 5811 (IGHV1-46)
ARVKLGSLGAFDI

SEQ ID NO: 11623 - protein, 9 aa, Homo sapiens
  Light chain CDR3 for antibody 5812 (IGKV3D-7)
QQDYNLPLT

SEQ ID NO: 11624 - protein, 15 aa, Homo sapiens
  Heavy chain CDR3 for antibody 5812 (IGHV3-11)
ARDRAVAGTIHAFGI

SEQ ID NO: 11625 - protein, 9 aa, Homo sapiens
  Light chain CDR3 for antibody 5813 (IGKV5-2)
LQHDKFPYT

SEQ ID NO: 11626 - protein, 17 aa, Homo sapiens
  Heavy chain CDR3 for antibody 5813 (IGHV3-33)
ARDRDDILTGFYTYFDY

SEQ ID NO: 11627 - protein, 9 aa, Homo sapiens
  Light chain CDR3 for antibody 5814 (IGKV3-11)
QQRSNWPPT

SEQ ID NO: 11628 - protein, 17 aa, Homo sapiens
  Heavy chain CDR3 for antibody 5814 (IGHV3-33)
ARVQYDILTGYSPYFDN

SEQ ID NO: 11629 - protein, 9 aa, Homo sapiens
  Light chain CDR3 for antibody 5815 (IGKV2D-24)
TQATQFPHT

SEQ ID NO: 11630 - protein, 17 aa, Homo sapiens
  Heavy chain CDR3 for antibody 5815 (IGHV1-18)
ARDEGYDILTGYPHFDY

SEQ ID NO: 11631 - protein, 9 aa, Homo sapiens
  Light chain CDR3 for antibody 5816 (IGKV1-17)
LQQNSYPWT

SEQ ID NO: 11632 - protein, 14 aa, Homo sapiens
  Heavy chain CDR3 for antibody 5816 (IGHV4-39)
ARDSGYDYYYAMDV

SEQ ID NO: 11633 - protein, 9 aa, Homo sapiens
  Light chain CDR3 for antibody 5817 (IGKV1-33)
QQYDNLPFT

SEQ ID NO: 11634 - protein, 12 aa, Homo sapiens
  Heavy chain CDR3 for antibody 5817 (IGHV3-33)
TRGYSSKSYFDY

SEQ ID NO: 11635 - protein, 9 aa, Homo sapiens
  Light chain CDR3 for antibody 5818 (IGKV3D-7)
QQDYNLPYT

SEQ ID NO: 11636 - protein, 14 aa, Homo sapiens
  Heavy chain CDR3 for antibody 5818 (IGHV4-39)
ARDSGYDYYYAMDV

SEQ ID NO: 11637 - protein, 9 aa, Homo sapiens
  Light chain CDR3 for antibody 5819 (IGKV1D-13)
QQFNNYPRT

SEQ ID NO: 11638 - protein, 17 aa, Homo sapiens
  Heavy chain CDR3 for antibody 5819 (IGHV3-33)
AREHIVVVTAINDAFDI

SEQ ID NO: 11639 - protein, 8 aa, Homo sapiens
  Light chain CDR3 for antibody 5820 (IGKV3-11)
QQRSNWLT

SEQ ID NO: 11640 - protein, 18 aa, Homo sapiens
  Heavy chain CDR3 for antibody 5820 (IGHV3-33)
ARREGIVGATTYYYGMDV

SEQ ID NO: 11641 - protein, 9 aa, Homo sapiens
  Light chain CDR3 for antibody 5821 (IGKV3D-7)
QQDYNLPYT

SEQ ID NO: 11642 - protein, 12 aa, Homo sapiens
  Heavy chain CDR3 for antibody 5821 (IGHV3-33)
ARKGYDMHAFDI

SEQ ID NO: 11643 - protein, 9 aa, Homo sapiens
  Light chain CDR3 for antibody 5822 (IGKV1D-13)
QQFNNYPHT

SEQ ID NO: 11644 - protein, 10 aa, Homo sapiens
  Heavy chain CDR3 for antibody 5822 (IGHV3-74)
ARENWGGFDY

SEQ ID NO: 11645 - protein, 9 aa, Homo sapiens
  Light chain CDR3 for antibody 5823 (IGKV1-17)
LQHNSYPYT

SEQ ID NO: 11646 - protein, 11 aa, Homo sapiens
  Heavy chain CDR3 for antibody 5823 (IGHV3-23)
AKEQKEAAMGA

SEQ ID NO: 11647 - protein, 9 aa, Homo sapiens
  Light chain CDR3 for antibody 5824 (IGKV3-15)
QQYNNWPLT

SEQ ID NO: 11648 - protein, 13 aa, Homo sapiens
  Heavy chain CDR3 for antibody 5824 (IGHV3-33)
AKEDGDYHHYFDY

SEQ ID NO: 11649 - protein, 9 aa, Homo sapiens
  Light chain CDR3 for antibody 5825 (IGKV1-17)
LQHNSYPYT

SEQ ID NO: 11650 - protein, 16 aa, Homo sapiens
  Heavy chain CDR3 for antibody 5825 (IGHV4-59)
AREGYNWNDGVNWFDP

SEQ ID NO: 11651 - protein, 9 aa, Homo sapiens
  Light chain CDR3 for antibody 5826 (IGKV2-30)
MQGTHWPLT

SEQ ID NO: 11652 - protein, 9 aa, Homo sapiens
  Heavy chain CDR3 for antibody 5826 (IGHV3-23)
AKEQQLFDY

SEQ ID NO: 11653 - protein, 9 aa, Homo sapiens
  Light chain CDR3 for antibody 5827 (IGKV1-27)
QKYNSAPYT

SEQ ID NO: 11654 - protein, 14 aa, Homo sapiens
  Heavy chain CDR3 for antibody 5827 (IGHV4-39)
ARQGGSGSYYNLDY

SEQ ID NO: 11655 - protein, 9 aa, Homo sapiens
  Light chain CDR3 for antibody 5828 (IGKV6-21)
HQSTSLPFT

SEQ ID NO: 11656 - protein, 12 aa, Homo sapiens
  Heavy chain CDR3 for antibody 5828 (IGHV4-61)
ARVDSSGWYFDY

SEQ ID NO: 11657 - protein, 9 aa, Homo sapiens
  Light chain CDR3 for antibody 5829 (IGKV1-6)
LQNYNYPYT

SEQ ID NO: 11658 - protein, 13 aa, Homo sapiens
  Heavy chain CDR3 for antibody 5829 (IGHV3-33)
ARDLAVAGYPFDF

SEQ ID NO: 11659 - protein, 9 aa, Homo sapiens
  Light chain CDR3 for antibody 5830 (IGKV1D-16)
QQYSSYPYT

SEQ ID NO: 11660 - protein, 9 aa, Homo sapiens
  Heavy chain CDR3 for antibody 5830 (IGHV3-30)
VRDNWGFDY

SEQ ID NO: 11661 - protein, 9 aa, Homo sapiens
  Light chain CDR3 for antibody 5831 (IGKV1-9)
QQLNSYPYT

SEQ ID NO: 11662 - protein, 15 aa, Homo sapiens
  Heavy chain CDR3 for antibody 5831 (IGHV3-33)
VCVLYDYGDYVGFDY

SEQ ID NO: 11663 - protein, 9 aa, Homo sapiens
  Light chain CDR3 for antibody 5832 (IGKV1-39)
QQSYSTPLT

SEQ ID NO: 11664 - protein, 16 aa, Homo sapiens
  Heavy chain CDR3 for antibody 5832 (IGHV3-33)
AREGGLIAAAGTGFDY

SEQ ID NO: 11665 - protein, 9 aa, Homo sapiens
  Light chain CDR3 for antibody 5833 (IGKV1-27)
QKYNSAPYT

SEQ ID NO: 11666 - protein, 14 aa, Homo sapiens
  Heavy chain CDR3 for antibody 5833 (IGHV4-39)
ARRGVVVPPGGMDV

SEQ ID NO: 11667 - protein, 9 aa, Homo sapiens
  Light chain CDR3 for antibody 5834 (IGKV1-27)
QKYNSAPYT

SEQ ID NO: 11668 - protein, 16 aa, Homo sapiens
  Heavy chain CDR3 for antibody 5834 (IGHV3-33)
AREVAGSYYYYYGMDV

SEQ ID NO: 11669 - protein, 9 aa, Homo sapiens
  Light chain CDR3 for antibody 5835 (IGKV3D-20)
QQYGSSPLT

SEQ ID NO: 11670 - protein, 14 aa, Homo sapiens
  Heavy chain CDR3 for antibody 5835 (IGHV3-20)
ARDRGSSFFDAFDI

SEQ ID NO: 11671 - protein, 9 aa, Homo sapiens
  Light chain CDR3 for antibody 5836 (IGKV1D-16)
QQYNSYPYT

SEQ ID NO: 11672 - protein, 5 aa, Homo sapiens
  Heavy chain CDR3 for antibody 5836 (IGHV1-18)
AREDY

SEQ ID NO: 11673 - protein, 9 aa, Homo sapiens
  Light chain CDR3 for antibody 5837 (IGKV1D-16)
QQYYSYPRT

SEQ ID NO: 11674 - protein, 13 aa, Homo sapiens
  Heavy chain CDR3 for antibody 5837 (IGHV4-59)
ARTMVRGVAPFDY

SEQ ID NO: 11675 - protein, 9 aa, Homo sapiens
  Light chain CDR3 for antibody 5838 (IGKV1-39)
QQSYRTPLT

SEQ ID NO: 11676 - protein, 13 aa, Homo sapiens
  Heavy chain CDR3 for antibody 5838 (IGHV1-46)
ARRQVGYYYGMDV

SEQ ID NO: 11677 - protein, 9 aa, Homo sapiens
  Light chain CDR3 for antibody 5839 (IGKV1D-16)
QQYNSFPLT

SEQ ID NO: 11678 - protein, 12 aa, Homo sapiens
  Heavy chain CDR3 for antibody 5839 (IGHV4-59)
ARGRYFDWLWDY

SEQ ID NO: 11679 - protein, 9 aa, Homo sapiens
  Light chain CDR3 for antibody 5840 (IGKV2-30)
MQGTHWPLT

SEQ ID NO: 11680 - protein, 9 aa, Homo sapiens
  Heavy chain CDR3 for antibody 5840 (IGHV3-33)
AREYKEFDY

SEQ ID NO: 11681 - protein, 9 aa, Homo sapiens
  Light chain CDR3 for antibody 5841 (IGKV1-16)
QHYNDYPFT

SEQ ID NO: 11682 - protein, 16 aa, Homo sapiens
  Heavy chain CDR3 for antibody 5841 (IGHV4-59)
ARGRYFEWLLGDVFDI

SEQ ID NO: 11683 - protein, 9 aa, Homo sapiens
  Light chain CDR3 for antibody 5842 (IGKV1-33)
QQYDNLPFT

SEQ ID NO: 11684 - protein, 14 aa, Homo sapiens
  Heavy chain CDR3 for antibody 5842 (IGHV3-33)
ARAISGSSYWYFDL

SEQ ID NO: 11685 - protein, 9 aa, Homo sapiens
  Light chain CDR3 for antibody 5843 (IGKV3-11)
QQRSNWPYT

SEQ ID NO: 11686 - protein, 14 aa, Homo sapiens
  Heavy chain CDR3 for antibody 5843 (IGHV3-20)
ARDGGSTCYDWFDP

SEQ ID NO: 11687 - protein, 8 aa, Homo sapiens
  Light chain CDR3 for antibody 5844 (IGKV2D-28)
MQALQTPT

SEQ ID NO: 11688 - protein, 15 aa, Homo sapiens
  Heavy chain CDR3 for antibody 5844 (IGHV3-30)
ARGAMVRGVDYGMDV

SEQ ID NO: 11689 - protein, 9 aa, Homo sapiens
  Light chain CDR3 for antibody 5845 (IGKV1-9)
QQLHIYPWT

SEQ ID NO: 11690 - protein, 12 aa, Homo sapiens
  Heavy chain CDR3 for antibody 5845 (IGHV3-33)
VRKGYALYGLDV

SEQ ID NO: 11691 - protein, 9 aa, Homo sapiens
  Light chain CDR3 for antibody 5846 (IGKV2D-28)
MQVLQTPFT

SEQ ID NO: 11692 - protein, 12 aa, Homo sapiens
  Heavy chain CDR3 for antibody 5846 (IGHV4-61)
ARVYSSGWLFDY

SEQ ID NO: 11693 - protein, 9 aa, Homo sapiens
  Light chain CDR3 for antibody 5847 (IGKV1-6)
LQDYNYPYT

SEQ ID NO: 11694 - protein, 19 aa, Homo sapiens
  Heavy chain CDR3 for antibody 5847 (IGHV3-33)
ARGGVVRGVIEYYYYGMDV

SEQ ID NO: 11695 - protein, 9 aa, Homo sapiens
  Light chain CDR3 for antibody 5848 (IGKV1-17)
LQHNSYPWT

SEQ ID NO: 11696 - protein, 14 aa, Homo sapiens
  Heavy chain CDR3 for antibody 5848 (IGHV4-39)
ARQGGSGSYYNLDY

SEQ ID NO: 11697 - protein, 9 aa, Homo sapiens
  Light chain CDR3 for antibody 5849 (IGKV1-39)
QQSYSTPFT

SEQ ID NO: 11698 - protein, 15 aa, Homo sapiens
  Heavy chain CDR3 for antibody 5849 (IGHV3-33)
ARDSRPEITGPPFDY

SEQ ID NO: 11699 - protein, 9 aa, Homo sapiens
  Light chain CDR3 for antibody 5850 (IGKV3D-7)
QQDYNLPLT

SEQ ID NO: 11700 - protein, 17 aa, Homo sapiens
  Heavy chain CDR3 for antibody 5850 (IGHV4-59)
AREGADSGIYYHWYFDL

SEQ ID NO: 11701 - protein, 9 aa, Homo sapiens
  Light chain CDR3 for antibody 5851 (IGKV4-1)
QQSYSTPLT

SEQ ID NO: 11702 - protein, 10 aa, Homo sapiens
  Heavy chain CDR3 for antibody 5851 (IGHV1-18)
AREQRLGFDY

SEQ ID NO: 11703 - protein, 8 aa, Homo sapiens
  Light chain CDR3 for antibody 5852 (IGKV3-20)
QQYGSSRT

SEQ ID NO: 11704 - protein, 17 aa, Homo sapiens
  Heavy chain CDR3 for antibody 5852 (IGHV1-18)
ARDRAFTMVRGVPPFDY

SEQ ID NO: 11705 - protein, 9 aa, Homo sapiens
  Light chain CDR3 for antibody 5853 (IGKV1-9)
QQLNSYPWT

SEQ ID NO: 11706 - protein, 13 aa, Homo sapiens
  Heavy chain CDR3 for antibody 5853 (IGHV3-33)
ARKAYGDYFYFDY

SEQ ID NO: 11707 - protein, 9 aa, Homo sapiens
  Light chain CDR3 for antibody 5854 (IGKV1D-13)
QQFNNYPIT

SEQ ID NO: 11708 - protein, 23 aa, Homo sapiens
  Heavy chain CDR3 for antibody 5854 (IGHV3-23)
AKDAGLPYDLLTGPYYYYFGINV

SEQ ID NO: 11709 - protein, 9 aa, Homo sapiens
  Light chain CDR3 for antibody 5855 (IGKV3D-7)
QQDYEFPLT

SEQ ID NO: 11710 - protein, 17 aa, Homo sapiens
  Heavy chain CDR3 for antibody 5855 (IGHV4-39)
ARQGWYYGSGSSLLFDY

SEQ ID NO: 11711 - protein, 9 aa, Homo sapiens
  Light chain CDR3 for antibody 5856 (IGKV3-15)
QQYNNWPLT

SEQ ID NO: 11712 - protein, 14 aa, Homo sapiens
  Heavy chain CDR3 for antibody 5856 (IGHV1-46)
ARDGVGAKEGGFDY

SEQ ID NO: 11713 - protein, 9 aa, Homo sapiens
  Light chain CDR3 for antibody 5857 (IGKV1-16)
QKYNSNPLT

SEQ ID NO: 11714 - protein, 14 aa, Homo sapiens
  Heavy chain CDR3 for antibody 5857 (IGHV3-33)
AREGYSSNWYDFDY

SEQ ID NO: 11715 - protein, 10 aa, Homo sapiens
  Light chain CDR3 for antibody 5858 (IGKV1-39)
QQSYSTPMYT

SEQ ID NO: 11716 - protein, 13 aa, Homo sapiens
  Heavy chain CDR3 for antibody 5858 (IGHV3-33)
ARDSSSWYHWFDP

SEQ ID NO: 11717 - protein, 9 aa, Homo sapiens
  Light chain CDR3 for antibody 5859 (IGKV1-17)
QQLNSYPLT

SEQ ID NO: 11718 - protein, 17 aa, Homo sapiens
  Heavy chain CDR3 for antibody 5859 (IGHV3-33)
ARGYSGYVGYYYYGMDV

SEQ ID NO: 11719 - protein, 9 aa, Homo sapiens
  Light chain CDR3 for antibody 5860 (IGKV3D-20)
QQYGSSPYT

SEQ ID NO: 11720 - protein, 18 aa, Homo sapiens
  Heavy chain CDR3 for antibody 5860 (IGHV3-33)
ARGAYSSGWDYYYYGLDV

SEQ ID NO: 11721 - protein, 9 aa, Homo sapiens
  Light chain CDR3 for antibody 5861 (IGKV1-6)
LQDYNYPFT

SEQ ID NO: 11722 - protein, 15 aa, Homo sapiens
  Heavy chain CDR3 for antibody 5861 (IGHV1-46)
ARAPLLLWFGEFIDY

SEQ ID NO: 11723 - protein, 8 aa, Homo sapiens
  Light chain CDR3 for antibody 5862 (IGKV3-11)
QQRSNWWT

SEQ ID NO: 11724 - protein, 12 aa, Homo sapiens
  Heavy chain CDR3 for antibody 5862 (IGHV3-33)
TRGYSSKSYFDY

SEQ ID NO: 11725 - protein, 9 aa, Homo sapiens
  Light chain CDR3 for antibody 5863 (IGKV1-16)
QHYNDYPFT

SEQ ID NO: 11726 - protein, 13 aa, Homo sapiens
  Heavy chain CDR3 for antibody 5863 (IGHV3-33)
ARKAYGDYFYFDY

SEQ ID NO: 11727 - protein, 9 aa, Homo sapiens
  Light chain CDR3 for antibody 5864 (IGKV1-6)
LQDYKSPFT

SEQ ID NO: 11728 - protein, 12 aa, Homo sapiens
  Heavy chain CDR3 for antibody 5864 (IGHV3-33)
ARDLVGATPFDY

SEQ ID NO: 11729 - protein, 9 aa, Homo sapiens
  Light chain CDR3 for antibody 5865 (IGKV3D-7)
QQDYNLPLT

SEQ ID NO: 11730 - protein, 11 aa, Homo sapiens
  Heavy chain CDR3 for antibody 5865 (IGHV3-33)
ARAGIAALFDY

SEQ ID NO: 11731 - protein, 9 aa, Homo sapiens
  Light chain CDR3 for antibody 5866 (IGKV2-30)
MQGTHWPLT

SEQ ID NO: 11732 - protein, 12 aa, Homo sapiens
  Heavy chain CDR3 for antibody 5866 (IGHV3-33)
ARAGMGAPYFDY

SEQ ID NO: 11733 - protein, 9 aa, Homo sapiens
  Light chain CDR3 for antibody 5867 (IGKV1-27)
QKYNSAPYT

SEQ ID NO: 11734 - protein, 13 aa, Homo sapiens
  Heavy chain CDR3 for antibody 5867 (IGHV3-33)
ARDSSSWYHWFDP

SEQ ID NO: 11735 - protein, 9 aa, Homo sapiens
  Light chain CDR3 for antibody 5868 (IGKV3-11)
QQRSNWPLT

SEQ ID NO: 11736 - protein, 22 aa, Homo sapiens
  Heavy chain CDR3 for antibody 5868 (IGHV4-59)
AREINYGSGSYYNEDYYYGMDV

SEQ ID NO: 11737 - protein, 6 aa, Homo sapiens
  Light chain CDR3 for antibody 5869 (IGKV3-20)
QQYGST

SEQ ID NO: 11738 - protein, 13 aa, Homo sapiens
  Heavy chain CDR3 for antibody 5869 (IGHV4-59)
ARDAGYSSSWFDY

SEQ ID NO: 11739 - protein, 11 aa, Homo sapiens
  Light chain CDR3 for antibody 5870 (IGKV3-11)
QQRSNWPPTWT

SEQ ID NO: 11740 - protein, 10 aa, Homo sapiens
  Heavy chain CDR3 for antibody 5870 (IGHV3-23)
AKEQWLVLDY

SEQ ID NO: 11741 - protein, 10 aa, Homo sapiens
  Light chain CDR3 for antibody 5871 (IGKV3-11)
QQRSNWPALT

SEQ ID NO: 11742 - protein, 18 aa, Homo sapiens
  Heavy chain CDR3 for antibody 5871 (IGHV3-33)
ARGGYSSGWDYYYYGMDV

SEQ ID NO: 11743 - protein, 10 aa, Homo sapiens
  Light chain CDR3 for antibody 5872 (IGKV3-15)
QQYNNWPPYT

SEQ ID NO: 11744 - protein, 11 aa, Homo sapiens
  Heavy chain CDR3 for antibody 5872 (IGHV4-59)
ARLYGGRLFDY

SEQ ID NO: 11745 - protein, 10 aa, Homo sapiens
  Light chain CDR3 for antibody 5873 (IGKV3-15)
QQYNNWPPLT

SEQ ID NO: 11746 - protein, 14 aa, Homo sapiens
  Heavy chain CDR3 for antibody 5873 (IGHV4-39)
ARQDYDILTGLFDY

SEQ ID NO: 11747 - protein, 9 aa, Homo sapiens
  Light chain CDR3 for antibody 5874 (IGKV3D-7)
QQDYNLPLT

SEQ ID NO: 11748 - protein, 24 aa, Homo sapiens
  Heavy chain CDR3 for antibody 5874 (IGHV1-46)
ARDEARGLLTGYYNMREYYYGMDV

SEQ ID NO: 11749 - protein, 9 aa, Homo sapiens
  Light chain CDR3 for antibody 5875 (IGKV3D-7)
QQDYNLPLT

SEQ ID NO: 11750 - protein, 16 aa, Homo sapiens
  Heavy chain CDR3 for antibody 5875 (IGHV3-33)
ARDGSMVRRIHDAFDF

SEQ ID NO: 11751 - protein, 10 aa, Homo sapiens
  Light chain CDR3 for antibody 5876 (IGKV3-11)
QQRSNWPALT

SEQ ID NO: 11752 - protein, 13 aa, Homo sapiens
  Heavy chain CDR3 for antibody 5876 (IGHV3-33)
ASGYSGYDWYFDL

SEQ ID NO: 11753 - protein, 9 aa, Homo sapiens
  Light chain CDR3 for antibody 5877 (IGKV2-30)
MQGTHWPLT

SEQ ID NO: 11754 - protein, 19 aa, Homo sapiens
  Heavy chain CDR3 for antibody 5877 (IGHV3-33)
TRDPHYDILTGYAYYGMDV

SEQ ID NO: 11755 - protein, 9 aa, Homo sapiens
  Light chain CDR3 for antibody 5878 (IGKV1D-16)
QQYDSYPWT

SEQ ID NO: 11756 - protein, 14 aa, Homo sapiens
  Heavy chain CDR3 for antibody 5878 (IGHV4-39)
ARDSGYDYYYGMDV

SEQ ID NO: 11757 - protein, 9 aa, Homo sapiens
  Light chain CDR3 for antibody 5879 (IGKV1-6)
LQDYNYPYT

SEQ ID NO: 11758 - protein, 16 aa, Homo sapiens
  Heavy chain CDR3 for antibody 5879 (IGHV3-33)
ARGAWYSNGWYGTFDI

SEQ ID NO: 11759 - protein, 9 aa, Homo sapiens
  Light chain CDR3 for antibody 5880 (IGKV1D-16)
QQYNSYPYT

SEQ ID NO: 11760 - protein, 11 aa, Homo sapiens
  Heavy chain CDR3 for antibody 5880 (IGHV4-59)
AREMGHDIFDI

SEQ ID NO: 11761 - protein, 9 aa, Homo sapiens
  Light chain CDR3 for antibody 5881 (IGKV1-27)
QKYNSAPYT

SEQ ID NO: 11762 - protein, 16 aa, Homo sapiens
  Heavy chain CDR3 for antibody 5881 (IGHV4-59)
ARDTPYYSGSGRPFDS

SEQ ID NO: 11763 - protein, 9 aa, Homo sapiens
  Light chain CDR3 for antibody 5882 (IGKV1-9)
QQLNTYPWT

SEQ ID NO: 11764 - protein, 11 aa, Homo sapiens
  Heavy chain CDR3 for antibody 5882 (IGHV3-33)
ARDTWDDYFDY

SEQ ID NO: 11765 - protein, 8 aa, Homo sapiens
  Light chain CDR3 for antibody 5883 (IGKV1-5)
QQYNSYWT

SEQ ID NO: 11766 - protein, 19 aa, Homo sapiens
  Heavy chain CDR3 for antibody 5883 (IGHV3-33)
TRDPHYDILTGYAYYGMDV

SEQ ID NO: 11767 - protein, 8 aa, Homo sapiens
  Light chain CDR3 for antibody 5884 (IGKV1-5)
QQYNSYWT

SEQ ID NO: 11768 - protein, 12 aa, Homo sapiens
  Heavy chain CDR3 for antibody 5884 (IGHV3-33)
AREGDILTGYSL

SEQ ID NO: 11769 - protein, 9 aa, Homo sapiens
  Light chain CDR3 for antibody 5885 (IGKV1-39)
QQSYSTPLT

SEQ ID NO: 11770 - protein, 16 aa, Homo sapiens
  Heavy chain CDR3 for antibody 5885 (IGHV3-33)
ARDRGGMTMVRGGFDY

SEQ ID NO: 11771 - protein, 9 aa, Homo sapiens
  Light chain CDR3 for antibody 5886 (IGKV3-20)
QQYGSSPYT

SEQ ID NO: 11772 - protein, 18 aa, Homo sapiens
  Heavy chain CDR3 for antibody 5886 (IGHV3-33)
VREGGYYGSGSYPDAFDI

SEQ ID NO: 11773 - protein, 8 aa, Homo sapiens
  Light chain CDR3 for antibody 5887 (IGKV1-17)
QQYNSYYT

SEQ ID NO: 11774 - protein, 14 aa, Homo sapiens
  Heavy chain CDR3 for antibody 5887 (IGHV3-33)
ARRGSPLRPSHLDV

SEQ ID NO: 11775 - protein, 9 aa, Homo sapiens
  Light chain CDR3 for antibody 5888 (IGKV1-9)
QQLKSYLYT

SEQ ID NO: 11776 - protein, 10 aa, Homo sapiens
  Heavy chain CDR3 for antibody 5888 (IGHV1-18)
AREQRLGFDY

SEQ ID NO: 11777 - protein, 9 aa, Homo sapiens
  Light chain CDR3 for antibody 5889 (IGKV2D-28)
MQALQTPPT

SEQ ID NO: 11778 - protein, 13 aa, Homo sapiens
  Heavy chain CDR3 for antibody 5889 (IGHV3-11)
ARDEGYRGYVLDT

SEQ ID NO: 11779 - protein, 9 aa, Homo sapiens
  Light chain CDR3 for antibody 5890 (IGKV1-16)
QQYNRYPYT

SEQ ID NO: 11780 - protein, 18 aa, Homo sapiens
  Heavy chain CDR3 for antibody 5890 (IGHV4-59)
AREGDYVWGSYRPNCFDP

SEQ ID NO: 11781 - protein, 9 aa, Homo sapiens
  Light chain CDR3 for antibody 5891 (IGKV1-39)
QQSYSTPLT

SEQ ID NO: 11782 - protein, 17 aa, Homo sapiens
  Heavy chain CDR3 for antibody 5891 (IGHV3-11)
ARQGVLLWFGELYYFDY

SEQ ID NO: 11783 - protein, 9 aa, Homo sapiens
  Light chain CDR3 for antibody 5892 (IGKV1-9)
QQLNTYPWT

SEQ ID NO: 11784 - protein, 18 aa, Homo sapiens
  Heavy chain CDR3 for antibody 5892 (IGHV3-33)
ARGLLWFGVSYYYYGMDV

SEQ ID NO: 11785 - protein, 9 aa, Homo sapiens
  Light chain CDR3 for antibody 5893 (IGKV1D-13)
QRFNNYLYT

SEQ ID NO: 11786 - protein, 14 aa, Homo sapiens
  Heavy chain CDR3 for antibody 5893 (IGHV3-33)
ARDRIAAASSDFDC

SEQ ID NO: 11787 - protein, 9 aa, Homo sapiens
  Light chain CDR3 for antibody 5894 (IGKV2-30)
MQGTHWPLT

SEQ ID NO: 11788 - protein, 15 aa, Homo sapiens
  Heavy chain CDR3 for antibody 5894 (IGHV3-23)
AKEFTMVRGVITPDY

SEQ ID NO: 11789 - protein, 8 aa, Homo sapiens
  Light chain CDR3 for antibody 5895 (IGKV3-11)
LQRGNWPT

SEQ ID NO: 11790 - protein, 13 aa, Homo sapiens
  Heavy chain CDR3 for antibody 5895 (IGHV4-59)
ARDAGYSSSWFDY

SEQ ID NO: 11791 - protein, 9 aa, Homo sapiens
  Light chain CDR3 for antibody 5896 (IGKV3D-20)
QQYGSSPRT

SEQ ID NO: 11792 - protein, 17 aa, Homo sapiens
  Heavy chain CDR3 for antibody 5896 (IGHV3-33)
ARGYSGYVGYYYYGMDV

SEQ ID NO: 11793 - protein, 9 aa, Homo sapiens
  Light chain CDR3 for antibody 5897 (IGKV1-17)
LQDYNYPYT

SEQ ID NO: 11794 - protein, 13 aa, Homo sapiens
  Heavy chain CDR3 for antibody 5897 (IGHV3-33)
ARDDDYGDYPFDY

SEQ ID NO: 11795 - protein, 8 aa, Homo sapiens
  Light chain CDR3 for antibody 5898 (IGKV1-5)
QQYNSYYT

SEQ ID NO: 11796 - protein, 13 aa, Homo sapiens
  Heavy chain CDR3 for antibody 5898 (IGHV3-33)
ARIDYYSYYGMDV

SEQ ID NO: 11797 - protein, 8 aa, Homo sapiens
  Light chain CDR3 for antibody 5899 (IGKV3D-7)
QQDYNLLT

SEQ ID NO: 11798 - protein, 19 aa, Homo sapiens
  Heavy chain CDR3 for antibody 5899 (IGHV3-33)
ARGPYYDILTGYGYYGMDV

SEQ ID NO: 11799 - protein, 9 aa, Homo sapiens
  Light chain CDR3 for antibody 5900 (IGKV1-33)
QQYDNLPFT

SEQ ID NO: 11800 - protein, 14 aa, Homo sapiens
  Heavy chain CDR3 for antibody 5900 (IGHV3-33)
ARDWNDVYYYGMDV

SEQ ID NO: 11801 - protein, 9 aa, Homo sapiens
  Light chain CDR3 for antibody 5901 (IGKV6-21)
HQSSRLPLT

SEQ ID NO: 11802 - protein, 15 aa, Homo sapiens
  Heavy chain CDR3 for antibody 5901 (IGHV4-39)
ARDEGLYGSGSYFDS

SEQ ID NO: 11803 - protein, 9 aa, Homo sapiens
  Light chain CDR3 for antibody 5902 (IGKV1-27)
QKYNSAPYT

SEQ ID NO: 11804 - protein, 10 aa, Homo sapiens
  Heavy chain CDR3 for antibody 5902 (IGHV3-33)
ARDGSGSYPI

SEQ ID NO: 11805 - protein, 8 aa, Homo sapiens
  Light chain CDR3 for antibody 5903 (IGKV3D-7)
QQDYNLLT

SEQ ID NO: 11806 - protein, 19 aa, Homo sapiens
  Heavy chain CDR3 for antibody 5903 (IGHV3-33)
ARRFSGYSGYDHYYYGMDV

SEQ ID NO: 11807 - protein, 10 aa, Homo sapiens
  Light chain CDR3 for antibody 5904 (IGKV3-20)
QQYGRSPPVT

SEQ ID NO: 11808 - protein, 13 aa, Homo sapiens
  Heavy chain CDR3 for antibody 5904 (IGHV3-33)
ARAFIMVRGVIDY

SEQ ID NO: 11809 - protein, 9 aa, Homo sapiens
  Light chain CDR3 for antibody 5905 (IGKV1D-16)
QQYDSYPYT

SEQ ID NO: 11810 - protein, 14 aa, Homo sapiens
  Heavy chain CDR3 for antibody 5905 (IGHV3-23)
ARGRRDFYYYGMDV

SEQ ID NO: 11811 - protein, 9 aa, Homo sapiens
  Light chain CDR3 for antibody 5906 (IGKV1D-13)
QRFNNYLYT

SEQ ID NO: 11812 - protein, 13 aa, Homo sapiens
  Heavy chain CDR3 for antibody 5906 (IGHV3-33)
ANTGDSYYYDMDV

SEQ ID NO: 11813 - protein, 11 aa, Homo sapiens
  Light chain CDR3 for antibody 5907 (IGKV3-11)
QQRSNWPPTWT

SEQ ID NO: 11814 - protein, 17 aa, Homo sapiens
  Heavy chain CDR3 for antibody 5907 (IGHV1-18)
ARDEGYDILTGYPHFDY

SEQ ID NO: 11815 - protein, 9 aa, Homo sapiens
  Light chain CDR3 for antibody 5908 (IGKV3-15)
QQYNNWPLT

SEQ ID NO: 11816 - protein, 15 aa, Homo sapiens
  Heavy chain CDR3 for antibody 5908 (IGHV3-33)
ARHSSGFYYYYGMDV

SEQ ID NO: 11817 - protein, 9 aa, Homo sapiens
  Light chain CDR3 for antibody 5909 (IGKV3-20)
QQYGSSPYT

SEQ ID NO: 11818 - protein, 12 aa, Homo sapiens
  Heavy chain CDR3 for antibody 5909 (IGHV3-33)
AREEAVAEAFDI

SEQ ID NO: 11819 - protein, 9 aa, Homo sapiens
  Light chain CDR3 for antibody 5910 (IGKV3D-20)
QQYGSSPYT

SEQ ID NO: 11820 - protein, 13 aa, Homo sapiens
  Heavy chain CDR3 for antibody 5910 (IGHV3-33)
ARCIVAAMGGFDY

SEQ ID NO: 11821 - protein, 9 aa, Homo sapiens
  Light chain CDR3 for antibody 5911 (IGKV3-15)
QQYNNWPLT

SEQ ID NO: 11822 - protein, 17 aa, Homo sapiens
  Heavy chain CDR3 for antibody 5911 (IGHV3-23)
AKDYDILTGYSHNWFDP

SEQ ID NO: 11823 - protein, 9 aa, Homo sapiens
  Light chain CDR3 for antibody 5912 (IGKV1-9)
QRFNNYMYT

SEQ ID NO: 11824 - protein, 12 aa, Homo sapiens
  Heavy chain CDR3 for antibody 5912 (IGHV1-46)
ARGLTGDHAVDI

SEQ ID NO: 11825 - protein, 8 aa, Homo sapiens
  Light chain CDR3 for antibody 5913 (IGKV3D-7)
QQDYNLLT

SEQ ID NO: 11826 - protein, 16 aa, Homo sapiens
  Heavy chain CDR3 for antibody 5913 (IGHV3-33)
ARDNFGSGSYYSHFHY

SEQ ID NO: 11827 - protein, 8 aa, Homo sapiens
  Light chain CDR3 for antibody 5914 (IGKV6-21)
HQSSSLPT

SEQ ID NO: 11828 - protein, 14 aa, Homo sapiens
  Heavy chain CDR3 for antibody 5914 (IGHV3-33)
AREGYSSNWYDFDY

SEQ ID NO: 11829 - protein, 10 aa, Homo sapiens
  Light chain CDR3 for antibody 5915 (IGKV1-39)
QQSYSTPMYT

SEQ ID NO: 11830 - protein, 13 aa, Homo sapiens
  Heavy chain CDR3 for antibody 5915 (IGHV3-33)
ARQSSGWFDAFDI

SEQ ID NO: 11831 - protein, 9 aa, Homo sapiens
  Light chain CDR3 for antibody 5916 (IGKV1-33)
QQYDNLPFT

SEQ ID NO: 11832 - protein, 13 aa, Homo sapiens
  Heavy chain CDR3 for antibody 5916 (IGHV3-33)
AKEDGDYHHYFDY

SEQ ID NO: 11833 - protein, 9 aa, Homo sapiens
  Light chain CDR3 for antibody 5917 (IGKV1D-13)
QRFNNYLYT

SEQ ID NO: 11834 - protein, 15 aa, Homo sapiens
  Heavy chain CDR3 for antibody 5917 (IGHV3-20)
ARDRGSSGWRDWFDP

SEQ ID NO: 11835 - protein, 9 aa, Homo sapiens
  Light chain CDR3 for antibody 5918 (IGKV1-27)
QKYNSAPYT

SEQ ID NO: 11836 - protein, 18 aa, Homo sapiens
  Heavy chain CDR3 for antibody 5918 (IGHV1-18)
ARDRYYYDSGSYYYGMDV

SEQ ID NO: 11837 - protein, 9 aa, Homo sapiens
  Light chain CDR3 for antibody 5919 (IGKV5-2)
LQHDNFPWT

SEQ ID NO: 11838 - protein, 13 aa, Homo sapiens
  Heavy chain CDR3 for antibody 5919 (IGHV1-18)
ARKWEWDLLNFDY

SEQ ID NO: 11839 - protein, 9 aa, Homo sapiens
  Light chain CDR3 for antibody 5920 (IGKV4-1)
QQYYSTPWT

SEQ ID NO: 11840 - protein, 15 aa, Homo sapiens
  Heavy chain CDR3 for antibody 5920 (IGHV3-33)
ARRGYNDYDPYGMDV

SEQ ID NO: 11841 - protein, 10 aa, Homo sapiens
  Light chain CDR3 for antibody 5921 (IGKV3-11)
QQRSNWPIFT

SEQ ID NO: 11842 - protein, 14 aa, Homo sapiens
  Heavy chain CDR3 for antibody 5921 (IGHV3-33)
VRDAMGATTAWFDP

SEQ ID NO: 11843 - protein, 8 aa, Homo sapiens
  Light chain CDR3 for antibody 5922 (IGKV3-20)
QQYGSSLT

SEQ ID NO: 11844 - protein, 15 aa, Homo sapiens
  Heavy chain CDR3 for antibody 5922 (IGHV4-59)
ARDLGHYYGSVSIDY

SEQ ID NO: 11845 - protein, 9 aa, Homo sapiens
  Light chain CDR3 for antibody 5923 (IGKV3-15)
QQYNNWPLT

SEQ ID NO: 11846 - protein, 23 aa, Homo sapiens
  Heavy chain CDR3 for antibody 5923 (IGHV3-11)
ARDEGVTMVRGVISYYYYYGMDV

SEQ ID NO: 11847 - protein, 9 aa, Homo sapiens
  Light chain CDR3 for antibody 5924 (IGKV2-30)
MQGTHWPLT

SEQ ID NO: 11848 - protein, 16 aa, Homo sapiens
  Heavy chain CDR3 for antibody 5924 (IGHV1-8)
AREGTMVRGVTYAFDI

SEQ ID NO: 11849 - protein, 9 aa, Homo sapiens
  Light chain CDR3 for antibody 5925 (IGKV3-15)
QQYNNWPLT

SEQ ID NO: 11850 - protein, 13 aa, Homo sapiens
  Heavy chain CDR3 for antibody 5925 (IGHV1-46)
ARRQVGYYYGMDV

SEQ ID NO: 11851 - protein, 9 aa, Homo sapiens
  Light chain CDR3 for antibody 5926 (IGKV1-17)
LQHNSYPYT

SEQ ID NO: 11852 - protein, 16 aa, Homo sapiens
  Heavy chain CDR3 for antibody 5926 (IGHV3-23)
AKDGSGSYYLTEYFQH

SEQ ID NO: 11853 - protein, 9 aa, Homo sapiens
  Light chain CDR3 for antibody 5927 (IGKV1-39)
QQSYRTPLT

SEQ ID NO: 11854 - protein, 17 aa, Homo sapiens
  Heavy chain CDR3 for antibody 5927 (IGHV3-23)
AKGNYGSGSYYNGDFQH

SEQ ID NO: 11855 - protein, 9 aa, Homo sapiens
  Light chain CDR3 for antibody 5928 (IGKV1-6)
LQDYSYPFT

SEQ ID NO: 11856 - protein, 7 aa, Homo sapiens
  Heavy chain CDR3 for antibody 5928 (IGHV3-33)
ARELFDY

SEQ ID NO: 11857 - protein, 8 aa, Homo sapiens
  Light chain CDR3 for antibody 5929 (IGKV3-11)
LQRGNWPT

SEQ ID NO: 11858 - protein, 17 aa, Homo sapiens
  Heavy chain CDR3 for antibody 5929 (IGHV3-33)
ARGYCSRTSCYLYYFDY

SEQ ID NO: 11859 - protein, 9 aa, Homo sapiens
  Light chain CDR3 for antibody 5930 (IGKV6-21)
HQSSSLPYT

SEQ ID NO: 11860 - protein, 12 aa, Homo sapiens
  Heavy chain CDR3 for antibody 5930 (IGHV3-33)
ARKQWLVQAFDI

SEQ ID NO: 11861 - protein, 9 aa, Homo sapiens
  Light chain CDR3 for antibody 5931 (IGKV5-2)
LQHDNFPYT

SEQ ID NO: 11862 - protein, 10 aa, Homo sapiens
  Heavy chain CDR3 for antibody 5931 (IGHV3-33)
ARVVDTAMAY

SEQ ID NO: 11863 - protein, 10 aa, Homo sapiens
  Light chain CDR3 for antibody 5932 (IGKV3-20)
QQYGRSPPVT

SEQ ID NO: 11864 - protein, 13 aa, Homo sapiens
  Heavy chain CDR3 for antibody 5932 (IGHV3-33)
ARKAYGDYFYFDY

SEQ ID NO: 11865 - protein, 9 aa, Homo sapiens
  Light chain CDR3 for antibody 5933 (IGKV1-33)
QQYDNLPFT

SEQ ID NO: 11866 - protein, 13 aa, Homo sapiens
  Heavy chain CDR3 for antibody 5933 (IGHV3-23)
ASPFNWNDGFFDY

SEQ ID NO: 11867 - protein, 10 aa, Homo sapiens
  Light chain CDR3 for antibody 5934 (IGKV3-11)
QQRSNWPMYT

SEQ ID NO: 11868 - protein, 18 aa, Homo sapiens
  Heavy chain CDR3 for antibody 5934 (IGHV1-46)
ARDGDYVWGSYRSNWFDP

SEQ ID NO: 11869 - protein, 8 aa, Homo sapiens
  Light chain CDR3 for antibody 5935 (IGKV3D-7)
QQDYNLLT

SEQ ID NO: 11870 - protein, 17 aa, Homo sapiens
  Heavy chain CDR3 for antibody 5935 (IGHV1-18)
ARDRAFTMVRGVPPFDY

SEQ ID NO: 11871 - protein, 8 aa, Homo sapiens
  Light chain CDR3 for antibody 5936 (IGKV1D-13)
QQFNNYYT

SEQ ID NO: 11872 - protein, 13 aa, Homo sapiens
  Heavy chain CDR3 for antibody 5936 (IGHV1-18)
ARSITMVRGVIGY

SEQ ID NO: 11873 - protein, 9 aa, Homo sapiens
  Light chain CDR3 for antibody 5937 (IGKV1-6)
LQDYNYPYT

SEQ ID NO: 11874 - protein, 16 aa, Homo sapiens
  Heavy chain CDR3 for antibody 5937 (IGHV3-33)
ARPTYYDILTGYPFDY

SEQ ID NO: 11875 - protein, 11 aa, Homo sapiens
  Light chain CDR3 for antibody 5938 (IGKV3-11)
QQRSNWPPTWT

SEQ ID NO: 11876 - protein, 23 aa, Homo sapiens
  Heavy chain CDR3 for antibody 5938 (IGHV4-59)
ARERTYSDILPGYYEDYYYGMDV

SEQ ID NO: 11877 - protein, 9 aa, Homo sapiens
  Light chain CDR3 for antibody 5939 (IGKV2-30)
MQGTHWPLT

SEQ ID NO: 11878 - protein, 12 aa, Homo sapiens
  Heavy chain CDR3 for antibody 5939 (IGHV3-33)
ARVDAAAPYFDY

SEQ ID NO: 11879 - protein, 9 aa, Homo sapiens
  Light chain CDR3 for antibody 5940 (IGKV3-20)
LQYGSSPYT

SEQ ID NO: 11880 - protein, 18 aa, Homo sapiens
  Heavy chain CDR3 for antibody 5940 (IGHV1-46)
ARDLTGRTENYYYYGMDV

SEQ ID NO: 11881 - protein, 9 aa, Homo sapiens
  Light chain CDR3 for antibody 5941 (IGKV2-30)
MQGTHWPLT

SEQ ID NO: 11882 - protein, 17 aa, Homo sapiens
  Heavy chain CDR3 for antibody 5941 (IGHV3-33)
ARAYYDILTGYSYYFDY

SEQ ID NO: 11883 - protein, 9 aa, Homo sapiens
  Light chain CDR3 for antibody 5942 (IGKV1-6)
LQDYKSPFT

SEQ ID NO: 11884 - protein, 9 aa, Homo sapiens
  Heavy chain CDR3 for antibody 5942 (IGHV3-30)
ARDNWGFDY

SEQ ID NO: 11885 - protein, 9 aa, Homo sapiens
  Light chain CDR3 for antibody 5943 (IGKV3-15)
QQYNNWPLT

SEQ ID NO: 11886 - protein, 15 aa, Homo sapiens
  Heavy chain CDR3 for antibody 5943 (IGHV1-46)
ARGRFFDWLLSPFDY

SEQ ID NO: 11887 - protein, 8 aa, Homo sapiens
  Light chain CDR3 for antibody 5944 (IGKV1-5)
QQYNSYWT

SEQ ID NO: 11888 - protein, 16 aa, Homo sapiens
  Heavy chain CDR3 for antibody 5944 (IGHV3-33)
ARGDDILTHQYYGVDV

SEQ ID NO: 11889 - protein, 9 aa, Homo sapiens
  Light chain CDR3 for antibody 5945 (IGKV1D-13)
QQFNNYPRT

SEQ ID NO: 11890 - protein, 14 aa, Homo sapiens
  Heavy chain CDR3 for antibody 5945 (IGHV1-46)
ARKGIVGAFDAFDI

SEQ ID NO: 11891 - protein, 8 aa, Homo sapiens
  Light chain CDR3 for antibody 5946 (IGKV3-20)
QQYGSSLT

SEQ ID NO: 11892 - protein, 12 aa, Homo sapiens
  Heavy chain CDR3 for antibody 5946 (IGHV3-33)
ARESGGSYSFDY

SEQ ID NO: 11893 - protein, 9 aa, Homo sapiens
  Light chain CDR3 for antibody 5947 (IGKV3D-20)
QQYGSSPLT

SEQ ID NO: 11894 - protein, 13 aa, Homo sapiens
  Heavy chain CDR3 for antibody 5947 (IGHV4-39)
ARPGIVAAGWFDP

SEQ ID NO: 11895 - protein, 9 aa, Homo sapiens
  Light chain CDR3 for antibody 5948 (IGKV1-39)
QQSYSTPLT

SEQ ID NO: 11896 - protein, 18 aa, Homo sapiens
  Heavy chain CDR3 for antibody 5948 (IGHV3-33)
AREGYDILTGDYRLGFDY

SEQ ID NO: 11897 - protein, 9 aa, Homo sapiens
  Light chain CDR3 for antibody 5949 (IGKV3D-7)
QQDYEFPLT

SEQ ID NO: 11898 - protein, 12 aa, Homo sapiens
  Heavy chain CDR3 for antibody 5949 (IGHV3-33)
ARESGGSYSFDY

SEQ ID NO: 11899 - protein, 9 aa, Homo sapiens
  Light chain CDR3 for antibody 5950 (IGKV1-39)
QQSYSTPLT

SEQ ID NO: 11900 - protein, 12 aa, Homo sapiens
  Heavy chain CDR3 for antibody 5950 (IGHV3-33)
AKDPGWQQLAEY

SEQ ID NO: 11901 - protein, 9 aa, Homo sapiens
  Light chain CDR3 for antibody 5951 (IGKV3D-7)
QQDYKLPLT

SEQ ID NO: 11902 - protein, 15 aa, Homo sapiens
  Heavy chain CDR3 for antibody 5951 (IGHV3-33)
ARDEHYDILTGYWGY

SEQ ID NO: 11903 - protein, 9 aa, Homo sapiens
  Light chain CDR3 for antibody 5952 (IGKV1-39)
QQSYSTPYT

SEQ ID NO: 11904 - protein, 10 aa, Homo sapiens
  Heavy chain CDR3 for antibody 5952 (IGHV3-23)
ATIVGPFLDV

SEQ ID NO: 11905 - protein, 10 aa, Homo sapiens
  Light chain CDR3 for antibody 5953 (IGKV3-11)
QQRSNWPIFT

SEQ ID NO: 11906 - protein, 12 aa, Homo sapiens
  Heavy chain CDR3 for antibody 5953 (IGHV3-33)
ARDYISTYGMDV

SEQ ID NO: 11907 - protein, 9 aa, Homo sapiens
  Light chain CDR3 for antibody 5954 (IGKV5-2)
LQHDNFPWT

SEQ ID NO: 11908 - protein, 12 aa, Homo sapiens
  Heavy chain CDR3 for antibody 5954 (IGHV4-39)
ARQGAYSRFFDY

SEQ ID NO: 11909 - protein, 9 aa, Homo sapiens
  Light chain CDR3 for antibody 5955 (IGKV1-39)
QQSYSTPLT

SEQ ID NO: 11910 - protein, 17 aa, Homo sapiens
  Heavy chain CDR3 for antibody 5955 (IGHV3-33)
TRDSGMVRGIIIYGMDV

SEQ ID NO: 11911 - protein, 9 aa, Homo sapiens
  Light chain CDR3 for antibody 5956 (IGKV3-11)
QQRSNWPLT

SEQ ID NO: 11912 - protein, 16 aa, Homo sapiens
  Heavy chain CDR3 for antibody 5956 (IGHV3-33)
ARGDDILTHQYYGVDV

SEQ ID NO: 11913 - protein, 10 aa, Homo sapiens
  Light chain CDR3 for antibody 5957 (IGKV3-11)
QQRSNWPIFT

SEQ ID NO: 11914 - protein, 13 aa, Homo sapiens
  Heavy chain CDR3 for antibody 5957 (IGHV3-23)
ARGELLWFGEFAC

SEQ ID NO: 11915 - protein, 9 aa, Homo sapiens
  Light chain CDR3 for antibody 5958 (IGKV5-2)
LQHDNFPYT

SEQ ID NO: 11916 - protein, 15 aa, Homo sapiens
  Heavy chain CDR3 for antibody 5958 (IGHV3-23)
AKDRSGSGSYNLFDY

SEQ ID NO: 11917 - protein, 8 aa, Homo sapiens
  Light chain CDR3 for antibody 5959 (IGKV1D-13)
QQFNNYYT

SEQ ID NO: 11918 - protein, 14 aa, Homo sapiens
  Heavy chain CDR3 for antibody 5959 (IGHV1-46)
ARRGIVGALDAFDI

SEQ ID NO: 11919 - protein, 9 aa, Homo sapiens
  Light chain CDR3 for antibody 5960 (IGKV1-6)
LQDYNYPYT

SEQ ID NO: 11920 - protein, 12 aa, Homo sapiens
  Heavy chain CDR3 for antibody 5960 (IGHV1-18)
ARERGIGRYFDL

SEQ ID NO: 11921 - protein, 8 aa, Homo sapiens
  Light chain CDR3 for antibody 5961 (IGKV1-5)
QQYNSYWT

SEQ ID NO: 11922 - protein, 18 aa, Homo sapiens
  Heavy chain CDR3 for antibody 5961 (IGHV3-33)
ARREGITLIFYYYYGMDV

SEQ ID NO: 11923 - protein, 9 aa, Homo sapiens
  Light chain CDR3 for antibody 5962 (IGKV2D-28)
MQVLQTPFT

SEQ ID NO: 11924 - protein, 13 aa, Homo sapiens
  Heavy chain CDR3 for antibody 5962 (IGHV4-39)
ARREVVGGRGFDY

SEQ ID NO: 11925 - protein, 9 aa, Homo sapiens
  Light chain CDR3 for antibody 5963 (IGKV1-16)
QHYNDYPFT

SEQ ID NO: 11926 - protein, 12 aa, Homo sapiens
  Heavy chain CDR3 for antibody 5963 (IGHV3-33)
AREGDILTGYSL

SEQ ID NO: 11927 - protein, 10 aa, Homo sapiens
  Light chain CDR3 for antibody 5964 (IGKV3-11)
QQRSNWPIFT

SEQ ID NO: 11928 - protein, 17 aa, Homo sapiens
  Heavy chain CDR3 for antibody 5964 (IGHV3-33)
ARESLKLGIYYYYGMDV

SEQ ID NO: 11929 - protein, 9 aa, Homo sapiens
  Light chain CDR3 for antibody 5965 (IGKV5-2)
LQHDNFPYT

SEQ ID NO: 11930 - protein, 10 aa, Homo sapiens
  Heavy chain CDR3 for antibody 5965 (IGHV3-33)
ARKGMNAFDI

SEQ ID NO: 11931 - protein, 9 aa, Homo sapiens
  Light chain CDR3 for antibody 5966 (IGKV1-17)
LQHNSYPYT

SEQ ID NO: 11932 - protein, 6 aa, Homo sapiens
  Heavy chain CDR3 for antibody 5966 (IGHV3-33)
ASRDIL

SEQ ID NO: 11933 - protein, 8 aa, Homo sapiens
  Light chain CDR3 for antibody 5967 (IGKV1-5)
QQYNSYYT

SEQ ID NO: 11934 - protein, 13 aa, Homo sapiens
  Heavy chain CDR3 for antibody 5967 (IGHV4-39)
ARREVVGGRGFDY

SEQ ID NO: 11935 - protein, 9 aa, Homo sapiens
  Light chain CDR3 for antibody 5968 (IGKV5-2)
LQHDKFPYT

SEQ ID NO: 11936 - protein, 13 aa, Homo sapiens
  Heavy chain CDR3 for antibody 5968 (IGHV3-33)
ARDWGYSHGYFDY

SEQ ID NO: 11937 - protein, 9 aa, Homo sapiens
  Light chain CDR3 for antibody 5969 (IGKV1-39)
QQSYSTPLT

SEQ ID NO: 11938 - protein, 9 aa, Homo sapiens
  Heavy chain CDR3 for antibody 5969 (IGHV3-33)
AANSYGLDY

SEQ ID NO: 11939 - protein, 9 aa, Homo sapiens
  Light chain CDR3 for antibody 5970 (IGKV1-27)
QKYNSAPYT

SEQ ID NO: 11940 - protein, 18 aa, Homo sapiens
  Heavy chain CDR3 for antibody 5970 (IGHV3-33)
ARDGRISLVRGIIDAFDI

SEQ ID NO: 11941 - protein, 8 aa, Homo sapiens
  Light chain CDR3 for antibody 5971 (IGKV1D-13)
QQFNNYPT

SEQ ID NO: 11942 - protein, 15 aa, Homo sapiens
  Heavy chain CDR3 for antibody 5971 (IGHV3-33)
VCVLYDYGDYVGFDY

SEQ ID NO: 11943 - protein, 10 aa, Homo sapiens
  Light chain CDR3 for antibody 5972 (IGKV3-20)
QQYGRSPPVT

SEQ ID NO: 11944 - protein, 13 aa, Homo sapiens
  Heavy chain CDR3 for antibody 5972 (IGHV3-11)
ARDGGAAAGTWDS

SEQ ID NO: 11945 - protein, 8 aa, Homo sapiens
  Light chain CDR3 for antibody 5973 (IGKV3D-7)
QQDYNLLT

SEQ ID NO: 11946 - protein, 15 aa, Homo sapiens
  Heavy chain CDR3 for antibody 5973 (IGHV3-74)
ARGSGSHYHYYGMDV

SEQ ID NO: 11947 - protein, 8 aa, Homo sapiens
  Light chain CDR3 for antibody 5974 (IGKV3-20)
QQYGSSLT

SEQ ID NO: 11948 - protein, 12 aa, Homo sapiens
  Heavy chain CDR3 for antibody 5974 (IGHV3-13)
VREAGIPDAFDI

SEQ ID NO: 11949 - protein, 9 aa, Homo sapiens
  Light chain CDR3 for antibody 5975 (IGKV1-16)
QHYNDYPFT

SEQ ID NO: 11950 - protein, 18 aa, Homo sapiens
  Heavy chain CDR3 for antibody 5975 (IGHV3-33)
ARREGIVGATTYYYGMDV

SEQ ID NO: 11951 - protein, 9 aa, Homo sapiens
  Light chain CDR3 for antibody 5976 (IGKV5-2)
LQHDNFPWT

SEQ ID NO: 11952 - protein, 19 aa, Homo sapiens
  Heavy chain CDR3 for antibody 5976 (IGHV3-33)
ARRKNYYGSGSWHYYGMDV

SEQ ID NO: 11953 - protein, 9 aa, Homo sapiens
  Light chain CDR3 for antibody 5977 (IGKV1-39)
QQSYSTPLT

SEQ ID NO: 11954 - protein, 19 aa, Homo sapiens
  Heavy chain CDR3 for antibody 5977 (IGHV3-33)
ARRRDDILTGWDYYFGMDV

SEQ ID NO: 11955 - protein, 9 aa, Homo sapiens
  Light chain CDR3 for antibody 5978 (IGKV6-21)
HQSSSLPLT

SEQ ID NO: 11956 - protein, 13 aa, Homo sapiens
  Heavy chain CDR3 for antibody 5978 (IGHV3-33)
GRTDYYSYYGVDV

SEQ ID NO: 11957 - protein, 9 aa, Homo sapiens
  Light chain CDR3 for antibody 5979 (IGKV5-2)
LQHDKFPYT

SEQ ID NO: 11958 - protein, 17 aa, Homo sapiens
  Heavy chain CDR3 for antibody 5979 (IGHV3-33)
ARGYSGYVGYYYYGMDV

SEQ ID NO: 11959 - protein, 9 aa, Homo sapiens
  Light chain CDR3 for antibody 5980 (IGKV1-6)
LQDYKSPFT

SEQ ID NO: 11960 - protein, 11 aa, Homo sapiens
  Heavy chain CDR3 for antibody 5980 (IGHV3-23)
AKGLWSYYFDY

SEQ ID NO: 11961 - protein, 8 aa, Homo sapiens
  Light chain CDR3 for antibody 5981 (IGKV1-5)
QQYNSYWT

SEQ ID NO: 11962 - protein, 19 aa, Homo sapiens
  Heavy chain CDR3 for antibody 5981 (IGHV3-33)
ARDSGYSGYDYYYYYGMDV

SEQ ID NO: 11963 - protein, 9 aa, Homo sapiens
  Light chain CDR3 for antibody 5982 (IGKV1-27)
QKYNSAPYT

SEQ ID NO: 11964 - protein, 11 aa, Homo sapiens
  Heavy chain CDR3 for antibody 5982 (IGHV3-33)
ARDILTGFLDH

SEQ ID NO: 11965 - protein, 9 aa, Homo sapiens
  Light chain CDR3 for antibody 5983 (IGKV1-6)
LQDYNYPWT

SEQ ID NO: 11966 - protein, 14 aa, Homo sapiens
  Heavy chain CDR3 for antibody 5983 (IGHV3-30)
ARGLLWFGGYGLDV

SEQ ID NO: 11967 - protein, 9 aa, Homo sapiens
  Light chain CDR3 for antibody 5984 (IGKV3D-7)
QQDYNLPWT

SEQ ID NO: 11968 - protein, 16 aa, Homo sapiens
  Heavy chain CDR3 for antibody 5984 (IGHV4-59)
ARDTPYYSGSGRPFDY

SEQ ID NO: 11969 - protein, 8 aa, Homo sapiens
  Light chain CDR3 for antibody 5985 (IGKV1D-13)
QQFNNYPT

SEQ ID NO: 11970 - protein, 12 aa, Homo sapiens
  Heavy chain CDR3 for antibody 5985 (IGHV4-59)
ARDRSGWAYFDY

SEQ ID NO: 11971 - protein, 9 aa, Homo sapiens
  Light chain CDR3 for antibody 5986 (IGKV1-6)
LQDYKSPFT

SEQ ID NO: 11972 - protein, 13 aa, Homo sapiens
  Heavy chain CDR3 for antibody 5986 (IGHV3-53)
ARDEGYRGYVLDT

SEQ ID NO: 11973 - protein, 9 aa, Homo sapiens
  Light chain CDR3 for antibody 5987 (IGKV1D-16)
QQYNSYPFT

SEQ ID NO: 11974 - protein, 15 aa, Homo sapiens
  Heavy chain CDR3 for antibody 5987 (IGHV3-23)
AKDRNYDFLTGPFDP

SEQ ID NO: 11975 - protein, 9 aa, Homo sapiens
  Light chain CDR3 for antibody 5988 (IGKV3-11)
QQRSNWMYT

SEQ ID NO: 11976 - protein, 12 aa, Homo sapiens
  Heavy chain CDR3 for antibody 5988 (IGHV3-33)
ARESGGSYSFDY

SEQ ID NO: 11977 - protein, 11 aa, Homo sapiens
  Light chain CDR3 for antibody 5989 (IGKV3-11)
QQRSNWPPTWT

SEQ ID NO: 11978 - protein, 18 aa, Homo sapiens
  Heavy chain CDR3 for antibody 5989 (IGHV3-33)
ARREGIVGATTYYYGMDV

SEQ ID NO: 11979 - protein, 10 aa, Homo sapiens
  Light chain CDR3 for antibody 5990 (IGKV3-15)
QQYNNWPPIT

SEQ ID NO: 11980 - protein, 14 aa, Homo sapiens
  Heavy chain CDR3 for antibody 5990 (IGHV3-33)
AREGYSSNWYDFDY

SEQ ID NO: 11981 - protein, 8 aa, Homo sapiens
  Light chain CDR3 for antibody 5991 (IGKV1-5)
QQYNSYWT

SEQ ID NO: 11982 - protein, 13 aa, Homo sapiens
  Heavy chain CDR3 for antibody 5991 (IGHV3-33)
ARVDTMVRGVMAY

SEQ ID NO: 11983 - protein, 9 aa, Homo sapiens
  Light chain CDR3 for antibody 5992 (IGKV2-30)
MQGTHWPLT

SEQ ID NO: 11984 - protein, 9 aa, Homo sapiens
  Heavy chain CDR3 for antibody 5992 (IGHV1-8)
ARGRLDFDY

SEQ ID NO: 11985 - protein, 9 aa, Homo sapiens
  Light chain CDR3 for antibody 5993 (IGKV6-21)
HQSSSLPYT

SEQ ID NO: 11986 - protein, 14 aa, Homo sapiens
  Heavy chain CDR3 for antibody 5993 (IGHV3-33)
ARDGAAAALDAFDI

SEQ ID NO: 11987 - protein, 8 aa, Homo sapiens
  Light chain CDR3 for antibody 5994 (IGKV1-5)
QQYNSYYT

SEQ ID NO: 11988 - protein, 17 aa, Homo sapiens
  Heavy chain CDR3 for antibody 5994 (IGHV1-18)
ARERYYGSGSYKYNMDV

SEQ ID NO: 11989 - protein, 9 aa, Homo sapiens
  Light chain CDR3 for antibody 5995 (IGKV1D-13)
QQFNNYPHT

SEQ ID NO: 11990 - protein, 13 aa, Homo sapiens
  Heavy chain CDR3 for antibody 5995 (IGHV4-39)
ARRGVVAPAAFDY

SEQ ID NO: 11991 - protein, 8 aa, Homo sapiens
  Light chain CDR3 for antibody 5996 (IGKV3D-7)
QQDYNLLT

SEQ ID NO: 11992 - protein, 13 aa, Homo sapiens
  Heavy chain CDR3 for antibody 5996 (IGHV3-23)
AKDRGLRYYGMDV

SEQ ID NO: 11993 - protein, 9 aa, Homo sapiens
  Light chain CDR3 for antibody 5997 (IGKV2-30)
MQGTHWPLT

SEQ ID NO: 11994 - protein, 12 aa, Homo sapiens
  Heavy chain CDR3 for antibody 5997 (IGHV6-1)
ARLDWNYRAFDI

SEQ ID NO: 11995 - protein, 9 aa, Homo sapiens
  Light chain CDR3 for antibody 5998 (IGKV1-39)
QQSYSTPLT

SEQ ID NO: 11996 - protein, 15 aa, Homo sapiens
  Heavy chain CDR3 for antibody 5998 (IGHV3-33)
ARDGSGSYSLYGMDV

SEQ ID NO: 11997 - protein, 9 aa, Homo sapiens
  Light chain CDR3 for antibody 5999 (IGKV5-2)
LQHDNFPYT

SEQ ID NO: 11998 - protein, 18 aa, Homo sapiens
  Heavy chain CDR3 for antibody 5999 (IGHV3-11)
ARDGYYGSGSFYYYGMDV

SEQ ID NO: 11999 - protein, 9 aa, Homo sapiens
  Light chain CDR3 for antibody 6000 (IGKV2-30)
MQGTHWPLT

SEQ ID NO: 12000 - protein, 14 aa, Homo sapiens
  Heavy chain CDR3 for antibody 6000 (IGHV3-33)
ARRGYSGYDWYFDY

SEQ ID NO: 12001 - protein, 10 aa, Homo sapiens
  Light chain CDR3 for antibody 6001 (IGKV1-39)
QQSYSTPMYT

SEQ ID NO: 12002 - protein, 17 aa, Homo sapiens
  Heavy chain CDR3 for antibody 6001 (IGHV3-33)
ARDLIGPLSSSWYPFDY

SEQ ID NO: 12003 - protein, 9 aa, Homo sapiens
  Light chain CDR3 for antibody 6002 (IGKV1-6)
LQDYNYPYT

SEQ ID NO: 12004 - protein, 19 aa, Homo sapiens
  Heavy chain CDR3 for antibody 6002 (IGHV3-20)
ARGGSGSYYNGYYYYGMDV

SEQ ID NO: 12005 - protein, 9 aa, Homo sapiens
  Light chain CDR3 for antibody 6003 (IGKV3D-20)
QQYGSSPFT

SEQ ID NO: 12006 - protein, 17 aa, Homo sapiens
  Heavy chain CDR3 for antibody 6003 (IGHV4-39)
AGRLTYYYGSGSPSFDY

SEQ ID NO: 12007 - protein, 9 aa, Homo sapiens
  Light chain CDR3 for antibody 6004 (IGKV1-9)
QQLNTYPWT

SEQ ID NO: 12008 - protein, 14 aa, Homo sapiens
  Heavy chain CDR3 for antibody 6004 (IGHV1-46)
ARRGIVGALDAFDI

SEQ ID NO: 12009 - protein, 8 aa, Homo sapiens
  Light chain CDR3 for antibody 6005 (IGKV1-5)
QQYNSYWT

SEQ ID NO: 12010 - protein, 15 aa, Homo sapiens
  Heavy chain CDR3 for antibody 6005 (IGHV3-33)
ARRGYNDYDPYGMDV

SEQ ID NO: 12011 - protein, 9 aa, Homo sapiens
  Light chain CDR3 for antibody 6006 (IGKV1-17)
LQHNSYPYT

SEQ ID NO: 12012 - protein, 15 aa, Homo sapiens
  Heavy chain CDR3 for antibody 6006 (IGHV3-33)
ATERAYGSGSSYCDY

SEQ ID NO: 12013 - protein, 9 aa, Homo sapiens
  Light chain CDR3 for antibody 6007 (IGKV1-9)
QQLKSYLYT

SEQ ID NO: 12014 - protein, 13 aa, Homo sapiens
  Heavy chain CDR3 for antibody 6007 (IGHV3-23)
ASPFNWNDGFFDY

SEQ ID NO: 12015 - protein, 9 aa, Homo sapiens
  Light chain CDR3 for antibody 6008 (IGKV1-6)
LQDYNYPYT

SEQ ID NO: 12016 - protein, 14 aa, Homo sapiens
  Heavy chain CDR3 for antibody 6008 (IGHV3-23)
VRDRIAAASSDFDN

SEQ ID NO: 12017 - protein, 11 aa, Homo sapiens
  Light chain CDR3 for antibody 6009 (IGKV3-11)
QQRSNWPPTWT

SEQ ID NO: 12018 - protein, 14 aa, Homo sapiens
  Heavy chain CDR3 for antibody 6009 (IGHV4-39)
ARQGGSGSYYNLDY

SEQ ID NO: 12019 - protein, 9 aa, Homo sapiens
  Light chain CDR3 for antibody 6010 (IGKV1-16)
QQYNSYPLT

SEQ ID NO: 12020 - protein, 18 aa, Homo sapiens
  Heavy chain CDR3 for antibody 6010 (IGHV3-23)
AKEGDYYSSGSYWGYFDL

SEQ ID NO: 12021 - protein, 9 aa, Homo sapiens
  Light chain CDR3 for antibody 6011 (IGKV3-11)
QQRSNWMYT

SEQ ID NO: 12022 - protein, 9 aa, Homo sapiens
  Heavy chain CDR3 for antibody 6011 (IGHV4-59)
AREGGSGSL

SEQ ID NO: 12023 - protein, 8 aa, Homo sapiens
  Light chain CDR3 for antibody 6012 (IGKV3D-7)
QQDYNLLT

SEQ ID NO: 12024 - protein, 20 aa, Homo sapiens
  Heavy chain CDR3 for antibody 6012 (IGHV3-33)
ARDNDSSGYYDYYYYYGMDV

SEQ ID NO: 12025 - protein, 9 aa, Homo sapiens
  Light chain CDR3 for antibody 6013 (IGKV1D-16)
QQYYSYPPT

SEQ ID NO: 12026 - protein, 13 aa, Homo sapiens
  Heavy chain CDR3 for antibody 6013 (IGHV3-11)
ARDEGYRGYVLDN

SEQ ID NO: 12027 - protein, 8 aa, Homo sapiens
  Light chain CDR3 for antibody 6014 (IGKV1-5)
QQYNSYWT

SEQ ID NO: 12028 - protein, 14 aa, Homo sapiens
  Heavy chain CDR3 for antibody 6014 (IGHV1-2)
ARDYYGSGNYYMGY

SEQ ID NO: 12029 - protein, 9 aa, Homo sapiens
  Light chain CDR3 for antibody 6015 (IGKV1-27)
QKYNSAPYT

SEQ ID NO: 12030 - protein, 10 aa, Homo sapiens
  Heavy chain CDR3 for antibody 6015 (IGHV3-30)
AREWYGGMDV

SEQ ID NO: 12031 - protein, 8 aa, Homo sapiens
  Light chain CDR3 for antibody 6016 (IGKV3D-7)
QQDYNLLT

SEQ ID NO: 12032 - protein, 10 aa, Homo sapiens
  Heavy chain CDR3 for antibody 6016 (IGHV3-33)
ARENSTPLDY

SEQ ID NO: 12033 - protein, 9 aa, Homo sapiens
  Light chain CDR3 for antibody 6017 (IGKV1D-13)
QQFNNYPYT

SEQ ID NO: 12034 - protein, 10 aa, Homo sapiens
  Heavy chain CDR3 for antibody 6017 (IGHV3-33)
ARDLRADFDY

SEQ ID NO: 12035 - protein, 9 aa, Homo sapiens
  Light chain CDR3 for antibody 6018 (IGKV3D-7)
QQDYNLPLT

SEQ ID NO: 12036 - protein, 13 aa, Homo sapiens
  Heavy chain CDR3 for antibody 6018 (IGHV3-23)
AKDRGGSYSYFDF

SEQ ID NO: 12037 - protein, 9 aa, Homo sapiens
  Light chain CDR3 for antibody 6019 (IGKV6-21)
HQSSSLPYT

SEQ ID NO: 12038 - protein, 12 aa, Homo sapiens
  Heavy chain CDR3 for antibody 6019 (IGHV3-21)
AREGFGESSFDY

SEQ ID NO: 12039 - protein, 9 aa, Homo sapiens
  Light chain CDR3 for antibody 6020 (IGKV3-11)
QQRSNWPLT

SEQ ID NO: 12040 - protein, 18 aa, Homo sapiens
  Heavy chain CDR3 for antibody 6020 (IGHV1-18)
ARDPNYYGSGSYYNYFDY

SEQ ID NO: 12041 - protein, 9 aa, Homo sapiens
  Light chain CDR3 for antibody 6021 (IGKV1-9)
QQLNTYPWT

SEQ ID NO: 12042 - protein, 17 aa, Homo sapiens
  Heavy chain CDR3 for antibody 6021 (IGHV3-33)
ARGEQWLGYYYYYGMDV

SEQ ID NO: 12043 - protein, 9 aa, Homo sapiens
  Light chain CDR3 for antibody 6022 (IGKV3D-7)
QQDYTLPLT

SEQ ID NO: 12044 - protein, 19 aa, Homo sapiens
  Heavy chain CDR3 for antibody 6022 (IGHV4-39)
ARQGDVLRYFDWLLGAFDI

SEQ ID NO: 12045 - protein, 8 aa, Homo sapiens
  Light chain CDR3 for antibody 6023 (IGKV3D-7)
QQDYNLLT

SEQ ID NO: 12046 - protein, 18 aa, Homo sapiens
  Heavy chain CDR3 for antibody 6023 (IGHV3-23)
AKEGNYYGSGSYWGYFDP

SEQ ID NO: 12047 - protein, 9 aa, Homo sapiens
  Light chain CDR3 for antibody 6024 (IGKV1-9)
QQLKSYLYT

SEQ ID NO: 12048 - protein, 9 aa, Homo sapiens
  Heavy chain CDR3 for antibody 6024 (IGHV1-8)
ARGRLDFDY

SEQ ID NO: 12049 - protein, 10 aa, Homo sapiens
  Light chain CDR3 for antibody 6025 (IGKV3-11)
QQRSNWPIFT

SEQ ID NO: 12050 - protein, 11 aa, Homo sapiens
  Heavy chain CDR3 for antibody 6025 (IGHV3-33)
ARAGIAAVFDY

SEQ ID NO: 12051 - protein, 8 aa, Homo sapiens
  Light chain CDR3 for antibody 6026 (IGKV3D-7)
QQDYNLLT

SEQ ID NO: 12052 - protein, 19 aa, Homo sapiens
  Heavy chain CDR3 for antibody 6026 (IGHV3-33)
TRDPHYDILTGYAYYGMDV

SEQ ID NO: 12053 - protein, 9 aa, Homo sapiens
  Light chain CDR3 for antibody 6027 (IGKV1-6)
LQDYKSPFT

SEQ ID NO: 12054 - protein, 17 aa, Homo sapiens
  Heavy chain CDR3 for antibody 6027 (IGHV3-33)
ARGFSGYDGYYYYGMDV

SEQ ID NO: 12055 - protein, 9 aa, Homo sapiens
  Light chain CDR3 for antibody 6028 (IGKV3-15)
QQYNNWPRT

SEQ ID NO: 12056 - protein, 18 aa, Homo sapiens
  Heavy chain CDR3 for antibody 6028 (IGHV3-33)
ARGYYGSGNFYKDSGMDV

SEQ ID NO: 12057 - protein, 9 aa, Homo sapiens
  Light chain CDR3 for antibody 6029 (IGKV3-20)
QQFGRSPRT

SEQ ID NO: 12058 - protein, 17 aa, Homo sapiens
  Heavy chain CDR3 for antibody 6029 (IGHV1-18)
ARDRAFTMVRGVPPFDY

SEQ ID NO: 12059 - protein, 9 aa, Homo sapiens
  Light chain CDR3 for antibody 6030 (IGKV1-9)
QQLKSYLYT

SEQ ID NO: 12060 - protein, 11 aa, Homo sapiens
  Heavy chain CDR3 for antibody 6030 (IGHV3-33)
ARARYTTGLDY

SEQ ID NO: 12061 - protein, 10 aa, Homo sapiens
  Light chain CDR3 for antibody 6031 (IGKV3-11)
QQRSNWPIFT

SEQ ID NO: 12062 - protein, 18 aa, Homo sapiens
  Heavy chain CDR3 for antibody 6031 (IGHV1-18)
ARDPNYYGSGSYYNYFDY

SEQ ID NO: 12063 - protein, 10 aa, Homo sapiens
  Light chain CDR3 for antibody 6032 (IGKV1-9)
QQLNSFLMYT

SEQ ID NO: 12064 - protein, 18 aa, Homo sapiens
  Heavy chain CDR3 for antibody 6032 (IGHV4-59)
AREGDYVWGSYRPNWFDP

SEQ ID NO: 12065 - protein, 8 aa, Homo sapiens
  Light chain CDR3 for antibody 6033 (IGKV1-5)
QQYNSYST

SEQ ID NO: 12066 - protein, 12 aa, Homo sapiens
  Heavy chain CDR3 for antibody 6033 (IGHV1-24)
ASDWAYYYGMDV

SEQ ID NO: 12067 - protein, 9 aa, Homo sapiens
  Light chain CDR3 for antibody 6034 (IGKV3D-7)
QQDYNLPYT

SEQ ID NO: 12068 - protein, 14 aa, Homo sapiens
  Heavy chain CDR3 for antibody 6034 (IGHV3-33)
ARGGYSGYRYYFDY

SEQ ID NO: 12069 - protein, 9 aa, Homo sapiens
  Light chain CDR3 for antibody 6035 (IGKV2-30)
MQGTHWPLT

SEQ ID NO: 12070 - protein, 14 aa, Homo sapiens
  Heavy chain CDR3 for antibody 6035 (IGHV1-46)
ARRGIVGALDAFDI

SEQ ID NO: 12071 - protein, 9 aa, Homo sapiens
  Light chain CDR3 for antibody 6036 (IGKV5-2)
LQHDNFPWT

SEQ ID NO: 12072 - protein, 9 aa, Homo sapiens
  Heavy chain CDR3 for antibody 6036 (IGHV4-59)
ARDDGDFDY

SEQ ID NO: 12073 - protein, 9 aa, Homo sapiens
  Light chain CDR3 for antibody 6037 (IGKV3-11)
QQRSNWMYT

SEQ ID NO: 12074 - protein, 16 aa, Homo sapiens
  Heavy chain CDR3 for antibody 6037 (IGHV3-23)
AKEGEVLRYFDWLFNY

SEQ ID NO: 12075 - protein, 9 aa, Homo sapiens
  Light chain CDR3 for antibody 6038 (IGKV1-9)
QQLNSYPYT

SEQ ID NO: 12076 - protein, 11 aa, Homo sapiens
  Heavy chain CDR3 for antibody 6038 (IGHV3-33)
ARDRSSGPFDY

SEQ ID NO: 12077 - protein, 8 aa, Homo sapiens
  Light chain CDR3 for antibody 6039 (IGKV3-20)
QQYGRSFT

SEQ ID NO: 12078 - protein, 9 aa, Homo sapiens
  Heavy chain CDR3 for antibody 6039 (IGHV4-39)
AREGGSGSL

SEQ ID NO: 12079 - protein, 9 aa, Homo sapiens
  Light chain CDR3 for antibody 6040 (IGKV2-30)
MQGTHWPLT

SEQ ID NO: 12080 - protein, 18 aa, Homo sapiens
  Heavy chain CDR3 for antibody 6040 (IGHV3-33)
AREGDYYGSGGFPNWFDP

SEQ ID NO: 12081 - protein, 9 aa, Homo sapiens
  Light chain CDR3 for antibody 6041 (IGKV1D-16)
QQYNSYPLT

SEQ ID NO: 12082 - protein, 14 aa, Homo sapiens
  Heavy chain CDR3 for antibody 6041 (IGHV3-33)
ARGLEWGGDNWFDP

SEQ ID NO: 12083 - protein, 9 aa, Homo sapiens
  Light chain CDR3 for antibody 6042 (IGKV1-9)
QQLNSYPWT

SEQ ID NO: 12084 - protein, 13 aa, Homo sapiens
  Heavy chain CDR3 for antibody 6042 (IGHV3-33)
AGDWGYSHGYFDY

SEQ ID NO: 12085 - protein, 8 aa, Homo sapiens
  Light chain CDR3 for antibody 6043 (IGKV3-20)
QQYGSSLT

SEQ ID NO: 12086 - protein, 12 aa, Homo sapiens
  Heavy chain CDR3 for antibody 6043 (IGHV3-33)
ARGYFGSGYAHF

SEQ ID NO: 12087 - protein, 9 aa, Homo sapiens
  Light chain CDR3 for antibody 6044 (IGKV3D-7)
QQDYTLPLT

SEQ ID NO: 12088 - protein, 17 aa, Homo sapiens
  Heavy chain CDR3 for antibody 6044 (IGHV3-23)
AKDYDILTGYSHNWFDP

SEQ ID NO: 12089 - protein, 9 aa, Homo sapiens
  Light chain CDR3 for antibody 6045 (IGKV3-15)
QQYNNWPLT

SEQ ID NO: 12090 - protein, 17 aa, Homo sapiens
  Heavy chain CDR3 for antibody 6045 (IGHV4-59)
ARVLRYFDWLSHDAFDI

SEQ ID NO: 12091 - protein, 9 aa, Homo sapiens
  Light chain CDR3 for antibody 6046 (IGKV3-11)
QQRSNWPPT

SEQ ID NO: 12092 - protein, 8 aa, Homo sapiens
  Heavy chain CDR3 for antibody 6046 (IGHV3-33)
ARDRGFDY

SEQ ID NO: 12093 - protein, 9 aa, Homo sapiens
  Light chain CDR3 for antibody 6047 (IGKV1-39)
QQSYSTPYT

SEQ ID NO: 12094 - protein, 15 aa, Homo sapiens
  Heavy chain CDR3 for antibody 6047 (IGHV3-23)
AKDRYFDWLSDAFDI

SEQ ID NO: 12095 - protein, 8 aa, Homo sapiens
  Light chain CDR3 for antibody 6048 (IGKV3-11)
QQRSNWLT

SEQ ID NO: 12096 - protein, 12 aa, Homo sapiens
  Heavy chain CDR3 for antibody 6048 (IGHV1-24)
ASDWAYYYGMDV

SEQ ID NO: 12097 - protein, 9 aa, Homo sapiens
  Light chain CDR3 for antibody 6049 (IGKV5-2)
LQHDNFPWT

SEQ ID NO: 12098 - protein, 15 aa, Homo sapiens
  Heavy chain CDR3 for antibody 6049 (IGHV4-39)
ARRVRGLIITRYFDY

SEQ ID NO: 12099 - protein, 8 aa, Homo sapiens
  Light chain CDR3 for antibody 6050 (IGKV3-11)
LQRGNWPT

SEQ ID NO: 12100 - protein, 18 aa, Homo sapiens
  Heavy chain CDR3 for antibody 6050 (IGHV1-46)
ARDGDYVWGSYRSDWFDP

SEQ ID NO: 12101 - protein, 8 aa, Homo sapiens
  Light chain CDR3 for antibody 6051 (IGKV3-20)
QQYGRSFT

SEQ ID NO: 12102 - protein, 17 aa, Homo sapiens
  Heavy chain CDR3 for antibody 6051 (IGHV3-33)
ARGEQWLGYYYYYGMDV

SEQ ID NO: 12103 - protein, 9 aa, Homo sapiens
  Light chain CDR3 for antibody 6052 (IGKV3-11)
QQRINWPWT

SEQ ID NO: 12104 - protein, 13 aa, Homo sapiens
  Heavy chain CDR3 for antibody 6052 (IGHV4-61)
ASRYSSGWYPFDY

SEQ ID NO: 12105 - protein, 9 aa, Homo sapiens
  Light chain CDR3 for antibody 6053 (IGKV3D-7)
QQDYEFPIT

SEQ ID NO: 12106 - protein, 17 aa, Homo sapiens
  Heavy chain CDR3 for antibody 6053 (IGHV1-18)
ARDEGYDILTGYPHFDY

SEQ ID NO: 12107 - protein, 8 aa, Homo sapiens
  Light chain CDR3 for antibody 6054 (IGKV1-5)
QQYNSYWT

SEQ ID NO: 12108 - protein, 15 aa, Homo sapiens
  Heavy chain CDR3 for antibody 6054 (IGHV3-33)
ARGYYYGSGSFPVDY

SEQ ID NO: 12109 - protein, 9 aa, Homo sapiens
  Light chain CDR3 for antibody 6055 (IGKV2-30)
MQGTHWPLT

SEQ ID NO: 12110 - protein, 17 aa, Homo sapiens
  Heavy chain CDR3 for antibody 6055 (IGHV3-11)
ARDLIGPLSSSWYPFDY

SEQ ID NO: 12111 - protein, 9 aa, Homo sapiens
  Light chain CDR3 for antibody 6056 (IGKV3-20)
QQYGSSPYT

SEQ ID NO: 12112 - protein, 20 aa, Homo sapiens
  Heavy chain CDR3 for antibody 6056 (IGHV3-23)
AKDRMTTVTSYYYYSYGMDV

SEQ ID NO: 12113 - protein, 9 aa, Homo sapiens
  Light chain CDR3 for antibody 6057 (IGKV3D-7)
QQDYSFPLT

SEQ ID NO: 12114 - protein, 11 aa, Homo sapiens
  Heavy chain CDR3 for antibody 6057 (IGHV4-59)
ARDGSWEPFDY

SEQ ID NO: 12115 - protein, 10 aa, Homo sapiens
  Light chain CDR3 for antibody 6058 (IGKV3-11)
QQRSNWPPFT

SEQ ID NO: 12116 - protein, 9 aa, Homo sapiens
  Heavy chain CDR3 for antibody 6058 (IGHV3-23)
AKEQLLFDY

SEQ ID NO: 12117 - protein, 9 aa, Homo sapiens
  Light chain CDR3 for antibody 6059 (IGKV3-11)
QQRSSWPPT

SEQ ID NO: 12118 - protein, 14 aa, Homo sapiens
  Heavy chain CDR3 for antibody 6059 (IGHV3-33)
ARGAAAGNFYGLDV

SEQ ID NO: 12119 - protein, 10 aa, Homo sapiens
  Light chain CDR3 for antibody 6060 (IGKV1-17)
LQHNSYPMYT

SEQ ID NO: 12120 - protein, 17 aa, Homo sapiens
  Heavy chain CDR3 for antibody 6060 (IGHV3-23)
AKDGSFYSSGWYDAFDI

SEQ ID NO: 12121 - protein, 9 aa, Homo sapiens
  Light chain CDR3 for antibody 6061 (IGKV5-2)
LQHDKFPYT

SEQ ID NO: 12122 - protein, 12 aa, Homo sapiens
  Heavy chain CDR3 for antibody 6061 (IGHV3-33)
ARVDTAAPYFDY

SEQ ID NO: 12123 - protein, 8 aa, Homo sapiens
  Light chain CDR3 for antibody 6062 (IGKV1D-13)
QQFNNYPT

SEQ ID NO: 12124 - protein, 19 aa, Homo sapiens
  Heavy chain CDR3 for antibody 6062 (IGHV3-33)
ARGVRLRYFDPYYYYGMDV

SEQ ID NO: 12125 - protein, 9 aa, Homo sapiens
  Light chain CDR3 for antibody 6063 (IGKV1-6)
LQDYKSPFT

SEQ ID NO: 12126 - protein, 10 aa, Homo sapiens
  Heavy chain CDR3 for antibody 6063 (IGHV3-23)
AKEQWLVLDY

SEQ ID NO: 12127 - protein, 9 aa, Homo sapiens
  Light chain CDR3 for antibody 6064 (IGKV3D-7)
QQDYNLPLT

SEQ ID NO: 12128 - protein, 12 aa, Homo sapiens
  Heavy chain CDR3 for antibody 6064 (IGHV1-18)
AGVLFDGDYFDY

SEQ ID NO: 12129 - protein, 8 aa, Homo sapiens
  Light chain CDR3 for antibody 6065 (IGKV1D-13)
QQFNNYPT

SEQ ID NO: 12130 - protein, 18 aa, Homo sapiens
  Heavy chain CDR3 for antibody 6065 (IGHV3-33)
ARKGGYYSGSGSYRHFDF

SEQ ID NO: 12131 - protein, 9 aa, Homo sapiens
  Light chain CDR3 for antibody 6066 (IGKV3-15)
QQYNNWPLT

SEQ ID NO: 12132 - protein, 14 aa, Homo sapiens
  Heavy chain CDR3 for antibody 6066 (IGHV1-18)
ARCFGSGSYGWFDP

SEQ ID NO: 12133 - protein, 9 aa, Homo sapiens
  Light chain CDR3 for antibody 6067 (IGKV1-6)
LQDYNYPYT

SEQ ID NO: 12134 - protein, 11 aa, Homo sapiens
  Heavy chain CDR3 for antibody 6067 (IGHV3-30)
VRVGTGEFFDL

SEQ ID NO: 12135 - protein, 9 aa, Homo sapiens
  Light chain CDR3 for antibody 6068 (IGKV1D-16)
QQYNSYPRT

SEQ ID NO: 12136 - protein, 21 aa, Homo sapiens
  Heavy chain CDR3 for antibody 6068 (IGHV3-33)
ARDGGITMGRGVYYYYYGMDV

SEQ ID NO: 12137 - protein, 9 aa, Homo sapiens
  Light chain CDR3 for antibody 6069 (IGKV1-6)
LQDYNYPYT

SEQ ID NO: 12138 - protein, 14 aa, Homo sapiens
  Heavy chain CDR3 for antibody 6069 (IGHV3-33)
AREGILTGYYPFDY

SEQ ID NO: 12139 - protein, 9 aa, Homo sapiens
  Light chain CDR3 for antibody 6070 (IGKV2-30)
MQGTHWPLT

SEQ ID NO: 12140 - protein, 17 aa, Homo sapiens
  Heavy chain CDR3 for antibody 6070 (IGHV3-33)
VREGGLLWVGELSLFDY

SEQ ID NO: 12141 - protein, 8 aa, Homo sapiens
  Light chain CDR3 for antibody 6071 (IGKV1-5)
QQYNSYWT

SEQ ID NO: 12142 - protein, 16 aa, Homo sapiens
  Heavy chain CDR3 for antibody 6071 (IGHV4-59)
ARDTPYYSGSGRPFDH

SEQ ID NO: 12143 - protein, 9 aa, Homo sapiens
  Light chain CDR3 for antibody 6072 (IGKV2-30)
MQGTHWPLT

SEQ ID NO: 12144 - protein, 12 aa, Homo sapiens
  Heavy chain CDR3 for antibody 6072 (IGHV3-33)
ARGYFTSGSAHY

SEQ ID NO: 12145 - protein, 9 aa, Homo sapiens
  Light chain CDR3 for antibody 6073 (IGKV1D-13)
QRFNNYLYT

SEQ ID NO: 12146 - protein, 9 aa, Homo sapiens
  Heavy chain CDR3 for antibody 6073 (IGHV1-18)
ARGKDWFDP

SEQ ID NO: 12147 - protein, 9 aa, Homo sapiens
  Light chain CDR3 for antibody 6074 (IGKV1-17)
LQHNSYPWT

SEQ ID NO: 12148 - protein, 11 aa, Homo sapiens
  Heavy chain CDR3 for antibody 6074 (IGHV3-33)
ATERDMVRGDY

SEQ ID NO: 12149 - protein, 9 aa, Homo sapiens
  Light chain CDR3 for antibody 6075 (IGKV1-39)
QQSYRTPLT

SEQ ID NO: 12150 - protein, 16 aa, Homo sapiens
  Heavy chain CDR3 for antibody 6075 (IGHV3-33)
AREVAGSYYYYYGMDV

SEQ ID NO: 12151 - protein, 9 aa, Homo sapiens
  Light chain CDR3 for antibody 6076 (IGKV1-17)
LQHNGYPLT

SEQ ID NO: 12152 - protein, 15 aa, Homo sapiens
  Heavy chain CDR3 for antibody 6076 (IGHV3-33)
ARGYYYGSGSFPVDY

SEQ ID NO: 12153 - protein, 9 aa, Homo sapiens
  Light chain CDR3 for antibody 6077 (IGKV1-9)
LQHNSYPYT

SEQ ID NO: 12154 - protein, 17 aa, Homo sapiens
  Heavy chain CDR3 for antibody 6077 (IGHV3-33)
ARKDYGILSGYYSPFDY

SEQ ID NO: 12155 - protein, 9 aa, Homo sapiens
  Light chain CDR3 for antibody 6078 (IGKV2D-28)
MQALQTPPT

SEQ ID NO: 12156 - protein, 14 aa, Homo sapiens
  Heavy chain CDR3 for antibody 6078 (IGHV3-23)
ANWAYDILTGYLDY

SEQ ID NO: 12157 - protein, 8 aa, Homo sapiens
  Light chain CDR3 for antibody 6079 (IGKV1D-13)
QQFNNYYT

SEQ ID NO: 12158 - protein, 16 aa, Homo sapiens
  Heavy chain CDR3 for antibody 6079 (IGHV1-18)
ARYFDWLLRDYYGMDV

SEQ ID NO: 12159 - protein, 9 aa, Homo sapiens
  Light chain CDR3 for antibody 6080 (IGKV3-15)
QQYNNWPRT

SEQ ID NO: 12160 - protein, 12 aa, Homo sapiens
  Heavy chain CDR3 for antibody 6080 (IGHV4-59)
ARDRSGWAYFDY

SEQ ID NO: 12161 - protein, 9 aa, Homo sapiens
  Light chain CDR3 for antibody 6081 (IGKV1-9)
QQLISYPLT

SEQ ID NO: 12162 - protein, 15 aa, Homo sapiens
  Heavy chain CDR3 for antibody 6081 (IGHV1-18)
ARGYCSSTSCYYFDY

SEQ ID NO: 12163 - protein, 9 aa, Homo sapiens
  Light chain CDR3 for antibody 6082 (IGKV3D-20)
QQYGNSPRT

SEQ ID NO: 12164 - protein, 13 aa, Homo sapiens
  Heavy chain CDR3 for antibody 6082 (IGHV3-33)
ARRATLVRGVFDP

SEQ ID NO: 12165 - protein, 9 aa, Homo sapiens
  Light chain CDR3 for antibody 6083 (IGKV1-17)
QQLNSYPWT

SEQ ID NO: 12166 - protein, 13 aa, Homo sapiens
  Heavy chain CDR3 for antibody 6083 (IGHV3-23)
ASPFNWNDGFFDY

SEQ ID NO: 12167 - protein, 10 aa, Homo sapiens
  Light chain CDR3 for antibody 6084 (IGKV3-11)
QQRSNWPIFT

SEQ ID NO: 12168 - protein, 9 aa, Homo sapiens
  Heavy chain CDR3 for antibody 6084 (IGHV4-59)
AGGSWDFDY

SEQ ID NO: 12169 - protein, 9 aa, Homo sapiens
  Light chain CDR3 for antibody 6085 (IGKV2-30)
MQGTHWPLT

SEQ ID NO: 12170 - protein, 13 aa, Homo sapiens
  Heavy chain CDR3 for antibody 6085 (IGHV3-33)
AREYFDWLLPLDY

SEQ ID NO: 12171 - protein, 9 aa, Homo sapiens
  Light chain CDR3 for antibody 6086 (IGKV3D-7)
QQDYNLPLT

SEQ ID NO: 12172 - protein, 18 aa, Homo sapiens
  Heavy chain CDR3 for antibody 6086 (IGHV3-33)
ARERDYYGSGSYPDAFDI

SEQ ID NO: 12173 - protein, 9 aa, Homo sapiens
  Light chain CDR3 for antibody 6087 (IGKV6-21)
HQSSSLPYT

SEQ ID NO: 12174 - protein, 13 aa, Homo sapiens
  Heavy chain CDR3 for antibody 6087 (IGHV3-33)
ASAGNSYYNVMDV

SEQ ID NO: 12175 - protein, 9 aa, Homo sapiens
  Light chain CDR3 for antibody 6088 (IGKV1-6)
LQGFNYPRT

SEQ ID NO: 12176 - protein, 13 aa, Homo sapiens
  Heavy chain CDR3 for antibody 6088 (IGHV4-34)
ASNFYYYYYGMDV

SEQ ID NO: 12177 - protein, 9 aa, Homo sapiens
  Light chain CDR3 for antibody 6089 (IGKV1-39)
QQSYSTPYT

SEQ ID NO: 12178 - protein, 18 aa, Homo sapiens
  Heavy chain CDR3 for antibody 6089 (IGHV3-33)
ARGGVLYDILTGFYGMDV

SEQ ID NO: 12179 - protein, 10 aa, Homo sapiens
  Light chain CDR3 for antibody 6090 (IGKV1-17)
LQHNSYPMYT

SEQ ID NO: 12180 - protein, 14 aa, Homo sapiens
  Heavy chain CDR3 for antibody 6090 (IGHV3-33)
ARAGSGYDRDWFDP

SEQ ID NO: 12181 - protein, 9 aa, Homo sapiens
  Light chain CDR3 for antibody 6091 (IGKV5-2)
LQHDNFPYT

SEQ ID NO: 12182 - protein, 9 aa, Homo sapiens
  Heavy chain CDR3 for antibody 6091 (IGHV3-30)
ARGRVSLDV

SEQ ID NO: 12183 - protein, 9 aa, Homo sapiens
  Light chain CDR3 for antibody 6092 (IGKV1D-13)
QQFNNYPST

SEQ ID NO: 12184 - protein, 6 aa, Homo sapiens
  Heavy chain CDR3 for antibody 6092 (IGHV1-8)
AREGTY

SEQ ID NO: 12185 - protein, 8 aa, Homo sapiens
  Light chain CDR3 for antibody 6093 (IGKV3-11)
LQRGNWPT

SEQ ID NO: 12186 - protein, 11 aa, Homo sapiens
  Heavy chain CDR3 for antibody 6093 (IGHV3-33)
ARDRSSGPFDY

SEQ ID NO: 12187 - protein, 9 aa, Homo sapiens
  Light chain CDR3 for antibody 6094 (IGKV1-16)
QHYNDYPFT

SEQ ID NO: 12188 - protein, 13 aa, Homo sapiens
  Heavy chain CDR3 for antibody 6094 (IGHV4-34)
ASNFYYYYYGMDV

SEQ ID NO: 12189 - protein, 9 aa, Homo sapiens
  Light chain CDR3 for antibody 6095 (IGKV3-11)
QQRSNWMYT

SEQ ID NO: 12190 - protein, 10 aa, Homo sapiens
  Heavy chain CDR3 for antibody 6095 (IGHV3-74)
ARENWGGFDY

SEQ ID NO: 12191 - protein, 9 aa, Homo sapiens
  Light chain CDR3 for antibody 6096 (IGKV3-11)
QQRSNWPYT

SEQ ID NO: 12192 - protein, 18 aa, Homo sapiens
  Heavy chain CDR3 for antibody 6096 (IGHV3-33)
ARERGYYGSDIYPAAFDI

SEQ ID NO: 12193 - protein, 9 aa, Homo sapiens
  Light chain CDR3 for antibody 6097 (IGKV6-21)
HQSSSLPYT

SEQ ID NO: 12194 - protein, 12 aa, Homo sapiens
  Heavy chain CDR3 for antibody 6097 (IGHV3-13)
AIGTMVRGIPDY

SEQ ID NO: 12195 - protein, 8 aa, Homo sapiens
  Light chain CDR3 for antibody 6098 (IGKV3D-7)
QQDYNLLT

SEQ ID NO: 12196 - protein, 17 aa, Homo sapiens
  Heavy chain CDR3 for antibody 6098 (IGHV3-23)
AKDGIGELSYYYYGMDV

SEQ ID NO: 12197 - protein, 10 aa, Homo sapiens
  Light chain CDR3 for antibody 6099 (IGKV1-17)
LQHNSYPMYT

SEQ ID NO: 12198 - protein, 14 aa, Homo sapiens
  Heavy chain CDR3 for antibody 6099 (IGHV3-33)
ARTTAAAGPRDFQH

SEQ ID NO: 12199 - protein, 9 aa, Homo sapiens
  Light chain CDR3 for antibody 6100 (IGKV1D-16)
QQYAGYPPT

SEQ ID NO: 12200 - protein, 18 aa, Homo sapiens
  Heavy chain CDR3 for antibody 6100 (IGHV4-59)
AREGDYVWGSYRPNWFDP

SEQ ID NO: 12201 - protein, 10 aa, Homo sapiens
  Light chain CDR3 for antibody 6101 (IGKV1-17)
LQHNSYPMYT

SEQ ID NO: 12202 - protein, 10 aa, Homo sapiens
  Heavy chain CDR3 for antibody 6101 (IGHV3-33)
ARENSTPLDY

SEQ ID NO: 12203 - protein, 8 aa, Homo sapiens
  Light chain CDR3 for antibody 6102 (IGKV3D-7)
QQDYNLLT

SEQ ID NO: 12204 - protein, 15 aa, Homo sapiens
  Heavy chain CDR3 for antibody 6102 (IGHV3-23)
AKDGSYYDYYYGMDV

SEQ ID NO: 12205 - protein, 9 aa, Homo sapiens
  Light chain CDR3 for antibody 6103 (IGKV1-9)
QQLNSYPLT

SEQ ID NO: 12206 - protein, 9 aa, Homo sapiens
  Heavy chain CDR3 for antibody 6103 (IGHV3-23)
AKEQQLFDY

SEQ ID NO: 12207 - protein, 10 aa, Homo sapiens
  Light chain CDR3 for antibody 6104 (IGKV3-11)
QQRSNWPIFT

SEQ ID NO: 12208 - protein, 14 aa, Homo sapiens
  Heavy chain CDR3 for antibody 6104 (IGHV3-33)
ARRGYSGYDWYFDY

SEQ ID NO: 12209 - protein, 9 aa, Homo sapiens
  Light chain CDR3 for antibody 6105 (IGKV4-1)
QQYYSTPWT

SEQ ID NO: 12210 - protein, 12 aa, Homo sapiens
  Heavy chain CDR3 for antibody 6105 (IGHV3-33)
TRGYSSKSYFDY

SEQ ID NO: 12211 - protein, 9 aa, Homo sapiens
  Light chain CDR3 for antibody 6106 (IGKV3D-7)
QQDYEFPIT

SEQ ID NO: 12212 - protein, 16 aa, Homo sapiens
  Heavy chain CDR3 for antibody 6106 (IGHV1-24)
ATEDSSSTYYYYGLDV

SEQ ID NO: 12213 - protein, 9 aa, Homo sapiens
  Light chain CDR3 for antibody 6107 (IGKV1-17)
LQHNSYPYT

SEQ ID NO: 12214 - protein, 17 aa, Homo sapiens
  Heavy chain CDR3 for antibody 6107 (IGHV3-13)
AREGWFGELWGYYGMDV

SEQ ID NO: 12215 - protein, 9 aa, Homo sapiens
  Light chain CDR3 for antibody 6108 (IGKV1-27)
QKYNSAPYT

SEQ ID NO: 12216 - protein, 16 aa, Homo sapiens
  Heavy chain CDR3 for antibody 6108 (IGHV1-24)
ATEDSSSYYYYYGMDV

SEQ ID NO: 12217 - protein, 8 aa, Homo sapiens
  Light chain CDR3 for antibody 6109 (IGKV3D-7)
QQDYNLVT

SEQ ID NO: 12218 - protein, 14 aa, Homo sapiens
  Heavy chain CDR3 for antibody 6109 (IGHV1-46)
ARRGIVGALDAFDI

SEQ ID NO: 12219 - protein, 9 aa, Homo sapiens
  Light chain CDR3 for antibody 6110 (IGKV3-11)
QQRSNWMYT

SEQ ID NO: 12220 - protein, 13 aa, Homo sapiens
  Heavy chain CDR3 for antibody 6110 (IGHV3-21)
ARDSTLVRGVFPY

SEQ ID NO: 12221 - protein, 9 aa, Homo sapiens
  Light chain CDR3 for antibody 6111 (IGKV1-39)
QQSYSTPFT

SEQ ID NO: 12222 - protein, 17 aa, Homo sapiens
  Heavy chain CDR3 for antibody 6111 (IGHV1-46)
AREGADSGIYYHWYFDL

SEQ ID NO: 12223 - protein, 8 aa, Homo sapiens
  Light chain CDR3 for antibody 6112 (IGKV3D-7)
QQDYNLLT

SEQ ID NO: 12224 - protein, 11 aa, Homo sapiens
  Heavy chain CDR3 for antibody 6112 (IGHV3-33)
AREGAVARFDY

SEQ ID NO: 12225 - protein, 9 aa, Homo sapiens
  Light chain CDR3 for antibody 6113 (IGKV1-39)
QQSYSTPYT

SEQ ID NO: 12226 - protein, 15 aa, Homo sapiens
  Heavy chain CDR3 for antibody 6113 (IGHV3-33)
ARHSSGFYYYYGMDV

SEQ ID NO: 12227 - protein, 9 aa, Homo sapiens
  Light chain CDR3 for antibody 6114 (IGKV1D-13)
QQFNNYPRT

SEQ ID NO: 12228 - protein, 17 aa, Homo sapiens
  Heavy chain CDR3 for antibody 6114 (IGHV1-18)
ARERYYGSGIYKYAMDV

SEQ ID NO: 12229 - protein, 9 aa, Homo sapiens
  Light chain CDR3 for antibody 6115 (IGKV3-11)
QQRSNWPLT

SEQ ID NO: 12230 - protein, 17 aa, Homo sapiens
  Heavy chain CDR3 for antibody 6115 (IGHV3-33)
AREDYDILTGYPFYFDY

SEQ ID NO: 12231 - protein, 10 aa, Homo sapiens
  Light chain CDR3 for antibody 6116 (IGKV1-17)
LQHNSYPMYT

SEQ ID NO: 12232 - protein, 12 aa, Homo sapiens
  Heavy chain CDR3 for antibody 6116 (IGHV3-33)
ARDRAYRGSLDY

SEQ ID NO: 12233 - protein, 9 aa, Homo sapiens
  Light chain CDR3 for antibody 6117 (IGKV3-20)
QQYGSSPYT

SEQ ID NO: 12234 - protein, 18 aa, Homo sapiens
  Heavy chain CDR3 for antibody 6117 (IGHV3-33)
VRERGHYGSGSFPDAFDI

SEQ ID NO: 12235 - protein, 8 aa, Homo sapiens
  Light chain CDR3 for antibody 6118 (IGKV6-21)
HQSSSLPT

SEQ ID NO: 12236 - protein, 14 aa, Homo sapiens
  Heavy chain CDR3 for antibody 6118 (IGHV3-23)
AKSRIVGALYYFDY

SEQ ID NO: 12237 - protein, 9 aa, Homo sapiens
  Light chain CDR3 for antibody 6119 (IGKV1-39)
QQSYRTPLT

SEQ ID NO: 12238 - protein, 18 aa, Homo sapiens
  Heavy chain CDR3 for antibody 6119 (IGHV1-46)
ARDLTGRTENYYFYGMDV

SEQ ID NO: 12239 - protein, 11 aa, Homo sapiens
  Light chain CDR3 for antibody 6120 (IGKV3-11)
QQRSNWPPTWT

SEQ ID NO: 12240 - protein, 9 aa, Homo sapiens
  Heavy chain CDR3 for antibody 6120 (IGHV1-8)
ARGRLDFDY

SEQ ID NO: 12241 - protein, 9 aa, Homo sapiens
  Light chain CDR3 for antibody 6121 (IGKV1D-16)
QQYITYPYT

SEQ ID NO: 12242 - protein, 13 aa, Homo sapiens
  Heavy chain CDR3 for antibody 6121 (IGHV3-33)
ARAFTMVRGVIDY

SEQ ID NO: 12243 - protein, 9 aa, Homo sapiens
  Light chain CDR3 for antibody 6122 (IGKV5-2)
LQHDKFPYT

SEQ ID NO: 12244 - protein, 9 aa, Homo sapiens
  Heavy chain CDR3 for antibody 6122 (IGHV3-30)
ARDYFHFDY

SEQ ID NO: 12245 - protein, 9 aa, Homo sapiens
  Light chain CDR3 for antibody 6123 (IGKV1-39)
QQSYSTPLT

SEQ ID NO: 12246 - protein, 15 aa, Homo sapiens
  Heavy chain CDR3 for antibody 6123 (IGHV3-64)
ARDSHHDLLTGHYEY

SEQ ID NO: 12247 - protein, 9 aa, Homo sapiens
  Light chain CDR3 for antibody 6124 (IGKV1-6)
LQDYKSPFT

SEQ ID NO: 12248 - protein, 9 aa, Homo sapiens
  Heavy chain CDR3 for antibody 6124 (IGHV3-33)
ARATVGVDY

SEQ ID NO: 12249 - protein, 9 aa, Homo sapiens
  Light chain CDR3 for antibody 6125 (IGKV1-39)
QQSYSTPYT

SEQ ID NO: 12250 - protein, 18 aa, Homo sapiens
  Heavy chain CDR3 for antibody 6125 (IGHV3-33)
ARDYDSLTTYPEDYGMDV

SEQ ID NO: 12251 - protein, 9 aa, Homo sapiens
  Light chain CDR3 for antibody 6126 (IGKV1D-13)
QRFNNYLYT

SEQ ID NO: 12252 - protein, 11 aa, Homo sapiens
  Heavy chain CDR3 for antibody 6126 (IGHV3-33)
ARDTWDDYFDY

SEQ ID NO: 12253 - protein, 9 aa, Homo sapiens
  Light chain CDR3 for antibody 6127 (IGKV4-1)
QQYYTTPPT

SEQ ID NO: 12254 - protein, 13 aa, Homo sapiens
  Heavy chain CDR3 for antibody 6127 (IGHV3-33)
ARTDYYFYYGLDV

SEQ ID NO: 12255 - protein, 9 aa, Homo sapiens
  Light chain CDR3 for antibody 6128 (IGKV5-2)
LQHDNFPYT

SEQ ID NO: 12256 - protein, 15 aa, Homo sapiens
  Heavy chain CDR3 for antibody 6128 (IGHV3-20)
AREGSSSWYLYYFDY

SEQ ID NO: 12257 - protein, 9 aa, Homo sapiens
  Light chain CDR3 for antibody 6129 (IGKV1-39)
QQSYSTPYT

SEQ ID NO: 12258 - protein, 15 aa, Homo sapiens
  Heavy chain CDR3 for antibody 6129 (IGHV3-23)
AKAGGRYFDWFPFDY

SEQ ID NO: 12259 - protein, 9 aa, Homo sapiens
  Light chain CDR3 for antibody 6130 (IGKV3-15)
QQYNNWPLT

SEQ ID NO: 12260 - protein, 11 aa, Homo sapiens
  Heavy chain CDR3 for antibody 6130 (IGHV4-59)
ARDGVRGVFDI

SEQ ID NO: 12261 - protein, 9 aa, Homo sapiens
  Light chain CDR3 for antibody 6131 (IGKV2D-28)
MQALQTPPT

SEQ ID NO: 12262 - protein, 12 aa, Homo sapiens
  Heavy chain CDR3 for antibody 6131 (IGHV3-33)
TRGYSSKSYFDY

SEQ ID NO: 12263 - protein, 9 aa, Homo sapiens
  Light chain CDR3 for antibody 6132 (IGKV1D-13)
QRFNNYLYT

SEQ ID NO: 12264 - protein, 13 aa, Homo sapiens
  Heavy chain CDR3 for antibody 6132 (IGHV3-33)
ARRATLVRGVFDP

SEQ ID NO: 12265 - protein, 9 aa, Homo sapiens
  Light chain CDR3 for antibody 6133 (IGKV1-39)
QQSYSTPLT

SEQ ID NO: 12266 - protein, 21 aa, Homo sapiens
  Heavy chain CDR3 for antibody 6133 (IGHV4-59)
AAGVLLWFGEPNYYYYYGMDV

SEQ ID NO: 12267 - protein, 9 aa, Homo sapiens
  Light chain CDR3 for antibody 6134 (IGKV6-21)
HQSSSLPLT

SEQ ID NO: 12268 - protein, 14 aa, Homo sapiens
  Heavy chain CDR3 for antibody 6134 (IGHV3-15)
SIYYYGSGRDFFDY

SEQ ID NO: 12269 - protein, 10 aa, Homo sapiens
  Light chain CDR3 for antibody 6135 (IGKV3-11)
QQRSNWLMYT

SEQ ID NO: 12270 - protein, 15 aa, Homo sapiens
  Heavy chain CDR3 for antibody 6135 (IGHV3-30)
ARGAMVRGVDYGMDV

SEQ ID NO: 12271 - protein, 9 aa, Homo sapiens
  Light chain CDR3 for antibody 6136 (IGKV1-39)
QQSYSTPIT

SEQ ID NO: 12272 - protein, 14 aa, Homo sapiens
  Heavy chain CDR3 for antibody 6136 (IGHV1-46)
ARAYYAFLTGAFDI

SEQ ID NO: 12273 - protein, 8 aa, Homo sapiens
  Light chain CDR3 for antibody 6137 (IGKV1-5)
QQYNSYWT

SEQ ID NO: 12274 - protein, 9 aa, Homo sapiens
  Heavy chain CDR3 for antibody 6137 (IGHV3-23)
AKEQQLFDY

SEQ ID NO: 12275 - protein, 8 aa, Homo sapiens
  Light chain CDR3 for antibody 6138 (IGKV1-5)
QQYNSYYT

SEQ ID NO: 12276 - protein, 18 aa, Homo sapiens
  Heavy chain CDR3 for antibody 6138 (IGHV4-59)
AREGHYYTSGSYYKAFDY

SEQ ID NO: 12277 - protein, 9 aa, Homo sapiens
  Light chain CDR3 for antibody 6139 (IGKV5-2)
LQHDNFPWT

SEQ ID NO: 12278 - protein, 9 aa, Homo sapiens
  Heavy chain CDR3 for antibody 6139 (IGHV1-18)
ARGNTWFDY

SEQ ID NO: 12279 - protein, 9 aa, Homo sapiens
  Light chain CDR3 for antibody 6140 (IGKV1D-13)
QQFNNYPHT

SEQ ID NO: 12280 - protein, 14 aa, Homo sapiens
  Heavy chain CDR3 for antibody 6140 (IGHV4-39)
ARQGTMIRGGYFDY

SEQ ID NO: 12281 - protein, 10 aa, Homo sapiens
  Light chain CDR3 for antibody 6141 (IGKV1-17)
LQHNSYPMYT

SEQ ID NO: 12282 - protein, 12 aa, Homo sapiens
  Heavy chain CDR3 for antibody 6141 (IGHV3-33)
ARDLVGATPFDY

SEQ ID NO: 12283 - protein, 9 aa, Homo sapiens
  Light chain CDR3 for antibody 6142 (IGKV1-6)
LQDFHYPWT

SEQ ID NO: 12284 - protein, 16 aa, Homo sapiens
  Heavy chain CDR3 for antibody 6142 (IGHV4-59)
ARGRYFEWLLGDVFDI

SEQ ID NO: 12285 - protein, 9 aa, Homo sapiens
  Light chain CDR3 for antibody 6143 (IGKV1-9)
QQLKSYLYT

SEQ ID NO: 12286 - protein, 16 aa, Homo sapiens
  Heavy chain CDR3 for antibody 6143 (IGHV1-24)
ATEDSSSTYYYYGLDV

SEQ ID NO: 12287 - protein, 9 aa, Homo sapiens
  Light chain CDR3 for antibody 6144 (IGKV1-6)
LQDFHYPWT

SEQ ID NO: 12288 - protein, 13 aa, Homo sapiens
  Heavy chain CDR3 for antibody 6144 (IGHV4-34)
ASNFYYYYYGMDV

SEQ ID NO: 12289 - protein, 10 aa, Homo sapiens
  Light chain CDR3 for antibody 6145 (IGKV3-15)
QQYNNWPPYT

SEQ ID NO: 12290 - protein, 14 aa, Homo sapiens
  Heavy chain CDR3 for antibody 6145 (IGHV3-23)
AKSRIVGALYYFDY

SEQ ID NO: 12291 - protein, 10 aa, Homo sapiens
  Light chain CDR3 for antibody 6146 (IGKV1-6)
LQDYNYPMYT

SEQ ID NO: 12292 - protein, 8 aa, Homo sapiens
  Heavy chain CDR3 for antibody 6146 (IGHV3-23)
AETFLFDY

SEQ ID NO: 12293 - protein, 9 aa, Homo sapiens
  Light chain CDR3 for antibody 6147 (IGKV3-15)
QQYNNWPYT

SEQ ID NO: 12294 - protein, 15 aa, Homo sapiens
  Heavy chain CDR3 for antibody 6147 (IGHV3-33)
ARAYDLPHYYYGMDV

SEQ ID NO: 12295 - protein, 9 aa, Homo sapiens
  Light chain CDR3 for antibody 6148 (IGKV1-9)
QQLISYPLT

SEQ ID NO: 12296 - protein, 14 aa, Homo sapiens
  Heavy chain CDR3 for antibody 6148 (IGHV1-46)
ARRGIVGALDAFDI

SEQ ID NO: 12297 - protein, 9 aa, Homo sapiens
  Light chain CDR3 for antibody 6149 (IGKV5-2)
LQHDNFPWT

SEQ ID NO: 12298 - protein, 11 aa, Homo sapiens
  Heavy chain CDR3 for antibody 6149 (IGHV3-64)
ARERGSYAFDI

SEQ ID NO: 12299 - protein, 10 aa, Homo sapiens
  Light chain CDR3 for antibody 6150 (IGKV3-15)
QKYNNWPPLT

SEQ ID NO: 12300 - protein, 18 aa, Homo sapiens
  Heavy chain CDR3 for antibody 6150 (IGHV1-46)
ARDGDYVWGSYRSDWFDP

SEQ ID NO: 12301 - protein, 9 aa, Homo sapiens
  Light chain CDR3 for antibody 6151 (IGKV1-6)
LQDYNYPWT

SEQ ID NO: 12302 - protein, 12 aa, Homo sapiens
  Heavy chain CDR3 for antibody 6151 (IGHV4-61)
ARVGSSGWYFDY

SEQ ID NO: 12303 - protein, 10 aa, Homo sapiens
  Light chain CDR3 for antibody 6152 (IGKV1-9)
QQLDSYPMYT

SEQ ID NO: 12304 - protein, 16 aa, Homo sapiens
  Heavy chain CDR3 for antibody 6152 (IGHV3-33)
ARGYDMLTGDYYGMDV

SEQ ID NO: 12305 - protein, 9 aa, Homo sapiens
  Light chain CDR3 for antibody 6153 (IGKV1-33)
QQYDNLPFT

SEQ ID NO: 12306 - protein, 13 aa, Homo sapiens
  Heavy chain CDR3 for antibody 6153 (IGHV4-59)
ARDAGYSSSWFDY

SEQ ID NO: 12307 - protein, 9 aa, Homo sapiens
  Light chain CDR3 for antibody 6154 (IGKV1-39)
QQSYSTPWT

SEQ ID NO: 12308 - protein, 12 aa, Homo sapiens
  Heavy chain CDR3 for antibody 6154 (IGHV4-61)
ARVDSSGWFFDY

SEQ ID NO: 12309 - protein, 9 aa, Homo sapiens
  Light chain CDR3 for antibody 6155 (IGKV1-6)
LQDYNYPRT

SEQ ID NO: 12310 - protein, 10 aa, Homo sapiens
  Heavy chain CDR3 for antibody 6155 (IGHV3-33)
ARKGMNAFDI

SEQ ID NO: 12311 - protein, 9 aa, Homo sapiens
  Light chain CDR3 for antibody 6156 (IGKV3-15)
QQYNNWPYT

SEQ ID NO: 12312 - protein, 17 aa, Homo sapiens
  Heavy chain CDR3 for antibody 6156 (IGHV3-33)
ARGGYSSGWDYYYGMDV

SEQ ID NO: 12313 - protein, 9 aa, Homo sapiens
  Light chain CDR3 for antibody 6157 (IGKV1-6)
LQDYNYPRT

SEQ ID NO: 12314 - protein, 9 aa, Homo sapiens
  Heavy chain CDR3 for antibody 6157 (IGHV3-23)
ATIAADFDY

SEQ ID NO: 12315 - protein, 9 aa, Homo sapiens
  Light chain CDR3 for antibody 6158 (IGKV1D-16)
QQYYSYPLT

SEQ ID NO: 12316 - protein, 15 aa, Homo sapiens
  Heavy chain CDR3 for antibody 6158 (IGHV3-23)
AKDYRSGWFGYYFDY

SEQ ID NO: 12317 - protein, 10 aa, Homo sapiens
  Light chain CDR3 for antibody 6159 (IGKV1-6)
LQDYNYPMYT

SEQ ID NO: 12318 - protein, 11 aa, Homo sapiens
  Heavy chain CDR3 for antibody 6159 (IGHV3-33)
ARDRSSGPFDY

SEQ ID NO: 12319 - protein, 9 aa, Homo sapiens
  Light chain CDR3 for antibody 6160 (IGKV5-2)
LQHDNFPWT

SEQ ID NO: 12320 - protein, 16 aa, Homo sapiens
  Heavy chain CDR3 for antibody 6160 (IGHV3-11)
ARDSELRYFDWFGMDV

SEQ ID NO: 12321 - protein, 9 aa, Homo sapiens
  Light chain CDR3 for antibody 6161 (IGKV3-20)
QQYGSSPYT

SEQ ID NO: 12322 - protein, 15 aa, Homo sapiens
  Heavy chain CDR3 for antibody 6161 (IGHV3-33)
ARPPIAVAGPEYFQH

SEQ ID NO: 12323 - protein, 9 aa, Homo sapiens
  Light chain CDR3 for antibody 6162 (IGKV1D-13)
QQFNNYPST

SEQ ID NO: 12324 - protein, 16 aa, Homo sapiens
  Heavy chain CDR3 for antibody 6162 (IGHV3-23)
AKDLRYFDWSLYAFDI

SEQ ID NO: 12325 - protein, 8 aa, Homo sapiens
  Light chain CDR3 for antibody 6163 (IGKV1D-13)
QQFNNYPT

SEQ ID NO: 12326 - protein, 20 aa, Homo sapiens
  Heavy chain CDR3 for antibody 6163 (IGHV3-33)
SRGGATLVRGVIDYYYGMDV

SEQ ID NO: 12327 - protein, 9 aa, Homo sapiens
  Light chain CDR3 for antibody 6164 (IGKV1-6)
LQDYNYPWT

SEQ ID NO: 12328 - protein, 13 aa, Homo sapiens
  Heavy chain CDR3 for antibody 6164 (IGHV3-23)
AKVWSSGWSDFDY

SEQ ID NO: 12329 - protein, 10 aa, Homo sapiens
  Light chain CDR3 for antibody 6165 (IGKV1-39)
QQSYSTPMYT

SEQ ID NO: 12330 - protein, 15 aa, Homo sapiens
  Heavy chain CDR3 for antibody 6165 (IGHV3-64)
ARDSRPEITGPPFDY

SEQ ID NO: 12331 - protein, 9 aa, Homo sapiens
  Light chain CDR3 for antibody 6166 (IGKV1D-16)
QQYNSFPLT

SEQ ID NO: 12332 - protein, 15 aa, Homo sapiens
  Heavy chain CDR3 for antibody 6166 (IGHV3-33)
ARDHLTGYYYYGMDV

SEQ ID NO: 12333 - protein, 9 aa, Homo sapiens
  Light chain CDR3 for antibody 6167 (IGKV1-27)
QKYNSAPYT

SEQ ID NO: 12334 - protein, 11 aa, Homo sapiens
  Heavy chain CDR3 for antibody 6167 (IGHV3-23)
AKKVYDYGSDY

SEQ ID NO: 12335 - protein, 9 aa, Homo sapiens
  Light chain CDR3 for antibody 6168 (IGKV1-6)
QQEYNYPLT

SEQ ID NO: 12336 - protein, 13 aa, Homo sapiens
  Heavy chain CDR3 for antibody 6168 (IGHV4-34)
ASNFYYYYYGMDV

SEQ ID NO: 12337 - protein, 9 aa, Homo sapiens
  Light chain CDR3 for antibody 6169 (IGKV1-6)
LQDYKSPFT

SEQ ID NO: 12338 - protein, 17 aa, Homo sapiens
  Heavy chain CDR3 for antibody 6169 (IGHV3-33)
ARGYCSRTSCYLYYFDY

SEQ ID NO: 12339 - protein, 9 aa, Homo sapiens
  Light chain CDR3 for antibody 6170 (IGKV5-2)
LQHDKFPYT

SEQ ID NO: 12340 - protein, 16 aa, Homo sapiens
  Heavy chain CDR3 for antibody 6170 (IGHV3-33)
AREVAGSYYYYYGIDV

SEQ ID NO: 12341 - protein, 8 aa, Homo sapiens
  Light chain CDR3 for antibody 6171 (IGKV3D-7)
QQDYNLLT

SEQ ID NO: 12342 - protein, 16 aa, Homo sapiens
  Heavy chain CDR3 for antibody 6171 (IGHV3-33)
ARGYDMLTGDYYGMDV

SEQ ID NO: 12343 - protein, 9 aa, Homo sapiens
  Light chain CDR3 for antibody 6172 (IGKV1-17)
LQHNSYPWT

SEQ ID NO: 12344 - protein, 18 aa, Homo sapiens
  Heavy chain CDR3 for antibody 6172 (IGHV3-33)
ARERYYYGSGSYPDAFDI

SEQ ID NO: 12345 - protein, 9 aa, Homo sapiens
  Light chain CDR3 for antibody 6173 (IGKV1-6)
LQDFHYPWT

SEQ ID NO: 12346 - protein, 18 aa, Homo sapiens
  Heavy chain CDR3 for antibody 6173 (IGHV3-33)
ARREGIVGATTYYYGMDV

SEQ ID NO: 12347 - protein, 9 aa, Homo sapiens
  Light chain CDR3 for antibody 6174 (IGKV3D-7)
QQDYNLPRT

SEQ ID NO: 12348 - protein, 17 aa, Homo sapiens
  Heavy chain CDR3 for antibody 6174 (IGHV3-33)
ARAYYDILTGYSYYFDY

SEQ ID NO: 12349 - protein, 9 aa, Homo sapiens
  Light chain CDR3 for antibody 6175 (IGKV3-11)
QQRINWPWT

SEQ ID NO: 12350 - protein, 19 aa, Homo sapiens
  Heavy chain CDR3 for antibody 6175 (IGHV4-59)
ARDRVVGATTYYYYYGMDV

SEQ ID NO: 12351 - protein, 9 aa, Homo sapiens
  Light chain CDR3 for antibody 6176 (IGKV1-6)
LQDYNYPWT

SEQ ID NO: 12352 - protein, 20 aa, Homo sapiens
  Heavy chain CDR3 for antibody 6176 (IGHV3-23)
TKDRYSDSSGYYLYYNDMDV

SEQ ID NO: 12353 - protein, 9 aa, Homo sapiens
  Light chain CDR3 for antibody 6177 (IGKV1-9)
QQLHIYPWT

SEQ ID NO: 12354 - protein, 14 aa, Homo sapiens
  Heavy chain CDR3 for antibody 6177 (IGHV3-33)
ARDKTYPLSYGMDV

SEQ ID NO: 12355 - protein, 9 aa, Homo sapiens
  Light chain CDR3 for antibody 6178 (IGKV5-2)
LQHDNFPYT

SEQ ID NO: 12356 - protein, 13 aa, Homo sapiens
  Heavy chain CDR3 for antibody 6178 (IGHV3-33)
GRTDYYSYYGVDV

SEQ ID NO: 12357 - protein, 9 aa, Homo sapiens
  Light chain CDR3 for antibody 6179 (IGKV3-11)
QQRSNWPPT

SEQ ID NO: 12358 - protein, 16 aa, Homo sapiens
  Heavy chain CDR3 for antibody 6179 (IGHV1-8)
AREGTMVRGVTYAFDI

SEQ ID NO: 12359 - protein, 8 aa, Homo sapiens
  Light chain CDR3 for antibody 6180 (IGKV1D-13)
QQFNNYPT

SEQ ID NO: 12360 - protein, 13 aa, Homo sapiens
  Heavy chain CDR3 for antibody 6180 (IGHV4-39)
ARHVLLWFGEFDP

SEQ ID NO: 12361 - protein, 9 aa, Homo sapiens
  Light chain CDR3 for antibody 6181 (IGKV1-16)
QHYNDYPFT

SEQ ID NO: 12362 - protein, 15 aa, Homo sapiens
  Heavy chain CDR3 for antibody 6181 (IGHV3-33)
ARDTGYSSSWNWFDP

SEQ ID NO: 12363 - protein, 9 aa, Homo sapiens
  Light chain CDR3 for antibody 6182 (IGKV6-21)
HQSSSLPYT

SEQ ID NO: 12364 - protein, 14 aa, Homo sapiens
  Heavy chain CDR3 for antibody 6182 (IGHV3-23)
AKCDYDILTGILDY

SEQ ID NO: 12365 - protein, 9 aa, Homo sapiens
  Light chain CDR3 for antibody 6183 (IGKV1D-13)
QQFNNYPHT

SEQ ID NO: 12366 - protein, 15 aa, Homo sapiens
  Heavy chain CDR3 for antibody 6183 (IGHV3-23)
AKDLSSGWYAYFFDY

SEQ ID NO: 12367 - protein, 9 aa, Homo sapiens
  Light chain CDR3 for antibody 6184 (IGKV1D-13)
QQFNNYPHT

SEQ ID NO: 12368 - protein, 12 aa, Homo sapiens
  Heavy chain CDR3 for antibody 6184 (IGHV3-33)
ARKGYGLYVLDV

SEQ ID NO: 12369 - protein, 8 aa, Homo sapiens
  Light chain CDR3 for antibody 6185 (IGKV3-11)
QQRSNWLT

SEQ ID NO: 12370 - protein, 14 aa, Homo sapiens
  Heavy chain CDR3 for antibody 6185 (IGHV4-39)
ARQDYDILTGLFDY

SEQ ID NO: 12371 - protein, 9 aa, Homo sapiens
  Light chain CDR3 for antibody 6186 (IGKV6-21)
HQSSSLPYT

SEQ ID NO: 12372 - protein, 17 aa, Homo sapiens
  Heavy chain CDR3 for antibody 6186 (IGHV3-33)
ARAYYDILTGYYIHCDY

SEQ ID NO: 12373 - protein, 9 aa, Homo sapiens
  Light chain CDR3 for antibody 6187 (IGKV3D-7)
QQDYNLPYT

SEQ ID NO: 12374 - protein, 17 aa, Homo sapiens
  Heavy chain CDR3 for antibody 6187 (IGHV3-33)
ARDWFGELSDYYYGMDV

SEQ ID NO: 12375 - protein, 9 aa, Homo sapiens
  Light chain CDR3 for antibody 6188 (IGKV2-30)
MQGTHWPLT

SEQ ID NO: 12376 - protein, 13 aa, Homo sapiens
  Heavy chain CDR3 for antibody 6188 (IGHV3-23)
AKDRGGSYSYFDF

SEQ ID NO: 12377 - protein, 9 aa, Homo sapiens
  Light chain CDR3 for antibody 6189 (IGKV2D-24)
TQATQFPHT

SEQ ID NO: 12378 - protein, 17 aa, Homo sapiens
  Heavy chain CDR3 for antibody 6189 (IGHV1-18)
ARDRAFTMVRGVPPFDY

SEQ ID NO: 12379 - protein, 9 aa, Homo sapiens
  Light chain CDR3 for antibody 6190 (IGKV2-30)
MQGTHWPLT

SEQ ID NO: 12380 - protein, 23 aa, Homo sapiens
  Heavy chain CDR3 for antibody 6190 (IGHV4-59)
ARERTYSDILPGYYEDYYYGMDV

SEQ ID NO: 12381 - protein, 9 aa, Homo sapiens
  Light chain CDR3 for antibody 6191 (IGKV1-16)
QHYNDYPFT

SEQ ID NO: 12382 - protein, 18 aa, Homo sapiens
  Heavy chain CDR3 for antibody 6191 (IGHV3-33)
ARGLLWFGVSYYYYGMDV

SEQ ID NO: 12383 - protein, 11 aa, Homo sapiens
  Light chain CDR3 for antibody 6192 (IGKV3-11)
QQRSNWPPTWT

SEQ ID NO: 12384 - protein, 14 aa, Homo sapiens
  Heavy chain CDR3 for antibody 6192 (IGHV3-33)
ARTTAAAGPRDFQH

SEQ ID NO: 12385 - protein, 9 aa, Homo sapiens
  Light chain CDR3 for antibody 6193 (IGKV1-17)
LQHNSYPYT

SEQ ID NO: 12386 - protein, 8 aa, Homo sapiens
  Heavy chain CDR3 for antibody 6193 (IGHV3-33)
ARDDGMDV

SEQ ID NO: 12387 - protein, 10 aa, Homo sapiens
  Light chain CDR3 for antibody 6194 (IGKV1-27)
QKYNSAPMYT

SEQ ID NO: 12388 - protein, 17 aa, Homo sapiens
  Heavy chain CDR3 for antibody 6194 (IGHV4-59)
ARDFLVRGEGSYYGMDV

SEQ ID NO: 12389 - protein, 9 aa, Homo sapiens
  Light chain CDR3 for antibody 6195 (IGKV1D-13)
QQFNNYPYT

SEQ ID NO: 12390 - protein, 14 aa, Homo sapiens
  Heavy chain CDR3 for antibody 6195 (IGHV3-20)
ARDGGSTSFDWFDP

SEQ ID NO: 12391 - protein, 9 aa, Homo sapiens
  Light chain CDR3 for antibody 6196 (IGKV1-6)
LQDYKSPFT

SEQ ID NO: 12392 - protein, 15 aa, Homo sapiens
  Heavy chain CDR3 for antibody 6196 (IGHV3-33)
ARDTGYSSSWNWFDP

SEQ ID NO: 12393 - protein, 9 aa, Homo sapiens
  Light chain CDR3 for antibody 6197 (IGKV1-6)
LQDFNYPRT

SEQ ID NO: 12394 - protein, 13 aa, Homo sapiens
  Heavy chain CDR3 for antibody 6197 (IGHV4-39)
ARHEVMIRGVFDY

SEQ ID NO: 12395 - protein, 9 aa, Homo sapiens
  Light chain CDR3 for antibody 6198 (IGKV3D-20)
QQYGYSPLT

SEQ ID NO: 12396 - protein, 13 aa, Homo sapiens
  Heavy chain CDR3 for antibody 6198 (IGHV3-11)
ARDEGYRGYVLDT

SEQ ID NO: 12397 - protein, 8 aa, Homo sapiens
  Light chain CDR3 for antibody 6199 (IGKV1-5)
QQYNSYWT

SEQ ID NO: 12398 - protein, 8 aa, Homo sapiens
  Heavy chain CDR3 for antibody 6199 (IGHV3-23)
AETFLFDY

SEQ ID NO: 12399 - protein, 9 aa, Homo sapiens
  Light chain CDR3 for antibody 6200 (IGKV1-17)
LQHTSYPFT

SEQ ID NO: 12400 - protein, 18 aa, Homo sapiens
  Heavy chain CDR3 for antibody 6200 (IGHV1-46)
ARDGDYVWGSYRSDWFDP

SEQ ID NO: 12401 - protein, 8 aa, Homo sapiens
  Light chain CDR3 for antibody 6201 (IGKV6-21)
HQSSSLPT

SEQ ID NO: 12402 - protein, 12 aa, Homo sapiens
  Heavy chain CDR3 for antibody 6201 (IGHV1-18)
ARVLFDGDYFDY

SEQ ID NO: 12403 - protein, 8 aa, Homo sapiens
  Light chain CDR3 for antibody 6202 (IGKV1D-13)
QQFNNYPT

SEQ ID NO: 12404 - protein, 20 aa, Homo sapiens
  Heavy chain CDR3 for antibody 6202 (IGHV3-11)
ARGGATLIRGLIDYYYGMDV

SEQ ID NO: 12405 - protein, 9 aa, Homo sapiens
  Light chain CDR3 for antibody 6203 (IGKV5-2)
LQHDNFPYT

SEQ ID NO: 12406 - protein, 12 aa, Homo sapiens
  Heavy chain CDR3 for antibody 6203 (IGHV3-33)
ARKAYALYVLDV

SEQ ID NO: 12407 - protein, 8 aa, Homo sapiens
  Light chain CDR3 for antibody 6204 (IGKV3-11)
QQRSNWLT

SEQ ID NO: 12408 - protein, 12 aa, Homo sapiens
  Heavy chain CDR3 for antibody 6204 (IGHV4-61)
ARVYSSGWLFDY

SEQ ID NO: 12409 - protein, 9 aa, Homo sapiens
  Light chain CDR3 for antibody 6205 (IGKV1-17)
LQHNSYPYT

SEQ ID NO: 12410 - protein, 12 aa, Homo sapiens
  Heavy chain CDR3 for antibody 6205 (IGHV3-33)
AREGVMGYSGSY

SEQ ID NO: 12411 - protein, 8 aa, Homo sapiens
  Light chain CDR3 for antibody 6206 (IGKV3-11)
LQRGNWPT

SEQ ID NO: 12412 - protein, 13 aa, Homo sapiens
  Heavy chain CDR3 for antibody 6206 (IGHV3-33)
ARAFTMVRGVIDY

SEQ ID NO: 12413 - protein, 9 aa, Homo sapiens
  Light chain CDR3 for antibody 6207 (IGKV6-21)
HQSSSLPLT

SEQ ID NO: 12414 - protein, 11 aa, Homo sapiens
  Heavy chain CDR3 for antibody 6207 (IGHV3-33)
ASWDILTGSGY

SEQ ID NO: 12415 - protein, 9 aa, Homo sapiens
  Light chain CDR3 for antibody 6208 (IGKV6-21)
QQSSNLPHT

SEQ ID NO: 12416 - protein, 16 aa, Homo sapiens
  Heavy chain CDR3 for antibody 6208 (IGHV3-23)
AKEGMVLRYFDWLWDY

SEQ ID NO: 12417 - protein, 9 aa, Homo sapiens
  Light chain CDR3 for antibody 6209 (IGKV1-33)
QQYDNLPFT

SEQ ID NO: 12418 - protein, 14 aa, Homo sapiens
  Heavy chain CDR3 for antibody 6209 (IGHV3-23)
AKSRIVGALYYFDY

SEQ ID NO: 12419 - protein, 9 aa, Homo sapiens
  Light chain CDR3 for antibody 6210 (IGKV3D-7)
QQDYTLPLT

SEQ ID NO: 12420 - protein, 11 aa, Homo sapiens
  Heavy chain CDR3 for antibody 6210 (IGHV4-39)
ARLLVGATTDY

SEQ ID NO: 12421 - protein, 9 aa, Homo sapiens
  Light chain CDR3 for antibody 6211 (IGKV1-33)
QQYDNLPFT

SEQ ID NO: 12422 - protein, 11 aa, Homo sapiens
  Heavy chain CDR3 for antibody 6211 (IGHV4-59)
AREMGHDTFDI

SEQ ID NO: 12423 - protein, 8 aa, Homo sapiens
  Light chain CDR3 for antibody 6212 (IGKV1-5)
QQYNSYYT

SEQ ID NO: 12424 - protein, 14 aa, Homo sapiens
  Heavy chain CDR3 for antibody 6212 (IGHV3-23)
ANWAYDILTGYLDY

SEQ ID NO: 12425 - protein, 10 aa, Homo sapiens
  Light chain CDR3 for antibody 6213 (IGKV3-11)
QQRSNWPIFT

SEQ ID NO: 12426 - protein, 19 aa, Homo sapiens
  Heavy chain CDR3 for antibody 6213 (IGHV3-33)
ARGPYYDILTGYGYYGMDV

SEQ ID NO: 12427 - protein, 8 aa, Homo sapiens
  Light chain CDR3 for antibody 6214 (IGKV1D-13)
QQFNNYPT

SEQ ID NO: 12428 - protein, 16 aa, Homo sapiens
  Heavy chain CDR3 for antibody 6214 (IGHV4-59)
ARGRYFEWLLGDVFDI

SEQ ID NO: 12429 - protein, 10 aa, Homo sapiens
  Light chain CDR3 for antibody 6215 (IGKV1-27)
QKYNSAPMYT

SEQ ID NO: 12430 - protein, 11 aa, Homo sapiens
  Heavy chain CDR3 for antibody 6215 (IGHV3-33)
ARDRSSGPFDY

SEQ ID NO: 12431 - protein, 9 aa, Homo sapiens
  Light chain CDR3 for antibody 6216 (IGKV3-15)
QQYNNWPRT

SEQ ID NO: 12432 - protein, 18 aa, Homo sapiens
  Heavy chain CDR3 for antibody 6216 (IGHV3-23)
AKEGNYYGSGSYWGYFDP

SEQ ID NO: 12433 - protein, 10 aa, Homo sapiens
  Light chain CDR3 for antibody 6217 (IGKV1-39)
QQSYSTPMYT

SEQ ID NO: 12434 - protein, 13 aa, Homo sapiens
  Heavy chain CDR3 for antibody 6217 (IGHV3-23)
ASPFNWNDGFFDY

SEQ ID NO: 12435 - protein, 8 aa, Homo sapiens
  Light chain CDR3 for antibody 6218 (IGKV1-5)
QQYNSYWT

SEQ ID NO: 12436 - protein, 13 aa, Homo sapiens
  Heavy chain CDR3 for antibody 6218 (IGHV3-33)
ARDYTMVRGVMNY

SEQ ID NO: 12437 - protein, 9 aa, Homo sapiens
  Light chain CDR3 for antibody 6219 (IGKV3D-7)
QQDYNLPLT

SEQ ID NO: 12438 - protein, 17 aa, Homo sapiens
  Heavy chain CDR3 for antibody 6219 (IGHV3-23)
AKDGSFYSSGWYDAFDI

SEQ ID NO: 12439 - protein, 9 aa, Homo sapiens
  Light chain CDR3 for antibody 6220 (IGKV3-11)
QQRSNWPLT

SEQ ID NO: 12440 - protein, 14 aa, Homo sapiens
  Heavy chain CDR3 for antibody 6220 (IGHV1-2)
ARDYYGSGNYYMGY

SEQ ID NO: 12441 - protein, 9 aa, Homo sapiens
  Light chain CDR3 for antibody 6221 (IGKV1-27)
QKYNSAPYT

SEQ ID NO: 12442 - protein, 14 aa, Homo sapiens
  Heavy chain CDR3 for antibody 6221 (IGHV3-33)
ARDTVAAGFNGMDV

SEQ ID NO: 12443 - protein, 9 aa, Homo sapiens
  Light chain CDR3 for antibody 6222 (IGKV1-17)
LQHNSYPYT

SEQ ID NO: 12444 - protein, 18 aa, Homo sapiens
  Heavy chain CDR3 for antibody 6222 (IGHV3-33)
ARAGYYGSGSFYYYGMDV

SEQ ID NO: 12445 - protein, 9 aa, Homo sapiens
  Light chain CDR3 for antibody 6223 (IGKV1D-16)
QQYDSYPYT

SEQ ID NO: 12446 - protein, 15 aa, Homo sapiens
  Heavy chain CDR3 for antibody 6223 (IGHV3-33)
ARGYYYGSGSFPFDY

SEQ ID NO: 12447 - protein, 9 aa, Homo sapiens
  Light chain CDR3 for antibody 6224 (IGKV1D-16)
QQYITYPYT

SEQ ID NO: 12448 - protein, 13 aa, Homo sapiens
  Heavy chain CDR3 for antibody 6224 (IGHV3-33)
ARDYCGGDCYLDY

SEQ ID NO: 12449 - protein, 9 aa, Homo sapiens
  Light chain CDR3 for antibody 6225 (IGKV1D-13)
QQFNNYPHT

SEQ ID NO: 12450 - protein, 6 aa, Homo sapiens
  Heavy chain CDR3 for antibody 6225 (IGHV3-53)
ARSGSY

SEQ ID NO: 12451 - protein, 9 aa, Homo sapiens
  Light chain CDR3 for antibody 6226 (IGKV1D-13)
QQFNNYPHT

SEQ ID NO: 12452 - protein, 13 aa, Homo sapiens
  Heavy chain CDR3 for antibody 6226 (IGHV3-33)
ARIDYYSYYGMDV

SEQ ID NO: 12453 - protein, 9 aa, Homo sapiens
  Light chain CDR3 for antibody 6227 (IGKV1-27)
QKYNSAPYT

SEQ ID NO: 12454 - protein, 18 aa, Homo sapiens
  Heavy chain CDR3 for antibody 6227 (IGHV3-33)
ARREGITMIFYYYYGMDV

SEQ ID NO: 12455 - protein, 8 aa, Homo sapiens
  Light chain CDR3 for antibody 6228 (IGKV1D-13)
QQFNNYPT

SEQ ID NO: 12456 - protein, 14 aa, Homo sapiens
  Heavy chain CDR3 for antibody 6228 (IGHV3-33)
ARDREQQLVRYFDY

SEQ ID NO: 12457 - protein, 9 aa, Homo sapiens
  Light chain CDR3 for antibody 6229 (IGKV1D-16)
QQYDSYPRT

SEQ ID NO: 12458 - protein, 16 aa, Homo sapiens
  Heavy chain CDR3 for antibody 6229 (IGHV3-33)
ARGYDMLTGDYYGMDV

SEQ ID NO: 12459 - protein, 9 aa, Homo sapiens
  Light chain CDR3 for antibody 6230 (IGKV1-39)
QQSYSTPLT

SEQ ID NO: 12460 - protein, 11 aa, Homo sapiens
  Heavy chain CDR3 for antibody 6230 (IGHV3-33)
ARDQGGSSFDY

SEQ ID NO: 12461 - protein, 10 aa, Homo sapiens
  Light chain CDR3 for antibody 6231 (IGKV3-20)
QQYGRSPPVT

SEQ ID NO: 12462 - protein, 20 aa, Homo sapiens
  Heavy chain CDR3 for antibody 6231 (IGHV3-23)
AKDREMAATSHYYYYYGMDV

SEQ ID NO: 12463 - protein, 9 aa, Homo sapiens
  Light chain CDR3 for antibody 6232 (IGKV2-30)
MQGTHWPLT

SEQ ID NO: 12464 - protein, 13 aa, Homo sapiens
  Heavy chain CDR3 for antibody 6232 (IGHV3-33)
ARGVLWFGELFDY

SEQ ID NO: 12465 - protein, 10 aa, Homo sapiens
  Light chain CDR3 for antibody 6233 (IGKV1D-13)
QQFNNYPMYT

SEQ ID NO: 12466 - protein, 11 aa, Homo sapiens
  Heavy chain CDR3 for antibody 6233 (IGHV3-23)
AKAYSGSYGDY

SEQ ID NO: 12467 - protein, 9 aa, Homo sapiens
  Light chain CDR3 for antibody 6234 (IGKV1-6)
LQDFHYPWT

SEQ ID NO: 12468 - protein, 12 aa, Homo sapiens
  Heavy chain CDR3 for antibody 6234 (IGHV3-33)
ARDRAYRGSLDY

SEQ ID NO: 12469 - protein, 8 aa, Homo sapiens
  Light chain CDR3 for antibody 6235 (IGKV1-5)
QQYNSYWT

SEQ ID NO: 12470 - protein, 18 aa, Homo sapiens
  Heavy chain CDR3 for antibody 6235 (IGHV3-33)
ARDRDRYGSGTYPDAIDI

SEQ ID NO: 12471 - protein, 8 aa, Homo sapiens
  Light chain CDR3 for antibody 6236 (IGKV1-5)
QQYNSYWT

SEQ ID NO: 12472 - protein, 15 aa, Homo sapiens
  Heavy chain CDR3 for antibody 6236 (IGHV3-33)
ARRVCSGGSCSLFDY

SEQ ID NO: 12473 - protein, 9 aa, Homo sapiens
  Light chain CDR3 for antibody 6237 (IGKV1-9)
QQLNGYPFT

SEQ ID NO: 12474 - protein, 11 aa, Homo sapiens
  Heavy chain CDR3 for antibody 6237 (IGHV3-33)
ARDRSSGPFDY

SEQ ID NO: 12475 - protein, 9 aa, Homo sapiens
  Light chain CDR3 for antibody 6238 (IGKV3-15)
QQYNNWPRT

SEQ ID NO: 12476 - protein, 15 aa, Homo sapiens
  Heavy chain CDR3 for antibody 6238 (IGHV3-30)
ARRGYGSGSPDAFDL

SEQ ID NO: 12477 - protein, 8 aa, Homo sapiens
  Light chain CDR3 for antibody 6239 (IGKV1-5)
QQYNSYWT

SEQ ID NO: 12478 - protein, 17 aa, Homo sapiens
  Heavy chain CDR3 for antibody 6239 (IGHV3-33)
ARGEQWLGYYYYYGMDV

SEQ ID NO: 12479 - protein, 8 aa, Homo sapiens
  Light chain CDR3 for antibody 6240 (IGKV1D-13)
QQFNNYPT

SEQ ID NO: 12480 - protein, 15 aa, Homo sapiens
  Heavy chain CDR3 for antibody 6240 (IGHV3-20)
ARDRGSSGWRGWFDP

SEQ ID NO: 12481 - protein, 9 aa, Homo sapiens
  Light chain CDR3 for antibody 6241 (IGKV1-17)
LQHNSYPYT

SEQ ID NO: 12482 - protein, 11 aa, Homo sapiens
  Heavy chain CDR3 for antibody 6241 (IGHV3-33)
ARDSAVGPKDY

SEQ ID NO: 12483 - protein, 10 aa, Homo sapiens
  Light chain CDR3 for antibody 6242 (IGKV1-39)
QQSYSSPMYT

SEQ ID NO: 12484 - protein, 13 aa, Homo sapiens
  Heavy chain CDR3 for antibody 6242 (IGHV3-11)
ARDEGYRGYVLDT

SEQ ID NO: 12485 - protein, 8 aa, Homo sapiens
  Light chain CDR3 for antibody 6243 (IGKV3D-7)
QQDYNLLT

SEQ ID NO: 12486 - protein, 14 aa, Homo sapiens
  Heavy chain CDR3 for antibody 6243 (IGHV1-2)
ARDYYGSGNYYMGY

SEQ ID NO: 12487 - protein, 9 aa, Homo sapiens
  Light chain CDR3 for antibody 6244 (IGKV3-11)
QQRSNWPPT

SEQ ID NO: 12488 - protein, 17 aa, Homo sapiens
  Heavy chain CDR3 for antibody 6244 (IGHV3-33)
ARVRGVIEGYYYYGMDV

SEQ ID NO: 12489 - protein, 10 aa, Homo sapiens
  Light chain CDR3 for antibody 6245 (IGKV1-9)
QQLDSYPMYT

SEQ ID NO: 12490 - protein, 11 aa, Homo sapiens
  Heavy chain CDR3 for antibody 6245 (IGHV3-33)
ARARYTTGLDY

SEQ ID NO: 12491 - protein, 9 aa, Homo sapiens
  Light chain CDR3 for antibody 6246 (IGKV3D-7)
QQDYTLPLT

SEQ ID NO: 12492 - protein, 9 aa, Homo sapiens
  Heavy chain CDR3 for antibody 6246 (IGHV4-59)
ARGGASFDY

SEQ ID NO: 12493 - protein, 9 aa, Homo sapiens
  Light chain CDR3 for antibody 6247 (IGKV1-39)
QQSYSTPLT

SEQ ID NO: 12494 - protein, 16 aa, Homo sapiens
  Heavy chain CDR3 for antibody 6247 (IGHV3-33)
ARDSSYYGSGYYGMDV

SEQ ID NO: 12495 - protein, 9 aa, Homo sapiens
  Light chain CDR3 for antibody 6248 (IGKV1-9)
QQLNSYPRT

SEQ ID NO: 12496 - protein, 16 aa, Homo sapiens
  Heavy chain CDR3 for antibody 6248 (IGHV4-34)
ARDTPCYSGAGRPFDY

SEQ ID NO: 12497 - protein, 9 aa, Homo sapiens
  Light chain CDR3 for antibody 6249 (IGKV5-2)
LQHDKFPYT

SEQ ID NO: 12498 - protein, 18 aa, Homo sapiens
  Heavy chain CDR3 for antibody 6249 (IGHV4-59)
AREGDYVWGSYRPNWFGP

SEQ ID NO: 12499 - protein, 9 aa, Homo sapiens
  Light chain CDR3 for antibody 6250 (IGKV1-6)
LQDYNYPYT

SEQ ID NO: 12500 - protein, 10 aa, Homo sapiens
  Heavy chain CDR3 for antibody 6250 (IGHV4-59)
ARDWNDAFDI

SEQ ID NO: 12501 - protein, 9 aa, Homo sapiens
  Light chain CDR3 for antibody 6251 (IGKV1D-16)
QQYYSYPRT

SEQ ID NO: 12502 - protein, 13 aa, Homo sapiens
  Heavy chain CDR3 for antibody 6251 (IGHV3-33)
ARDWGYSHGYFDY

SEQ ID NO: 12503 - protein, 9 aa, Homo sapiens
  Light chain CDR3 for antibody 6252 (IGKV1-6)
LQDYKSPFT

SEQ ID NO: 12504 - protein, 15 aa, Homo sapiens
  Heavy chain CDR3 for antibody 6252 (IGHV3-23)
AKDGSYYDYYYGMDV

SEQ ID NO: 12505 - protein, 9 aa, Homo sapiens
  Light chain CDR3 for antibody 6253 (IGKV3D-20)
QQYGRSPRT

SEQ ID NO: 12506 - protein, 17 aa, Homo sapiens
  Heavy chain CDR3 for antibody 6253 (IGHV3-33)
ARGFSGYDGYYYYGMDV

SEQ ID NO: 12507 - protein, 8 aa, Homo sapiens
  Light chain CDR3 for antibody 6254 (IGKV1D-13)
QQFNNYYT

SEQ ID NO: 12508 - protein, 15 aa, Homo sapiens
  Heavy chain CDR3 for antibody 6254 (IGHV3-23)
AKDGSYYDYYYGMDV

SEQ ID NO: 12509 - protein, 9 aa, Homo sapiens
  Light chain CDR3 for antibody 6255 (IGKV3D-7)
QQDYKLPLT

SEQ ID NO: 12510 - protein, 7 aa, Homo sapiens
  Heavy chain CDR3 for antibody 6255 (IGHV3-33)
ARELVDY

SEQ ID NO: 12511 - protein, 8 aa, Homo sapiens
  Light chain CDR3 for antibody 6256 (IGKV3D-7)
QQDYNLLT

SEQ ID NO: 12512 - protein, 18 aa, Homo sapiens
  Heavy chain CDR3 for antibody 6256 (IGHV3-33)
AREGDYYGSGGFPNWFDP

SEQ ID NO: 12513 - protein, 9 aa, Homo sapiens
  Light chain CDR3 for antibody 6257 (IGKV1-39)
QQSYSTPLT

SEQ ID NO: 12514 - protein, 14 aa, Homo sapiens
  Heavy chain CDR3 for antibody 6257 (IGHV3-23)
AKGGDVLTGYYPDY

SEQ ID NO: 12515 - protein, 9 aa, Homo sapiens
  Light chain CDR3 for antibody 6258 (IGKV1-6)
LQDYNYPYT

SEQ ID NO: 12516 - protein, 9 aa, Homo sapiens
  Heavy chain CDR3 for antibody 6258 (IGHV3-33)
ASHSSGEDY

SEQ ID NO: 12517 - protein, 9 aa, Homo sapiens
  Light chain CDR3 for antibody 6259 (IGKV1-6)
LQDFHYPWT

SEQ ID NO: 12518 - protein, 12 aa, Homo sapiens
  Heavy chain CDR3 for antibody 6259 (IGHV3-33)
ARDLVGATPFDY

SEQ ID NO: 12519 - protein, 8 aa, Homo sapiens
  Light chain CDR3 for antibody 6260 (IGKV1D-13)
QQFNNYPT

SEQ ID NO: 12520 - protein, 13 aa, Homo sapiens
  Heavy chain CDR3 for antibody 6260 (IGHV3-33)
ARIDYYSYYGMDV

SEQ ID NO: 12521 - protein, 9 aa, Homo sapiens
  Light chain CDR3 for antibody 6261 (IGKV2-30)
MQGTHWPLT

SEQ ID NO: 12522 - protein, 12 aa, Homo sapiens
  Heavy chain CDR3 for antibody 6261 (IGHV3-33)
AREGTGGNWFDP

SEQ ID NO: 12523 - protein, 9 aa, Homo sapiens
  Light chain CDR3 for antibody 6262 (IGKV1D-13)
QQFNNYPHT

SEQ ID NO: 12524 - protein, 14 aa, Homo sapiens
  Heavy chain CDR3 for antibody 6262 (IGHV3-33)
ARSTLVRGANWFDP

SEQ ID NO: 12525 - protein, 10 aa, Homo sapiens
  Light chain CDR3 for antibody 6263 (IGKV3-11)
QQRSNWPIFT

SEQ ID NO: 12526 - protein, 13 aa, Homo sapiens
  Heavy chain CDR3 for antibody 6263 (IGHV3-33)
ARQSSGWFDAFDI

SEQ ID NO: 12527 - protein, 9 aa, Homo sapiens
  Light chain CDR3 for antibody 6264 (IGKV1-27)
QKYNSAPYT

SEQ ID NO: 12528 - protein, 14 aa, Homo sapiens
  Heavy chain CDR3 for antibody 6264 (IGHV3-23)
AKGGDILTGYYTDY

SEQ ID NO: 12529 - protein, 9 aa, Homo sapiens
  Light chain CDR3 for antibody 6265 (IGKV3-11)
QQRINWPWT

SEQ ID NO: 12530 - protein, 17 aa, Homo sapiens
  Heavy chain CDR3 for antibody 6265 (IGHV4-39)
AGRLTYYYGSGSPSFDY

SEQ ID NO: 12531 - protein, 8 aa, Homo sapiens
  Light chain CDR3 for antibody 6266 (IGKV1-9)
QQYNSYST

SEQ ID NO: 12532 - protein, 12 aa, Homo sapiens
  Heavy chain CDR3 for antibody 6266 (IGHV1-46)
AREDYDIDGMDV

SEQ ID NO: 12533 - protein, 9 aa, Homo sapiens
  Light chain CDR3 for antibody 6267 (IGKV1-39)
QQSYRTPLT

SEQ ID NO: 12534 - protein, 10 aa, Homo sapiens
  Heavy chain CDR3 for antibody 6267 (IGHV3-11)
ARGQWPPLDY

SEQ ID NO: 12535 - protein, 9 aa, Homo sapiens
  Light chain CDR3 for antibody 6268 (IGKV1-9)
QQLNNYLLT

SEQ ID NO: 12536 - protein, 16 aa, Homo sapiens
  Heavy chain CDR3 for antibody 6268 (IGHV4-59)
ARGRYFEWLLGDVFDI

SEQ ID NO: 12537 - protein, 9 aa, Homo sapiens
  Light chain CDR3 for antibody 6269 (IGKV1-39)
QQSYSTPYT

SEQ ID NO: 12538 - protein, 16 aa, Homo sapiens
  Heavy chain CDR3 for antibody 6269 (IGHV3-23)
AKEGMVLRYFDWLWDY

SEQ ID NO: 12539 - protein, 9 aa, Homo sapiens
  Light chain CDR3 for antibody 6270 (IGKV3D-7)
QQDYNLPRT

SEQ ID NO: 12540 - protein, 12 aa, Homo sapiens
  Heavy chain CDR3 for antibody 6270 (IGHV3-23)
AKEYDILTGYFH

SEQ ID NO: 12541 - protein, 9 aa, Homo sapiens
  Light chain CDR3 for antibody 6271 (IGKV1-39)
QQSYSTPFT

SEQ ID NO: 12542 - protein, 14 aa, Homo sapiens
  Heavy chain CDR3 for antibody 6271 (IGHV3-33)
ARDLYGSGTYYKDF

SEQ ID NO: 12543 - protein, 9 aa, Homo sapiens
  Light chain CDR3 for antibody 6272 (IGKV2D-28)
MQALQTPPT

SEQ ID NO: 12544 - protein, 12 aa, Homo sapiens
  Heavy chain CDR3 for antibody 6272 (IGHV3-33)
ARESGGSYSFDY

SEQ ID NO: 12545 - protein, 8 aa, Homo sapiens
  Light chain CDR3 for antibody 6273 (IGKV1-5)
QQYNSYYT

SEQ ID NO: 12546 - protein, 15 aa, Homo sapiens
  Heavy chain CDR3 for antibody 6273 (IGHV3-23)
AKEFTMVRGVITPDY

SEQ ID NO: 12547 - protein, 8 aa, Homo sapiens
  Light chain CDR3 for antibody 6274 (IGKV3-20)
QQYGRSFT

SEQ ID NO: 12548 - protein, 8 aa, Homo sapiens
  Heavy chain CDR3 for antibody 6274 (IGHV4-39)
ARRGGLDY

SEQ ID NO: 12549 - protein, 9 aa, Homo sapiens
  Light chain CDR3 for antibody 6275 (IGKV1-27)
QKYNSAPYT

SEQ ID NO: 12550 - protein, 12 aa, Homo sapiens
  Heavy chain CDR3 for antibody 6275 (IGHV3-33)
ARGYFGSGYGDF

SEQ ID NO: 12551 - protein, 10 aa, Homo sapiens
  Light chain CDR3 for antibody 6276 (IGKV3-15)
QQYNNWPPIT

SEQ ID NO: 12552 - protein, 11 aa, Homo sapiens
  Heavy chain CDR3 for antibody 6276 (IGHV3-33)
ARDKSSGWSDY

SEQ ID NO: 12553 - protein, 9 aa, Homo sapiens
  Light chain CDR3 for antibody 6277 (IGKV1-33)
QQYDNLPFT

SEQ ID NO: 12554 - protein, 13 aa, Homo sapiens
  Heavy chain CDR3 for antibody 6277 (IGHV3-30)
AAPFMVRGDGMDV

SEQ ID NO: 12555 - protein, 8 aa, Homo sapiens
  Light chain CDR3 for antibody 6278 (IGKV6-21)
HQSSSLPT

SEQ ID NO: 12556 - protein, 18 aa, Homo sapiens
  Heavy chain CDR3 for antibody 6278 (IGHV3-33)
ARDRDRYGSGTYPDAIDI

SEQ ID NO: 12557 - protein, 8 aa, Homo sapiens
  Light chain CDR3 for antibody 6279 (IGKV1-5)
QQYNSYWT

SEQ ID NO: 12558 - protein, 15 aa, Homo sapiens
  Heavy chain CDR3 for antibody 6279 (IGHV3-23)
AKDGGWNYYYYGMDV

SEQ ID NO: 12559 - protein, 9 aa, Homo sapiens
  Light chain CDR3 for antibody 6280 (IGKV1-6)
LQDYNYPYT

SEQ ID NO: 12560 - protein, 18 aa, Homo sapiens
  Heavy chain CDR3 for antibody 6280 (IGHV4-39)
VKYITMVRGDIITGPFAY

SEQ ID NO: 12561 - protein, 9 aa, Homo sapiens
  Light chain CDR3 for antibody 6281 (IGKV1-9)
QQLNGYPFT

SEQ ID NO: 12562 - protein, 16 aa, Homo sapiens
  Heavy chain CDR3 for antibody 6281 (IGHV3-23)
AKEGMVLRYFDWLWDY

SEQ ID NO: 12563 - protein, 11 aa, Homo sapiens
  Light chain CDR3 for antibody 6282 (IGKV3-11)
QQRSNWPPTWT

SEQ ID NO: 12564 - protein, 13 aa, Homo sapiens
  Heavy chain CDR3 for antibody 6282 (IGHV3-11)
ARDEGYRGYVLDT

SEQ ID NO: 12565 - protein, 9 aa, Homo sapiens
  Light chain CDR3 for antibody 6283 (IGKV1-17)
LQHNGYPLT

SEQ ID NO: 12566 - protein, 7 aa, Homo sapiens
  Heavy chain CDR3 for antibody 6283 (IGHV3-33)
ARELFDY

SEQ ID NO: 12567 - protein, 8 aa, Homo sapiens
  Light chain CDR3 for antibody 6284 (IGKV3-11)
QQRSNWLT

SEQ ID NO: 12568 - protein, 8 aa, Homo sapiens
  Heavy chain CDR3 for antibody 6284 (IGHV3-23)
EKSAGEDV

SEQ ID NO: 12569 - protein, 9 aa, Homo sapiens
  Light chain CDR3 for antibody 6285 (IGKV1D-16)
QQYDSYPYT

SEQ ID NO: 12570 - protein, 15 aa, Homo sapiens
  Heavy chain CDR3 for antibody 6285 (IGHV3-33)
AKGGTMVRGVIAFDY

SEQ ID NO: 12571 - protein, 9 aa, Homo sapiens
  Light chain CDR3 for antibody 6286 (IGKV1-39)
QQSYSTPLT

SEQ ID NO: 12572 - protein, 18 aa, Homo sapiens
  Heavy chain CDR3 for antibody 6286 (IGHV3-33)
AREGDYYGSGGFPNWFDP

SEQ ID NO: 12573 - protein, 8 aa, Homo sapiens
  Light chain CDR3 for antibody 6287 (IGKV3D-7)
QQDYNLVT

SEQ ID NO: 12574 - protein, 17 aa, Homo sapiens
  Heavy chain CDR3 for antibody 6287 (IGHV4-59)
AREGADSGIYYHWYFDL

SEQ ID NO: 12575 - protein, 8 aa, Homo sapiens
  Light chain CDR3 for antibody 6288 (IGKV3D-7)
QQDYNLLT

SEQ ID NO: 12576 - protein, 14 aa, Homo sapiens
  Heavy chain CDR3 for antibody 6288 (IGHV3-33)
ARDLNYDILNGGGY

SEQ ID NO: 12577 - protein, 9 aa, Homo sapiens
  Light chain CDR3 for antibody 6289 (IGKV1-17)
LQHNSYPLT

SEQ ID NO: 12578 - protein, 12 aa, Homo sapiens
  Heavy chain CDR3 for antibody 6289 (IGHV3-74)
ARDKGGRNGMDV

SEQ ID NO: 12579 - protein, 9 aa, Homo sapiens
  Light chain CDR3 for antibody 6290 (IGKV3-20)
QQYGSSPYT

SEQ ID NO: 12580 - protein, 12 aa, Homo sapiens
  Heavy chain CDR3 for antibody 6290 (IGHV3-23)
AKEGLGNDYEPY

SEQ ID NO: 12581 - protein, 9 aa, Homo sapiens
  Light chain CDR3 for antibody 6291 (IGKV5-2)
LQHDNFPYT

SEQ ID NO: 12582 - protein, 17 aa, Homo sapiens
  Heavy chain CDR3 for antibody 6291 (IGHV3-23)
AKERNWNDGYYYYGMDV

SEQ ID NO: 12583 - protein, 9 aa, Homo sapiens
  Light chain CDR3 for antibody 6292 (IGKV1-39)
QQSYSTPFT

SEQ ID NO: 12584 - protein, 18 aa, Homo sapiens
  Heavy chain CDR3 for antibody 6292 (IGHV3-33)
ARDQYSGYDFYYYYGMDV

SEQ ID NO: 12585 - protein, 9 aa, Homo sapiens
  Light chain CDR3 for antibody 6293 (IGKV1-9)
QQLNSYPWT

SEQ ID NO: 12586 - protein, 16 aa, Homo sapiens
  Heavy chain CDR3 for antibody 6293 (IGHV3-33)
ARAVYYGSGSSLIMDV

SEQ ID NO: 12587 - protein, 9 aa, Homo sapiens
  Light chain CDR3 for antibody 6294 (IGKV3-15)
QQYSNWPLT

SEQ ID NO: 12588 - protein, 16 aa, Homo sapiens
  Heavy chain CDR3 for antibody 6294 (IGHV3-33)
ARDNFGSGSYYSHFHY

SEQ ID NO: 12589 - protein, 8 aa, Homo sapiens
  Light chain CDR3 for antibody 6295 (IGKV3-15)
QQYNNWLT

SEQ ID NO: 12590 - protein, 20 aa, Homo sapiens
  Heavy chain CDR3 for antibody 6295 (IGHV1-18)
AREVGIAVAGTLYYYYGMDV

SEQ ID NO: 12591 - protein, 9 aa, Homo sapiens
  Light chain CDR3 for antibody 6296 (IGKV1-6)
QQEYNYPLT

SEQ ID NO: 12592 - protein, 20 aa, Homo sapiens
  Heavy chain CDR3 for antibody 6296 (IGHV3-11)
ARGGATLIRGLIDYYYGMDV

SEQ ID NO: 12593 - protein, 8 aa, Homo sapiens
  Light chain CDR3 for antibody 6297 (IGKV1-5)
QQYNSYYT

SEQ ID NO: 12594 - protein, 11 aa, Homo sapiens
  Heavy chain CDR3 for antibody 6297 (IGHV3-23)
ARDPGSITGDY

SEQ ID NO: 12595 - protein, 8 aa, Homo sapiens
  Light chain CDR3 for antibody 6298 (IGKV3-15)
QQYNNWPT

SEQ ID NO: 12596 - protein, 9 aa, Homo sapiens
  Heavy chain CDR3 for antibody 6298 (IGHV3-30)
ARDNWGFDY

SEQ ID NO: 12597 - protein, 10 aa, Homo sapiens
  Light chain CDR3 for antibody 6299 (IGKV3-15)
QKYNNWPPLT

SEQ ID NO: 12598 - protein, 12 aa, Homo sapiens
  Heavy chain CDR3 for antibody 6299 (IGHV1-24)
ASDWAYYYGMDV

SEQ ID NO: 12599 - protein, 9 aa, Homo sapiens
  Light chain CDR3 for antibody 6300 (IGKV1D-13)
QQFNNYPHT

SEQ ID NO: 12600 - protein, 10 aa, Homo sapiens
  Heavy chain CDR3 for antibody 6300 (IGHV3-33)
ARDGLRYFDW

SEQ ID NO: 12601 - protein, 10 aa, Homo sapiens
  Light chain CDR3 for antibody 6301 (IGKV3-11)
QQRSNWPIFT

SEQ ID NO: 12602 - protein, 11 aa, Homo sapiens
  Heavy chain CDR3 for antibody 6301 (IGHV4-59)
ARSIRYSVFDY

SEQ ID NO: 12603 - protein, 9 aa, Homo sapiens
  Light chain CDR3 for antibody 6302 (IGKV6-21)
HQSYSLPHT

SEQ ID NO: 12604 - protein, 17 aa, Homo sapiens
  Heavy chain CDR3 for antibody 6302 (IGHV4-39)
AGRLTYYYGSGSPSSDY

SEQ ID NO: 12605 - protein, 8 aa, Homo sapiens
  Light chain CDR3 for antibody 6303 (IGKV3D-7)
QQDYNLLT

SEQ ID NO: 12606 - protein, 11 aa, Homo sapiens
  Heavy chain CDR3 for antibody 6303 (IGHV1-46)
AREEDLGAFDI

SEQ ID NO: 12607 - protein, 9 aa, Homo sapiens
  Light chain CDR3 for antibody 6304 (IGKV1-33)
QQYDNLPFT

SEQ ID NO: 12608 - protein, 13 aa, Homo sapiens
  Heavy chain CDR3 for antibody 6304 (IGHV3-33)
VSTGDSYYYVMDV

SEQ ID NO: 12609 - protein, 9 aa, Homo sapiens
  Light chain CDR3 for antibody 6305 (IGKV3D-7)
QQDYNLPFT

SEQ ID NO: 12610 - protein, 12 aa, Homo sapiens
  Heavy chain CDR3 for antibody 6305 (IGHV3-33)
AREGTGGNWFDP

SEQ ID NO: 12611 - protein, 8 aa, Homo sapiens
  Light chain CDR3 for antibody 6306 (IGKV1-5)
QQYNSYYT

SEQ ID NO: 12612 - protein, 17 aa, Homo sapiens
  Heavy chain CDR3 for antibody 6306 (IGHV3-33)
ARDLIGPLSSSWYPFDY

SEQ ID NO: 12613 - protein, 8 aa, Homo sapiens
  Light chain CDR3 for antibody 6307 (IGKV1D-13)
QQFNNYPT

SEQ ID NO: 12614 - protein, 16 aa, Homo sapiens
  Heavy chain CDR3 for antibody 6307 (IGHV3-33)
ARGGRSDWLYYYGMDV

SEQ ID NO: 12615 - protein, 10 aa, Homo sapiens
  Light chain CDR3 for antibody 6308 (IGKV3-11)
QQRSNWPPFT

SEQ ID NO: 12616 - protein, 14 aa, Homo sapiens
  Heavy chain CDR3 for antibody 6308 (IGHV4-39)
ARQGTMIRGGYFDY

SEQ ID NO: 12617 - protein, 9 aa, Homo sapiens
  Light chain CDR3 for antibody 6309 (IGKV6-21)
HQSSSLPLT

SEQ ID NO: 12618 - protein, 12 aa, Homo sapiens
  Heavy chain CDR3 for antibody 6309 (IGHV4-59)
MGWLAYYYGMDV

SEQ ID NO: 12619 - protein, 9 aa, Homo sapiens
  Light chain CDR3 for antibody 6310 (IGKV3-11)
QQRSNWPRT

SEQ ID NO: 12620 - protein, 18 aa, Homo sapiens
  Heavy chain CDR3 for antibody 6310 (IGHV4-59)
ARERGNWNDVDYYYGMDV

SEQ ID NO: 12621 - protein, 9 aa, Homo sapiens
  Light chain CDR3 for antibody 6311 (IGKV3-20)
QQYGSSPYT

SEQ ID NO: 12622 - protein, 17 aa, Homo sapiens
  Heavy chain CDR3 for antibody 6311 (IGHV1-24)
ATDRYFDWLSPLDAFDI

SEQ ID NO: 12623 - protein, 9 aa, Homo sapiens
  Light chain CDR3 for antibody 6312 (IGKV2-30)
MQGTHWPLT

SEQ ID NO: 12624 - protein, 21 aa, Homo sapiens
  Heavy chain CDR3 for antibody 6312 (IGHV3-33)
ARDEYYEIVTGYGYYHYGMDV

SEQ ID NO: 12625 - protein, 9 aa, Homo sapiens
  Light chain CDR3 for antibody 6313 (IGKV1-6)
LQDYNHPFT

SEQ ID NO: 12626 - protein, 17 aa, Homo sapiens
  Heavy chain CDR3 for antibody 6313 (IGHV3-33)
ARVYYDILTGYSYYFDY

SEQ ID NO: 12627 - protein, 9 aa, Homo sapiens
  Light chain CDR3 for antibody 6314 (IGKV1-16)
QKYNSAPHT

SEQ ID NO: 12628 - protein, 15 aa, Homo sapiens
  Heavy chain CDR3 for antibody 6314 (IGHV3-33)
ARRGYNDYDPYGMDV

SEQ ID NO: 12629 - protein, 9 aa, Homo sapiens
  Light chain CDR3 for antibody 6315 (IGKV3-11)
QQRSNWPYT

SEQ ID NO: 12630 - protein, 15 aa, Homo sapiens
  Heavy chain CDR3 for antibody 6315 (IGHV3-33)
AKDRNSGYDWGGFDY

SEQ ID NO: 12631 - protein, 9 aa, Homo sapiens
  Light chain CDR3 for antibody 6316 (IGKV1-27)
QKYNSAPYT

SEQ ID NO: 12632 - protein, 10 aa, Homo sapiens
  Heavy chain CDR3 for antibody 6316 (IGHV3-33)
ARDHGYYFDY

SEQ ID NO: 12633 - protein, 9 aa, Homo sapiens
  Light chain CDR3 for antibody 6317 (IGKV1-39)
QQSYSTPLT

SEQ ID NO: 12634 - protein, 12 aa, Homo sapiens
  Heavy chain CDR3 for antibody 6317 (IGHV3-33)
ARKQWLVQAFDI

SEQ ID NO: 12635 - protein, 9 aa, Homo sapiens
  Light chain CDR3 for antibody 6318 (IGKV1D-13)
QQFNNYPYT

SEQ ID NO: 12636 - protein, 11 aa, Homo sapiens
  Heavy chain CDR3 for antibody 6318 (IGHV4-59)
ARDGSWEPFDY

SEQ ID NO: 12637 - protein, 9 aa, Homo sapiens
  Light chain CDR3 for antibody 6319 (IGKV3-11)
QQRSNWPWT

SEQ ID NO: 12638 - protein, 11 aa, Homo sapiens
  Heavy chain CDR3 for antibody 6319 (IGHV1-24)
ATYFGSGSLDY

SEQ ID NO: 12639 - protein, 9 aa, Homo sapiens
  Light chain CDR3 for antibody 6320 (IGKV1-6)
LQDYKSPFT

SEQ ID NO: 12640 - protein, 15 aa, Homo sapiens
  Heavy chain CDR3 for antibody 6320 (IGHV3-30)
ARDSRPEITGPPFDY

SEQ ID NO: 12641 - protein, 9 aa, Homo sapiens
  Light chain CDR3 for antibody 6321 (IGKV1-6)
QQLHIYPWT

SEQ ID NO: 12642 - protein, 15 aa, Homo sapiens
  Heavy chain CDR3 for antibody 6321 (IGHV3-33)
ARDRGSSGWRDWFDP

SEQ ID NO: 12643 - protein, 9 aa, Homo sapiens
  Light chain CDR3 for antibody 6322 (IGKV2D-28)
MQALQTPPT

SEQ ID NO: 12644 - protein, 14 aa, Homo sapiens
  Heavy chain CDR3 for antibody 6322 (IGHV3-33)
AREGYSSNWYDFDY

SEQ ID NO: 12645 - protein, 9 aa, Homo sapiens
  Light chain CDR3 for antibody 6323 (IGKV1D-16)
QQYDSYPWT

SEQ ID NO: 12646 - protein, 7 aa, Homo sapiens
  Heavy chain CDR3 for antibody 6323 (IGHV3-33)
ARELVDY

SEQ ID NO: 12647 - protein, 10 aa, Homo sapiens
  Light chain CDR3 for antibody 6324 (IGKV1-17)
LQHNSYPMYT

SEQ ID NO: 12648 - protein, 17 aa, Homo sapiens
  Heavy chain CDR3 for antibody 6324 (IGHV1-18)
ARERYYGSGSYKYNMDV

SEQ ID NO: 12649 - protein, 10 aa, Homo sapiens
  Light chain CDR3 for antibody 6325 (IGKV3-11)
QQRSNWPIFT

SEQ ID NO: 12650 - protein, 17 aa, Homo sapiens
  Heavy chain CDR3 for antibody 6325 (IGHV3-33)
TRDSGMVRGIIIYGMDV

SEQ ID NO: 12651 - protein, 8 aa, Homo sapiens
  Light chain CDR3 for antibody 6326 (IGKV6-21)
HQSSSLPT

SEQ ID NO: 12652 - protein, 12 aa, Homo sapiens
  Heavy chain CDR3 for antibody 6326 (IGHV3-13)
AREAGIPDAFDI

SEQ ID NO: 12653 - protein, 9 aa, Homo sapiens
  Light chain CDR3 for antibody 6327 (IGKV1-16)
QQYNSYPYT

SEQ ID NO: 12654 - protein, 19 aa, Homo sapiens
  Heavy chain CDR3 for antibody 6327 (IGHV5-51)
ARHGEKGKRITMVRGSLDV

SEQ ID NO: 12655 - protein, 8 aa, Homo sapiens
  Light chain CDR3 for antibody 6328 (IGKV3D-7)
QQDYNLLT

SEQ ID NO: 12656 - protein, 13 aa, Homo sapiens
  Heavy chain CDR3 for antibody 6328 (IGHV1-2)
ARDGVRGSFGMDV

SEQ ID NO: 12657 - protein, 9 aa, Homo sapiens
  Light chain CDR3 for antibody 6329 (IGKV1-17)
LQHNSYPYT

SEQ ID NO: 12658 - protein, 12 aa, Homo sapiens
  Heavy chain CDR3 for antibody 6329 (IGHV4-39)
ARHPRYLDAFDI

SEQ ID NO: 12659 - protein, 9 aa, Homo sapiens
  Light chain CDR3 for antibody 6330 (IGKV1-27)
QKYNSAPYT

SEQ ID NO: 12660 - protein, 8 aa, Homo sapiens
  Heavy chain CDR3 for antibody 6330 (IGHV3-20)
APHWIFDY

SEQ ID NO: 12661 - protein, 8 aa, Homo sapiens
  Light chain CDR3 for antibody 6331 (IGKV3D-7)
QQDYNLLT

SEQ ID NO: 12662 - protein, 10 aa, Homo sapiens
  Heavy chain CDR3 for antibody 6331 (IGHV3-30)
AREWYGGMDV

SEQ ID NO: 12663 - protein, 10 aa, Homo sapiens
  Light chain CDR3 for antibody 6332 (IGKV1-39)
QQSYSTPMYT

SEQ ID NO: 12664 - protein, 7 aa, Homo sapiens
  Heavy chain CDR3 for antibody 6332 (IGHV1-46)
AREGGDY

SEQ ID NO: 12665 - protein, 9 aa, Homo sapiens
  Light chain CDR3 for antibody 6333 (IGKV1D-13)
QHFNNYMYT

SEQ ID NO: 12666 - protein, 17 aa, Homo sapiens
  Heavy chain CDR3 for antibody 6333 (IGHV1-18)
ARDRAFTMVRGVPPFDY

SEQ ID NO: 12667 - protein, 9 aa, Homo sapiens
  Light chain CDR3 for antibody 6334 (IGKV1-39)
QQSYSTPLT

SEQ ID NO: 12668 - protein, 14 aa, Homo sapiens
  Heavy chain CDR3 for antibody 6334 (IGHV3-33)
VSAISGSSYWYFAL

SEQ ID NO: 12669 - protein, 9 aa, Homo sapiens
  Light chain CDR3 for antibody 6335 (IGKV1-9)
QQYNSYPLT

SEQ ID NO: 12670 - protein, 12 aa, Homo sapiens
  Heavy chain CDR3 for antibody 6335 (IGHV3-21)
AREGFGESSFDY

SEQ ID NO: 12671 - protein, 8 aa, Homo sapiens
  Light chain CDR3 for antibody 6336 (IGKV3-11)
QQRSNWLT

SEQ ID NO: 12672 - protein, 15 aa, Homo sapiens
  Heavy chain CDR3 for antibody 6336 (IGHV1-18)
ARGYCSSTSCYYFDY

SEQ ID NO: 12673 - protein, 10 aa, Homo sapiens
  Light chain CDR3 for antibody 6337 (IGKV3-11)
QQRSNWPPFT

SEQ ID NO: 12674 - protein, 11 aa, Homo sapiens
  Heavy chain CDR3 for antibody 6337 (IGHV4-4)
AREAYYYGLDV

SEQ ID NO: 12675 - protein, 9 aa, Homo sapiens
  Light chain CDR3 for antibody 6338 (IGKV1-17)
LHSNNYPWT

SEQ ID NO: 12676 - protein, 11 aa, Homo sapiens
  Heavy chain CDR3 for antibody 6338 (IGHV3-33)
ARDTWDDYFDY

SEQ ID NO: 12677 - protein, 9 aa, Homo sapiens
  Light chain CDR3 for antibody 6339 (IGKV1-6)
LQDYNYPYT

SEQ ID NO: 12678 - protein, 4 aa, Homo sapiens
  Heavy chain CDR3 for antibody 6339 (IGHV3-13)
ARDY

SEQ ID NO: 12679 - protein, 10 aa, Homo sapiens
  Light chain CDR3 for antibody 6340 (IGKV3-11)
QQRSNWPIFT

SEQ ID NO: 12680 - protein, 16 aa, Homo sapiens
  Heavy chain CDR3 for antibody 6340 (IGHV1-18)
ARYFDWLLRDYYGMDV

SEQ ID NO: 12681 - protein, 9 aa, Homo sapiens
  Light chain CDR3 for antibody 6341 (IGKV1-17)
LQHNSYPYT

SEQ ID NO: 12682 - protein, 14 aa, Homo sapiens
  Heavy chain CDR3 for antibody 6341 (IGHV3-23)
AKDRNIPAAGPFDY

SEQ ID NO: 12683 - protein, 8 aa, Homo sapiens
  Light chain CDR3 for antibody 6342 (IGKV3-15)
QQYNNWPT

SEQ ID NO: 12684 - protein, 16 aa, Homo sapiens
  Heavy chain CDR3 for antibody 6342 (IGHV3-33)
ARGYDMLTGDYYGMDV

SEQ ID NO: 12685 - protein, 9 aa, Homo sapiens
  Light chain CDR3 for antibody 6343 (IGKV1-16)
QQYNSYPYT

SEQ ID NO: 12686 - protein, 17 aa, Homo sapiens
  Heavy chain CDR3 for antibody 6343 (IGHV4-39)
ARLVLRYSDWLLPHFDY

SEQ ID NO: 12687 - protein, 9 aa, Homo sapiens
  Light chain CDR3 for antibody 6344 (IGKV1-9)
LQDYKSPFT

SEQ ID NO: 12688 - protein, 14 aa, Homo sapiens
  Heavy chain CDR3 for antibody 6344 (IGHV1-46)
ARRGIVGALDAFDI

SEQ ID NO: 12689 - protein, 9 aa, Homo sapiens
  Light chain CDR3 for antibody 6345 (IGKV1-27)
QKYNSAPYT

SEQ ID NO: 12690 - protein, 18 aa, Homo sapiens
  Heavy chain CDR3 for antibody 6345 (IGHV3-11)
ARDGYYGSGSFYYYGMDV

SEQ ID NO: 12691 - protein, 9 aa, Homo sapiens
  Light chain CDR3 for antibody 6346 (IGKV3-20)
QQYGSSPYT

SEQ ID NO: 12692 - protein, 13 aa, Homo sapiens
  Heavy chain CDR3 for antibody 6346 (IGHV4-4)
ARERGIAAAGPDY

SEQ ID NO: 12693 - protein, 9 aa, Homo sapiens
  Light chain CDR3 for antibody 6347 (IGKV3D-7)
QQDYNLPLT

SEQ ID NO: 12694 - protein, 11 aa, Homo sapiens
  Heavy chain CDR3 for antibody 6347 (IGHV3-33)
AREAANWGFDY

SEQ ID NO: 12695 - protein, 9 aa, Homo sapiens
  Light chain CDR3 for antibody 6348 (IGKV1-39)
QQSYRTPLT

SEQ ID NO: 12696 - protein, 11 aa, Homo sapiens
  Heavy chain CDR3 for antibody 6348 (IGHV4-59)
AREMGHDTFDI

SEQ ID NO: 12697 - protein, 9 aa, Homo sapiens
  Light chain CDR3 for antibody 6349 (IGKV3-11)
QQRSNWPPT

SEQ ID NO: 12698 - protein, 17 aa, Homo sapiens
  Heavy chain CDR3 for antibody 6349 (IGHV3-23)
AKDRPVTTLYYYFGMDV

SEQ ID NO: 12699 - protein, 10 aa, Homo sapiens
  Light chain CDR3 for antibody 6350 (IGKV3-11)
QQRSTWPTLT

SEQ ID NO: 12700 - protein, 14 aa, Homo sapiens
  Heavy chain CDR3 for antibody 6350 (IGHV3-33)
AREDYYGPLNWFDP

SEQ ID NO: 12701 - protein, 10 aa, Homo sapiens
  Light chain CDR3 for antibody 6351 (IGKV1-39)
QQSYSTPMYT

SEQ ID NO: 12702 - protein, 14 aa, Homo sapiens
  Heavy chain CDR3 for antibody 6351 (IGHV3-33)
ARQYSYGYPYYFDY

SEQ ID NO: 12703 - protein, 8 aa, Homo sapiens
  Light chain CDR3 for antibody 6352 (IGKV1-5)
QQYNSYYT

SEQ ID NO: 12704 - protein, 11 aa, Homo sapiens
  Heavy chain CDR3 for antibody 6352 (IGHV3-33)
ARAGIAALFDY

SEQ ID NO: 12705 - protein, 9 aa, Homo sapiens
  Light chain CDR3 for antibody 6353 (IGKV1-6)
LQDYNYPRT

SEQ ID NO: 12706 - protein, 11 aa, Homo sapiens
  Heavy chain CDR3 for antibody 6353 (IGHV3-33)
ARAGIAALFDY

SEQ ID NO: 12707 - protein, 8 aa, Homo sapiens
  Light chain CDR3 for antibody 6354 (IGKV3-20)
QQYGSSLT

SEQ ID NO: 12708 - protein, 17 aa, Homo sapiens
  Heavy chain CDR3 for antibody 6354 (IGHV1-18)
ARDEGYDILTGYPHFDY

SEQ ID NO: 12709 - protein, 8 aa, Homo sapiens
  Light chain CDR3 for antibody 6355 (IGKV3D-7)
QQDYNLLT

SEQ ID NO: 12710 - protein, 18 aa, Homo sapiens
  Heavy chain CDR3 for antibody 6355 (IGHV3-33)
ARREGITLIFYYYYGMDV

SEQ ID NO: 12711 - protein, 8 aa, Homo sapiens
  Light chain CDR3 for antibody 6356 (IGKV3-11)
QQRSNWWT

SEQ ID NO: 12712 - protein, 11 aa, Homo sapiens
  Heavy chain CDR3 for antibody 6356 (IGHV3-33)
ARGSGSYAFDY

SEQ ID NO: 12713 - protein, 9 aa, Homo sapiens
  Light chain CDR3 for antibody 6357 (IGKV5-2)
LQHDNFPYT

SEQ ID NO: 12714 - protein, 19 aa, Homo sapiens
  Heavy chain CDR3 for antibody 6357 (IGHV3-33)
ARGRGSYYYGPGSHYGMDV

SEQ ID NO: 12715 - protein, 9 aa, Homo sapiens
  Light chain CDR3 for antibody 6358 (IGKV1-27)
QKYNSAPYT

SEQ ID NO: 12716 - protein, 7 aa, Homo sapiens
  Heavy chain CDR3 for antibody 6358 (IGHV1-46)
AREGGDY

SEQ ID NO: 12717 - protein, 8 aa, Homo sapiens
  Light chain CDR3 for antibody 6359 (IGKV3-20)
QQYGSSFT

SEQ ID NO: 12718 - protein, 17 aa, Homo sapiens
  Heavy chain CDR3 for antibody 6359 (IGHV4-59)
ARRITMVREIIITAFDY

SEQ ID NO: 12719 - protein, 9 aa, Homo sapiens
  Light chain CDR3 for antibody 6360 (IGKV1D-16)
LQQNSYPWT

SEQ ID NO: 12720 - protein, 12 aa, Homo sapiens
  Heavy chain CDR3 for antibody 6360 (IGHV3-13)
VREAGIPDAFDI

SEQ ID NO: 12721 - protein, 10 aa, Homo sapiens
  Light chain CDR3 for antibody 6361 (IGKV3-11)
QQRSNWLMYT

SEQ ID NO: 12722 - protein, 11 aa, Homo sapiens
  Heavy chain CDR3 for antibody 6361 (IGHV3-33)
ARDRSSGPFDY

SEQ ID NO: 12723 - protein, 10 aa, Homo sapiens
  Light chain CDR3 for antibody 6362 (IGKV3-11)
QQRSNWPALT

SEQ ID NO: 12724 - protein, 16 aa, Homo sapiens
  Heavy chain CDR3 for antibody 6362 (IGHV3-23)
ARNWNDVGDYYYGMDV

SEQ ID NO: 12725 - protein, 9 aa, Homo sapiens
  Light chain CDR3 for antibody 6363 (IGKV1D-16)
QQYNSFPLT

SEQ ID NO: 12726 - protein, 12 aa, Homo sapiens
  Heavy chain CDR3 for antibody 6363 (IGHV3-33)
AREKGGSYSFDY

SEQ ID NO: 12727 - protein, 8 aa, Homo sapiens
  Light chain CDR3 for antibody 6364 (IGKV1-6)
QQFNNYPT

SEQ ID NO: 12728 - protein, 11 aa, Homo sapiens
  Heavy chain CDR3 for antibody 6364 (IGHV3-33)
ARDILTGFLDH

SEQ ID NO: 12729 - protein, 9 aa, Homo sapiens
  Light chain CDR3 for antibody 6365 (IGKV3D-7)
QQDYTLPLT

SEQ ID NO: 12730 - protein, 10 aa, Homo sapiens
  Heavy chain CDR3 for antibody 6365 (IGHV3-33)
ARENSTPLDY

SEQ ID NO: 12731 - protein, 8 aa, Homo sapiens
  Light chain CDR3 for antibody 6366 (IGKV3D-7)
QQDYNLVT

SEQ ID NO: 12732 - protein, 16 aa, Homo sapiens
  Heavy chain CDR3 for antibody 6366 (IGHV4-59)
ARYSGSYYGDYYGMDV

SEQ ID NO: 12733 - protein, 9 aa, Homo sapiens
  Light chain CDR3 for antibody 6367 (IGKV5-2)
LQHDNFPWT

SEQ ID NO: 12734 - protein, 12 aa, Homo sapiens
  Heavy chain CDR3 for antibody 6367 (IGHV6-1)
ARLDWNYRAFDI

SEQ ID NO: 12735 - protein, 9 aa, Homo sapiens
  Light chain CDR3 for antibody 6368 (IGKV1-33)
QQYDNLPPT

SEQ ID NO: 12736 - protein, 18 aa, Homo sapiens
  Heavy chain CDR3 for antibody 6368 (IGHV1-46)
ARDGDYVWGSYRSDWFDP

SEQ ID NO: 12737 - protein, 9 aa, Homo sapiens
  Light chain CDR3 for antibody 6369 (IGKV3D-7)
QQDYNLPWT

SEQ ID NO: 12738 - protein, 12 aa, Homo sapiens
  Heavy chain CDR3 for antibody 6369 (IGHV3-13)
ARDRGYSGYFDY

SEQ ID NO: 12739 - protein, 9 aa, Homo sapiens
  Light chain CDR3 for antibody 6370 (IGKV1-6)
LQDYNYPYT

SEQ ID NO: 12740 - protein, 14 aa, Homo sapiens
  Heavy chain CDR3 for antibody 6370 (IGHV1-18)
AREGGSGSSPGMDV

SEQ ID NO: 12741 - protein, 9 aa, Homo sapiens
  Light chain CDR3 for antibody 6371 (IGKV3-11)
QQRSNWPPT

SEQ ID NO: 12742 - protein, 12 aa, Homo sapiens
  Heavy chain CDR3 for antibody 6371 (IGHV3-13)
AIGTMVRGIPDY

SEQ ID NO: 12743 - protein, 9 aa, Homo sapiens
  Light chain CDR3 for antibody 6372 (IGKV1D-16)
QQYNSYPYT

SEQ ID NO: 12744 - protein, 12 aa, Homo sapiens
  Heavy chain CDR3 for antibody 6372 (IGHV3-23)
AKEYDSLTGYFH

SEQ ID NO: 12745 - protein, 9 aa, Homo sapiens
  Light chain CDR3 for antibody 6373 (IGKV1D-13)
QQFNNYPST

SEQ ID NO: 12746 - protein, 13 aa, Homo sapiens
  Heavy chain CDR3 for antibody 6373 (IGHV3-53)
ARDRDSSGSYFDY

SEQ ID NO: 12747 - protein, 8 aa, Homo sapiens
  Light chain CDR3 for antibody 6374 (IGKV6-21)
HQSSSLPT

SEQ ID NO: 12748 - protein, 9 aa, Homo sapiens
  Heavy chain CDR3 for antibody 6374 (IGHV3-33)
ARATVGVDY

SEQ ID NO: 12749 - protein, 8 aa, Homo sapiens
  Light chain CDR3 for antibody 6375 (IGKV1-5)
QQYNSYYT

SEQ ID NO: 12750 - protein, 12 aa, Homo sapiens
  Heavy chain CDR3 for antibody 6375 (IGHV4-59)
ARVYSSGWLFDY

SEQ ID NO: 12751 - protein, 9 aa, Homo sapiens
  Light chain CDR3 for antibody 6376 (IGKV3D-20)
QQYYSTPWT

SEQ ID NO: 12752 - protein, 9 aa, Homo sapiens
  Heavy chain CDR3 for antibody 6376 (IGHV3-13)
ARDRWYFDL

SEQ ID NO: 12753 - protein, 10 aa, Homo sapiens
  Light chain CDR3 for antibody 6377 (IGKV3-11)
QQRSNWPALT

SEQ ID NO: 12754 - protein, 18 aa, Homo sapiens
  Heavy chain CDR3 for antibody 6377 (IGHV3-23)
AKPDYYGSGSYYNVPFDY

SEQ ID NO: 12755 - protein, 8 aa, Homo sapiens
  Light chain CDR3 for antibody 6378 (IGKV1D-13)
QQFNNYPT

SEQ ID NO: 12756 - protein, 16 aa, Homo sapiens
  Heavy chain CDR3 for antibody 6378 (IGHV3-33)
AREVAGSYYYYYGIDV

SEQ ID NO: 12757 - protein, 9 aa, Homo sapiens
  Light chain CDR3 for antibody 6379 (IGKV1-39)
QQSYRTPLT

SEQ ID NO: 12758 - protein, 18 aa, Homo sapiens
  Heavy chain CDR3 for antibody 6379 (IGHV4-59)
AREGHYYTSGSYYKAFDY

SEQ ID NO: 12759 - protein, 9 aa, Homo sapiens
  Light chain CDR3 for antibody 6380 (IGKV1-6)
LQDYNYPRT

SEQ ID NO: 12760 - protein, 12 aa, Homo sapiens
  Heavy chain CDR3 for antibody 6380 (IGHV3-23)
AKEGLGNDYESY

SEQ ID NO: 12761 - protein, 9 aa, Homo sapiens
  Light chain CDR3 for antibody 6381 (IGKV3D-7)
QQDYEFPLT

SEQ ID NO: 12762 - protein, 11 aa, Homo sapiens
  Heavy chain CDR3 for antibody 6381 (IGHV4-61)
ARVDSSGWFDY

SEQ ID NO: 12763 - protein, 9 aa, Homo sapiens
  Light chain CDR3 for antibody 6382 (IGKV1-16)
QQYNSYPYT

SEQ ID NO: 12764 - protein, 17 aa, Homo sapiens
  Heavy chain CDR3 for antibody 6382 (IGHV4-59)
ARDRELLWFGEFGGMDV

SEQ ID NO: 12765 - protein, 9 aa, Homo sapiens
  Light chain CDR3 for antibody 6383 (IGKV1-39)
QQGFSTPWT

SEQ ID NO: 12766 - protein, 11 aa, Homo sapiens
  Heavy chain CDR3 for antibody 6383 (IGHV4-59)
ARSIRYSVFDY

SEQ ID NO: 12767 - protein, 9 aa, Homo sapiens
  Light chain CDR3 for antibody 6384 (IGKV1-9)
QQLKSYLYT

SEQ ID NO: 12768 - protein, 15 aa, Homo sapiens
  Heavy chain CDR3 for antibody 6384 (IGHV1-18)
ARRSPNWGHYYGMDV

SEQ ID NO: 12769 - protein, 9 aa, Homo sapiens
  Light chain CDR3 for antibody 6385 (IGKV6-21)
HQSSSLPYT

SEQ ID NO: 12770 - protein, 16 aa, Homo sapiens
  Heavy chain CDR3 for antibody 6385 (IGHV4-59)
ARQLLWFGELKGVFDY

SEQ ID NO: 12771 - protein, 9 aa, Homo sapiens
  Light chain CDR3 for antibody 6386 (IGKV1-6)
LQDYNYPYT

SEQ ID NO: 12772 - protein, 13 aa, Homo sapiens
  Heavy chain CDR3 for antibody 6386 (IGHV3-33)
ARRGSGSPDGFDI

SEQ ID NO: 12773 - protein, 9 aa, Homo sapiens
  Light chain CDR3 for antibody 6387 (IGKV1-9)
QQLKSYPYT

SEQ ID NO: 12774 - protein, 18 aa, Homo sapiens
  Heavy chain CDR3 for antibody 6387 (IGHV3-33)
ARREGIVGATTYYYGMDV

SEQ ID NO: 12775 - protein, 9 aa, Homo sapiens
  Light chain CDR3 for antibody 6388 (IGKV1D-13)
QQFNNYPYT

SEQ ID NO: 12776 - protein, 20 aa, Homo sapiens
  Heavy chain CDR3 for antibody 6388 (IGHV1-8)
ARGDGTMVRGIYYYYYGMDV

SEQ ID NO: 12777 - protein, 8 aa, Homo sapiens
  Light chain CDR3 for antibody 6389 (IGKV3D-7)
QQDYNLLT

SEQ ID NO: 12778 - protein, 12 aa, Homo sapiens
  Heavy chain CDR3 for antibody 6389 (IGHV1-46)
AREDYDIDGMDV

SEQ ID NO: 12779 - protein, 9 aa, Homo sapiens
  Light chain CDR3 for antibody 6390 (IGKV2-30)
MQGTHWPLT

SEQ ID NO: 12780 - protein, 20 aa, Homo sapiens
  Heavy chain CDR3 for antibody 6390 (IGHV3-33)
ARDNDSSGYYDYYYYYGMDV

SEQ ID NO: 12781 - protein, 9 aa, Homo sapiens
  Light chain CDR3 for antibody 6391 (IGKV2-30)
MQGTHWPLT

SEQ ID NO: 12782 - protein, 16 aa, Homo sapiens
  Heavy chain CDR3 for antibody 6391 (IGHV3-33)
ARAVYYGSGSSLIMDV

SEQ ID NO: 12783 - protein, 9 aa, Homo sapiens
  Light chain CDR3 for antibody 6392 (IGKV1-6)
LQDFHYPWT

SEQ ID NO: 12784 - protein, 12 aa, Homo sapiens
  Heavy chain CDR3 for antibody 6392 (IGHV3-33)
ASRDILTGYLGY

SEQ ID NO: 12785 - protein, 9 aa, Homo sapiens
  Light chain CDR3 for antibody 6393 (IGKV3D-7)
QQDYNLPLT

SEQ ID NO: 12786 - protein, 21 aa, Homo sapiens
  Heavy chain CDR3 for antibody 6393 (IGHV1-18)
ASGVLIWFGELLSEDYYDMDV

SEQ ID NO: 12787 - protein, 9 aa, Homo sapiens
  Light chain CDR3 for antibody 6394 (IGKV1-16)
QHYNDYPFT

SEQ ID NO: 12788 - protein, 18 aa, Homo sapiens
  Heavy chain CDR3 for antibody 6394 (IGHV1-46)
ARDGDYVWGSYRSDWFDP

SEQ ID NO: 12789 - protein, 8 aa, Homo sapiens
  Light chain CDR3 for antibody 6395 (IGKV3D-7)
QQDYNLVT

SEQ ID NO: 12790 - protein, 16 aa, Homo sapiens
  Heavy chain CDR3 for antibody 6395 (IGHV4-39)
ARDTPYYSGSGRPFDY

SEQ ID NO: 12791 - protein, 10 aa, Homo sapiens
  Light chain CDR3 for antibody 6396 (IGKV1-39)
QQSYSTPMYT

SEQ ID NO: 12792 - protein, 17 aa, Homo sapiens
  Heavy chain CDR3 for antibody 6396 (IGHV3-33)
ARGEQWLGYYYYYGMDV

SEQ ID NO: 12793 - protein, 9 aa, Homo sapiens
  Light chain CDR3 for antibody 6397 (IGKV3D-20)
QQYGYSPRT

SEQ ID NO: 12794 - protein, 17 aa, Homo sapiens
  Heavy chain CDR3 for antibody 6397 (IGHV3-33)
ARGEQWLGYYYYYGMDV

SEQ ID NO: 12795 - protein, 8 aa, Homo sapiens
  Light chain CDR3 for antibody 6398 (IGKV3-11)
QQRSNWLT

SEQ ID NO: 12796 - protein, 14 aa, Homo sapiens
  Heavy chain CDR3 for antibody 6398 (IGHV1-18)
ARCFGSGSYGWFDP

SEQ ID NO: 12797 - protein, 9 aa, Homo sapiens
  Light chain CDR3 for antibody 6399 (IGKV1-9)
QQLKSYPYT

SEQ ID NO: 12798 - protein, 13 aa, Homo sapiens
  Heavy chain CDR3 for antibody 6399 (IGHV1-46)
ARGGGVRGAPLDY

SEQ ID NO: 12799 - protein, 9 aa, Homo sapiens
  Light chain CDR3 for antibody 6400 (IGKV3-20)
QQYGTSPFP

SEQ ID NO: 12800 - protein, 13 aa, Homo sapiens
  Heavy chain CDR3 for antibody 6400 (IGHV3-33)
ARTDYYFYYGLDV

SEQ ID NO: 12801 - protein, 8 aa, Homo sapiens
  Light chain CDR3 for antibody 6401 (IGKV1D-13)
QQFNNYPT

SEQ ID NO: 12802 - protein, 16 aa, Homo sapiens
  Heavy chain CDR3 for antibody 6401 (IGHV1-24)
ATEDSSSTYYYYGLDV

SEQ ID NO: 12803 - protein, 9 aa, Homo sapiens
  Light chain CDR3 for antibody 6402 (IGKV1-39)
QQSYRTPLT

SEQ ID NO: 12804 - protein, 18 aa, Homo sapiens
  Heavy chain CDR3 for antibody 6402 (IGHV3-23)
AKVGDFFASGNYWDYFDY

SEQ ID NO: 12805 - protein, 9 aa, Homo sapiens
  Light chain CDR3 for antibody 6403 (IGKV2-30)
MQGTHWPLT

SEQ ID NO: 12806 - protein, 13 aa, Homo sapiens
  Heavy chain CDR3 for antibody 6403 (IGHV3-33)
ARIDYYSYYGMDV

SEQ ID NO: 12807 - protein, 10 aa, Homo sapiens
  Light chain CDR3 for antibody 6404 (IGKV3-20)
QQYGRSPPVT

SEQ ID NO: 12808 - protein, 18 aa, Homo sapiens
  Heavy chain CDR3 for antibody 6404 (IGHV3-23)
AKEGDYYSSGSYWGYFDL

SEQ ID NO: 12809 - protein, 8 aa, Homo sapiens
  Light chain CDR3 for antibody 6405 (IGKV3-20)
QQYGSSLT

SEQ ID NO: 12810 - protein, 13 aa, Homo sapiens
  Heavy chain CDR3 for antibody 6405 (IGHV3-23)
ARAITMVRGVIDY

SEQ ID NO: 12811 - protein, 9 aa, Homo sapiens
  Light chain CDR3 for antibody 6406 (IGKV3-15)
QQYNNWPLT

SEQ ID NO: 12812 - protein, 14 aa, Homo sapiens
  Heavy chain CDR3 for antibody 6406 (IGHV3-33)
VRDAMGAPTAWFDP

SEQ ID NO: 12813 - protein, 9 aa, Homo sapiens
  Light chain CDR3 for antibody 6407 (IGKV2D-24)
TQATQFPHT

SEQ ID NO: 12814 - protein, 13 aa, Homo sapiens
  Heavy chain CDR3 for antibody 6407 (IGHV4-34)
ASNFYYYYYGMDV

SEQ ID NO: 12815 - protein, 8 aa, Homo sapiens
  Light chain CDR3 for antibody 6408 (IGKV3-11)
QQRSNWLT

SEQ ID NO: 12816 - protein, 12 aa, Homo sapiens
  Heavy chain CDR3 for antibody 6408 (IGHV1-46)
AREDYDIDGMDV

SEQ ID NO: 12817 - protein, 9 aa, Homo sapiens
  Light chain CDR3 for antibody 6409 (IGKV3D-7)
QQDYNLPFT

SEQ ID NO: 12818 - protein, 18 aa, Homo sapiens
  Heavy chain CDR3 for antibody 6409 (IGHV3-33)
ARGGVLYDILTGFYGMDV

SEQ ID NO: 12819 - protein, 9 aa, Homo sapiens
  Light chain CDR3 for antibody 6410 (IGKV1-9)
QQLNSYPLT

SEQ ID NO: 12820 - protein, 19 aa, Homo sapiens
  Heavy chain CDR3 for antibody 6410 (IGHV3-33)
ARDNDSSGYYDYYYYGMDV

SEQ ID NO: 12821 - protein, 9 aa, Homo sapiens
  Light chain CDR3 for antibody 6411 (IGKV4-1)
QQYYSTPWT

SEQ ID NO: 12822 - protein, 12 aa, Homo sapiens
  Heavy chain CDR3 for antibody 6411 (IGHV3-33)
AREGDILTGYSL

SEQ ID NO: 12823 - protein, 8 aa, Homo sapiens
  Light chain CDR3 for antibody 6412 (IGKV3D-7)
QQDYNLLT

SEQ ID NO: 12824 - protein, 16 aa, Homo sapiens
  Heavy chain CDR3 for antibody 6412 (IGHV3-23)
AKEGEVLRYFDWLFNY

SEQ ID NO: 12825 - protein, 9 aa, Homo sapiens
  Light chain CDR3 for antibody 6413 (IGKV3-11)
QHRGNWPLT

SEQ ID NO: 12826 - protein, 13 aa, Homo sapiens
  Heavy chain CDR3 for antibody 6413 (IGHV4-34)
ASNFYYYYYGMDV

SEQ ID NO: 12827 - protein, 9 aa, Homo sapiens
  Light chain CDR3 for antibody 6414 (IGKV2D-28)
MQALQTPPT

SEQ ID NO: 12828 - protein, 20 aa, Homo sapiens
  Heavy chain CDR3 for antibody 6414 (IGHV3-20)
ARDLCSSTSCYGYYYYGMDV

SEQ ID NO: 12829 - protein, 9 aa, Homo sapiens
  Light chain CDR3 for antibody 6415 (IGKV1-17)
LQQNSYPWT

SEQ ID NO: 12830 - protein, 11 aa, Homo sapiens
  Heavy chain CDR3 for antibody 6415 (IGHV4-59)
ARSLRYAVCDY

SEQ ID NO: 12831 - protein, 8 aa, Homo sapiens
  Light chain CDR3 for antibody 6416 (IGKV3D-7)
QQDYNLLT

SEQ ID NO: 12832 - protein, 18 aa, Homo sapiens
  Heavy chain CDR3 for antibody 6416 (IGHV3-23)
ARYHLYFGSGFGSDGMDV

SEQ ID NO: 12833 - protein, 9 aa, Homo sapiens
  Light chain CDR3 for antibody 6417 (IGKV1-9)
QQLKSYLYT

SEQ ID NO: 12834 - protein, 20 aa, Homo sapiens
  Heavy chain CDR3 for antibody 6417 (IGHV3-23)
AKDREMAATSHYYYYYGMDV

SEQ ID NO: 12835 - protein, 8 aa, Homo sapiens
  Light chain CDR3 for antibody 6418 (IGKV3D-7)
QQDYNLLT

SEQ ID NO: 12836 - protein, 14 aa, Homo sapiens
  Heavy chain CDR3 for antibody 6418 (IGHV3-33)
AREDYYGPLNWFDP

SEQ ID NO: 12837 - protein, 9 aa, Homo sapiens
  Light chain CDR3 for antibody 6419 (IGKV3D-7)
QQDYNLPYT

SEQ ID NO: 12838 - protein, 17 aa, Homo sapiens
  Heavy chain CDR3 for antibody 6419 (IGHV3-74)
ARGDGDILTGYYEWFDP

SEQ ID NO: 12839 - protein, 8 aa, Homo sapiens
  Light chain CDR3 for antibody 6420 (IGKV3-15)
QQYNNYPT

SEQ ID NO: 12840 - protein, 13 aa, Homo sapiens
  Heavy chain CDR3 for antibody 6420 (IGHV3-33)
ARRATLVRGVFDP

SEQ ID NO: 12841 - protein, 8 aa, Homo sapiens
  Light chain CDR3 for antibody 6421 (IGKV6-21)
HQSSSLPT

SEQ ID NO: 12842 - protein, 15 aa, Homo sapiens
  Heavy chain CDR3 for antibody 6421 (IGHV3-33)
ARDRGWKAPGYGMDV

SEQ ID NO: 12843 - protein, 9 aa, Homo sapiens
  Light chain CDR3 for antibody 6422 (IGKV1D-16)
QQYDSYPYT

SEQ ID NO: 12844 - protein, 9 aa, Homo sapiens
  Heavy chain CDR3 for antibody 6422 (IGHV3-33)
ARDAVYFDY

SEQ ID NO: 12845 - protein, 9 aa, Homo sapiens
  Light chain CDR3 for antibody 6423 (IGKV1D-13)
QQFNNYPHT

SEQ ID NO: 12846 - protein, 12 aa, Homo sapiens
  Heavy chain CDR3 for antibody 6423 (IGHV3-33)
ARESGGSFGMDV

SEQ ID NO: 12847 - protein, 9 aa, Homo sapiens
  Light chain CDR3 for antibody 6424 (IGKV3-11)
QQRSSWPPT

SEQ ID NO: 12848 - protein, 13 aa, Homo sapiens
  Heavy chain CDR3 for antibody 6424 (IGHV4-34)
ASNFYYYYYGMDV

SEQ ID NO: 12849 - protein, 9 aa, Homo sapiens
  Light chain CDR3 for antibody 6425 (IGKV5-2)
LQHDNFPYT

SEQ ID NO: 12850 - protein, 16 aa, Homo sapiens
  Heavy chain CDR3 for antibody 6425 (IGHV3-33)
ARDAGYPNYDYYGMDV

SEQ ID NO: 12851 - protein, 9 aa, Homo sapiens
  Light chain CDR3 for antibody 6426 (IGKV1-9)
QQLKSYLYT

SEQ ID NO: 12852 - protein, 13 aa, Homo sapiens
  Heavy chain CDR3 for antibody 6426 (IGHV3-15)
ARAFTMVRGVIDY

SEQ ID NO: 12853 - protein, 10 aa, Homo sapiens
  Light chain CDR3 for antibody 6427 (IGKV3-20)
QQYGRSPPVT

SEQ ID NO: 12854 - protein, 10 aa, Homo sapiens
  Heavy chain CDR3 for antibody 6427 (IGHV3-23)
AKEQWLVLDY

SEQ ID NO: 12855 - protein, 10 aa, Homo sapiens
  Light chain CDR3 for antibody 6428 (IGKV3-11)
QQRSTWPTLI

SEQ ID NO: 12856 - protein, 13 aa, Homo sapiens
  Heavy chain CDR3 for antibody 6428 (IGHV3-33)
ARDYCGGDCYLDY

SEQ ID NO: 12857 - protein, 9 aa, Homo sapiens
  Light chain CDR3 for antibody 6429 (IGKV1-6)
LQDFHYPWT

SEQ ID NO: 12858 - protein, 20 aa, Homo sapiens
  Heavy chain CDR3 for antibody 6429 (IGHV3-20)
ARDLCSSTSCYGYYYYGMDV

SEQ ID NO: 12859 - protein, 10 aa, Homo sapiens
  Light chain CDR3 for antibody 6430 (IGKV3-11)
QQRSNWPPFT

SEQ ID NO: 12860 - protein, 16 aa, Homo sapiens
  Heavy chain CDR3 for antibody 6430 (IGHV3-20)
AREGYSSSWFDRNFDY

SEQ ID NO: 12861 - protein, 9 aa, Homo sapiens
  Light chain CDR3 for antibody 6431 (IGKV3-11)
QQRSNWQYT

SEQ ID NO: 12862 - protein, 17 aa, Homo sapiens
  Heavy chain CDR3 for antibody 6431 (IGHV4-59)
ARDFLVRGEGSYYGMDV

SEQ ID NO: 12863 - protein, 9 aa, Homo sapiens
  Light chain CDR3 for antibody 6432 (IGKV1-33)
QQYDNLPFT

SEQ ID NO: 12864 - protein, 20 aa, Homo sapiens
  Heavy chain CDR3 for antibody 6432 (IGHV3-20)
ARDLCSSTSCYGYYYYGMDV

SEQ ID NO: 12865 - protein, 9 aa, Homo sapiens
  Light chain CDR3 for antibody 6433 (IGKV1-9)
QQLNSYPRT

SEQ ID NO: 12866 - protein, 14 aa, Homo sapiens
  Heavy chain CDR3 for antibody 6433 (IGHV3-33)
ARDGIVRATDAFAI

SEQ ID NO: 12867 - protein, 11 aa, Homo sapiens
  Light chain CDR3 for antibody 6434 (IGKV3-11)
QQRSNWPPTWT

SEQ ID NO: 12868 - protein, 14 aa, Homo sapiens
  Heavy chain CDR3 for antibody 6434 (IGHV1-46)
ARRGIVGALDAFDI

SEQ ID NO: 12869 - protein, 9 aa, Homo sapiens
  Light chain CDR3 for antibody 6435 (IGKV1-16)
QQYNSYPYT

SEQ ID NO: 12870 - protein, 11 aa, Homo sapiens
  Heavy chain CDR3 for antibody 6435 (IGHV1-69)
ARDPAGRTFDI

SEQ ID NO: 12871 - protein, 9 aa, Homo sapiens
  Light chain CDR3 for antibody 6436 (IGKV1-9)
QQGNTYSRT

SEQ ID NO: 12872 - protein, 10 aa, Homo sapiens
  Heavy chain CDR3 for antibody 6436 (IGHV3-33)
ARENSTPLDY

SEQ ID NO: 12873 - protein, 9 aa, Homo sapiens
  Light chain CDR3 for antibody 6437 (IGKV5-2)
LQHDNFPWT

SEQ ID NO: 12874 - protein, 11 aa, Homo sapiens
  Heavy chain CDR3 for antibody 6437 (IGHV3-11)
ARASRGSYYDY

SEQ ID NO: 12875 - protein, 9 aa, Homo sapiens
  Light chain CDR3 for antibody 6438 (IGKV5-2)
LQHDNFPWT

SEQ ID NO: 12876 - protein, 14 aa, Homo sapiens
  Heavy chain CDR3 for antibody 6438 (IGHV1-18)
ARDQPTVPSGYFDY

SEQ ID NO: 12877 - protein, 9 aa, Homo sapiens
  Light chain CDR3 for antibody 6439 (IGKV1-17)
LQHNSYPIT

SEQ ID NO: 12878 - protein, 14 aa, Homo sapiens
  Heavy chain CDR3 for antibody 6439 (IGHV3-20)
ARDRGSSGHDAFDI

SEQ ID NO: 12879 - protein, 9 aa, Homo sapiens
  Light chain CDR3 for antibody 6440 (IGKV1-27)
QKYNSAPYT

SEQ ID NO: 12880 - protein, 17 aa, Homo sapiens
  Heavy chain CDR3 for antibody 6440 (IGHV3-23)
AKGDYYGSGSYSTFFDY

SEQ ID NO: 12881 - protein, 9 aa, Homo sapiens
  Light chain CDR3 for antibody 6441 (IGKV1D-13)
QRFNNYLYT

SEQ ID NO: 12882 - protein, 14 aa, Homo sapiens
  Heavy chain CDR3 for antibody 6441 (IGHV3-33)
AREGYSSNWYDFDY

SEQ ID NO: 12883 - protein, 9 aa, Homo sapiens
  Light chain CDR3 for antibody 6442 (IGKV3-11)
QQRSNWPPT

SEQ ID NO: 12884 - protein, 13 aa, Homo sapiens
  Heavy chain CDR3 for antibody 6442 (IGHV1-18)
ARSYYGSGSPFDY

SEQ ID NO: 12885 - protein, 9 aa, Homo sapiens
  Light chain CDR3 for antibody 6443 (IGKV3-15)
QQYHNWPYT

SEQ ID NO: 12886 - protein, 17 aa, Homo sapiens
  Heavy chain CDR3 for antibody 6443 (IGHV3-33)
ARVYYDILTGYSPAFDI

SEQ ID NO: 12887 - protein, 9 aa, Homo sapiens
  Light chain CDR3 for antibody 6444 (IGKV1-17)
LQHNSYPRT

SEQ ID NO: 12888 - protein, 18 aa, Homo sapiens
  Heavy chain CDR3 for antibody 6444 (IGHV1-46)
ARDGDYVWGSYRSDWFDP

SEQ ID NO: 12889 - protein, 9 aa, Homo sapiens
  Light chain CDR3 for antibody 6445 (IGKV2D-28)
MQVLQTPFT

SEQ ID NO: 12890 - protein, 20 aa, Homo sapiens
  Heavy chain CDR3 for antibody 6445 (IGHV1-f)
ATGLITFVRGVILTYRSFDY

SEQ ID NO: 12891 - protein, 8 aa, Homo sapiens
  Light chain CDR3 for antibody 6446 (IGKV3-15)
QQYNNYPT

SEQ ID NO: 12892 - protein, 14 aa, Homo sapiens
  Heavy chain CDR3 for antibody 6446 (IGHV3-33)
ARRGSPLRPSHLDV

SEQ ID NO: 12893 - protein, 9 aa, Homo sapiens
  Light chain CDR3 for antibody 6447 (IGKV1-5)
QQYNTYSRT

SEQ ID NO: 12894 - protein, 15 aa, Homo sapiens
  Heavy chain CDR3 for antibody 6447 (IGHV3-33)
ARDRGWKAPGYGMDV

SEQ ID NO: 12895 - protein, 8 aa, Homo sapiens
  Light chain CDR3 for antibody 6448 (IGKV1D-13)
QQFNNYPT

SEQ ID NO: 12896 - protein, 13 aa, Homo sapiens
  Heavy chain CDR3 for antibody 6448 (IGHV3-33)
ARDSSSWYHWFDP

SEQ ID NO: 12897 - protein, 8 aa, Homo sapiens
  Light chain CDR3 for antibody 6449 (IGKV3D-7)
QQDYNLLT

SEQ ID NO: 12898 - protein, 15 aa, Homo sapiens
  Heavy chain CDR3 for antibody 6449 (IGHV1-46)
ARGRFFDWLLSPFDY

SEQ ID NO: 12899 - protein, 9 aa, Homo sapiens
  Light chain CDR3 for antibody 6450 (IGKV1-16)
QHYNDYPFT

SEQ ID NO: 12900 - protein, 13 aa, Homo sapiens
  Heavy chain CDR3 for antibody 6450 (IGHV3-33)
ARRYRSGWYPFDY

SEQ ID NO: 12901 - protein, 9 aa, Homo sapiens
  Light chain CDR3 for antibody 6451 (IGKV5-2)
LQHDNFPYT

SEQ ID NO: 12902 - protein, 20 aa, Homo sapiens
  Heavy chain CDR3 for antibody 6451 (IGHV3-23)
AKDRETGTTSYHYYYYGMDV

SEQ ID NO: 12903 - protein, 9 aa, Homo sapiens
  Light chain CDR3 for antibody 6452 (IGKV5-2)
LQHDNFPWT

SEQ ID NO: 12904 - protein, 15 aa, Homo sapiens
  Heavy chain CDR3 for antibody 6452 (IGHV3-33)
AKGGTMVRGVIAFDY

SEQ ID NO: 12905 - protein, 8 aa, Homo sapiens
  Light chain CDR3 for antibody 6453 (IGKV1-5)
QQYNSYYT

SEQ ID NO: 12906 - protein, 15 aa, Homo sapiens
  Heavy chain CDR3 for antibody 6453 (IGHV4-59)
ARDLGHYYGSVSIDY

SEQ ID NO: 12907 - protein, 9 aa, Homo sapiens
  Light chain CDR3 for antibody 6454 (IGKV1-9)
QQYISYPLT

SEQ ID NO: 12908 - protein, 14 aa, Homo sapiens
  Heavy chain CDR3 for antibody 6454 (IGHV3-33)
AREGYSSGWDYFDH

SEQ ID NO: 12909 - protein, 9 aa, Homo sapiens
  Light chain CDR3 for antibody 6455 (IGKV1-9)
QQLISYPLT

SEQ ID NO: 12910 - protein, 9 aa, Homo sapiens
  Heavy chain CDR3 for antibody 6455 (IGHV1-8)
ARGRLDFDY

SEQ ID NO: 12911 - protein, 9 aa, Homo sapiens
  Light chain CDR3 for antibody 6456 (IGKV1-6)
LQDYKSPFT

SEQ ID NO: 12912 - protein, 11 aa, Homo sapiens
  Heavy chain CDR3 for antibody 6456 (IGHV3-33)
ARDKSSGWSDY

SEQ ID NO: 12913 - protein, 9 aa, Homo sapiens
  Light chain CDR3 for antibody 6457 (IGKV2-30)
MQGTHWPLT

SEQ ID NO: 12914 - protein, 11 aa, Homo sapiens
  Heavy chain CDR3 for antibody 6457 (IGHV4-59)
ARDGSWEPFDY

SEQ ID NO: 12915 - protein, 9 aa, Homo sapiens
  Light chain CDR3 for antibody 6458 (IGKV3-15)
QQYNNWPFT

SEQ ID NO: 12916 - protein, 12 aa, Homo sapiens
  Heavy chain CDR3 for antibody 6458 (IGHV3-33)
AREGTRWVYFDY

SEQ ID NO: 12917 - protein, 9 aa, Homo sapiens
  Light chain CDR3 for antibody 6459 (IGKV3D-7)
QQDYNLPLT

SEQ ID NO: 12918 - protein, 13 aa, Homo sapiens
  Heavy chain CDR3 for antibody 6459 (IGHV3-30)
AAPFMVRGDGMDV

SEQ ID NO: 12919 - protein, 9 aa, Homo sapiens
  Light chain CDR3 for antibody 6460 (IGKV5-2)
LQHDKFPYT

SEQ ID NO: 12920 - protein, 19 aa, Homo sapiens
  Heavy chain CDR3 for antibody 6460 (IGHV3-33)
ARGSDYDILTGYSSDAFDI

SEQ ID NO: 12921 - protein, 9 aa, Homo sapiens
  Light chain CDR3 for antibody 6461 (IGKV1-39)
QQSYSTPLT

SEQ ID NO: 12922 - protein, 17 aa, Homo sapiens
  Heavy chain CDR3 for antibody 6461 (IGHV1-24)
ATHYGSGSHYKGYGMDV

SEQ ID NO: 12923 - protein, 9 aa, Homo sapiens
  Light chain CDR3 for antibody 6462 (IGKV3D-20)
QQYDSYPWT

SEQ ID NO: 12924 - protein, 18 aa, Homo sapiens
  Heavy chain CDR3 for antibody 6462 (IGHV1-46)
ARDGDYVWGSYRSNWFDP

SEQ ID NO: 12925 - protein, 9 aa, Homo sapiens
  Light chain CDR3 for antibody 6463 (IGKV3-20)
QQYGSSPYT

SEQ ID NO: 12926 - protein, 12 aa, Homo sapiens
  Heavy chain CDR3 for antibody 6463 (IGHV3-13)
AIGTMVRGIPDY

SEQ ID NO: 12927 - protein, 9 aa, Homo sapiens
  Light chain CDR3 for antibody 6464 (IGKV3-20)
QQYGSSPYT

SEQ ID NO: 12928 - protein, 15 aa, Homo sapiens
  Heavy chain CDR3 for antibody 6464 (IGHV3-64)
ARDSHHDLLTGHYEY

SEQ ID NO: 12929 - protein, 9 aa, Homo sapiens
  Light chain CDR3 for antibody 6465 (IGKV3-15)
QQYNNWPLT

SEQ ID NO: 12930 - protein, 12 aa, Homo sapiens
  Heavy chain CDR3 for antibody 6465 (IGHV3-23)
AKEYDILTGYFH

SEQ ID NO: 12931 - protein, 9 aa, Homo sapiens
  Light chain CDR3 for antibody 6466 (IGKV1-39)
QQSYSTPYT

SEQ ID NO: 12932 - protein, 12 aa, Homo sapiens
  Heavy chain CDR3 for antibody 6466 (IGHV1-18)
AGVLFDGDYSDY

SEQ ID NO: 12933 - protein, 8 aa, Homo sapiens
  Light chain CDR3 for antibody 6467 (IGKV3-11)
QQRSNWLT

SEQ ID NO: 12934 - protein, 13 aa, Homo sapiens
  Heavy chain CDR3 for antibody 6467 (IGHV4-39)
ARQWPSGYWYFDL

SEQ ID NO: 12935 - protein, 9 aa, Homo sapiens
  Light chain CDR3 for antibody 6468 (IGKV1-17)
LQHNSYPYT

SEQ ID NO: 12936 - protein, 16 aa, Homo sapiens
  Heavy chain CDR3 for antibody 6468 (IGHV3-30)
ARDSSYYGSGYYGMDV

SEQ ID NO: 12937 - protein, 9 aa, Homo sapiens
  Light chain CDR3 for antibody 6469 (IGKV4-1)
QQYYSTPWT

SEQ ID NO: 12938 - protein, 16 aa, Homo sapiens
  Heavy chain CDR3 for antibody 6469 (IGHV3-30)
ARGGRSDWLYYYGMDV

SEQ ID NO: 12939 - protein, 11 aa, Homo sapiens
  Light chain CDR3 for antibody 6470 (IGKV3-11)
QQRSNWPPTWT

SEQ ID NO: 12940 - protein, 11 aa, Homo sapiens
  Heavy chain CDR3 for antibody 6470 (IGHV3-33)
ARGSGSYAFDS

SEQ ID NO: 12941 - protein, 8 aa, Homo sapiens
  Light chain CDR3 for antibody 6471 (IGKV1-5)
QQYNSYYT

SEQ ID NO: 12942 - protein, 11 aa, Homo sapiens
  Heavy chain CDR3 for antibody 6471 (IGHV3-33)
ARDRATATVDY

SEQ ID NO: 12943 - protein, 10 aa, Homo sapiens
  Light chain CDR3 for antibody 6472 (IGKV1-17)
LQHNSYPMYT

SEQ ID NO: 12944 - protein, 17 aa, Homo sapiens
  Heavy chain CDR3 for antibody 6472 (IGHV3-33)
ARGYCSRTSCYLYYFDY

SEQ ID NO: 12945 - protein, 9 aa, Homo sapiens
  Light chain CDR3 for antibody 6473 (IGKV3-15)
QQYNNWPLT

SEQ ID NO: 12946 - protein, 13 aa, Homo sapiens
  Heavy chain CDR3 for antibody 6473 (IGHV3-33)
ARGVLWFGELFDY

SEQ ID NO: 12947 - protein, 11 aa, Homo sapiens
  Light chain CDR3 for antibody 6474 (IGKV3-11)
QQRSNWPPTWT

SEQ ID NO: 12948 - protein, 18 aa, Homo sapiens
  Heavy chain CDR3 for antibody 6474 (IGHV3-23)
AKEGNYYGSGSYWGYFDP

SEQ ID NO: 12949 - protein, 9 aa, Homo sapiens
  Light chain CDR3 for antibody 6475 (IGKV1-9)
QQYNTYSRT

SEQ ID NO: 12950 - protein, 17 aa, Homo sapiens
  Heavy chain CDR3 for antibody 6475 (IGHV3-66)
ARVQYDILTGYSPYFDN

SEQ ID NO: 12951 - protein, 9 aa, Homo sapiens
  Light chain CDR3 for antibody 6476 (IGKV1-39)
QQYAGYPPT

SEQ ID NO: 12952 - protein, 13 aa, Homo sapiens
  Heavy chain CDR3 for antibody 6476 (IGHV4-59)
ARDAGYSSSWFDY

SEQ ID NO: 12953 - protein, 9 aa, Homo sapiens
  Light chain CDR3 for antibody 6477 (IGKV3-11)
QQRSNWPLT

SEQ ID NO: 12954 - protein, 17 aa, Homo sapiens
  Heavy chain CDR3 for antibody 6477 (IGHV3-33)
ARDLIGPLSSSWYPFDY

SEQ ID NO: 12955 - protein, 8 aa, Homo sapiens
  Light chain CDR3 for antibody 6478 (IGKV3-11)
LQRGNWPT

SEQ ID NO: 12956 - protein, 15 aa, Homo sapiens
  Heavy chain CDR3 for antibody 6478 (IGHV3-30)
ARGAMVRGVDYGMDV

SEQ ID NO: 12957 - protein, 9 aa, Homo sapiens
  Light chain CDR3 for antibody 6479 (IGKV1-6)
LQDYKSPFT

SEQ ID NO: 12958 - protein, 16 aa, Homo sapiens
  Heavy chain CDR3 for antibody 6479 (IGHV3-33)
ARGYDMLTGDYYGMDV

SEQ ID NO: 12959 - protein, 9 aa, Homo sapiens
  Light chain CDR3 for antibody 6480 (IGKV5-2)
LQHDNFPWT

SEQ ID NO: 12960 - protein, 16 aa, Homo sapiens
  Heavy chain CDR3 for antibody 6480 (IGHV4-39)
ARRGVLVVTAIPGFDY

SEQ ID NO: 12961 - protein, 9 aa, Homo sapiens
  Light chain CDR3 for antibody 6481 (IGKV2D-28)
MQALQTPPT

SEQ ID NO: 12962 - protein, 16 aa, Homo sapiens
  Heavy chain CDR3 for antibody 6481 (IGHV1-24)
ATEDSSSTYYYYGLDV

SEQ ID NO: 12963 - protein, 9 aa, Homo sapiens
  Light chain CDR3 for antibody 6482 (IGKV3-11)
QQRSNWPPT

SEQ ID NO: 12964 - protein, 19 aa, Homo sapiens
  Heavy chain CDR3 for antibody 6482 (IGHV3-33)
TRDPHYDILTGYAYYGMDV

SEQ ID NO: 12965 - protein, 9 aa, Homo sapiens
  Light chain CDR3 for antibody 6483 (IGKV2-30)
MQGTHWPLT

SEQ ID NO: 12966 - protein, 12 aa, Homo sapiens
  Heavy chain CDR3 for antibody 6483 (IGHV3-33)
ARKGYDMHEFDI

SEQ ID NO: 12967 - protein, 10 aa, Homo sapiens
  Light chain CDR3 for antibody 6484 (IGKV1-9)
QQLDSYPMYT

SEQ ID NO: 12968 - protein, 11 aa, Homo sapiens
  Heavy chain CDR3 for antibody 6484 (IGHV3-33)
ARDRVLTPFDY

SEQ ID NO: 12969 - protein, 9 aa, Homo sapiens
  Light chain CDR3 for antibody 6485 (IGKV1D-16)
QQYNSYPLT

SEQ ID NO: 12970 - protein, 12 aa, Homo sapiens
  Heavy chain CDR3 for antibody 6485 (IGHV3-11)
ARVLLWFGETDY

SEQ ID NO: 12971 - protein, 9 aa, Homo sapiens
  Light chain CDR3 for antibody 6486 (IGKV2-30)
MQGTHWPLT

SEQ ID NO: 12972 - protein, 14 aa, Homo sapiens
  Heavy chain CDR3 for antibody 6486 (IGHV3-11)
AKDRYRGYEGLFDY

SEQ ID NO: 12973 - protein, 8 aa, Homo sapiens
  Light chain CDR3 for antibody 6487 (IGKV3-11)
QQRSNWLT

SEQ ID NO: 12974 - protein, 9 aa, Homo sapiens
  Heavy chain CDR3 for antibody 6487 (IGHV1-8)
ARGRLDFDY

SEQ ID NO: 12975 - protein, 10 aa, Homo sapiens
  Light chain CDR3 for antibody 6488 (IGKV3-15)
QQYNNWPPYT

SEQ ID NO: 12976 - protein, 13 aa, Homo sapiens
  Heavy chain CDR3 for antibody 6488 (IGHV3-33)
ARTDYYFYYGLDV

SEQ ID NO: 12977 - protein, 9 aa, Homo sapiens
  Light chain CDR3 for antibody 6489 (IGKV3-15)
QQYNNWPLT

SEQ ID NO: 12978 - protein, 17 aa, Homo sapiens
  Heavy chain CDR3 for antibody 6489 (IGHV3-33)
ARGFSGYDGYYYYGMDV

SEQ ID NO: 12979 - protein, 9 aa, Homo sapiens
  Light chain CDR3 for antibody 6490 (IGKV2-30)
MQGTHWPLT

SEQ ID NO: 12980 - protein, 17 aa, Homo sapiens
  Heavy chain CDR3 for antibody 6490 (IGHV4-39)
AGRLTYYYGSGSPSFDY

SEQ ID NO: 12981 - protein, 9 aa, Homo sapiens
  Light chain CDR3 for antibody 6491 (IGKV1-39)
QQSYSTPFT

SEQ ID NO: 12982 - protein, 16 aa, Homo sapiens
  Heavy chain CDR3 for antibody 6491 (IGHV3-33)
ARGYDMLTGDYHGMDV

SEQ ID NO: 12983 - protein, 9 aa, Homo sapiens
  Light chain CDR3 for antibody 6492 (IGKV1D-13)
QQFNNYPHT

SEQ ID NO: 12984 - protein, 15 aa, Homo sapiens
  Heavy chain CDR3 for antibody 6492 (IGHV3-23)
AKDRYFDWLSDAFDI

SEQ ID NO: 12985 - protein, 9 aa, Homo sapiens
  Light chain CDR3 for antibody 6493 (IGKV1-39)
QQSYSTPLT

SEQ ID NO: 12986 - protein, 12 aa, Homo sapiens
  Heavy chain CDR3 for antibody 6493 (IGHV3-33)
ARAGMGAPYFDY

SEQ ID NO: 12987 - protein, 8 aa, Homo sapiens
  Light chain CDR3 for antibody 6494 (IGKV3D-7)
QQDYNLVT

SEQ ID NO: 12988 - protein, 15 aa, Homo sapiens
  Heavy chain CDR3 for antibody 6494 (IGHV4-39)
ARHSKYSSGWYPFDY

SEQ ID NO: 12989 - protein, 9 aa, Homo sapiens
  Light chain CDR3 for antibody 6495 (IGKV4-1)
QQYYSTPPT

SEQ ID NO: 12990 - protein, 11 aa, Homo sapiens
  Heavy chain CDR3 for antibody 6495 (IGHV3-33)
ARDKSSGWSDY

SEQ ID NO: 12991 - protein, 10 aa, Homo sapiens
  Light chain CDR3 for antibody 6496 (IGKV1-17)
LQHNSYPMYT

SEQ ID NO: 12992 - protein, 17 aa, Homo sapiens
  Heavy chain CDR3 for antibody 6496 (IGHV3-33)
ARDLIGPLSSSWYPFDY

SEQ ID NO: 12993 - protein, 9 aa, Homo sapiens
  Light chain CDR3 for antibody 6497 (IGKV2D-28)
MQALQTPWT

SEQ ID NO: 12994 - protein, 15 aa, Homo sapiens
  Heavy chain CDR3 for antibody 6497 (IGHV3-23)
AKDGSYYDYYYGMDV

SEQ ID NO: 12995 - protein, 9 aa, Homo sapiens
  Light chain CDR3 for antibody 6498 (IGKV1-9)
QQLISYPLT

SEQ ID NO: 12996 - protein, 15 aa, Homo sapiens
  Heavy chain CDR3 for antibody 6498 (IGHV3-33)
ARKRLYDILTGYLDY

SEQ ID NO: 12997 - protein, 9 aa, Homo sapiens
  Light chain CDR3 for antibody 6499 (IGKV1-17)
LQHNSFPLT

SEQ ID NO: 12998 - protein, 16 aa, Homo sapiens
  Heavy chain CDR3 for antibody 6499 (IGHV4-59)
ARGRYFDWLLGDVFDI

SEQ ID NO: 12999 - protein, 9 aa, Homo sapiens
  Light chain CDR3 for antibody 6500 (IGKV1D-13)
QQFNNYPHT

SEQ ID NO: 13000 - protein, 13 aa, Homo sapiens
  Heavy chain CDR3 for antibody 6500 (IGHV3-33)
ASGYSGYDWYFDL

SEQ ID NO: 13001 - protein, 10 aa, Homo sapiens
  Light chain CDR3 for antibody 6501 (IGKV3-11)
QQRSNWPIFT

SEQ ID NO: 13002 - protein, 14 aa, Homo sapiens
  Heavy chain CDR3 for antibody 6501 (IGHV3-20)
ARDEGSGGYDVFDI

SEQ ID NO: 13003 - protein, 9 aa, Homo sapiens
  Light chain CDR3 for antibody 6502 (IGKV2-30)
MQGTHWPLT

SEQ ID NO: 13004 - protein, 14 aa, Homo sapiens
  Heavy chain CDR3 for antibody 6502 (IGHV3-33)
ARDRRDFYYYGMDV

SEQ ID NO: 13005 - protein, 9 aa, Homo sapiens
  Light chain CDR3 for antibody 6503 (IGKV3D-7)
QQDYNLPYT

SEQ ID NO: 13006 - protein, 12 aa, Homo sapiens
  Heavy chain CDR3 for antibody 6503 (IGHV4-61)
ARVYSSGWLFDY

SEQ ID NO: 13007 - protein, 9 aa, Homo sapiens
  Light chain CDR3 for antibody 6504 (IGKV1D-16)
LQDYNHPFT

SEQ ID NO: 13008 - protein, 13 aa, Homo sapiens
  Heavy chain CDR3 for antibody 6504 (IGHV3-23)
ASTFNWNDGFFDY

SEQ ID NO: 13009 - protein, 8 aa, Homo sapiens
  Light chain CDR3 for antibody 6505 (IGKV3D-7)
QQDYNLLT

SEQ ID NO: 13010 - protein, 19 aa, Homo sapiens
  Heavy chain CDR3 for antibody 6505 (IGHV4-39)
ARQGDVLRYFDWLLGAFDI

SEQ ID NO: 13011 - protein, 9 aa, Homo sapiens
  Light chain CDR3 for antibody 6506 (IGKV3-11)
QQRSSWPPT

SEQ ID NO: 13012 - protein, 12 aa, Homo sapiens
  Heavy chain CDR3 for antibody 6506 (IGHV3-23)
AKDGWFGESLDY

SEQ ID NO: 13013 - protein, 9 aa, Homo sapiens
  Light chain CDR3 for antibody 6507 (IGKV1-17)
LQHNSYPYT

SEQ ID NO: 13014 - protein, 5 aa, Homo sapiens
  Heavy chain CDR3 for antibody 6507 (IGHV3-33)
AREDY

SEQ ID NO: 13015 - protein, 9 aa, Homo sapiens
  Light chain CDR3 for antibody 6508 (IGKV1-17)
LQHNSYPWT

SEQ ID NO: 13016 - protein, 13 aa, Homo sapiens
  Heavy chain CDR3 for antibody 6508 (IGHV3-33)
TGRIAVAGAEGDY

SEQ ID NO: 13017 - protein, 8 aa, Homo sapiens
  Light chain CDR3 for antibody 6509 (IGKV3-11)
LQRGNWPT

SEQ ID NO: 13018 - protein, 16 aa, Homo sapiens
  Heavy chain CDR3 for antibody 6509 (IGHV4-59)
ARGRYFEWLLGDVFDI

SEQ ID NO: 13019 - protein, 9 aa, Homo sapiens
  Light chain CDR3 for antibody 6510 (IGKV1-6)
LQDYKSPFT

SEQ ID NO: 13020 - protein, 17 aa, Homo sapiens
  Heavy chain CDR3 for antibody 6510 (IGHV1-18)
ARDEGYDILTGYPHFDY

SEQ ID NO: 13021 - protein, 9 aa, Homo sapiens
  Light chain CDR3 for antibody 6511 (IGKV1D-13)
QQFNNYPFT

SEQ ID NO: 13022 - protein, 16 aa, Homo sapiens
  Heavy chain CDR3 for antibody 6511 (IGHV4-59)
ARGRGYYGSGSPYFDY

SEQ ID NO: 13023 - protein, 9 aa, Homo sapiens
  Light chain CDR3 for antibody 6512 (IGKV1-6)
LQDYKSPFT

SEQ ID NO: 13024 - protein, 15 aa, Homo sapiens
  Heavy chain CDR3 for antibody 6512 (IGHV3-20)
ARDRGSSGWRDWFDP

SEQ ID NO: 13025 - protein, 8 aa, Homo sapiens
  Light chain CDR3 for antibody 6513 (IGKV6-21)
HQSSSLPT

SEQ ID NO: 13026 - protein, 16 aa, Homo sapiens
  Heavy chain CDR3 for antibody 6513 (IGHV1-18)
ARGRYFEWLLGDVFDI

SEQ ID NO: 13027 - protein, 9 aa, Homo sapiens
  Light chain CDR3 for antibody 6514 (IGKV5-2)
LQHDKFPYT

SEQ ID NO: 13028 - protein, 12 aa, Homo sapiens
  Heavy chain CDR3 for antibody 6514 (IGHV3-33)
ASGYFGSGSAHY

SEQ ID NO: 13029 - protein, 10 aa, Homo sapiens
  Light chain CDR3 for antibody 6515 (IGKV3-15)
QQYNNWPPIT

SEQ ID NO: 13030 - protein, 13 aa, Homo sapiens
  Heavy chain CDR3 for antibody 6515 (IGHV3-33)
ANTGDSYYYDMDV

SEQ ID NO: 13031 - protein, 9 aa, Homo sapiens
  Light chain CDR3 for antibody 6516 (IGKV1D-13)
QQFNNYPHT

SEQ ID NO: 13032 - protein, 14 aa, Homo sapiens
  Heavy chain CDR3 for antibody 6516 (IGHV3-33)
ARDAYDILTGYYDY

SEQ ID NO: 13033 - protein, 11 aa, Homo sapiens
  Light chain CDR3 for antibody 6517 (IGKV3-11)
QQRSNWPPMYT

SEQ ID NO: 13034 - protein, 18 aa, Homo sapiens
  Heavy chain CDR3 for antibody 6517 (IGHV4-59)
AREGDYVWGSYRPNWFDP

SEQ ID NO: 13035 - protein, 8 aa, Homo sapiens
  Light chain CDR3 for antibody 6518 (IGKV1D-13)
QQFNNYPT

SEQ ID NO: 13036 - protein, 13 aa, Homo sapiens
  Heavy chain CDR3 for antibody 6518 (IGHV3-23)
AKDRGYSSTSTAY

SEQ ID NO: 13037 - protein, 8 aa, Homo sapiens
  Light chain CDR3 for antibody 6519 (IGKV3D-7)
QQDYNLLT

SEQ ID NO: 13038 - protein, 15 aa, Homo sapiens
  Heavy chain CDR3 for antibody 6519 (IGHV3-33)
ARDRGWKAPGYGMDV

SEQ ID NO: 13039 - protein, 9 aa, Homo sapiens
  Light chain CDR3 for antibody 6520 (IGKV1-9)
QQLISYPLT

SEQ ID NO: 13040 - protein, 8 aa, Homo sapiens
  Heavy chain CDR3 for antibody 6520 (IGHV3-23)
EKSAGEDV

SEQ ID NO: 13041 - protein, 9 aa, Homo sapiens
  Light chain CDR3 for antibody 6521 (IGKV5-2)
LQHDNFPYT

SEQ ID NO: 13042 - protein, 11 aa, Homo sapiens
  Heavy chain CDR3 for antibody 6521 (IGHV3-33)
ARDRGYSYFDY

SEQ ID NO: 13043 - protein, 9 aa, Homo sapiens
  Light chain CDR3 for antibody 6522 (IGKV1-9)
QQLNSYPWT

SEQ ID NO: 13044 - protein, 18 aa, Homo sapiens
  Heavy chain CDR3 for antibody 6522 (IGHV4-59)
AREGDYVWGSYRPNWFDP

SEQ ID NO: 13045 - protein, 9 aa, Homo sapiens
  Light chain CDR3 for antibody 6523 (IGKV1-9)
QQLNSYPLT

SEQ ID NO: 13046 - protein, 14 aa, Homo sapiens
  Heavy chain CDR3 for antibody 6523 (IGHV3-33)
ARGYGSGSYYSFDY

SEQ ID NO: 13047 - protein, 8 aa, Homo sapiens
  Light chain CDR3 for antibody 6524 (IGKV6-21)
HQSSSLPT

SEQ ID NO: 13048 - protein, 18 aa, Homo sapiens
  Heavy chain CDR3 for antibody 6524 (IGHV3-33)
ARREGIVGATTYYYGMDV

SEQ ID NO: 13049 - protein, 9 aa, Homo sapiens
  Light chain CDR3 for antibody 6525 (IGKV3-15)
QQYNNWPLT

SEQ ID NO: 13050 - protein, 8 aa, Homo sapiens
  Heavy chain CDR3 for antibody 6525 (IGHV3-33)
ARDRGFDY

SEQ ID NO: 13051 - protein, 9 aa, Homo sapiens
  Light chain CDR3 for antibody 6526 (IGKV1D-16)
QQYYSYPRT

SEQ ID NO: 13052 - protein, 12 aa, Homo sapiens
  Heavy chain CDR3 for antibody 6526 (IGHV1-46)
ARGLTGDYAFDI

SEQ ID NO: 13053 - protein, 9 aa, Homo sapiens
  Light chain CDR3 for antibody 6527 (IGKV1-39)
QQSYSTPFT

SEQ ID NO: 13054 - protein, 13 aa, Homo sapiens
  Heavy chain CDR3 for antibody 6527 (IGHV4-59)
ANRDYYGYYGMDV

SEQ ID NO: 13055 - protein, 9 aa, Homo sapiens
  Light chain CDR3 for antibody 6528 (IGKV1D-13)
QRFNNYLYT

SEQ ID NO: 13056 - protein, 11 aa, Homo sapiens
  Heavy chain CDR3 for antibody 6528 (IGHV3-33)
ARDRVLTPFDY

SEQ ID NO: 13057 - protein, 10 aa, Homo sapiens
  Light chain CDR3 for antibody 6529 (IGKV1-6)
LQDYNYPMYT

SEQ ID NO: 13058 - protein, 16 aa, Homo sapiens
  Heavy chain CDR3 for antibody 6529 (IGHV3-23)
AKEGMVLRYFDWLWDY

SEQ ID NO: 13059 - protein, 9 aa, Homo sapiens
  Light chain CDR3 for antibody 6530 (IGKV1-27)
QRFNNYLYT

SEQ ID NO: 13060 - protein, 17 aa, Homo sapiens
  Heavy chain CDR3 for antibody 6530 (IGHV1-18)
ARDEGYDILTGYPHFDY

SEQ ID NO: 13061 - protein, 9 aa, Homo sapiens
  Light chain CDR3 for antibody 6531 (IGKV6-21)
HQSSSLPFT

SEQ ID NO: 13062 - protein, 10 aa, Homo sapiens
  Heavy chain CDR3 for antibody 6531 (IGHV4-39)
ARQLGNWFDP

SEQ ID NO: 13063 - protein, 9 aa, Homo sapiens
  Light chain CDR3 for antibody 6532 (IGKV1-33)
QQYYNLPFT

SEQ ID NO: 13064 - protein, 15 aa, Homo sapiens
  Heavy chain CDR3 for antibody 6532 (IGHV3-33)
ARDGSGSYSLYGMDV

SEQ ID NO: 13065 - protein, 9 aa, Homo sapiens
  Light chain CDR3 for antibody 6533 (IGKV6-21)
HQSSSLPLT

SEQ ID NO: 13066 - protein, 16 aa, Homo sapiens
  Heavy chain CDR3 for antibody 6533 (IGHV3-33)
ARIAAPGSEYYYGMDV

SEQ ID NO: 13067 - protein, 8 aa, Homo sapiens
  Light chain CDR3 for antibody 6534 (IGKV3D-7)
QQDYNLLT

SEQ ID NO: 13068 - protein, 17 aa, Homo sapiens
  Heavy chain CDR3 for antibody 6534 (IGHV4-59)
ARDSYDILTGYYKPFDY

SEQ ID NO: 13069 - protein, 9 aa, Homo sapiens
  Light chain CDR3 for antibody 6535 (IGKV1-39)
QQSYRTPLT

SEQ ID NO: 13070 - protein, 14 aa, Homo sapiens
  Heavy chain CDR3 for antibody 6535 (IGHV3-33)
ARSTLVRGANWFDP

SEQ ID NO: 13071 - protein, 9 aa, Homo sapiens
  Light chain CDR3 for antibody 6536 (IGKV1-5)
QQYNTYSRT

SEQ ID NO: 13072 - protein, 8 aa, Homo sapiens
  Heavy chain CDR3 for antibody 6536 (IGHV3-23)
AKETGNNY

SEQ ID NO: 13073 - protein, 9 aa, Homo sapiens
  Light chain CDR3 for antibody 6537 (IGKV1-17)
LQHNSYPYT

SEQ ID NO: 13074 - protein, 18 aa, Homo sapiens
  Heavy chain CDR3 for antibody 6537 (IGHV3-11)
ARDGYFSGWNYYYFGMDV

SEQ ID NO: 13075 - protein, 10 aa, Homo sapiens
  Light chain CDR3 for antibody 6538 (IGKV3-11)
QQRSTWPTLT

SEQ ID NO: 13076 - protein, 12 aa, Homo sapiens
  Heavy chain CDR3 for antibody 6538 (IGHV3-33)
ARDLVGATPFDY

SEQ ID NO: 13077 - protein, 8 aa, Homo sapiens
  Light chain CDR3 for antibody 6539 (IGKV3-20)
QQYGSSLT

SEQ ID NO: 13078 - protein, 18 aa, Homo sapiens
  Heavy chain CDR3 for antibody 6539 (IGHV1-46)
ARDGDYVWGSYRSDWFDP

SEQ ID NO: 13079 - protein, 9 aa, Homo sapiens
  Light chain CDR3 for antibody 6540 (IGKV1-39)
QQSYRTPLT

SEQ ID NO: 13080 - protein, 14 aa, Homo sapiens
  Heavy chain CDR3 for antibody 6540 (IGHV4-39)
ARDSGYDYYYAMDV

SEQ ID NO: 13081 - protein, 9 aa, Homo sapiens
  Light chain CDR3 for antibody 6541 (IGKV1-6)
LQDFHYPWT

SEQ ID NO: 13082 - protein, 15 aa, Homo sapiens
  Heavy chain CDR3 for antibody 6541 (IGHV3-20)
ARDRGSSGWRDWFDP

SEQ ID NO: 13083 - protein, 9 aa, Homo sapiens
  Light chain CDR3 for antibody 6542 (IGKV2-30)
MQGTHWPLT

SEQ ID NO: 13084 - protein, 16 aa, Homo sapiens
  Heavy chain CDR3 for antibody 6542 (IGHV3-20)
AREGYSSSWFDRNFDY

SEQ ID NO: 13085 - protein, 10 aa, Homo sapiens
  Light chain CDR3 for antibody 6543 (IGKV3-15)
QQYNNWPPLT

SEQ ID NO: 13086 - protein, 8 aa, Homo sapiens
  Heavy chain CDR3 for antibody 6543 (IGHV3-23)
EKSAGEDV

SEQ ID NO: 13087 - protein, 8 aa, Homo sapiens
  Light chain CDR3 for antibody 6544 (IGKV1-5)
QQYNSYYT

SEQ ID NO: 13088 - protein, 12 aa, Homo sapiens
  Heavy chain CDR3 for antibody 6544 (IGHV4-39)
ARHGSGSSYFDY

SEQ ID NO: 13089 - protein, 10 aa, Homo sapiens
  Light chain CDR3 for antibody 6545 (IGKV3-20)
QQYGSSPPYT

SEQ ID NO: 13090 - protein, 18 aa, Homo sapiens
  Heavy chain CDR3 for antibody 6545 (IGHV3-23)
AKDRITGTTYGYYSGLDV

SEQ ID NO: 13091 - protein, 11 aa, Homo sapiens
  Light chain CDR3 for antibody 6546 (IGKV3-11)
QQRSNWPPTWT

SEQ ID NO: 13092 - protein, 18 aa, Homo sapiens
  Heavy chain CDR3 for antibody 6546 (IGHV1-46)
ARDLTGRTENYYYYGMDV

SEQ ID NO: 13093 - protein, 10 aa, Homo sapiens
  Light chain CDR3 for antibody 6547 (IGKV3-15)
QQYNNWPPYT

SEQ ID NO: 13094 - protein, 14 aa, Homo sapiens
  Heavy chain CDR3 for antibody 6547 (IGHV3-33)
VRDAMGATTAWFDP

SEQ ID NO: 13095 - protein, 10 aa, Homo sapiens
  Light chain CDR3 for antibody 6548 (IGKV3-11)
QQRSNWPTWT

SEQ ID NO: 13096 - protein, 15 aa, Homo sapiens
  Heavy chain CDR3 for antibody 6548 (IGHV3-33)
ARDRVVRGVMGYFDY

SEQ ID NO: 13097 - protein, 9 aa, Homo sapiens
  Light chain CDR3 for antibody 6549 (IGKV1-37)
QRTSNAPYT

SEQ ID NO: 13098 - protein, 13 aa, Homo sapiens
  Heavy chain CDR3 for antibody 6549 (IGHV3-33)
ARDYCGGDCYLDY

SEQ ID NO: 13099 - protein, 9 aa, Homo sapiens
  Light chain CDR3 for antibody 6550 (IGKV3-20)
QHYGSSPYT

SEQ ID NO: 13100 - protein, 16 aa, Homo sapiens
  Heavy chain CDR3 for antibody 6550 (IGHV3-20)
ARDSSSLDYYYYGMDV

SEQ ID NO: 13101 - protein, 8 aa, Homo sapiens
  Light chain CDR3 for antibody 6551 (IGKV1-5)
QQYNSYWT

SEQ ID NO: 13102 - protein, 11 aa, Homo sapiens
  Heavy chain CDR3 for antibody 6551 (IGHV3-33)
ARARYTTGLDY

SEQ ID NO: 13103 - protein, 9 aa, Homo sapiens
  Light chain CDR3 for antibody 6552 (IGKV1-9)
QQLNTYPWT

SEQ ID NO: 13104 - protein, 16 aa, Homo sapiens
  Heavy chain CDR3 for antibody 6552 (IGHV3-33)
ARDNFGSGSYYSHFHY

SEQ ID NO: 13105 - protein, 9 aa, Homo sapiens
  Light chain CDR3 for antibody 6553 (IGKV5-2)
LQHDNFPWT

SEQ ID NO: 13106 - protein, 9 aa, Homo sapiens
  Heavy chain CDR3 for antibody 6553 (IGHV3-30)
ARDDYGVDV

SEQ ID NO: 13107 - protein, 9 aa, Homo sapiens
  Light chain CDR3 for antibody 6554 (IGKV1-39)
QQSYSTPLT

SEQ ID NO: 13108 - protein, 12 aa, Homo sapiens
  Heavy chain CDR3 for antibody 6554 (IGHV3-21)
ARDGYSSRNFDY

SEQ ID NO: 13109 - protein, 9 aa, Homo sapiens
  Light chain CDR3 for antibody 6555 (IGKV3D-20)
QQYGSSPRT

SEQ ID NO: 13110 - protein, 18 aa, Homo sapiens
  Heavy chain CDR3 for antibody 6555 (IGHV3-23)
AKEGDYYGSGSSWGYFDP

SEQ ID NO: 13111 - protein, 9 aa, Homo sapiens
  Light chain CDR3 for antibody 6556 (IGKV1-27)
QKYNSAPYT

SEQ ID NO: 13112 - protein, 12 aa, Homo sapiens
  Heavy chain CDR3 for antibody 6556 (IGHV4-39)
ARQMVREGWFDP

SEQ ID NO: 13113 - protein, 9 aa, Homo sapiens
  Light chain CDR3 for antibody 6557 (IGKV1-39)
QQSYSTPLT

SEQ ID NO: 13114 - protein, 18 aa, Homo sapiens
  Heavy chain CDR3 for antibody 6557 (IGHV4-59)
ARDNHYYSSGTYSNWFDP

SEQ ID NO: 13115 - protein, 9 aa, Homo sapiens
  Light chain CDR3 for antibody 6558 (IGKV1-39)
QQSYRTPLT

SEQ ID NO: 13116 - protein, 10 aa, Homo sapiens
  Heavy chain CDR3 for antibody 6558 (IGHV3-23)
AKENWNDFDY

SEQ ID NO: 13117 - protein, 9 aa, Homo sapiens
  Light chain CDR3 for antibody 6559 (IGKV3-15)
QQYNNWPRT

SEQ ID NO: 13118 - protein, 12 aa, Homo sapiens
  Heavy chain CDR3 for antibody 6559 (IGHV3-33)
ARDSSGWSHFDY

SEQ ID NO: 13119 - protein, 10 aa, Homo sapiens
  Light chain CDR3 for antibody 6560 (IGKV1-39)
QQSYSTPMYT

SEQ ID NO: 13120 - protein, 12 aa, Homo sapiens
  Heavy chain CDR3 for antibody 6560 (IGHV3-33)
ARDGYSSRNFDY

SEQ ID NO: 13121 - protein, 8 aa, Homo sapiens
  Light chain CDR3 for antibody 6561 (IGKV3-15)
QQYNNWPT

SEQ ID NO: 13122 - protein, 17 aa, Homo sapiens
  Heavy chain CDR3 for antibody 6561 (IGHV4-59)
ARDFLVRGEGSYYGMDV

SEQ ID NO: 13123 - protein, 10 aa, Homo sapiens
  Light chain CDR3 for antibody 6562 (IGKV3-11)
QQRSNWPIFT

SEQ ID NO: 13124 - protein, 20 aa, Homo sapiens
  Heavy chain CDR3 for antibody 6562 (IGHV3-23)
AKDREMAATSHYYYYYGMDV

SEQ ID NO: 13125 - protein, 9 aa, Homo sapiens
  Light chain CDR3 for antibody 6563 (IGKV1-17)
LQHNSFPLT

SEQ ID NO: 13126 - protein, 14 aa, Homo sapiens
  Heavy chain CDR3 for antibody 6563 (IGHV3-33)
ARAISGSSYWYFDL

SEQ ID NO: 13127 - protein, 9 aa, Homo sapiens
  Light chain CDR3 for antibody 6564 (IGKV1D-16)
QQYSSYPYT

SEQ ID NO: 13128 - protein, 18 aa, Homo sapiens
  Heavy chain CDR3 for antibody 6564 (IGHV3-33)
ARGAYSSGWDYYYYGLDV

SEQ ID NO: 13129 - protein, 9 aa, Homo sapiens
  Light chain CDR3 for antibody 6565 (IGKV3-11)
QQRSSWPPT

SEQ ID NO: 13130 - protein, 17 aa, Homo sapiens
  Heavy chain CDR3 for antibody 6565 (IGHV3-23)
AKEYCSGGSCYVYYFDY

SEQ ID NO: 13131 - protein, 11 aa, Homo sapiens
  Light chain CDR3 for antibody 6566 (IGKV3-11)
QQRSNWPPTWT

SEQ ID NO: 13132 - protein, 15 aa, Homo sapiens
  Heavy chain CDR3 for antibody 6566 (IGHV4-39)
ARHSGYSSGWYPFDY

SEQ ID NO: 13133 - protein, 10 aa, Homo sapiens
  Light chain CDR3 for antibody 6567 (IGKV3-11)
QQRSNWPIFT

SEQ ID NO: 13134 - protein, 13 aa, Homo sapiens
  Heavy chain CDR3 for antibody 6567 (IGHV3-33)
ARIDYYSYYGMDV

SEQ ID NO: 13135 - protein, 9 aa, Homo sapiens
  Light chain CDR3 for antibody 6568 (IGKV1-39)
QQSYSSPFT

SEQ ID NO: 13136 - protein, 12 aa, Homo sapiens
  Heavy chain CDR3 for antibody 6568 (IGHV1-18)
ARILFYGDYFDY

SEQ ID NO: 13137 - protein, 8 aa, Homo sapiens
  Light chain CDR3 for antibody 6569 (IGKV3D-7)
QQDYNLVT

SEQ ID NO: 13138 - protein, 21 aa, Homo sapiens
  Heavy chain CDR3 for antibody 6569 (IGHV4-59)
AAGVLLWFGEPNYYYYYGMDV

SEQ ID NO: 13139 - protein, 9 aa, Homo sapiens
  Light chain CDR3 for antibody 6570 (IGKV1-27)
QKYNSAPYT

SEQ ID NO: 13140 - protein, 18 aa, Homo sapiens
  Heavy chain CDR3 for antibody 6570 (IGHV3-33)
AREGSYYGSGSFPNWFDP

SEQ ID NO: 13141 - protein, 8 aa, Homo sapiens
  Light chain CDR3 for antibody 6571 (IGKV3D-7)
QQDYNLLT

SEQ ID NO: 13142 - protein, 10 aa, Homo sapiens
  Heavy chain CDR3 for antibody 6571 (IGHV3-33)
ARDLGWSFDH

SEQ ID NO: 13143 - protein, 9 aa, Homo sapiens
  Light chain CDR3 for antibody 6572 (IGKV3D-20)
QQFGSLPLT

SEQ ID NO: 13144 - protein, 13 aa, Homo sapiens
  Heavy chain CDR3 for antibody 6572 (IGHV4-59)
ARDAGYSSSWFDY

SEQ ID NO: 13145 - protein, 11 aa, Homo sapiens
  Light chain CDR3 for antibody 6573 (IGKV3-11)
QQRSNWPPTWT

SEQ ID NO: 13146 - protein, 13 aa, Homo sapiens
  Heavy chain CDR3 for antibody 6573 (IGHV4-39)
ARRDGSYYGYFDY

SEQ ID NO: 13147 - protein, 9 aa, Homo sapiens
  Light chain CDR3 for antibody 6574 (IGKV3D-20)
QQYGYSPLT

SEQ ID NO: 13148 - protein, 17 aa, Homo sapiens
  Heavy chain CDR3 for antibody 6574 (IGHV1-24)
ATEGYDILPGYYNVLDY

SEQ ID NO: 13149 - protein, 9 aa, Homo sapiens
  Light chain CDR3 for antibody 6575 (IGKV2D-24)
TQATQFPHT

SEQ ID NO: 13150 - protein, 17 aa, Homo sapiens
  Heavy chain CDR3 for antibody 6575 (IGHV1-18)
ARERYYGSGIYKYAMDV

SEQ ID NO: 13151 - protein, 6 aa, Homo sapiens
  Light chain CDR3 for antibody 6576 (IGKV3-20)
QQYGST

SEQ ID NO: 13152 - protein, 12 aa, Homo sapiens
  Heavy chain CDR3 for antibody 6576 (IGHV1-18)
ARILFYGDYFDY

SEQ ID NO: 13153 - protein, 9 aa, Homo sapiens
  Light chain CDR3 for antibody 6577 (IGKV1-6)
LQDYNYPWT

SEQ ID NO: 13154 - protein, 12 aa, Homo sapiens
  Heavy chain CDR3 for antibody 6577 (IGHV1-46)
ARGLIGDHAVDI

SEQ ID NO: 13155 - protein, 11 aa, Homo sapiens
  Light chain CDR3 for antibody 6578 (IGKV3-11)
QQRSNWPPTWT

SEQ ID NO: 13156 - protein, 17 aa, Homo sapiens
  Heavy chain CDR3 for antibody 6578 (IGHV4-59)
ARDRELLWFGEFGGMDV

SEQ ID NO: 13157 - protein, 9 aa, Homo sapiens
  Light chain CDR3 for antibody 6579 (IGKV1-6)
LQDYNYPYT

SEQ ID NO: 13158 - protein, 8 aa, Homo sapiens
  Heavy chain CDR3 for antibody 6579 (IGHV4-4)
ARGARFDP

SEQ ID NO: 13159 - protein, 9 aa, Homo sapiens
  Light chain CDR3 for antibody 6580 (IGKV1D-13)
QQFNNYPYT

SEQ ID NO: 13160 - protein, 13 aa, Homo sapiens
  Heavy chain CDR3 for antibody 6580 (IGHV3-15)
TTDRLLLFGAFDY

SEQ ID NO: 13161 - protein, 9 aa, Homo sapiens
  Light chain CDR3 for antibody 6581 (IGKV3D-7)
QQDYNLPLT

SEQ ID NO: 13162 - protein, 17 aa, Homo sapiens
  Heavy chain CDR3 for antibody 6581 (IGHV1-8)
ARGDYYGSGSPYWYFDL

SEQ ID NO: 13163 - protein, 8 aa, Homo sapiens
  Light chain CDR3 for antibody 6582 (IGKV3D-7)
QQDYNLLT

SEQ ID NO: 13164 - protein, 11 aa, Homo sapiens
  Heavy chain CDR3 for antibody 6582 (IGHV3-33)
ARAGIAALFDY

SEQ ID NO: 13165 - protein, 9 aa, Homo sapiens
  Light chain CDR3 for antibody 6583 (IGKV1-33)
QQYDNLPFT

SEQ ID NO: 13166 - protein, 15 aa, Homo sapiens
  Heavy chain CDR3 for antibody 6583 (IGHV3-33)
ARRICSGGSCSLFDY

SEQ ID NO: 13167 - protein, 8 aa, Homo sapiens
  Light chain CDR3 for antibody 6584 (IGKV3-20)
QQYGRSFT

SEQ ID NO: 13168 - protein, 16 aa, Homo sapiens
  Heavy chain CDR3 for antibody 6584 (IGHV1-24)
ATEDSSSTYYYYGLDV

SEQ ID NO: 13169 - protein, 9 aa, Homo sapiens
  Light chain CDR3 for antibody 6585 (IGKV1-6)
LQDFHYPWT

SEQ ID NO: 13170 - protein, 9 aa, Homo sapiens
  Heavy chain CDR3 for antibody 6585 (IGHV3-13)
ARDHWYFDL

SEQ ID NO: 13171 - protein, 9 aa, Homo sapiens
  Light chain CDR3 for antibody 6586 (IGKV1-27)
QKYNSAPYT

SEQ ID NO: 13172 - protein, 14 aa, Homo sapiens
  Heavy chain CDR3 for antibody 6586 (IGHV3-20)
ARDGGSTSFDWFDP

SEQ ID NO: 13173 - protein, 10 aa, Homo sapiens
  Light chain CDR3 for antibody 6587 (IGKV3-11)
QQRSNWPIFT

SEQ ID NO: 13174 - protein, 14 aa, Homo sapiens
  Heavy chain CDR3 for antibody 6587 (IGHV4-39)
ARRGVVVPPGGMDV

SEQ ID NO: 13175 - protein, 9 aa, Homo sapiens
  Light chain CDR3 for antibody 6588 (IGKV1D-16)
QQYYSYPRT

SEQ ID NO: 13176 - protein, 13 aa, Homo sapiens
  Heavy chain CDR3 for antibody 6588 (IGHV3-33)
ARRYSSGWYPFDY

SEQ ID NO: 13177 - protein, 9 aa, Homo sapiens
  Light chain CDR3 for antibody 6589 (IGKV1-9)
QQLKSYLYT

SEQ ID NO: 13178 - protein, 14 aa, Homo sapiens
  Heavy chain CDR3 for antibody 6589 (IGHV3-33)
ARATSGSSYWYFDL

SEQ ID NO: 13179 - protein, 9 aa, Homo sapiens
  Light chain CDR3 for antibody 6590 (IGKV1-6)
LQDYKSPFT

SEQ ID NO: 13180 - protein, 9 aa, Homo sapiens
  Heavy chain CDR3 for antibody 6590 (IGHV1-18)
ARGKDWFDP

SEQ ID NO: 13181 - protein, 9 aa, Homo sapiens
  Light chain CDR3 for antibody 6591 (IGKV3D-7)
QQDYELPLT

SEQ ID NO: 13182 - protein, 22 aa, Homo sapiens
  Heavy chain CDR3 for antibody 6591 (IGHV4-59)
AREINYGSGSYYNEDYYYGMDV

SEQ ID NO: 13183 - protein, 8 aa, Homo sapiens
  Light chain CDR3 for antibody 6592 (IGKV1D-13)
QQFNNYPT

SEQ ID NO: 13184 - protein, 14 aa, Homo sapiens
  Heavy chain CDR3 for antibody 6592 (IGHV3-20)
ARDGGSTSFDWFDP

SEQ ID NO: 13185 - protein, 8 aa, Homo sapiens
  Light chain CDR3 for antibody 6593 (IGKV3-20)
QQYGSSLT

SEQ ID NO: 13186 - protein, 13 aa, Homo sapiens
  Heavy chain CDR3 for antibody 6593 (IGHV1-46)
ARVKLGSLGAFDI

SEQ ID NO: 13187 - protein, 8 aa, Homo sapiens
  Light chain CDR3 for antibody 6594 (IGKV1D-13)
QQYNNYPT

SEQ ID NO: 13188 - protein, 13 aa, Homo sapiens
  Heavy chain CDR3 for antibody 6594 (IGHV3-11)
ARDEGYRGYVLDT

SEQ ID NO: 13189 - protein, 9 aa, Homo sapiens
  Light chain CDR3 for antibody 6595 (IGKV1-17)
LQHNSYPPT

SEQ ID NO: 13190 - protein, 17 aa, Homo sapiens
  Heavy chain CDR3 for antibody 6595 (IGHV3-23)
SKERNWNDGYYYFGMDA

SEQ ID NO: 13191 - protein, 9 aa, Homo sapiens
  Light chain CDR3 for antibody 6596 (IGKV3-15)
QQYNNWPRT

SEQ ID NO: 13192 - protein, 13 aa, Homo sapiens
  Heavy chain CDR3 for antibody 6596 (IGHV3-23)
ASPFNWNDGFFDY

SEQ ID NO: 13193 - protein, 9 aa, Homo sapiens
  Light chain CDR3 for antibody 6597 (IGKV4-1)
QQYYTTPPT

SEQ ID NO: 13194 - protein, 12 aa, Homo sapiens
  Heavy chain CDR3 for antibody 6597 (IGHV3-33)
ARDLVGATPFDY

SEQ ID NO: 13195 - protein, 9 aa, Homo sapiens
  Light chain CDR3 for antibody 6598 (IGKV1-6)
LQDYNYPYT

SEQ ID NO: 13196 - protein, 18 aa, Homo sapiens
  Heavy chain CDR3 for antibody 6598 (IGHV1-18)
ARDRYSSGWSDYYFGMDV

SEQ ID NO: 13197 - protein, 9 aa, Homo sapiens
  Light chain CDR3 for antibody 6599 (IGKV1D-16)
QQYNNWPLT

SEQ ID NO: 13198 - protein, 13 aa, Homo sapiens
  Heavy chain CDR3 for antibody 6599 (IGHV4-39)
ARRGVVAPAAFDY

SEQ ID NO: 13199 - protein, 10 aa, Homo sapiens
  Light chain CDR3 for antibody 6600 (IGKV1-9)
QQLDSYPMYT

SEQ ID NO: 13200 - protein, 13 aa, Homo sapiens
  Heavy chain CDR3 for antibody 6600 (IGHV3-33)
ARDYCGGDCYLDY

SEQ ID NO: 13201 - protein, 9 aa, Homo sapiens
  Light chain CDR3 for antibody 6601 (IGKV3-11)
QQRSNWMYT

SEQ ID NO: 13202 - protein, 16 aa, Homo sapiens
  Heavy chain CDR3 for antibody 6601 (IGHV3-23)
AKDLRYFDWSLYAFDI

SEQ ID NO: 13203 - protein, 9 aa, Homo sapiens
  Light chain CDR3 for antibody 6602 (IGKV2-30)
MQGTHWPLT

SEQ ID NO: 13204 - protein, 23 aa, Homo sapiens
  Heavy chain CDR3 for antibody 6602 (IGHV3-11)
ARDEGVTMVRGVISYYYYYGMDV

SEQ ID NO: 13205 - protein, 10 aa, Homo sapiens
  Light chain CDR3 for antibody 6603 (IGKV3-11)
QQRSNWPIFT

SEQ ID NO: 13206 - protein, 14 aa, Homo sapiens
  Heavy chain CDR3 for antibody 6603 (IGHV3-33)
ARDAYDILTGYYDY

SEQ ID NO: 13207 - protein, 9 aa, Homo sapiens
  Light chain CDR3 for antibody 6604 (IGKV1D-16)
QQYNSYPFT

SEQ ID NO: 13208 - protein, 16 aa, Homo sapiens
  Heavy chain CDR3 for antibody 6604 (IGHV4-39)
ARDTPCYSGSGRPFDY

SEQ ID NO: 13209 - protein, 9 aa, Homo sapiens
  Light chain CDR3 for antibody 6605 (IGKV1-6)
LQDYNYPRT

SEQ ID NO: 13210 - protein, 11 aa, Homo sapiens
  Heavy chain CDR3 for antibody 6605 (IGHV3-33)
ARGSGNYAFDY

SEQ ID NO: 13211 - protein, 9 aa, Homo sapiens
  Light chain CDR3 for antibody 6606 (IGKV3-11)
QQRSNWPYT

SEQ ID NO: 13212 - protein, 11 aa, Homo sapiens
  Heavy chain CDR3 for antibody 6606 (IGHV3-33)
ARDRATATVDY

SEQ ID NO: 13213 - protein, 9 aa, Homo sapiens
  Light chain CDR3 for antibody 6607 (IGKV2-30)
MQGTHWPLT

SEQ ID NO: 13214 - protein, 17 aa, Homo sapiens
  Heavy chain CDR3 for antibody 6607 (IGHV3-33)
ARCGYSSSWYDPYYFDY

SEQ ID NO: 13215 - protein, 9 aa, Homo sapiens
  Light chain CDR3 for antibody 6608 (IGKV1-27)
QKYNSAPYT

SEQ ID NO: 13216 - protein, 11 aa, Homo sapiens
  Heavy chain CDR3 for antibody 6608 (IGHV3-33)
ARASRGSYYDY

SEQ ID NO: 13217 - protein, 9 aa, Homo sapiens
  Light chain CDR3 for antibody 6609 (IGKV1-33)
QQYDNLPFT

SEQ ID NO: 13218 - protein, 18 aa, Homo sapiens
  Heavy chain CDR3 for antibody 6609 (IGHV3-33)
ARDRYYDILTGYYMGFDY

SEQ ID NO: 13219 - protein, 8 aa, Homo sapiens
  Light chain CDR3 for antibody 6610 (IGKV3-11)
QQRSNWLT

SEQ ID NO: 13220 - protein, 17 aa, Homo sapiens
  Heavy chain CDR3 for antibody 6610 (IGHV1-18)
ARERYYGSGIYKYAMDV

SEQ ID NO: 13221 - protein, 10 aa, Homo sapiens
  Light chain CDR3 for antibody 6611 (IGKV3-11)
QQRSNWPIFT

SEQ ID NO: 13222 - protein, 15 aa, Homo sapiens
  Heavy chain CDR3 for antibody 6611 (IGHV3-23)
AKDRDYDFLSGPFDY

SEQ ID NO: 13223 - protein, 9 aa, Homo sapiens
  Light chain CDR3 for antibody 6612 (IGKV3-20)
QQYGSSPRT

SEQ ID NO: 13224 - protein, 17 aa, Homo sapiens
  Heavy chain CDR3 for antibody 6612 (IGHV1-24)
ATEDSSSTYYYYYGMDV

SEQ ID NO: 13225 - protein, 8 aa, Homo sapiens
  Light chain CDR3 for antibody 6613 (IGKV6-21)
HQSSSLYT

SEQ ID NO: 13226 - protein, 12 aa, Homo sapiens
  Heavy chain CDR3 for antibody 6613 (IGHV1-46)
ARGLTGDHAVDI

SEQ ID NO: 13227 - protein, 9 aa, Homo sapiens
  Light chain CDR3 for antibody 6614 (IGKV1-17)
LQHNSYPWT

SEQ ID NO: 13228 - protein, 22 aa, Homo sapiens
  Heavy chain CDR3 for antibody 6614 (IGHV3-48)
ARDFPLYYDILTGYPYYHGMDV

SEQ ID NO: 13229 - protein, 9 aa, Homo sapiens
  Light chain CDR3 for antibody 6615 (IGKV1-33)
QQYDNLPFT

SEQ ID NO: 13230 - protein, 7 aa, Homo sapiens
  Heavy chain CDR3 for antibody 6615 (IGHV3-33)
ARELVDY

SEQ ID NO: 13231 - protein, 9 aa, Homo sapiens
  Light chain CDR3 for antibody 6616 (IGKV6-21)
HQSSSLPYT

SEQ ID NO: 13232 - protein, 15 aa, Homo sapiens
  Heavy chain CDR3 for antibody 6616 (IGHV3-23)
ARDALAVTGTGWFDP

SEQ ID NO: 13233 - protein, 10 aa, Homo sapiens
  Light chain CDR3 for antibody 6617 (IGKV3-11)
QQRSNWPIFT

SEQ ID NO: 13234 - protein, 10 aa, Homo sapiens
  Heavy chain CDR3 for antibody 6617 (IGHV3-64)
ARDGLESFDY

SEQ ID NO: 13235 - protein, 9 aa, Homo sapiens
  Light chain CDR3 for antibody 6618 (IGKV4-1)
QQYYSTPWT

SEQ ID NO: 13236 - protein, 13 aa, Homo sapiens
  Heavy chain CDR3 for antibody 6618 (IGHV3-33)
ARVDTMVRGVMAY

SEQ ID NO: 13237 - protein, 9 aa, Homo sapiens
  Light chain CDR3 for antibody 6619 (IGKV1D-16)
QQYNSYPPT

SEQ ID NO: 13238 - protein, 13 aa, Homo sapiens
  Heavy chain CDR3 for antibody 6619 (IGHV4-59)
ARDAGYSSGWFDY

SEQ ID NO: 13239 - protein, 10 aa, Homo sapiens
  Light chain CDR3 for antibody 6620 (IGKV1-39)
QQSYSTPMYT

SEQ ID NO: 13240 - protein, 14 aa, Homo sapiens
  Heavy chain CDR3 for antibody 6620 (IGHV3-33)
ARAGSGYDRDWFDP

SEQ ID NO: 13241 - protein, 9 aa, Homo sapiens
  Light chain CDR3 for antibody 6621 (IGKV2-30)
MQGTHWPLT

SEQ ID NO: 13242 - protein, 15 aa, Homo sapiens
  Heavy chain CDR3 for antibody 6621 (IGHV3-74)
ARGSGSHYHYYGMDV

SEQ ID NO: 13243 - protein, 9 aa, Homo sapiens
  Light chain CDR3 for antibody 6622 (IGKV5-2)
LQHDNFPYT

SEQ ID NO: 13244 - protein, 17 aa, Homo sapiens
  Heavy chain CDR3 for antibody 6622 (IGHV3-23)
AREGYYDILTDYYGMDV

SEQ ID NO: 13245 - protein, 8 aa, Homo sapiens
  Light chain CDR3 for antibody 6623 (IGKV1D-13)
QQFNNYPT

SEQ ID NO: 13246 - protein, 10 aa, Homo sapiens
  Heavy chain CDR3 for antibody 6623 (IGHV3-23)
AKEQWLVLDY

SEQ ID NO: 13247 - protein, 8 aa, Homo sapiens
  Light chain CDR3 for antibody 6624 (IGKV1D-13)
QQFNNYYT

SEQ ID NO: 13248 - protein, 15 aa, Homo sapiens
  Heavy chain CDR3 for antibody 6624 (IGHV3-33)
AKDRNSGYDWGGFDY

SEQ ID NO: 13249 - protein, 11 aa, Homo sapiens
  Light chain CDR3 for antibody 6625 (IGKV3-11)
QQRSNWPPTWT

SEQ ID NO: 13250 - protein, 13 aa, Homo sapiens
  Heavy chain CDR3 for antibody 6625 (IGHV3-33)
ASGYSGYDWYFDL

SEQ ID NO: 13251 - protein, 8 aa, Homo sapiens
  Light chain CDR3 for antibody 6626 (IGKV1-5)
QQYNSYWT

SEQ ID NO: 13252 - protein, 20 aa, Homo sapiens
  Heavy chain CDR3 for antibody 6626 (IGHV3-33)
SRGGATLVRGVIDYYYGMDV

SEQ ID NO: 13253 - protein, 10 aa, Homo sapiens
  Light chain CDR3 for antibody 6627 (IGKV3-11)
QQRSNWPIFT

SEQ ID NO: 13254 - protein, 16 aa, Homo sapiens
  Heavy chain CDR3 for antibody 6627 (IGHV3-33)
ARDNFGSGSYYSHFHY

SEQ ID NO: 13255 - protein, 9 aa, Homo sapiens
  Light chain CDR3 for antibody 6628 (IGKV3D-7)
QQDYNLPYT

SEQ ID NO: 13256 - protein, 10 aa, Homo sapiens
  Heavy chain CDR3 for antibody 6628 (IGHV3-74)
ARDGSGSYPI

SEQ ID NO: 13257 - protein, 10 aa, Homo sapiens
  Light chain CDR3 for antibody 6629 (IGKV3-11)
QQRSNWPMYT

SEQ ID NO: 13258 - protein, 12 aa, Homo sapiens
  Heavy chain CDR3 for antibody 6629 (IGHV3-33)
AREKGGSYSFDY

SEQ ID NO: 13259 - protein, 9 aa, Homo sapiens
  Light chain CDR3 for antibody 6630 (IGKV1-9)
QQVKSYPYT

SEQ ID NO: 13260 - protein, 11 aa, Homo sapiens
  Heavy chain CDR3 for antibody 6630 (IGHV4-59)
ARSLRYSFFDY

SEQ ID NO: 13261 - protein, 9 aa, Homo sapiens
  Light chain CDR3 for antibody 6631 (IGKV1-6)
LQDYNYPYT

SEQ ID NO: 13262 - protein, 14 aa, Homo sapiens
  Heavy chain CDR3 for antibody 6631 (IGHV4-59)
AREGHYYGSVSIDY

SEQ ID NO: 13263 - protein, 9 aa, Homo sapiens
  Light chain CDR3 for antibody 6632 (IGKV1-39)
QQSYRTPLT

SEQ ID NO: 13264 - protein, 11 aa, Homo sapiens
  Heavy chain CDR3 for antibody 6632 (IGHV3-23)
AKAGIVGCLDV

SEQ ID NO: 13265 - protein, 9 aa, Homo sapiens
  Light chain CDR3 for antibody 6633 (IGKV1D-13)
QQFNNYPHT

SEQ ID NO: 13266 - protein, 18 aa, Homo sapiens
  Heavy chain CDR3 for antibody 6633 (IGHV3-33)
ARRTAAGTGDYYYYGMDV

SEQ ID NO: 13267 - protein, 9 aa, Homo sapiens
  Light chain CDR3 for antibody 6634 (IGKV1-27)
QKYNSAPYT

SEQ ID NO: 13268 - protein, 17 aa, Homo sapiens
  Heavy chain CDR3 for antibody 6634 (IGHV3-33)
TRDSGMVRGIIIYGMDV

SEQ ID NO: 13269 - protein, 9 aa, Homo sapiens
  Light chain CDR3 for antibody 6635 (IGKV1-9)
QQLNSYPPL

SEQ ID NO: 13270 - protein, 11 aa, Homo sapiens
  Heavy chain CDR3 for antibody 6635 (IGHV3-53)
ARDLGPRGIDY

SEQ ID NO: 13271 - protein, 9 aa, Homo sapiens
  Light chain CDR3 for antibody 6636 (IGKV1-9)
QQLISYPLT

SEQ ID NO: 13272 - protein, 18 aa, Homo sapiens
  Heavy chain CDR3 for antibody 6636 (IGHV1-46)
ARDGDYVWGSYRSDWFDP

SEQ ID NO: 13273 - protein, 9 aa, Homo sapiens
  Light chain CDR3 for antibody 6637 (IGKV3-15)
QQYNNWPRT

SEQ ID NO: 13274 - protein, 13 aa, Homo sapiens
  Heavy chain CDR3 for antibody 6637 (IGHV1-18)
ARSITMVRGVIGY

SEQ ID NO: 13275 - protein, 9 aa, Homo sapiens
  Light chain CDR3 for antibody 6638 (IGKV1-16)
QHYNDYPFT

SEQ ID NO: 13276 - protein, 9 aa, Homo sapiens
  Heavy chain CDR3 for antibody 6638 (IGHV3-30)
ARDNWGFDY

SEQ ID NO: 13277 - protein, 9 aa, Homo sapiens
  Light chain CDR3 for antibody 6639 (IGKV1-27)
QKYNSAPYT

SEQ ID NO: 13278 - protein, 19 aa, Homo sapiens
  Heavy chain CDR3 for antibody 6639 (IGHV3-33)
AREDYYGSGSYYNEDWFDP

SEQ ID NO: 13279 - protein, 9 aa, Homo sapiens
  Light chain CDR3 for antibody 6640 (IGKV3-11)
QQRINWPWT

SEQ ID NO: 13280 - protein, 17 aa, Homo sapiens
  Heavy chain CDR3 for antibody 6640 (IGHV4-39)
ARQGWYYGSGSSLLFDY

SEQ ID NO: 13281 - protein, 9 aa, Homo sapiens
  Light chain CDR3 for antibody 6641 (IGKV1-16)
QQYNRYPYT

SEQ ID NO: 13282 - protein, 9 aa, Homo sapiens
  Heavy chain CDR3 for antibody 6641 (IGHV4-59)
ARGGASFDY

SEQ ID NO: 13283 - protein, 9 aa, Homo sapiens
  Light chain CDR3 for antibody 6642 (IGKV5-2)
LQHDKFPYT

SEQ ID NO: 13284 - protein, 14 aa, Homo sapiens
  Heavy chain CDR3 for antibody 6642 (IGHV3-33)
ARTTAAAGPRDFRH

SEQ ID NO: 13285 - protein, 9 aa, Homo sapiens
  Light chain CDR3 for antibody 6643 (IGKV1-17)
QQYNSYPFT

SEQ ID NO: 13286 - protein, 13 aa, Homo sapiens
  Heavy chain CDR3 for antibody 6643 (IGHV4-34)
ASNFYDYYYGMDV

SEQ ID NO: 13287 - protein, 9 aa, Homo sapiens
  Light chain CDR3 for antibody 6644 (IGKV1-39)
QQSYSTPLT

SEQ ID NO: 13288 - protein, 14 aa, Homo sapiens
  Heavy chain CDR3 for antibody 6644 (IGHV3-20)
ARGGSSGWYDWFDP

SEQ ID NO: 13289 - protein, 9 aa, Homo sapiens
  Light chain CDR3 for antibody 6645 (IGKV1-9)
QQGNTYSRT

SEQ ID NO: 13290 - protein, 15 aa, Homo sapiens
  Heavy chain CDR3 for antibody 6645 (IGHV4-59)
ARDLGHYYGSVSIDY

SEQ ID NO: 13291 - protein, 9 aa, Homo sapiens
  Light chain CDR3 for antibody 6646 (IGKV1-17)
QQLKSYPYT

SEQ ID NO: 13292 - protein, 8 aa, Homo sapiens
  Heavy chain CDR3 for antibody 6646 (IGHV3-23)
AETFLFDY

SEQ ID NO: 13293 - protein, 10 aa, Homo sapiens
  Light chain CDR3 for antibody 6647 (IGKV1-6)
LQDYNYPMYT

SEQ ID NO: 13294 - protein, 13 aa, Homo sapiens
  Heavy chain CDR3 for antibody 6647 (IGHV3-33)
ARDYCGGDCYLDY

SEQ ID NO: 13295 - protein, 10 aa, Homo sapiens
  Light chain CDR3 for antibody 6648 (IGKV3-15)
QQYNNWPPYT

SEQ ID NO: 13296 - protein, 11 aa, Homo sapiens
  Heavy chain CDR3 for antibody 6648 (IGHV3-33)
AREAANWGFDY

SEQ ID NO: 13297 - protein, 8 aa, Homo sapiens
  Light chain CDR3 for antibody 6649 (IGKV3-15)
QQYNNWPT

SEQ ID NO: 13298 - protein, 12 aa, Homo sapiens
  Heavy chain CDR3 for antibody 6649 (IGHV3-33)
ARDPGYYYGLDV

SEQ ID NO: 13299 - protein, 9 aa, Homo sapiens
  Light chain CDR3 for antibody 6650 (IGKV2-30)
MQGTHWPLT

SEQ ID NO: 13300 - protein, 17 aa, Homo sapiens
  Heavy chain CDR3 for antibody 6650 (IGHV3-64)
ARERYYGSGSYYNWFDP

SEQ ID NO: 13301 - protein, 10 aa, Homo sapiens
  Light chain CDR3 for antibody 6651 (IGKV1-17)
LQHNSYPMYT

SEQ ID NO: 13302 - protein, 9 aa, Homo sapiens
  Heavy chain CDR3 for antibody 6651 (IGHV3-13)
ARDRWYFDL

SEQ ID NO: 13303 - protein, 9 aa, Homo sapiens
  Light chain CDR3 for antibody 6652 (IGKV1-9)
QQLNSYPYT

SEQ ID NO: 13304 - protein, 13 aa, Homo sapiens
  Heavy chain CDR3 for antibody 6652 (IGHV4-59)
ARGYYDIFGWFDP

SEQ ID NO: 13305 - protein, 9 aa, Homo sapiens
  Light chain CDR3 for antibody 6653 (IGKV6-21)
HQSSSLPLT

SEQ ID NO: 13306 - protein, 5 aa, Homo sapiens
  Heavy chain CDR3 for antibody 6653 (IGHV3-33)
ARDIL

SEQ ID NO: 13307 - protein, 8 aa, Homo sapiens
  Light chain CDR3 for antibody 6654 (IGKV3-11)
QQRSNWLT

SEQ ID NO: 13308 - protein, 13 aa, Homo sapiens
  Heavy chain CDR3 for antibody 6654 (IGHV1-46)
ARVKLGSLGAFDI

SEQ ID NO: 13309 - protein, 8 aa, Homo sapiens
  Light chain CDR3 for antibody 6655 (IGKV3D-7)
QQDYNLLT

SEQ ID NO: 13310 - protein, 17 aa, Homo sapiens
  Heavy chain CDR3 for antibody 6655 (IGHV4-39)
ARQGWYYGSGSSLLFDY

SEQ ID NO: 13311 - protein, 9 aa, Homo sapiens
  Light chain CDR3 for antibody 6656 (IGKV3D-7)
QQDYEFPIT

SEQ ID NO: 13312 - protein, 17 aa, Homo sapiens
  Heavy chain CDR3 for antibody 6656 (IGHV4-59)
ARDFLVRGEGSYYGMDV

SEQ ID NO: 13313 - protein, 9 aa, Homo sapiens
  Light chain CDR3 for antibody 6657 (IGKV1-6)
LQDYNYPWT

SEQ ID NO: 13314 - protein, 13 aa, Homo sapiens
  Heavy chain CDR3 for antibody 6657 (IGHV1-18)
ARVRITGTYAFDI

SEQ ID NO: 13315 - protein, 9 aa, Homo sapiens
  Light chain CDR3 for antibody 6658 (IGKV3-11)
QQRSNWPYT

SEQ ID NO: 13316 - protein, 12 aa, Homo sapiens
  Heavy chain CDR3 for antibody 6658 (IGHV3-33)
AKDPGWQQLAEY

SEQ ID NO: 13317 - protein, 9 aa, Homo sapiens
  Light chain CDR3 for antibody 6659 (IGKV1-17)
LQHNSYPPT

SEQ ID NO: 13318 - protein, 18 aa, Homo sapiens
  Heavy chain CDR3 for antibody 6659 (IGHV1-18)
ARDRGYYYGSGSYSPFDY

SEQ ID NO: 13319 - protein, 9 aa, Homo sapiens
  Light chain CDR3 for antibody 6660 (IGKV3-15)
QQYNNWPRT

SEQ ID NO: 13320 - protein, 18 aa, Homo sapiens
  Heavy chain CDR3 for antibody 6660 (IGHV3-33)
ARDRYYDILTGYYMGFDY

SEQ ID NO: 13321 - protein, 9 aa, Homo sapiens
  Light chain CDR3 for antibody 6661 (IGKV3-15)
QQYHNWPLT

SEQ ID NO: 13322 - protein, 17 aa, Homo sapiens
  Heavy chain CDR3 for antibody 6661 (IGHV3-33)
ARGEQWLGYYYYYGMDV

SEQ ID NO: 13323 - protein, 8 aa, Homo sapiens
  Light chain CDR3 for antibody 6662 (IGKV1D-13)
QQFNNYPT

SEQ ID NO: 13324 - protein, 14 aa, Homo sapiens
  Heavy chain CDR3 for antibody 6662 (IGHV3-33)
VRDAMGATTAWFDP

SEQ ID NO: 13325 - protein, 8 aa, Homo sapiens
  Light chain CDR3 for antibody 6663 (IGKV3-15)
QQYNNWPT

SEQ ID NO: 13326 - protein, 12 aa, Homo sapiens
  Heavy chain CDR3 for antibody 6663 (IGHV1-46)
ARGLTGDHAVDI

SEQ ID NO: 13327 - protein, 9 aa, Homo sapiens
  Light chain CDR3 for antibody 6664 (IGKV1-9)
QQLNSYPWT

SEQ ID NO: 13328 - protein, 15 aa, Homo sapiens
  Heavy chain CDR3 for antibody 6664 (IGHV3-33)
ARESRDPASYYGMDV

SEQ ID NO: 13329 - protein, 9 aa, Homo sapiens
  Light chain CDR3 for antibody 6665 (IGKV3-11)
QQRSNWPYT

SEQ ID NO: 13330 - protein, 12 aa, Homo sapiens
  Heavy chain CDR3 for antibody 6665 (IGHV3-33)
ARDGPVAGLFDY

SEQ ID NO: 13331 - protein, 9 aa, Homo sapiens
  Light chain CDR3 for antibody 6666 (IGKV1-6)
QQEYNYPLT

SEQ ID NO: 13332 - protein, 21 aa, Homo sapiens
  Heavy chain CDR3 for antibody 6666 (IGHV3-33)
ARKRLYDILTGYYKAYYGMDV

SEQ ID NO: 13333 - protein, 9 aa, Homo sapiens
  Light chain CDR3 for antibody 6667 (IGKV6-21)
HQSSSLPYT

SEQ ID NO: 13334 - protein, 12 aa, Homo sapiens
  Heavy chain CDR3 for antibody 6667 (IGHV1-18)
AGVLFDGDYSDY

SEQ ID NO: 13335 - protein, 9 aa, Homo sapiens
  Light chain CDR3 for antibody 6668 (IGKV1-17)
LQQNSYPYT

SEQ ID NO: 13336 - protein, 16 aa, Homo sapiens
  Heavy chain CDR3 for antibody 6668 (IGHV4-59)
AREPLRYFDWPDAFDI

SEQ ID NO: 13337 - protein, 9 aa, Homo sapiens
  Light chain CDR3 for antibody 6669 (IGKV3D-7)
QQDYEFPLT

SEQ ID NO: 13338 - protein, 13 aa, Homo sapiens
  Heavy chain CDR3 for antibody 6669 (IGHV4-39)
ARRDGSYYGYFGY

SEQ ID NO: 13339 - protein, 9 aa, Homo sapiens
  Light chain CDR3 for antibody 6670 (IGKV3-15)
QQYNNWPRT

SEQ ID NO: 13340 - protein, 13 aa, Homo sapiens
  Heavy chain CDR3 for antibody 6670 (IGHV3-33)
ARTDYYFYYGLDV

SEQ ID NO: 13341 - protein, 9 aa, Homo sapiens
  Light chain CDR3 for antibody 6671 (IGKV3D-20)
QQYGSSPLT

SEQ ID NO: 13342 - protein, 14 aa, Homo sapiens
  Heavy chain CDR3 for antibody 6671 (IGHV4-39)
ARHGYYGSSNWFDP

SEQ ID NO: 13343 - protein, 9 aa, Homo sapiens
  Light chain CDR3 for antibody 6672 (IGKV3-11)
QQRSNWPYT

SEQ ID NO: 13344 - protein, 16 aa, Homo sapiens
  Heavy chain CDR3 for antibody 6672 (IGHV4-59)
AGGSGSYRDYYYGMDV

SEQ ID NO: 13345 - protein, 9 aa, Homo sapiens
  Light chain CDR3 for antibody 6673 (IGKV3-11)
QQRINWPWT

SEQ ID NO: 13346 - protein, 17 aa, Homo sapiens
  Heavy chain CDR3 for antibody 6673 (IGHV4-34)
AGLRFFDWLFDYYGMDV

SEQ ID NO: 13347 - protein, 10 aa, Homo sapiens
  Light chain CDR3 for antibody 6674 (IGKV3-20)
QQYGRSPPVT

SEQ ID NO: 13348 - protein, 14 aa, Homo sapiens
  Heavy chain CDR3 for antibody 6674 (IGHV4-39)
ARQDYDILTGLFDY

SEQ ID NO: 13349 - protein, 9 aa, Homo sapiens
  Light chain CDR3 for antibody 6675 (IGKV3-20)
QQYGSSPLT

SEQ ID NO: 13350 - protein, 10 aa, Homo sapiens
  Heavy chain CDR3 for antibody 6675 (IGHV1-46)
AREWELLFDY

SEQ ID NO: 13351 - protein, 9 aa, Homo sapiens
  Light chain CDR3 for antibody 6676 (IGKV5-2)
LQHDKFPYT

SEQ ID NO: 13352 - protein, 15 aa, Homo sapiens
  Heavy chain CDR3 for antibody 6676 (IGHV3-64)
ARDSRPEITGPPFDY

SEQ ID NO: 13353 - protein, 9 aa, Homo sapiens
  Light chain CDR3 for antibody 6677 (IGKV1-17)
LQHNSYPYT

SEQ ID NO: 13354 - protein, 14 aa, Homo sapiens
  Heavy chain CDR3 for antibody 6677 (IGHV3-33)
ARDNILTGYYLFDY

SEQ ID NO: 13355 - protein, 9 aa, Homo sapiens
  Light chain CDR3 for antibody 6678 (IGKV5-2)
LQHDNFPWT

SEQ ID NO: 13356 - protein, 11 aa, Homo sapiens
  Heavy chain CDR3 for antibody 6678 (IGHV4-59)
ARESFYGSGNL

SEQ ID NO: 13357 - protein, 9 aa, Homo sapiens
  Light chain CDR3 for antibody 6679 (IGKV5-2)
LQHDNFPYT

SEQ ID NO: 13358 - protein, 15 aa, Homo sapiens
  Heavy chain CDR3 for antibody 6679 (IGHV4-34)
ARGGTGYYSYWYFDL

SEQ ID NO: 13359 - protein, 9 aa, Homo sapiens
  Light chain CDR3 for antibody 6680 (IGKV1-9)
QQLNSYPYT

SEQ ID NO: 13360 - protein, 15 aa, Homo sapiens
  Heavy chain CDR3 for antibody 6680 (IGHV3-33)
ARDTGYSSSWNWFDP

SEQ ID NO: 13361 - protein, 9 aa, Homo sapiens
  Light chain CDR3 for antibody 6681 (IGKV1-17)
LQHNSYPWT

SEQ ID NO: 13362 - protein, 16 aa, Homo sapiens
  Heavy chain CDR3 for antibody 6681 (IGHV3-33)
ARGYDMLTGDYHGMDV

SEQ ID NO: 13363 - protein, 8 aa, Homo sapiens
  Light chain CDR3 for antibody 6682 (IGKV1D-13)
QQFNNYPT

SEQ ID NO: 13364 - protein, 15 aa, Homo sapiens
  Heavy chain CDR3 for antibody 6682 (IGHV3-33)
ARRGYNDYDPYGMDV

SEQ ID NO: 13365 - protein, 9 aa, Homo sapiens
  Light chain CDR3 for antibody 6683 (IGKV1-39)
QQSYSTPLT

SEQ ID NO: 13366 - protein, 17 aa, Homo sapiens
  Heavy chain CDR3 for antibody 6683 (IGHV3-23)
AKDRDWKDGYYYFGMDV

SEQ ID NO: 13367 - protein, 9 aa, Homo sapiens
  Light chain CDR3 for antibody 6684 (IGKV1-9)
QQLISYPLT

SEQ ID NO: 13368 - protein, 18 aa, Homo sapiens
  Heavy chain CDR3 for antibody 6684 (IGHV3-33)
AREGSYYGSGSFPNWFDP

SEQ ID NO: 13369 - protein, 9 aa, Homo sapiens
  Light chain CDR3 for antibody 6685 (IGKV2-30)
MQGTHWPLT

SEQ ID NO: 13370 - protein, 15 aa, Homo sapiens
  Heavy chain CDR3 for antibody 6685 (IGHV3-23)
AKDGGWNYYYYGMDV

SEQ ID NO: 13371 - protein, 9 aa, Homo sapiens
  Light chain CDR3 for antibody 6686 (IGKV1-6)
LQDYKSPFT

SEQ ID NO: 13372 - protein, 18 aa, Homo sapiens
  Heavy chain CDR3 for antibody 6686 (IGHV1-8)
AREGAAAGSYYYYNGMDV

SEQ ID NO: 13373 - protein, 10 aa, Homo sapiens
  Light chain CDR3 for antibody 6687 (IGKV3-15)
QQYNNWPPLT

SEQ ID NO: 13374 - protein, 13 aa, Homo sapiens
  Heavy chain CDR3 for antibody 6687 (IGHV3-33)
ARAFTMVRGVIDY

SEQ ID NO: 13375 - protein, 9 aa, Homo sapiens
  Light chain CDR3 for antibody 6688 (IGKV1D-13)
QQFNNYPHT

SEQ ID NO: 13376 - protein, 12 aa, Homo sapiens
  Heavy chain CDR3 for antibody 6688 (IGHV3-33)
ARDPGYFFGLDV

SEQ ID NO: 13377 - protein, 10 aa, Homo sapiens
  Light chain CDR3 for antibody 6689 (IGKV3-11)
QQRSNWPALT

SEQ ID NO: 13378 - protein, 24 aa, Homo sapiens
  Heavy chain CDR3 for antibody 6689 (IGHV1-46)
ARDEARGLLTGYYNMREYYYGMDV

SEQ ID NO: 13379 - protein, 8 aa, Homo sapiens
  Light chain CDR3 for antibody 6690 (IGKV1-6)
QQYNSYYT

SEQ ID NO: 13380 - protein, 13 aa, Homo sapiens
  Heavy chain CDR3 for antibody 6690 (IGHV1-46)
ARVKLGSLGAFDI

SEQ ID NO: 13381 - protein, 9 aa, Homo sapiens
  Light chain CDR3 for antibody 6691 (IGKV1D-16)
QQYITYPYT

SEQ ID NO: 13382 - protein, 15 aa, Homo sapiens
  Heavy chain CDR3 for antibody 6691 (IGHV3-33)
ARDRGWKAPGYGMDV

SEQ ID NO: 13383 - protein, 9 aa, Homo sapiens
  Light chain CDR3 for antibody 6692 (IGKV1-17)
LQHNSYPWT

SEQ ID NO: 13384 - protein, 11 aa, Homo sapiens
  Heavy chain CDR3 for antibody 6692 (IGHV3-33)
ARDRGYSYFDY

SEQ ID NO: 13385 - protein, 10 aa, Homo sapiens
  Light chain CDR3 for antibody 6693 (IGKV3-11)
QQRSNWPIFT

SEQ ID NO: 13386 - protein, 17 aa, Homo sapiens
  Heavy chain CDR3 for antibody 6693 (IGHV3-23)
AKDRDWKDGYYYFGMDV

SEQ ID NO: 13387 - protein, 10 aa, Homo sapiens
  Light chain CDR3 for antibody 6694 (IGKV3-15)
QQYNNWPPYT

SEQ ID NO: 13388 - protein, 12 aa, Homo sapiens
  Heavy chain CDR3 for antibody 6694 (IGHV3-33)
ARGYFGSGYAHF

SEQ ID NO: 13389 - protein, 9 aa, Homo sapiens
  Light chain CDR3 for antibody 6695 (IGKV1D-13)
QQFNNYPHT

SEQ ID NO: 13390 - protein, 12 aa, Homo sapiens
  Heavy chain CDR3 for antibody 6695 (IGHV3-13)
ARDRGYSGYFDY

SEQ ID NO: 13391 - protein, 9 aa, Homo sapiens
  Light chain CDR3 for antibody 6696 (IGKV1D-16)
QQYDSYPWT

SEQ ID NO: 13392 - protein, 13 aa, Homo sapiens
  Heavy chain CDR3 for antibody 6696 (IGHV4-39)
ARRGVLAPAAFDH

SEQ ID NO: 13393 - protein, 8 aa, Homo sapiens
  Light chain CDR3 for antibody 6697 (IGKV1-5)
QQYNSYYT

SEQ ID NO: 13394 - protein, 16 aa, Homo sapiens
  Heavy chain CDR3 for antibody 6697 (IGHV3-30)
ARDIAVAGHVYYGMDV

SEQ ID NO: 13395 - protein, 8 aa, Homo sapiens
  Light chain CDR3 for antibody 6698 (IGKV3D-7)
QQDYNLLT

SEQ ID NO: 13396 - protein, 18 aa, Homo sapiens
  Heavy chain CDR3 for antibody 6698 (IGHV3-33)
ARDEYYGSGIYYNYGMDV

SEQ ID NO: 13397 - protein, 9 aa, Homo sapiens
  Light chain CDR3 for antibody 6699 (IGKV3D-7)
QQDYTLPLT

SEQ ID NO: 13398 - protein, 13 aa, Homo sapiens
  Heavy chain CDR3 for antibody 6699 (IGHV4-39)
ARHPPSRDYGMDV

SEQ ID NO: 13399 - protein, 8 aa, Homo sapiens
  Light chain CDR3 for antibody 6700 (IGKV3-20)
QQYGRSFT

SEQ ID NO: 13400 - protein, 17 aa, Homo sapiens
  Heavy chain CDR3 for antibody 6700 (IGHV4-39)
ARVLRYFDWLSHDAFDI

SEQ ID NO: 13401 - protein, 9 aa, Homo sapiens
  Light chain CDR3 for antibody 6701 (IGKV3-11)
QQRSNWPLT

SEQ ID NO: 13402 - protein, 14 aa, Homo sapiens
  Heavy chain CDR3 for antibody 6701 (IGHV3-33)
AREEDYYYYYDMDV

SEQ ID NO: 13403 - protein, 9 aa, Homo sapiens
  Light chain CDR3 for antibody 6702 (IGKV3D-7)
QQDYEFPIT

SEQ ID NO: 13404 - protein, 9 aa, Homo sapiens
  Heavy chain CDR3 for antibody 6702 (IGHV4-59)
AREGGSGSL

SEQ ID NO: 13405 - protein, 9 aa, Homo sapiens
  Light chain CDR3 for antibody 6703 (IGKV1-6)
LQDYNYPRT

SEQ ID NO: 13406 - protein, 12 aa, Homo sapiens
  Heavy chain CDR3 for antibody 6703 (IGHV3-11)
VRVLLWFGESDY

SEQ ID NO: 13407 - protein, 9 aa, Homo sapiens
  Light chain CDR3 for antibody 6704 (IGKV3-11)
QQRSNWMYT

SEQ ID NO: 13408 - protein, 13 aa, Homo sapiens
  Heavy chain CDR3 for antibody 6704 (IGHV3-33)
ARVDTMVRGVMAY

SEQ ID NO: 13409 - protein, 9 aa, Homo sapiens
  Light chain CDR3 for antibody 6705 (IGKV3D-20)
QQYGSSPRT

SEQ ID NO: 13410 - protein, 14 aa, Homo sapiens
  Heavy chain CDR3 for antibody 6705 (IGHV3-23)
AKERLRYFDWFLDY

SEQ ID NO: 13411 - protein, 9 aa, Homo sapiens
  Light chain CDR3 for antibody 6706 (IGKV2D-28)
MQALQTPPT

SEQ ID NO: 13412 - protein, 14 aa, Homo sapiens
  Heavy chain CDR3 for antibody 6706 (IGHV3-33)
ARAGSGYDRDWFDP

SEQ ID NO: 13413 - protein, 9 aa, Homo sapiens
  Light chain CDR3 for antibody 6707 (IGKV1D-13)
QHFNNYMYT

SEQ ID NO: 13414 - protein, 13 aa, Homo sapiens
  Heavy chain CDR3 for antibody 6707 (IGHV4-34)
ASNFYYYYYGMDV

SEQ ID NO: 13415 - protein, 9 aa, Homo sapiens
  Light chain CDR3 for antibody 6708 (IGKV6-21)
HQSSSLPYT

SEQ ID NO: 13416 - protein, 16 aa, Homo sapiens
  Heavy chain CDR3 for antibody 6708 (IGHV3-33)
ARDAGYPNYDYYGMDV

SEQ ID NO: 13417 - protein, 9 aa, Homo sapiens
  Light chain CDR3 for antibody 6709 (IGKV2D-28)
MQALQTPPT

SEQ ID NO: 13418 - protein, 12 aa, Homo sapiens
  Heavy chain CDR3 for antibody 6709 (IGHV3-33)
ARDLVGATPFDY

SEQ ID NO: 13419 - protein, 8 aa, Homo sapiens
  Light chain CDR3 for antibody 6710 (IGKV3-20)
QQYGRSFT

SEQ ID NO: 13420 - protein, 23 aa, Homo sapiens
  Heavy chain CDR3 for antibody 6710 (IGHV4-59)
ARERTYSDILPGYYEDYYYGMDV

SEQ ID NO: 13421 - protein, 9 aa, Homo sapiens
  Light chain CDR3 for antibody 6711 (IGKV1D-13)
QQSYNYPRT

SEQ ID NO: 13422 - protein, 11 aa, Homo sapiens
  Heavy chain CDR3 for antibody 6711 (IGHV3-33)
ASGYSYGPFDY

SEQ ID NO: 13423 - protein, 10 aa, Homo sapiens
  Light chain CDR3 for antibody 6712 (IGKV1-17)
LQHNSYPMYT

SEQ ID NO: 13424 - protein, 14 aa, Homo sapiens
  Heavy chain CDR3 for antibody 6712 (IGHV3-20)
ARDGGSTSFDWFDP

SEQ ID NO: 13425 - protein, 9 aa, Homo sapiens
  Light chain CDR3 for antibody 6713 (IGKV4-1)
QQYYSTPWT

SEQ ID NO: 13426 - protein, 19 aa, Homo sapiens
  Heavy chain CDR3 for antibody 6713 (IGHV3-33)
ARRKNYYGSGSWHYYGMDV

SEQ ID NO: 13427 - protein, 8 aa, Homo sapiens
  Light chain CDR3 for antibody 6714 (IGKV3D-7)
QQDYNLLT

SEQ ID NO: 13428 - protein, 13 aa, Homo sapiens
  Heavy chain CDR3 for antibody 6714 (IGHV3-21)
ARDSTLVRGVFPY

SEQ ID NO: 13429 - protein, 9 aa, Homo sapiens
  Light chain CDR3 for antibody 6715 (IGKV3D-7)
QQDYNLPLT

SEQ ID NO: 13430 - protein, 13 aa, Homo sapiens
  Heavy chain CDR3 for antibody 6715 (IGHV3-66)
ANTGDSYYYGFYV

SEQ ID NO: 13431 - protein, 9 aa, Homo sapiens
  Light chain CDR3 for antibody 6716 (IGKV1-17)
QQHNSYPYT

SEQ ID NO: 13432 - protein, 24 aa, Homo sapiens
  Heavy chain CDR3 for antibody 6716 (IGHV1-24)
ATEAHYDILTGYYNPHYYYYGMDV

SEQ ID NO: 13433 - protein, 9 aa, Homo sapiens
  Light chain CDR3 for antibody 6717 (IGKV1-6)
LQDYNYPYT

SEQ ID NO: 13434 - protein, 10 aa, Homo sapiens
  Heavy chain CDR3 for antibody 6717 (IGHV3-72)
CRDREGFGDV

SEQ ID NO: 13435 - protein, 9 aa, Homo sapiens
  Light chain CDR3 for antibody 6718 (IGKV3-15)
QQYNNWPLT

SEQ ID NO: 13436 - protein, 19 aa, Homo sapiens
  Heavy chain CDR3 for antibody 6718 (IGHV1-24)
ATAGLQWFGEKIGYYGMDV

SEQ ID NO: 13437 - protein, 10 aa, Homo sapiens
  Light chain CDR3 for antibody 6719 (IGKV1-39)
QQSYSTPMYT

SEQ ID NO: 13438 - protein, 20 aa, Homo sapiens
  Heavy chain CDR3 for antibody 6719 (IGHV3-33)
AREDYYGSGSYYPAYNWFDP

SEQ ID NO: 13439 - protein, 9 aa, Homo sapiens
  Light chain CDR3 for antibody 6720 (IGKV1-17)
LQHNSYPYT

SEQ ID NO: 13440 - protein, 14 aa, Homo sapiens
  Heavy chain CDR3 for antibody 6720 (IGHV3-11)
ARDEGSTWSDIFDI

SEQ ID NO: 13441 - protein, 10 aa, Homo sapiens
  Light chain CDR3 for antibody 6721 (IGKV1-9)
QQLDSYPMYT

SEQ ID NO: 13442 - protein, 12 aa, Homo sapiens
  Heavy chain CDR3 for antibody 6721 (IGHV1-46)
ARGLTGDHAVDI

SEQ ID NO: 13443 - protein, 9 aa, Homo sapiens
  Light chain CDR3 for antibody 6722 (IGKV1-17)
LQHNSYPYT

SEQ ID NO: 13444 - protein, 12 aa, Homo sapiens
  Heavy chain CDR3 for antibody 6722 (IGHV3-33)
ARGGFDWGSIDY

SEQ ID NO: 13445 - protein, 9 aa, Homo sapiens
  Light chain CDR3 for antibody 6723 (IGKV5-2)
LQHDNFPYT

SEQ ID NO: 13446 - protein, 10 aa, Homo sapiens
  Heavy chain CDR3 for antibody 6723 (IGHV3-23)
ATIVGPFLDV

SEQ ID NO: 13447 - protein, 8 aa, Homo sapiens
  Light chain CDR3 for antibody 6724 (IGKV1-5)
QQYNSYWT

SEQ ID NO: 13448 - protein, 15 aa, Homo sapiens
  Heavy chain CDR3 for antibody 6724 (IGHV3-30)
ARRGYGSGSPDAFDL

SEQ ID NO: 13449 - protein, 9 aa, Homo sapiens
  Light chain CDR3 for antibody 6725 (IGKV1-9)
QQGNTYSRT

SEQ ID NO: 13450 - protein, 16 aa, Homo sapiens
  Heavy chain CDR3 for antibody 6725 (IGHV4-59)
ARGRYFEWLLGDVFDI

SEQ ID NO: 13451 - protein, 9 aa, Homo sapiens
  Light chain CDR3 for antibody 6726 (IGKV1-6)
LQDYKSPFT

SEQ ID NO: 13452 - protein, 18 aa, Homo sapiens
  Heavy chain CDR3 for antibody 6726 (IGHV3-33)
ARREGIVGATTYYYGMDV

SEQ ID NO: 13453 - protein, 9 aa, Homo sapiens
  Light chain CDR3 for antibody 6727 (IGKV1-17)
LQHNSYPYT

SEQ ID NO: 13454 - protein, 16 aa, Homo sapiens
  Heavy chain CDR3 for antibody 6727 (IGHV3-33)
ARDNILTGYYYYGMDV

SEQ ID NO: 13455 - protein, 9 aa, Homo sapiens
  Light chain CDR3 for antibody 6728 (IGKV3D-7)
QQDYTLPLT

SEQ ID NO: 13456 - protein, 11 aa, Homo sapiens
  Heavy chain CDR3 for antibody 6728 (IGHV4-59)
ARDGVRGVFDI

SEQ ID NO: 13457 - protein, 10 aa, Homo sapiens
  Light chain CDR3 for antibody 6729 (IGKV1-39)
QQSYSTPMYT

SEQ ID NO: 13458 - protein, 16 aa, Homo sapiens
  Heavy chain CDR3 for antibody 6729 (IGHV4-59)
ARYSGSYYGDYYGMDV

SEQ ID NO: 13459 - protein, 9 aa, Homo sapiens
  Light chain CDR3 for antibody 6730 (IGKV3-20)
QQYGSSPYT

SEQ ID NO: 13460 - protein, 14 aa, Homo sapiens
  Heavy chain CDR3 for antibody 6730 (IGHV3-33)
ARDGYDILTGPMDV

SEQ ID NO: 13461 - protein, 9 aa, Homo sapiens
  Light chain CDR3 for antibody 6731 (IGKV1-17)
LQHNSYPYT

SEQ ID NO: 13462 - protein, 13 aa, Homo sapiens
  Heavy chain CDR3 for antibody 6731 (IGHV3-11)
AREGIAVAGDFDH

SEQ ID NO: 13463 - protein, 11 aa, Homo sapiens
  Light chain CDR3 for antibody 6732 (IGKV3-11)
QQRSNWPPTWT

SEQ ID NO: 13464 - protein, 13 aa, Homo sapiens
  Heavy chain CDR3 for antibody 6732 (IGHV4-39)
ARHPPSRDYGMDV

SEQ ID NO: 13465 - protein, 9 aa, Homo sapiens
  Light chain CDR3 for antibody 6733 (IGKV1-9)
QQLISYPLT

SEQ ID NO: 13466 - protein, 13 aa, Homo sapiens
  Heavy chain CDR3 for antibody 6733 (IGHV3-33)
ANTGDSYYYDMDV

SEQ ID NO: 13467 - protein, 9 aa, Homo sapiens
  Light chain CDR3 for antibody 6734 (IGKV1D-16)
QQYSSYPYT

SEQ ID NO: 13468 - protein, 12 aa, Homo sapiens
  Heavy chain CDR3 for antibody 6734 (IGHV3-23)
AKEGLGNDYESY

SEQ ID NO: 13469 - protein, 11 aa, Homo sapiens
  Light chain CDR3 for antibody 6735 (IGKV3-11)
QQRSNWPPTWT

SEQ ID NO: 13470 - protein, 8 aa, Homo sapiens
  Heavy chain CDR3 for antibody 6735 (IGHV3-23)
AKETGNNY

SEQ ID NO: 13471 - protein, 9 aa, Homo sapiens
  Light chain CDR3 for antibody 6736 (IGKV1-17)
QQLNSYPYT

SEQ ID NO: 13472 - protein, 11 aa, Homo sapiens
  Heavy chain CDR3 for antibody 6736 (IGHV4-59)
AREMGHDTFDI

SEQ ID NO: 13473 - protein, 9 aa, Homo sapiens
  Light chain CDR3 for antibody 6737 (IGKV1-39)
QQSYSTPFT

SEQ ID NO: 13474 - protein, 15 aa, Homo sapiens
  Heavy chain CDR3 for antibody 6737 (IGHV4-59)
ARDRVQLGYYYGMDV

SEQ ID NO: 13475 - protein, 9 aa, Homo sapiens
  Light chain CDR3 for antibody 6738 (IGKV2-30)
MQGTHWPLT

SEQ ID NO: 13476 - protein, 17 aa, Homo sapiens
  Heavy chain CDR3 for antibody 6738 (IGHV3-23)
AKDRPVTTLYYYFGMDV

SEQ ID NO: 13477 - protein, 10 aa, Homo sapiens
  Light chain CDR3 for antibody 6739 (IGKV1-17)
LQHNSYPMYT

SEQ ID NO: 13478 - protein, 20 aa, Homo sapiens
  Heavy chain CDR3 for antibody 6739 (IGHV3-11)
ARGGATLIRGLIDYYYGMDV

SEQ ID NO: 13479 - protein, 9 aa, Homo sapiens
  Light chain CDR3 for antibody 6740 (IGKV1D-16)
QQYYSYPRT

SEQ ID NO: 13480 - protein, 15 aa, Homo sapiens
  Heavy chain CDR3 for antibody 6740 (IGHV3-33)
ARRICSGGSCSLFDY

SEQ ID NO: 13481 - protein, 8 aa, Homo sapiens
  Light chain CDR3 for antibody 6741 (IGKV1-5)
QQYNSYWT

SEQ ID NO: 13482 - protein, 11 aa, Homo sapiens
  Heavy chain CDR3 for antibody 6741 (IGHV3-33)
ARDKSSGWSDY

SEQ ID NO: 13483 - protein, 9 aa, Homo sapiens
  Light chain CDR3 for antibody 6742 (IGKV5-2)
LQHDNFPWT

SEQ ID NO: 13484 - protein, 14 aa, Homo sapiens
  Heavy chain CDR3 for antibody 6742 (IGHV4-34)
ARAYYAFLTGALDI

SEQ ID NO: 13485 - protein, 9 aa, Homo sapiens
  Light chain CDR3 for antibody 6743 (IGKV1-16)
QQYNSYPLT

SEQ ID NO: 13486 - protein, 13 aa, Homo sapiens
  Heavy chain CDR3 for antibody 6743 (IGHV3-33)
ARVHFDWLDAFDI

SEQ ID NO: 13487 - protein, 9 aa, Homo sapiens
  Light chain CDR3 for antibody 6744 (IGKV3-15)
QQYNNWPLT

SEQ ID NO: 13488 - protein, 8 aa, Homo sapiens
  Heavy chain CDR3 for antibody 6744 (IGHV3-23)
AKESLLDY

SEQ ID NO: 13489 - protein, 9 aa, Homo sapiens
  Light chain CDR3 for antibody 6745 (IGKV1-33)
QQYDNLPFT

SEQ ID NO: 13490 - protein, 17 aa, Homo sapiens
  Heavy chain CDR3 for antibody 6745 (IGHV3-33)
AREDYDILTGYPFYFDY

SEQ ID NO: 13491 - protein, 9 aa, Homo sapiens
  Light chain CDR3 for antibody 6746 (IGKV1-6)
LQDYNYPYT

SEQ ID NO: 13492 - protein, 18 aa, Homo sapiens
  Heavy chain CDR3 for antibody 6746 (IGHV3-33)
ARRGVGARGYYYYYGMDV

SEQ ID NO: 13493 - protein, 9 aa, Homo sapiens
  Light chain CDR3 for antibody 6747 (IGKV3D-7)
QQDYNLPWT

SEQ ID NO: 13494 - protein, 18 aa, Homo sapiens
  Heavy chain CDR3 for antibody 6747 (IGHV4-59)
ARERGNWNDVDYYYGMDV

SEQ ID NO: 13495 - protein, 10 aa, Homo sapiens
  Light chain CDR3 for antibody 6748 (IGKV3-15)
QQYNNWPPIT

SEQ ID NO: 13496 - protein, 13 aa, Homo sapiens
  Heavy chain CDR3 for antibody 6748 (IGHV3-33)
ARGDNWNDGGFDY

SEQ ID NO: 13497 - protein, 9 aa, Homo sapiens
  Light chain CDR3 for antibody 6749 (IGKV3-11)
QQRSNWPPT

SEQ ID NO: 13498 - protein, 15 aa, Homo sapiens
  Heavy chain CDR3 for antibody 6749 (IGHV3-23)
AKEFTMVRGVITPDY

SEQ ID NO: 13499 - protein, 9 aa, Homo sapiens
  Light chain CDR3 for antibody 6750 (IGKV1D-13)
QRFNNYLYT

SEQ ID NO: 13500 - protein, 18 aa, Homo sapiens
  Heavy chain CDR3 for antibody 6750 (IGHV3-33)
ARGGYSSGWDYYYYGMDV

SEQ ID NO: 13501 - protein, 9 aa, Homo sapiens
  Light chain CDR3 for antibody 6751 (IGKV3-15)
QQYINWPLT

SEQ ID NO: 13502 - protein, 12 aa, Homo sapiens
  Heavy chain CDR3 for antibody 6751 (IGHV3-33)
ARDLVRGIRMDV

SEQ ID NO: 13503 - protein, 9 aa, Homo sapiens
  Light chain CDR3 for antibody 6752 (IGKV1-16)
QQYTSYPFT

SEQ ID NO: 13504 - protein, 10 aa, Homo sapiens
  Heavy chain CDR3 for antibody 6752 (IGHV4-59)
ARQLGNWFDP

SEQ ID NO: 13505 - protein, 9 aa, Homo sapiens
  Light chain CDR3 for antibody 6753 (IGKV3-15)
QQYNNWPYT

SEQ ID NO: 13506 - protein, 10 aa, Homo sapiens
  Heavy chain CDR3 for antibody 6753 (IGHV3-23)
AKDHYGDYPY

SEQ ID NO: 13507 - protein, 9 aa, Homo sapiens
  Light chain CDR3 for antibody 6754 (IGKV1-9)
QQLISYPLT

SEQ ID NO: 13508 - protein, 15 aa, Homo sapiens
  Heavy chain CDR3 for antibody 6754 (IGHV3-33)
AKDRNSGYDWGGFDY

SEQ ID NO: 13509 - protein, 9 aa, Homo sapiens
  Light chain CDR3 for antibody 6755 (IGKV1-6)
QQEYNYPLT

SEQ ID NO: 13510 - protein, 18 aa, Homo sapiens
  Heavy chain CDR3 for antibody 6755 (IGHV4-59)
AREGHYYTSGSYYKAFDY

SEQ ID NO: 13511 - protein, 9 aa, Homo sapiens
  Light chain CDR3 for antibody 6756 (IGKV1-17)
LQHNSYPYT

SEQ ID NO: 13512 - protein, 10 aa, Homo sapiens
  Heavy chain CDR3 for antibody 6756 (IGHV3-66)
ARDLRADFDY

SEQ ID NO: 13513 - protein, 9 aa, Homo sapiens
  Light chain CDR3 for antibody 6757 (IGKV1-27)
QKYNSAPYT

SEQ ID NO: 13514 - protein, 14 aa, Homo sapiens
  Heavy chain CDR3 for antibody 6757 (IGHV3-20)
ARDEGSGGYDVFDI

SEQ ID NO: 13515 - protein, 10 aa, Homo sapiens
  Light chain CDR3 for antibody 6758 (IGKV1-17)
LQHNSYPMYT

SEQ ID NO: 13516 - protein, 18 aa, Homo sapiens
  Heavy chain CDR3 for antibody 6758 (IGHV3-23)
ARYHLYFGSGFGSDGMDV

SEQ ID NO: 13517 - protein, 9 aa, Homo sapiens
  Light chain CDR3 for antibody 6759 (IGKV1D-16)
QHYNDYPFT

SEQ ID NO: 13518 - protein, 13 aa, Homo sapiens
  Heavy chain CDR3 for antibody 6759 (IGHV3-33)
ARRATLVRGVFDP

SEQ ID NO: 13519 - protein, 8 aa, Homo sapiens
  Light chain CDR3 for antibody 6760 (IGKV1-5)
QQYNSYWT

SEQ ID NO: 13520 - protein, 12 aa, Homo sapiens
  Heavy chain CDR3 for antibody 6760 (IGHV4-59)
ARDRSGWAYFDY

SEQ ID NO: 13521 - protein, 8 aa, Homo sapiens
  Light chain CDR3 for antibody 6761 (IGKV3D-7)
QQDYNLLT

SEQ ID NO: 13522 - protein, 12 aa, Homo sapiens
  Heavy chain CDR3 for antibody 6761 (IGHV4-39)
ARQMVREGWFDP

SEQ ID NO: 13523 - protein, 9 aa, Homo sapiens
  Light chain CDR3 for antibody 6762 (IGKV1-16)
QQYNSYPIT

SEQ ID NO: 13524 - protein, 18 aa, Homo sapiens
  Heavy chain CDR3 for antibody 6762 (IGHV3-33)
ARREGITTIFYYYYGMDV

SEQ ID NO: 13525 - protein, 10 aa, Homo sapiens
  Light chain CDR3 for antibody 6763 (IGKV1-17)
LQHNSYPMYT

SEQ ID NO: 13526 - protein, 13 aa, Homo sapiens
  Heavy chain CDR3 for antibody 6763 (IGHV3-66)
ANTGDSYYYGFYV

SEQ ID NO: 13527 - protein, 9 aa, Homo sapiens
  Light chain CDR3 for antibody 6764 (IGKV1D-13)
QQFNNYMYT

SEQ ID NO: 13528 - protein, 14 aa, Homo sapiens
  Heavy chain CDR3 for antibody 6764 (IGHV3-33)
ARASSGSSYWYFDL

SEQ ID NO: 13529 - protein, 9 aa, Homo sapiens
  Light chain CDR3 for antibody 6765 (IGKV1-6)
LQDYNYPYT

SEQ ID NO: 13530 - protein, 12 aa, Homo sapiens
  Heavy chain CDR3 for antibody 6765 (IGHV3-66)
VRDRAAAPYFDL

SEQ ID NO: 13531 - protein, 9 aa, Homo sapiens
  Light chain CDR3 for antibody 6766 (IGKV1D-13)
QQFNNYPHT

SEQ ID NO: 13532 - protein, 14 aa, Homo sapiens
  Heavy chain CDR3 for antibody 6766 (IGHV3-64)
ARDHAAGGYSHSDY

SEQ ID NO: 13533 - protein, 9 aa, Homo sapiens
  Light chain CDR3 for antibody 6767 (IGKV1-33)
QQYDNLPFT

SEQ ID NO: 13534 - protein, 18 aa, Homo sapiens
  Heavy chain CDR3 for antibody 6767 (IGHV3-33)
ARDQYSGYDFYYYYGMDV

SEQ ID NO: 13535 - protein, 9 aa, Homo sapiens
  Light chain CDR3 for antibody 6768 (IGKV3-15)
QQYNNWPRT

SEQ ID NO: 13536 - protein, 17 aa, Homo sapiens
  Heavy chain CDR3 for antibody 6768 (IGHV3-23)
AKDGSFYSSGWYDAFDI

SEQ ID NO: 13537 - protein, 10 aa, Homo sapiens
  Light chain CDR3 for antibody 6769 (IGKV1-17)
LQHNSYPMYT

SEQ ID NO: 13538 - protein, 16 aa, Homo sapiens
  Heavy chain CDR3 for antibody 6769 (IGHV4-59)
ARGRYFEWLLGDVFDI

SEQ ID NO: 13539 - protein, 8 aa, Homo sapiens
  Light chain CDR3 for antibody 6770 (IGKV3D-7)
QQDYNLLT

SEQ ID NO: 13540 - protein, 14 aa, Homo sapiens
  Heavy chain CDR3 for antibody 6770 (IGHV3-33)
ANWAYDILTGYLDY

SEQ ID NO: 13541 - protein, 9 aa, Homo sapiens
  Light chain CDR3 for antibody 6771 (IGKV2-30)
MQGTHWPLT

SEQ ID NO: 13542 - protein, 16 aa, Homo sapiens
  Heavy chain CDR3 for antibody 6771 (IGHV3-33)
ARDKNTDYDILTGFDY

SEQ ID NO: 13543 - protein, 9 aa, Homo sapiens
  Light chain CDR3 for antibody 6772 (IGKV3-15)
QQYNNWPLT

SEQ ID NO: 13544 - protein, 12 aa, Homo sapiens
  Heavy chain CDR3 for antibody 6772 (IGHV1-24)
ASDWAYYYGMDV

SEQ ID NO: 13545 - protein, 9 aa, Homo sapiens
  Light chain CDR3 for antibody 6773 (IGKV5-2)
LQHDNFPYT

SEQ ID NO: 13546 - protein, 18 aa, Homo sapiens
  Heavy chain CDR3 for antibody 6773 (IGHV3-23)
AKDGDYFGSGSYWGYFDL

SEQ ID NO: 13547 - protein, 10 aa, Homo sapiens
  Light chain CDR3 for antibody 6774 (IGKV3-11)
QQRSNWPIFT

SEQ ID NO: 13548 - protein, 17 aa, Homo sapiens
  Heavy chain CDR3 for antibody 6774 (IGHV3-23)
AKGNYGSGSYYNGDFQH

SEQ ID NO: 13549 - protein, 9 aa, Homo sapiens
  Light chain CDR3 for antibody 6775 (IGKV3-15)
QQYNNWPLT

SEQ ID NO: 13550 - protein, 18 aa, Homo sapiens
  Heavy chain CDR3 for antibody 6775 (IGHV3-49)
TRDLRPPGIAVAEGAFDI

SEQ ID NO: 13551 - protein, 9 aa, Homo sapiens
  Light chain CDR3 for antibody 6776 (IGKV5-2)
LQHDNFPYT

SEQ ID NO: 13552 - protein, 16 aa, Homo sapiens
  Heavy chain CDR3 for antibody 6776 (IGHV1-24)
ATEDSSSYYYYYGMDV

SEQ ID NO: 13553 - protein, 9 aa, Homo sapiens
  Light chain CDR3 for antibody 6777 (IGKV3-20)
HQSTSLPFT

SEQ ID NO: 13554 - protein, 13 aa, Homo sapiens
  Heavy chain CDR3 for antibody 6777 (IGHV4-59)
ARDAGYSSSWFDY

SEQ ID NO: 13555 - protein, 8 aa, Homo sapiens
  Light chain CDR3 for antibody 6778 (IGKV1-5)
QQYNSYYT

SEQ ID NO: 13556 - protein, 19 aa, Homo sapiens
  Heavy chain CDR3 for antibody 6778 (IGHV3-33)
ARGPYYDILTGYGYYGMDV

SEQ ID NO: 13557 - protein, 9 aa, Homo sapiens
  Light chain CDR3 for antibody 6779 (IGKV3D-20)
QQYNNWPRT

SEQ ID NO: 13558 - protein, 14 aa, Homo sapiens
  Heavy chain CDR3 for antibody 6779 (IGHV3-15)
SIYYYGSGRDFFDY

SEQ ID NO: 13559 - protein, 9 aa, Homo sapiens
  Light chain CDR3 for antibody 6780 (IGKV1-13)
QQYHSYPYT

SEQ ID NO: 13560 - protein, 12 aa, Homo sapiens
  Heavy chain CDR3 for antibody 6780 (IGHV1-18)
ARRDGSGTSFDY

SEQ ID NO: 13561 - protein, 9 aa, Homo sapiens
  Light chain CDR3 for antibody 6781 (IGKV3-11)
QQRSNWPPT

SEQ ID NO: 13562 - protein, 18 aa, Homo sapiens
  Heavy chain CDR3 for antibody 6781 (IGHV3-33)
ARGGYSSGWDYYYYGMDV

SEQ ID NO: 13563 - protein, 10 aa, Homo sapiens
  Light chain CDR3 for antibody 6782 (IGKV3-15)
QQYNNWPPLT

SEQ ID NO: 13564 - protein, 18 aa, Homo sapiens
  Heavy chain CDR3 for antibody 6782 (IGHV3-33)
ARGYYGSGNFYKDSGMDV

SEQ ID NO: 13565 - protein, 9 aa, Homo sapiens
  Light chain CDR3 for antibody 6783 (IGKV3-15)
QQYNNWPLT

SEQ ID NO: 13566 - protein, 18 aa, Homo sapiens
  Heavy chain CDR3 for antibody 6783 (IGHV4-59)
ARERGNWNDVDYYYGMDV

SEQ ID NO: 13567 - protein, 10 aa, Homo sapiens
  Light chain CDR3 for antibody 6784 (IGKV1-39)
QQSYSTPMYT

SEQ ID NO: 13568 - protein, 21 aa, Homo sapiens
  Heavy chain CDR3 for antibody 6784 (IGHV3-23)
AKDIDYYGSGSYPLYYYGMDV

SEQ ID NO: 13569 - protein, 9 aa, Homo sapiens
  Light chain CDR3 for antibody 6785 (IGKV1-39)
QQSYSTPLT

SEQ ID NO: 13570 - protein, 9 aa, Homo sapiens
  Heavy chain CDR3 for antibody 6785 (IGHV1-18)
ARGGWGFEY

SEQ ID NO: 13571 - protein, 9 aa, Homo sapiens
  Light chain CDR3 for antibody 6786 (IGKV3D-7)
QQDYEFPLT

SEQ ID NO: 13572 - protein, 23 aa, Homo sapiens
  Heavy chain CDR3 for antibody 6786 (IGHV4-59)
ARERTYSDILPGYYEDYYYGMDV

SEQ ID NO: 13573 - protein, 8 aa, Homo sapiens
  Light chain CDR3 for antibody 6787 (IGKV3D-7)
QQDYNLVT

SEQ ID NO: 13574 - protein, 12 aa, Homo sapiens
  Heavy chain CDR3 for antibody 6787 (IGHV4-61)
ARVDSSGWFFDY

SEQ ID NO: 13575 - protein, 9 aa, Homo sapiens
  Light chain CDR3 for antibody 6788 (IGKV1-17)
LQHNSYPYT

SEQ ID NO: 13576 - protein, 11 aa, Homo sapiens
  Heavy chain CDR3 for antibody 6788 (IGHV4-59)
AREDYGVPFDY

SEQ ID NO: 13577 - protein, 9 aa, Homo sapiens
  Light chain CDR3 for antibody 6789 (IGKV4-1)
QQYYSTPWT

SEQ ID NO: 13578 - protein, 17 aa, Homo sapiens
  Heavy chain CDR3 for antibody 6789 (IGHV3-33)
ARGFSGYDGYYYYGMDV

SEQ ID NO: 13579 - protein, 9 aa, Homo sapiens
  Light chain CDR3 for antibody 6790 (IGKV1-9)
QQLKSYLYT

SEQ ID NO: 13580 - protein, 16 aa, Homo sapiens
  Heavy chain CDR3 for antibody 6790 (IGHV1-18)
ARYFDWLLRDYYGMDV

SEQ ID NO: 13581 - protein, 9 aa, Homo sapiens
  Light chain CDR3 for antibody 6791 (IGKV1-17)
LQHNSYPYT

SEQ ID NO: 13582 - protein, 17 aa, Homo sapiens
  Heavy chain CDR3 for antibody 6791 (IGHV3-30)
ARESLWFGEANHFVMDV

SEQ ID NO: 13583 - protein, 9 aa, Homo sapiens
  Light chain CDR3 for antibody 6792 (IGKV1-9)
QQLNTYPWT

SEQ ID NO: 13584 - protein, 14 aa, Homo sapiens
  Heavy chain CDR3 for antibody 6792 (IGHV3-33)
ARTTAAAGPRDFQH

SEQ ID NO: 13585 - protein, 9 aa, Homo sapiens
  Light chain CDR3 for antibody 6793 (IGKV1-9)
QQYNSYPYT

SEQ ID NO: 13586 - protein, 12 aa, Homo sapiens
  Heavy chain CDR3 for antibody 6793 (IGHV3-33)
ARERGIGRYFDL

SEQ ID NO: 13587 - protein, 9 aa, Homo sapiens
  Light chain CDR3 for antibody 6794 (IGKV1-5)
QQYNTYSRT

SEQ ID NO: 13588 - protein, 14 aa, Homo sapiens
  Heavy chain CDR3 for antibody 6794 (IGHV3-33)
ARDKSYPLSYGMDV

SEQ ID NO: 13589 - protein, 9 aa, Homo sapiens
  Light chain CDR3 for antibody 6795 (IGKV1-9)
QQLKSYLYT

SEQ ID NO: 13590 - protein, 12 aa, Homo sapiens
  Heavy chain CDR3 for antibody 6795 (IGHV4-59)
ARDRSGWAYFDY

SEQ ID NO: 13591 - protein, 10 aa, Homo sapiens
  Light chain CDR3 for antibody 6796 (IGKV1-17)
LQHNSYPMYT

SEQ ID NO: 13592 - protein, 21 aa, Homo sapiens
  Heavy chain CDR3 for antibody 6796 (IGHV3-33)
ARKRLYDILTGYYKAYYGMDV

SEQ ID NO: 13593 - protein, 9 aa, Homo sapiens
  Light chain CDR3 for antibody 6797 (IGKV1-27)
QKYNSAPYT

SEQ ID NO: 13594 - protein, 16 aa, Homo sapiens
  Heavy chain CDR3 for antibody 6797 (IGHV3-64)
ARGRYFDWLLGDWFDP

SEQ ID NO: 13595 - protein, 9 aa, Homo sapiens
  Light chain CDR3 for antibody 6798 (IGKV3-15)
QQYHNWPLT

SEQ ID NO: 13596 - protein, 19 aa, Homo sapiens
  Heavy chain CDR3 for antibody 6798 (IGHV3-33)
ARDSGYSGYDYYYYYGMDV

SEQ ID NO: 13597 - protein, 9 aa, Homo sapiens
  Light chain CDR3 for antibody 6799 (IGKV3-20)
QQYGSSPYT

SEQ ID NO: 13598 - protein, 17 aa, Homo sapiens
  Heavy chain CDR3 for antibody 6799 (IGHV3-33)
ARGGGYENDHYYYGMDV

SEQ ID NO: 13599 - protein, 9 aa, Homo sapiens
  Light chain CDR3 for antibody 6800 (IGKV2D-28)
MQALQTPFT

SEQ ID NO: 13600 - protein, 12 aa, Homo sapiens
  Heavy chain CDR3 for antibody 6800 (IGHV3-13)
AREAGIPDAFDI

SEQ ID NO: 13601 - protein, 9 aa, Homo sapiens
  Light chain CDR3 for antibody 6801 (IGKV1-27)
QKYNSAPYT

SEQ ID NO: 13602 - protein, 18 aa, Homo sapiens
  Heavy chain CDR3 for antibody 6801 (IGHV3-33)
ARGYNQGSGSYYNVCFDY

SEQ ID NO: 13603 - protein, 9 aa, Homo sapiens
  Light chain CDR3 for antibody 6802 (IGKV3-20)
QQYGSSPRT

SEQ ID NO: 13604 - protein, 20 aa, Homo sapiens
  Heavy chain CDR3 for antibody 6802 (IGHV3-33)
ARTMGSGSYYKAYYYYVMDV

SEQ ID NO: 13605 - protein, 10 aa, Homo sapiens
  Light chain CDR3 for antibody 6803 (IGKV3-11)
QQRSTWPTLT

SEQ ID NO: 13606 - protein, 16 aa, Homo sapiens
  Heavy chain CDR3 for antibody 6803 (IGHV3-23)
AKEGMVLRYFDWLWDY

SEQ ID NO: 13607 - protein, 10 aa, Homo sapiens
  Light chain CDR3 for antibody 6804 (IGKV1-39)
QQSYSTPMYT

SEQ ID NO: 13608 - protein, 15 aa, Homo sapiens
  Heavy chain CDR3 for antibody 6804 (IGHV3-30)
ARRGYGSGSPDAFDL

SEQ ID NO: 13609 - protein, 9 aa, Homo sapiens
  Light chain CDR3 for antibody 6805 (IGKV3-20)
QQYGSSPWT

SEQ ID NO: 13610 - protein, 12 aa, Homo sapiens
  Heavy chain CDR3 for antibody 6805 (IGHV4-61)
ARVGSSGWYFDY

SEQ ID NO: 13611 - protein, 9 aa, Homo sapiens
  Light chain CDR3 for antibody 6806 (IGKV4-1)
QQYYSTPWT

SEQ ID NO: 13612 - protein, 13 aa, Homo sapiens
  Heavy chain CDR3 for antibody 6806 (IGHV3-53)
ARSGSYWGYYFDY

SEQ ID NO: 13613 - protein, 9 aa, Homo sapiens
  Light chain CDR3 for antibody 6807 (IGKV1-17)
LQHNSYPRT

SEQ ID NO: 13614 - protein, 10 aa, Homo sapiens
  Heavy chain CDR3 for antibody 6807 (IGHV1-46)
AREWELLFDY

SEQ ID NO: 13615 - protein, 9 aa, Homo sapiens
  Light chain CDR3 for antibody 6808 (IGKV5-2)
LQHDNFPYT

SEQ ID NO: 13616 - protein, 10 aa, Homo sapiens
  Heavy chain CDR3 for antibody 6808 (IGHV3-33)
ARDGLRYFDW

SEQ ID NO: 13617 - protein, 9 aa, Homo sapiens
  Light chain CDR3 for antibody 6809 (IGKV3D-7)
QQDYEFPIT

SEQ ID NO: 13618 - protein, 13 aa, Homo sapiens
  Heavy chain CDR3 for antibody 6809 (IGHV4-34)
ASNFYYYYYGMDV

SEQ ID NO: 13619 - protein, 10 aa, Homo sapiens
  Light chain CDR3 for antibody 6810 (IGKV1-17)
LQHNSYPMYT

SEQ ID NO: 13620 - protein, 15 aa, Homo sapiens
  Heavy chain CDR3 for antibody 6810 (IGHV3-33)
ARDRGWKAPGYGMDV

SEQ ID NO: 13621 - protein, 9 aa, Homo sapiens
  Light chain CDR3 for antibody 6811 (IGKV1D-13)
QQFNNYPHT

SEQ ID NO: 13622 - protein, 17 aa, Homo sapiens
  Heavy chain CDR3 for antibody 6811 (IGHV4-39)
ARDRDDILTGFYTYFDY

SEQ ID NO: 13623 - protein, 9 aa, Homo sapiens
  Light chain CDR3 for antibody 6812 (IGKV3-11)
QQRSNWPYT

SEQ ID NO: 13624 - protein, 17 aa, Homo sapiens
  Heavy chain CDR3 for antibody 6812 (IGHV1-24)
ATHYGSGSHYKGYGMDV

SEQ ID NO: 13625 - protein, 9 aa, Homo sapiens
  Light chain CDR3 for antibody 6813 (IGKV1-6)
LQDYNYPYT

SEQ ID NO: 13626 - protein, 16 aa, Homo sapiens
  Heavy chain CDR3 for antibody 6813 (IGHV3-33)
ARGSVSDILTGAYFDY

SEQ ID NO: 13627 - protein, 10 aa, Homo sapiens [sequence omitted]

SEQ ID NO: 13628 - protein, 18 aa, Homo sapiens
  Heavy chain CDR3 for antibody 6814 (IGHV4-39)
ARQYYFGSGNYYRGWFDP

SEQ ID NO: 13629 - protein, 9 aa, Homo sapiens
  Light chain CDR3 for antibody 6815 (IGKV1D-13)
QQFNNYPHT

SEQ ID NO: 13630 - protein, 17 aa, Homo sapiens
  Heavy chain CDR3 for antibody 6815 (IGHV4-39)
AGRLTYYYGSGSPSFDY

SEQ ID NO: 13631 - protein, 10 aa, Homo sapiens
  Light chain CDR3 for antibody 6816 (IGKV3-11)
QQRSNWPIFT

SEQ ID NO: 13632 - protein, 20 aa, Homo sapiens
  Heavy chain CDR3 for antibody 6816 (IGHV3-33)
ARDPAQLERRYYYFYYGMDV

SEQ ID NO: 13633 - protein, 9 aa, Homo sapiens
  Light chain CDR3 for antibody 6817 (IGKV1D-16)
QQYDSYPLT

SEQ ID NO: 13634 - protein, 15 aa, Homo sapiens
  Heavy chain CDR3 for antibody 6817 (IGHV3-33)
ARERYSSAWSSGMDV

SEQ ID NO: 13635 - protein, 9 aa, Homo sapiens
  Light chain CDR3 for antibody 6818 (IGKV2-30)
MQGTHWPLT

SEQ ID NO: 13636 - protein, 12 aa, Homo sapiens
  Heavy chain CDR3 for antibody 6818 (IGHV3-33)
ARDSSGWSHFDY

SEQ ID NO: 13637 - protein, 11 aa, Homo sapiens
  Light chain CDR3 for antibody 6819 (IGKV3-11)
QQRSNWPPTWT

SEQ ID NO: 13638 - protein, 13 aa, Homo sapiens
  Heavy chain CDR3 for antibody 6819 (IGHV3-33)
ARKAYGDYFYFDY

SEQ ID NO: 13639 - protein, 10 aa, Homo sapiens
  Light chain CDR3 for antibody 6820 (IGKV1-17)
LQHNSYPMYT

SEQ ID NO: 13640 - protein, 12 aa, Homo sapiens
  Heavy chain CDR3 for antibody 6820 (IGHV3-h)
AREDYYYYGMDV

SEQ ID NO: 13641 - protein, 9 aa, Homo sapiens
  Light chain CDR3 for antibody 6821 (IGKV1D-13)
QQFNNYPHT

SEQ ID NO: 13642 - protein, 14 aa, Homo sapiens
  Heavy chain CDR3 for antibody 6821 (IGHV3-23)
AKDRYRGYEGLFDY

SEQ ID NO: 13643 - protein, 9 aa, Homo sapiens
  Light chain CDR3 for antibody 6822 (IGKV4-1)
QQYYSTPPT

SEQ ID NO: 13644 - protein, 18 aa, Homo sapiens
  Heavy chain CDR3 for antibody 6822 (IGHV3-23)
ARYHLYFGSGFGSDGMDV

SEQ ID NO: 13645 - protein, 9 aa, Homo sapiens
  Light chain CDR3 for antibody 6823 (IGKV2D-28)
MQALQTPPT

SEQ ID NO: 13646 - protein, 17 aa, Homo sapiens
  Heavy chain CDR3 for antibody 6823 (IGHV3-23)
AKDGIGELSYYYYGMDV

SEQ ID NO: 13647 - protein, 9 aa, Homo sapiens
  Light chain CDR3 for antibody 6824 (IGKV1-9)
QQLISYPLT

SEQ ID NO: 13648 - protein, 11 aa, Homo sapiens
  Heavy chain CDR3 for antibody 6824 (IGHV3-23)
ARDPGSITGDY

SEQ ID NO: 13649 - protein, 9 aa, Homo sapiens
  Light chain CDR3 for antibody 6825 (IGKV3-11)
QQRSNWPLT

SEQ ID NO: 13650 - protein, 15 aa, Homo sapiens
  Heavy chain CDR3 for antibody 6825 (IGHV1-2)
ARDLGYYGSGSRMDV

SEQ ID NO: 13651 - protein, 8 aa, Homo sapiens
  Light chain CDR3 for antibody 6826 (IGKV3D-7)
QQDYNLLT

SEQ ID NO: 13652 - protein, 11 aa, Homo sapiens
  Heavy chain CDR3 for antibody 6826 (IGHV3-33)
ARDQGGSSFDY

SEQ ID NO: 13653 - protein, 8 aa, Homo sapiens
  Light chain CDR3 for antibody 6827 (IGKV1D-13)
QQFNNYPT

SEQ ID NO: 13654 - protein, 18 aa, Homo sapiens
  Heavy chain CDR3 for antibody 6827 (IGHV3-33)
ARDRDRYGSGTYPDAIDI

SEQ ID NO: 13655 - protein, 9 aa, Homo sapiens
  Light chain CDR3 for antibody 6828 (IGKV3D-7)
QQDYEFPIT

SEQ ID NO: 13656 - protein, 9 aa, Homo sapiens
  Heavy chain CDR3 for antibody 6828 (IGHV4-59)
AGGSWDFDY

SEQ ID NO: 13657 - protein, 9 aa, Homo sapiens
  Light chain CDR3 for antibody 6829 (IGKV3-11)
QQRSNWPPT

SEQ ID NO: 13658 - protein, 13 aa, Homo sapiens
  Heavy chain CDR3 for antibody 6829 (IGHV3-33)
ASGYSGYDWYFDL

SEQ ID NO: 13659 - protein, 9 aa, Homo sapiens
  Light chain CDR3 for antibody 6830 (IGKV1-9)
QQVKGYPYT

SEQ ID NO: 13660 - protein, 18 aa, Homo sapiens
  Heavy chain CDR3 for antibody 6830 (IGHV1-46)
ARDGDYVWGSYRSDWFDP

SEQ ID NO: 13661 - protein, 9 aa, Homo sapiens
  Light chain CDR3 for antibody 6831 (IGKV1-27)
QKYNSAPYT

SEQ ID NO: 13662 - protein, 14 aa, Homo sapiens
  Heavy chain CDR3 for antibody 6831 (IGHV3-23)
VRDRIAAASSDFDN

SEQ ID NO: 13663 - protein, 9 aa, Homo sapiens
  Light chain CDR3 for antibody 6832 (IGKV4-1)
QQYYSTPWT

SEQ ID NO: 13664 - protein, 14 aa, Homo sapiens
  Heavy chain CDR3 for antibody 6832 (IGHV3-33)
AREGYSSNWYDFDY

SEQ ID NO: 13665 - protein, 9 aa, Homo sapiens
  Light chain CDR3 for antibody 6833 (IGKV1D-16)
QQYNSYPFT

SEQ ID NO: 13666 - protein, 18 aa, Homo sapiens
  Heavy chain CDR3 for antibody 6833 (IGHV4-59)
AREGHYYTSGSYYKAFDY

SEQ ID NO: 13667 - protein, 9 aa, Homo sapiens
  Light chain CDR3 for antibody 6834 (IGKV1-39)
QQSYSTPYT

SEQ ID NO: 13668 - protein, 12 aa, Homo sapiens
  Heavy chain CDR3 for antibody 6834 (IGHV4-39)
ARHPRYLDAFDI

SEQ ID NO: 13669 - protein, 9 aa, Homo sapiens
  Light chain CDR3 for antibody 6835 (IGKV5-2)
LQHDNFPWT

SEQ ID NO: 13670 - protein, 16 aa, Homo sapiens
  Heavy chain CDR3 for antibody 6835 (IGHV4-59)
AREPLRYFDWPDAFDI

SEQ ID NO: 13671 - protein, 9 aa, Homo sapiens
  Light chain CDR3 for antibody 6836 (IGKV2-30)
MQGTHWPLT

SEQ ID NO: 13672 - protein, 12 aa, Homo sapiens
  Heavy chain CDR3 for antibody 6836 (IGHV1-18)
AGVLFDGDYSDY

SEQ ID NO: 13673 - protein, 10 aa, Homo sapiens
  Light chain CDR3 for antibody 6837 (IGKV1-39)
QQSYSTPMYT

SEQ ID NO: 13674 - protein, 13 aa, Homo sapiens
  Heavy chain CDR3 for antibody 6837 (IGHV3-33)
ARVDTMVRGVMAY

SEQ ID NO: 13675 - protein, 8 aa, Homo sapiens
  Light chain CDR3 for antibody 6838 (IGKV3-20)
QQYGSSLT

SEQ ID NO: 13676 - protein, 14 aa, Homo sapiens
  Heavy chain CDR3 for antibody 6838 (IGHV3-33)
ARATSGSSYWYFDL

SEQ ID NO: 13677 - protein, 9 aa, Homo sapiens
  Light chain CDR3 for antibody 6839 (IGKV1-27)
QKYNSAPYT

SEQ ID NO: 13678 - protein, 12 aa, Homo sapiens
  Heavy chain CDR3 for antibody 6839 (IGHV4-61)
ARVDSSGWYFDY

SEQ ID NO: 13679 - protein, 10 aa, Homo sapiens
  Light chain CDR3 for antibody 6840 (IGKV3-11)
QQRSNWPIFT

SEQ ID NO: 13680 - protein, 13 aa, Homo sapiens
  Heavy chain CDR3 for antibody 6840 (IGHV3-33)
ARGVLWFGELFDY

SEQ ID NO: 13681 - protein, 9 aa, Homo sapiens
  Light chain CDR3 for antibody 6841 (IGKV1-39)
QQSYSTPLT

SEQ ID NO: 13682 - protein, 13 aa, Homo sapiens
  Heavy chain CDR3 for antibody 6841 (IGHV3-64)
AREYFDWLLPLDY

SEQ ID NO: 13683 - protein, 9 aa, Homo sapiens
  Light chain CDR3 for antibody 6842 (IGKV6-21)
HQSSSLPYT

SEQ ID NO: 13684 - protein, 14 aa, Homo sapiens
  Heavy chain CDR3 for antibody 6842 (IGHV3-20)
AREGWFGDYYGMDV

SEQ ID NO: 13685 - protein, 9 aa, Homo sapiens
  Light chain CDR3 for antibody 6843 (IGKV1-17)
LQHNSYPRT

SEQ ID NO: 13686 - protein, 18 aa, Homo sapiens
  Heavy chain CDR3 for antibody 6843 (IGHV3-33)
ARGYNQGSGSYYNVCFDY

SEQ ID NO: 13687 - protein, 9 aa, Homo sapiens
  Light chain CDR3 for antibody 6844 (IGKV1-6)
LQDYNYPWT

SEQ ID NO: 13688 - protein, 18 aa, Homo sapiens
  Heavy chain CDR3 for antibody 6844 (IGHV3-33)
ARGAYSSGWDYYYYGLDV

SEQ ID NO: 13689 - protein, 9 aa, Homo sapiens
  Light chain CDR3 for antibody 6845 (IGKV1D-16)
QQYNSYPYT

SEQ ID NO: 13690 - protein, 18 aa, Homo sapiens
  Heavy chain CDR3 for antibody 6845 (IGHV3-33)
AREAIVVVPAAPYYGMDV

SEQ ID NO: 13691 - protein, 9 aa, Homo sapiens
  Light chain CDR3 for antibody 6846 (IGKV1-6)
LQDYNYPRT

SEQ ID NO: 13692 - protein, 7 aa, Homo sapiens
  Heavy chain CDR3 for antibody 6846 (IGHV3-33)
AREGDIL

SEQ ID NO: 13693 - protein, 10 aa, Homo sapiens
  Light chain CDR3 for antibody 6847 (IGKV3-20)
QQYGRSPPVT

SEQ ID NO: 13694 - protein, 15 aa, Homo sapiens
  Heavy chain CDR3 for antibody 6847 (IGHV3-23)
AKDGSYYDYYYGMDV

SEQ ID NO: 13695 - protein, 9 aa, Homo sapiens
  Light chain CDR3 for antibody 6848 (IGKV2-30)
MQGTHWPLT

SEQ ID NO: 13696 - protein, 17 aa, Homo sapiens
  Heavy chain CDR3 for antibody 6848 (IGHV4-34)
AGLRFFDWLFDYYGMDV

SEQ ID NO: 13697 - protein, 8 aa, Homo sapiens
  Light chain CDR3 for antibody 6849 (IGKV3-11)
QQRSNWLT

SEQ ID NO: 13698 - protein, 12 aa, Homo sapiens
  Heavy chain CDR3 for antibody 6849 (IGHV1-8)
ARGYFGSGYAHF

SEQ ID NO: 13699 - protein, 9 aa, Homo sapiens
  Light chain CDR3 for antibody 6850 (IGKV1-6)
LQDYKSPFT

SEQ ID NO: 13700 - protein, 12 aa, Homo sapiens
  Heavy chain CDR3 for antibody 6850 (IGHV4-39)
ARHGSGSSYFDY

SEQ ID NO: 13701 - protein, 9 aa, Homo sapiens
  Light chain CDR3 for antibody 6851 (IGKV1D-13)
QHFNNYMYT

SEQ ID NO: 13702 - protein, 15 aa, Homo sapiens
  Heavy chain CDR3 for antibody 6851 (IGHV3-33)
ARDHLTGYYYYGMDV

SEQ ID NO: 13703 - protein, 9 aa, Homo sapiens
  Light chain CDR3 for antibody 6852 (IGKV1-13)
QQLKSYPYT

SEQ ID NO: 13704 - protein, 18 aa, Homo sapiens
  Heavy chain CDR3 for antibody 6852 (IGHV3-33)
ARGLLWFGVSYYYYGMDV

SEQ ID NO: 13705 - protein, 9 aa, Homo sapiens
  Light chain CDR3 for antibody 6853 (IGKV5-2)
LQHDKFPYT

SEQ ID NO: 13706 - protein, 18 aa, Homo sapiens
  Heavy chain CDR3 for antibody 6853 (IGHV3-33)
ARREGIVGATTYYYGMDV

SEQ ID NO: 13707 - protein, 9 aa, Homo sapiens
  Light chain CDR3 for antibody 6854 (IGKV2-30)
MQGTHWPYT

SEQ ID NO: 13708 - protein, 17 aa, Homo sapiens
  Heavy chain CDR3 for antibody 6854 (IGHV4-39)
ARVLRYFDWLSHDAFDI

SEQ ID NO: 13709 - protein, 10 aa, Homo sapiens
  Light chain CDR3 for antibody 6855 (IGKV1-9)
QQLDSYPMYT

SEQ ID NO: 13710 - protein, 20 aa, Homo sapiens
  Heavy chain CDR3 for antibody 6855 (IGHV3-20)
ARDLCSSTSCYGYYYYGMDV

SEQ ID NO: 13711 - protein, 9 aa, Homo sapiens
  Light chain CDR3 for antibody 6856 (IGKV1-5)
QQYNSYPYT

SEQ ID NO: 13712 - protein, 14 aa, Homo sapiens
  Heavy chain CDR3 for antibody 6856 (IGHV4-39)
ARQGTMIRGGYFDY

SEQ ID NO: 13713 - protein, 9 aa, Homo sapiens
  Light chain CDR3 for antibody 6857 (IGKV1-9)
QQLNGYPFT

SEQ ID NO: 13714 - protein, 8 aa, Homo sapiens
  Heavy chain CDR3 for antibody 6857 (IGHV3-23)
AKETGNNY

SEQ ID NO: 13715 - protein, 10 aa, Homo sapiens
  Light chain CDR3 for antibody 6858 (IGKV1D-17)
LQHNSYPMYT

SEQ ID NO: 13716 - protein, 7 aa, Homo sapiens
  Heavy chain CDR3 for antibody 6858 (IGHV1-46)
AREGGDY

SEQ ID NO: 13717 - protein, 10 aa, Homo sapiens
  Light chain CDR3 for antibody 6859 (IGKV1-39)
QQSYSTPMYT

SEQ ID NO: 13718 - protein, 9 aa, Homo sapiens
  Heavy chain CDR3 for antibody 6859 (IGHV1-8)
ARGRLDFDY

SEQ ID NO: 13719 - protein, 9 aa, Homo sapiens
  Light chain CDR3 for antibody 6860 (IGKV1D-16)
QQYNSYPLT

SEQ ID NO: 13720 - protein, 11 aa, Homo sapiens
  Heavy chain CDR3 for antibody 6860 (IGHV3-33)
ARDRGYSYFDY

SEQ ID NO: 13721 - protein, 9 aa, Homo sapiens
  Light chain CDR3 for antibody 6861 (IGKV3D-7)
QQDYNLPFT

SEQ ID NO: 13722 - protein, 15 aa, Homo sapiens
  Heavy chain CDR3 for antibody 6861 (IGHV3-64)
ARDGLRYFDWLFPWY

SEQ ID NO: 13723 - protein, 9 aa, Homo sapiens
  Light chain CDR3 for antibody 6862 (IGKV1-16)
QQYNSYPLT

SEQ ID NO: 13724 - protein, 13 aa, Homo sapiens
  Heavy chain CDR3 for antibody 6862 (IGHV3-33)
ARGRGYNYGYGDY

SEQ ID NO: 13725 - protein, 9 aa, Homo sapiens
  Light chain CDR3 for antibody 6863 (IGKV6-21)
HQSSSLPHT

SEQ ID NO: 13726 - protein, 12 aa, Homo sapiens
  Heavy chain CDR3 for antibody 6863 (IGHV4-39)
ARHGSGSSYFEY

SEQ ID NO: 13727 - protein, 9 aa, Homo sapiens
  Light chain CDR3 for antibody 6864 (IGKV3D-20)
QQYGRSPRT

SEQ ID NO: 13728 - protein, 13 aa, Homo sapiens
  Heavy chain CDR3 for antibody 6864 (IGHV3-53)
ARSGSYWGYYFDY

SEQ ID NO: 13729 - protein, 10 aa, Homo sapiens
  Light chain CDR3 for antibody 6865 (IGKV1-17)
LQHNSYPMYT

SEQ ID NO: 13730 - protein, 21 aa, Homo sapiens
  Heavy chain CDR3 for antibody 6865 (IGHV3-33)
ARDEYYEIVTGYGYYHYGMDV

SEQ ID NO: 13731 - protein, 9 aa, Homo sapiens
  Light chain CDR3 for antibody 6866 (IGKV1-6)
LQDYNYPYT

SEQ ID NO: 13732 - protein, 19 aa, Homo sapiens
  Heavy chain CDR3 for antibody 6866 (IGHV3-33)
ARDKYYDILTGYPWNGMDV

SEQ ID NO: 13733 - protein, 10 aa, Homo sapiens
  Light chain CDR3 for antibody 6867 (IGKV1-39)
QQSYSTPMYT

SEQ ID NO: 13734 - protein, 13 aa, Homo sapiens
  Heavy chain CDR3 for antibody 6867 (IGHV3-33)
ARRYRSGWYPFDY

SEQ ID NO: 13735 - protein, 9 aa, Homo sapiens
  Light chain CDR3 for antibody 6868 (IGKV2-30)
MQGTHWPLT

SEQ ID NO: 13736 - protein, 14 aa, Homo sapiens
  Heavy chain CDR3 for antibody 6868 (IGHV1-46)
ARDGVGAKEGGFDY

SEQ ID NO: 13737 - protein, 8 aa, Homo sapiens
  Light chain CDR3 for antibody 6869 (IGKV1D-13)
QQFNNYPT

SEQ ID NO: 13738 - protein, 18 aa, Homo sapiens
  Heavy chain CDR3 for antibody 6869 (IGHV3-33)
VRDRERYGSGSYPDAFDI

SEQ ID NO: 13739 - protein, 9 aa, Homo sapiens
  Light chain CDR3 for antibody 6870 (IGKV3D-20)
QQYGSSPYT

SEQ ID NO: 13740 - protein, 22 aa, Homo sapiens
  Heavy chain CDR3 for antibody 6870 (IGHV3-11)
AREAYYDILTGYYTGYYYGMDV

SEQ ID NO: 13741 - protein, 9 aa, Homo sapiens
  Light chain CDR3 for antibody 6871 (IGKV3-11)
QQRSNWMYT

SEQ ID NO: 13742 - protein, 11 aa, Homo sapiens
  Heavy chain CDR3 for antibody 6871 (IGHV3-33)
ARAGIAAVFDY

SEQ ID NO: 13743 - protein, 9 aa, Homo sapiens
  Light chain CDR3 for antibody 6872 (IGKV3-20)
QQYGSSPYT

SEQ ID NO: 13744 - protein, 15 aa, Homo sapiens
  Heavy chain CDR3 for antibody 6872 (IGHV3-33)
AKGGTMVRGVIAFDY

SEQ ID NO: 13745 - protein, 9 aa, Homo sapiens
  Light chain CDR3 for antibody 6873 (IGKV3D-7)
QQDYNLPYT

SEQ ID NO: 13746 - protein, 14 aa, Homo sapiens
  Heavy chain CDR3 for antibody 6873 (IGHV3-33)
VSAISGSSYWYFAL

SEQ ID NO: 13747 - protein, 9 aa, Homo sapiens
  Light chain CDR3 for antibody 6874 (IGKV1-17)
LHSNNYPWT

SEQ ID NO: 13748 - protein, 14 aa, Homo sapiens
  Heavy chain CDR3 for antibody 6874 (IGHV3-33)
ARDWNDVYYYGMDV

SEQ ID NO: 13749 - protein, 9 aa, Homo sapiens
  Light chain CDR3 for antibody 6875 (IGKV2D-28)
MQVLQTPFT

SEQ ID NO: 13750 - protein, 13 aa, Homo sapiens
  Heavy chain CDR3 for antibody 6875 (IGHV4-59)
ARTMVRGVAPFDY

SEQ ID NO: 13751 - protein, 9 aa, Homo sapiens
  Light chain CDR3 for antibody 6876 (IGKV2-30)
MQGTHWPLT

SEQ ID NO: 13752 - protein, 13 aa, Homo sapiens
  Heavy chain CDR3 for antibody 6876 (IGHV4-59)
ANRDYYGYYGMDV

SEQ ID NO: 13753 - protein, 10 aa, Homo sapiens
  Light chain CDR3 for antibody 6877 (IGKV1-17)
LQHNSYPMYT

SEQ ID NO: 13754 - protein, 16 aa, Homo sapiens
  Heavy chain CDR3 for antibody 6877 (IGHV3-13)
ARDRSYESYYYYGMDV

SEQ ID NO: 13755 - protein, 10 aa, Homo sapiens
  Light chain CDR3 for antibody 6878 (IGKV1-9)
QQLDSYPMYT

SEQ ID NO: 13756 - protein, 13 aa, Homo sapiens
  Heavy chain CDR3 for antibody 6878 (IGHV3-11)
ARDEGYRGYVLDT

SEQ ID NO: 13757 - protein, 10 aa, Homo sapiens
  Light chain CDR3 for antibody 6879 (IGKV3-11)
QQRSNWPALT

SEQ ID NO: 13758 - protein, 11 aa, Homo sapiens
  Heavy chain CDR3 for antibody 6879 (IGHV4-59)
ARSLRYSFFDY

SEQ ID NO: 13759 - protein, 9 aa, Homo sapiens
  Light chain CDR3 for antibody 6880 (IGKV1-17)
QRFNNYMYT

SEQ ID NO: 13760 - protein, 14 aa, Homo sapiens
  Heavy chain CDR3 for antibody 6880 (IGHV4-39)
ARRGVVVPPGGMDV

SEQ ID NO: 13761 - protein, 9 aa, Homo sapiens
  Light chain CDR3 for antibody 6881 (IGKV3-20)
QQYGSSPYT

SEQ ID NO: 13762 - protein, 13 aa, Homo sapiens
  Heavy chain CDR3 for antibody 6881 (IGHV3-33)
AKCIVAAIGGFDY

SEQ ID NO: 13763 - protein, 9 aa, Homo sapiens
  Light chain CDR3 for antibody 6882 (IGKV1D-13)
QQFNNYPYT

SEQ ID NO: 13764 - protein, 15 aa, Homo sapiens
  Heavy chain CDR3 for antibody 6882 (IGHV3-33)
AKGGTMVRGVIAFDY

SEQ ID NO: 13765 - protein, 8 aa, Homo sapiens
  Light chain CDR3 for antibody 6883 (IGKV3D-7)
QQDYNLLT

SEQ ID NO: 13766 - protein, 12 aa, Homo sapiens
  Heavy chain CDR3 for antibody 6883 (IGHV3-33)
ARKGYDMHEFDI

SEQ ID NO: 13767 - protein, 8 aa, Homo sapiens
  Light chain CDR3 for antibody 6884 (IGKV1-5)
QQYNSYWT

SEQ ID NO: 13768 - protein, 13 aa, Homo sapiens
  Heavy chain CDR3 for antibody 6884 (IGHV3-66)
ANTGDSYYYGFYV

SEQ ID NO: 13769 - protein, 9 aa, Homo sapiens
  Light chain CDR3 for antibody 6885 (IGKV2-30)
MQGTHWPLT

SEQ ID NO: 13770 - protein, 15 aa, Homo sapiens
  Heavy chain CDR3 for antibody 6885 (IGHV4-39)
ARRDYDISTGYLFDY

SEQ ID NO: 13771 - protein, 10 aa, Homo sapiens
  Light chain CDR3 for antibody 6886 (IGKV3-11)
QQRSNWPALT

SEQ ID NO: 13772 - protein, 17 aa, Homo sapiens
  Heavy chain CDR3 for antibody 6886 (IGHV3-33)
ARVRGVIEGYYYYGMDV

SEQ ID NO: 13773 - protein, 9 aa, Homo sapiens
  Light chain CDR3 for antibody 6887 (IGKV1D-16)
QQYITYPYT

SEQ ID NO: 13774 - protein, 15 aa, Homo sapiens
  Heavy chain CDR3 for antibody 6887 (IGHV3-23)
AKDGSYYDYYYGMDV

SEQ ID NO: 13775 - protein, 9 aa, Homo sapiens
  Light chain CDR3 for antibody 6888 (IGKV3-11)
QQRSNWPWT

SEQ ID NO: 13776 - protein, 17 aa, Homo sapiens
  Heavy chain CDR3 for antibody 6888 (IGHV3-33)
ARGGGYENDHYYYGMDV

SEQ ID NO: 13777 - protein, 9 aa, Homo sapiens
  Light chain CDR3 for antibody 6889 (IGKV6-21)
HQSSSLPYT

SEQ ID NO: 13778 - protein, 15 aa, Homo sapiens
  Heavy chain CDR3 for antibody 6889 (IGHV3-33)
ARGGTGYYSYWYFDL

SEQ ID NO: 13779 - protein, 11 aa, Homo sapiens
  Light chain CDR3 for antibody 6890 (IGKV3-11)
QQRSNWPPTWT

SEQ ID NO: 13780 - protein, 12 aa, Homo sapiens
  Heavy chain CDR3 for antibody 6890 (IGHV3-23)
AKDGWFGESLDY

SEQ ID NO: 13781 - protein, 9 aa, Homo sapiens
  Light chain CDR3 for antibody 6891 (IGKV1-6)
LQDYNYPWT

SEQ ID NO: 13782 - protein, 16 aa, Homo sapiens
  Heavy chain CDR3 for antibody 6891 (IGHV3-33)
AREVGAKDYYYYGMDV

SEQ ID NO: 13783 - protein, 9 aa, Homo sapiens
  Light chain CDR3 for antibody 6892 (IGKV6-21)
HQSSSLPYT

SEQ ID NO: 13784 - protein, 11 aa, Homo sapiens
  Heavy chain CDR3 for antibody 6892 (IGHV4-59)
ARESFYGSGNL

SEQ ID NO: 13785 - protein, 8 aa, Homo sapiens
  Light chain CDR3 for antibody 6893 (IGKV1-5)
QQYNSYWT

SEQ ID NO: 13786 - protein, 18 aa, Homo sapiens
  Heavy chain CDR3 for antibody 6893 (IGHV3-23)
AKDRITGTTYGYYSGLDV

SEQ ID NO: 13787 - protein, 8 aa, Homo sapiens
  Light chain CDR3 for antibody 6894 (IGKV3D-7)
QQDYNLLT

SEQ ID NO: 13788 - protein, 12 aa, Homo sapiens
  Heavy chain CDR3 for antibody 6894 (IGHV3-33)
ARVDTAAPYFDY

SEQ ID NO: 13789 - protein, 9 aa, Homo sapiens
  Light chain CDR3 for antibody 6895 (IGKV1-33)
QQYDNLPFT

SEQ ID NO: 13790 - protein, 12 aa, Homo sapiens
  Heavy chain CDR3 for antibody 6895 (IGHV3-33)
ARDPGYYYGLDV

SEQ ID NO: 13791 - protein, 8 aa, Homo sapiens
  Light chain CDR3 for antibody 6896 (IGKV3D-7)
QQDYNLLT

SEQ ID NO: 13792 - protein, 13 aa, Homo sapiens
  Heavy chain CDR3 for antibody 6896 (IGHV3-33)
AKEDGDYHHYFDY

SEQ ID NO: 13793 - protein, 9 aa, Homo sapiens
  Light chain CDR3 for antibody 6897 (IGKV6-21)
HQSSSLPYT

SEQ ID NO: 13794 - protein, 14 aa, Homo sapiens
  Heavy chain CDR3 for antibody 6897 (IGHV3-20)
ARNGGSTWYDWFDP

SEQ ID NO: 13795 - protein, 8 aa, Homo sapiens
  Light chain CDR3 for antibody 6898 (IGKV3D-7)
QQDYNLLT

SEQ ID NO: 13796 - protein, 16 aa, Homo sapiens
  Heavy chain CDR3 for antibody 6898 (IGHV1-8)
AREGTMVRGVTYAFDI

SEQ ID NO: 13797 - protein, 8 aa, Homo sapiens
  Light chain CDR3 for antibody 6899 (IGKV1-5)
QQYNSYYT

SEQ ID NO: 13798 - protein, 22 aa, Homo sapiens
  Heavy chain CDR3 for antibody 6899 (IGHV4-59)
AREINYGSGSYYNEDYYYGMDV

SEQ ID NO: 13799 - protein, 9 aa, Homo sapiens
  Light chain CDR3 for antibody 6900 (IGKV1-17)
LQHNSYPRT

SEQ ID NO: 13800 - protein, 12 aa, Homo sapiens
  Heavy chain CDR3 for antibody 6900 (IGHV3-33)
AREFPWGDYFDY

SEQ ID NO: 13801 - protein, 6 aa, Homo sapiens
  Light chain CDR3 for antibody 6901 (IGKV3-20)
QQYGST

SEQ ID NO: 13802 - protein, 15 aa, Homo sapiens
  Heavy chain CDR3 for antibody 6901 (IGHV3-30)
ARGAMVRGVDYGMDV

SEQ ID NO: 13803 - protein, 9 aa, Homo sapiens
  Light chain CDR3 for antibody 6902 (IGKV1-6)
LQDYKSPFT

SEQ ID NO: 13804 - protein, 14 aa, Homo sapiens
  Heavy chain CDR3 for antibody 6902 (IGHV3-33)
VRDAMGATTAWFDP

SEQ ID NO: 13805 - protein, 9 aa, Homo sapiens
  Light chain CDR3 for antibody 6903 (IGKV3-11)
QQRSNWPPT

SEQ ID NO: 13806 - protein, 12 aa, Homo sapiens
  Heavy chain CDR3 for antibody 6903 (IGHV1-46)
ARAGMGAPYFDY

SEQ ID NO: 13807 - protein, 9 aa, Homo sapiens
  Light chain CDR3 for antibody 6904 (IGKV1-39)
QQSYSTPLT

SEQ ID NO: 13808 - protein, 18 aa, Homo sapiens
  Heavy chain CDR3 for antibody 6904 (IGHV3-33)
ARDGRISLVRGIIDAFDI

SEQ ID NO: 13809 - protein, 9 aa, Homo sapiens
  Light chain CDR3 for antibody 6905 (IGKV1D-13)
QHFNNYMYT

SEQ ID NO: 13810 - protein, 17 aa, Homo sapiens
  Heavy chain CDR3 for antibody 6905 (IGHV4-59)
ARDFLVRGEGSYYGMDV

SEQ ID NO: 13811 - protein, 9 aa, Homo sapiens
  Light chain CDR3 for antibody 6906 (IGKV1-33)
QQYDNLPFT

SEQ ID NO: 13812 - protein, 15 aa, Homo sapiens
  Heavy chain CDR3 for antibody 6906 (IGHV3-33)
ARDRGWKAPGYGMDV

SEQ ID NO: 13813 - protein, 8 aa, Homo sapiens
  Light chain CDR3 for antibody 6907 (IGKV3D-7)
QQDYNLVT

SEQ ID NO: 13814 - protein, 13 aa, Homo sapiens
  Heavy chain CDR3 for antibody 6907 (IGHV4-39)
ARRDGSYYGYFDY

SEQ ID NO: 13815 - protein, 9 aa, Homo sapiens
  Light chain CDR3 for antibody 6908 (IGKV5-2)
LQHDNFPYT

SEQ ID NO: 13816 - protein, 14 aa, Homo sapiens
  Heavy chain CDR3 for antibody 6908 (IGHV1-2)
AREGGSGSSPGMDV

SEQ ID NO: 13817 - protein, 9 aa, Homo sapiens
  Light chain CDR3 for antibody 6909 (IGKV1-27)
QKYNSAPYT

SEQ ID NO: 13818 - protein, 14 aa, Homo sapiens
  Heavy chain CDR3 for antibody 6909 (IGHV4-39)
ARQGTMIRGGYFDY

SEQ ID NO: 13819 - protein, 8 aa, Homo sapiens
  Light chain CDR3 for antibody 6910 (IGKV3-11)
QQRSNWLT

SEQ ID NO: 13820 - protein, 15 aa, Homo sapiens
  Heavy chain CDR3 for antibody 6910 (IGHV3-20)
ARDRGSSGWRDWFDP

SEQ ID NO: 13821 - protein, 9 aa, Homo sapiens
  Light chain CDR3 for antibody 6911 (IGKV1-16)
QQYNSYPLT

SEQ ID NO: 13822 - protein, 13 aa, Homo sapiens
  Heavy chain CDR3 for antibody 6911 (IGHV3-33)
AKRYSSGWYPFDF

SEQ ID NO: 13823 - protein, 9 aa, Homo sapiens
  Light chain CDR3 for antibody 6912 (IGKV1D-13)
QRFNNYLYT

SEQ ID NO: 13824 - protein, 12 aa, Homo sapiens
  Heavy chain CDR3 for antibody 6912 (IGHV3-33)
ARGYFGSGYAHF

SEQ ID NO: 13825 - protein, 9 aa, Homo sapiens
  Light chain CDR3 for antibody 6913 (IGKV1-16)
QHYNDYPFT

SEQ ID NO: 13826 - protein, 14 aa, Homo sapiens
  Heavy chain CDR3 for antibody 6913 (IGHV3-33)
ARDKTYPLSYGMDV

SEQ ID NO: 13827 - protein, 9 aa, Homo sapiens
  Light chain CDR3 for antibody 6914 (IGKV1-39)
QQSYRTPLT

SEQ ID NO: 13828 - protein, 15 aa, Homo sapiens
  Heavy chain CDR3 for antibody 6914 (IGHV3-23)
AKDGFYYGSGSSFDH

SEQ ID NO: 13829 - protein, 9 aa, Homo sapiens
  Light chain CDR3 for antibody 6915 (IGKV1-17)
LQHNSFPLT

SEQ ID NO: 13830 - protein, 20 aa, Homo sapiens
  Heavy chain CDR3 for antibody 6915 (IGHV3-33)
ARDRCSSTSCYGYYYYGMDV

SEQ ID NO: 13831 - protein, 9 aa, Homo sapiens
  Light chain CDR3 for antibody 6916 (IGKV3D-7)
QQDYTLPLT

SEQ ID NO: 13832 - protein, 13 aa, Homo sapiens
  Heavy chain CDR3 for antibody 6916 (IGHV4-39)
ARHEVMVRGVFDY

SEQ ID NO: 13833 - protein, 9 aa, Homo sapiens
  Light chain CDR3 for antibody 6917 (IGKV6-21)
HQSSSLPYT

SEQ ID NO: 13834 - protein, 9 aa, Homo sapiens
  Heavy chain CDR3 for antibody 6917 (IGHV1-18)
ARGNTWFDY

SEQ ID NO: 13835 - protein, 9 aa, Homo sapiens
  Light chain CDR3 for antibody 6918 (IGKV1D-16)
QQYYSYPRT

SEQ ID NO: 13836 - protein, 20 aa, Homo sapiens
  Heavy chain CDR3 for antibody 6918 (IGHV3-20)
ARDLCSSTSCYGYYYYGMDV

SEQ ID NO: 13837 - protein, 9 aa, Homo sapiens
  Light chain CDR3 for antibody 6919 (IGKV1-39)
QQSYRTPLT

SEQ ID NO: 13838 - protein, 18 aa, Homo sapiens
  Heavy chain CDR3 for antibody 6919 (IGHV4-59)
AREGDYVWGSYRPNWFDP

SEQ ID NO: 13839 - protein, 9 aa, Homo sapiens
  Light chain CDR3 for antibody 6920 (IGKV1-6)
LQDYNYPRT

SEQ ID NO: 13840 - protein, 22 aa, Homo sapiens
  Heavy chain CDR3 for antibody 6920 (IGHV3-33)
ARMYYDILTGYYKDYYYYGMDA

SEQ ID NO: 13841 - protein, 9 aa, Homo sapiens
  Light chain CDR3 for antibody 6921 (IGKV1D-13)
QQFNNYPST

SEQ ID NO: 13842 - protein, 12 aa, Homo sapiens
  Heavy chain CDR3 for antibody 6921 (IGHV3-33)
ARKQWLVQAFDI

SEQ ID NO: 13843 - protein, 6 aa, Homo sapiens
  Light chain CDR3 for antibody 6922 (IGKV3-20)
QQYGST

SEQ ID NO: 13844 - protein, 11 aa, Homo sapiens
  Heavy chain CDR3 for antibody 6922 (IGHV4-59)
AREMGHDTFDI

SEQ ID NO: 13845 - protein, 9 aa, Homo sapiens
  Light chain CDR3 for antibody 6923 (IGKV1-9)
QQLISYPLT

SEQ ID NO: 13846 - protein, 18 aa, Homo sapiens
  Heavy chain CDR3 for antibody 6923 (IGHV3-33)
ARDQYSGYDFYYYYGMDV

SEQ ID NO: 13847 - protein, 9 aa, Homo sapiens
  Light chain CDR3 for antibody 6924 (IGKV5-2)
LQHDNFPYT

SEQ ID NO: 13848 - protein, 14 aa, Homo sapiens
  Heavy chain CDR3 for antibody 6924 (IGHV3-23)
AKDPRGYYYYGMDV

SEQ ID NO: 13849 - protein, 9 aa, Homo sapiens
  Light chain CDR3 for antibody 6925 (IGKV3-15)
QQYNNWPRT

SEQ ID NO: 13850 - protein, 20 aa, Homo sapiens
  Heavy chain CDR3 for antibody 6925 (IGHV3-33)
ARDWMVRGVIITDYYYGMDV

SEQ ID NO: 13851 - protein, 9 aa, Homo sapiens
  Light chain CDR3 for antibody 6926 (IGKV1-39)
QQSYSTPLT

SEQ ID NO: 13852 - protein, 13 aa, Homo sapiens
  Heavy chain CDR3 for antibody 6926 (IGHV3-33)
ARALYSSSWPGDY

SEQ ID NO: 13853 - protein, 9 aa, Homo sapiens
  Light chain CDR3 for antibody 6927 (IGKV1-9)
QQGNTYSRT

SEQ ID NO: 13854 - protein, 13 aa, Homo sapiens
  Heavy chain CDR3 for antibody 6927 (IGHV4-59)
ARTMVRGVAPFDY

SEQ ID NO: 13855 - protein, 9 aa, Homo sapiens
  Light chain CDR3 for antibody 6928 (IGKV1-27)
QKYNSAPYT

SEQ ID NO: 13856 - protein, 24 aa, Homo sapiens
  Heavy chain CDR3 for antibody 6928 (IGHV1-46)
ARDEARGLLTGYYNMREYYYGMDV

SEQ ID NO: 13857 - protein, 9 aa, Homo sapiens
  Light chain CDR3 for antibody 6929 (IGKV1-6)
LQDYNYPRT

SEQ ID NO: 13858 - protein, 18 aa, Homo sapiens
  Heavy chain CDR3 for antibody 6929 (IGHV3-33)
AREAIVVVPAAPYYGMDV

SEQ ID NO: 13859 - protein, 9 aa, Homo sapiens
  Light chain CDR3 for antibody 6930 (IGKV3-11)
QQRSNWMYT

SEQ ID NO: 13860 - protein, 18 aa, Homo sapiens
  Heavy chain CDR3 for antibody 6930 (IGHV3-23)
AKEGNYYGSGSYWGYFDP

SEQ ID NO: 13861 - protein, 9 aa, Homo sapiens
  Light chain CDR3 for antibody 6931 (IGKV6-21)
HQSSSLPYT

SEQ ID NO: 13862 - protein, 18 aa, Homo sapiens
  Heavy chain CDR3 for antibody 6931 (IGHV1-24)
ATGLRYFDWPIISDLFDY

SEQ ID NO: 13863 - protein, 11 aa, Homo sapiens
  Light chain CDR3 for antibody 6932 (IGKV3-11)
QQRSNWPPTWT

SEQ ID NO: 13864 - protein, 14 aa, Homo sapiens
  Heavy chain CDR3 for antibody 6932 (IGHV3-33)
ARDREQQLVRYFDY

SEQ ID NO: 13865 - protein, 9 aa, Homo sapiens
  Light chain CDR3 for antibody 6933 (IGKV2-30)
MQGTHWPLT

SEQ ID NO: 13866 - protein, 13 aa, Homo sapiens
  Heavy chain CDR3 for antibody 6933 (IGHV3-33)
ARDSSSWYHWFDP

SEQ ID NO: 13867 - protein, 10 aa, Homo sapiens
  Light chain CDR3 for antibody 6934 (IGKV3-11)
QQRSNWPIFT

SEQ ID NO: 13868 - protein, 17 aa, Homo sapiens
  Heavy chain CDR3 for antibody 6934 (IGHV3-23)
SKERNWNDGYYYFGMDA

SEQ ID NO: 13869 - protein, 9 aa, Homo sapiens
  Light chain CDR3 for antibody 6935 (IGKV2-30)
MQGTHWPLT

SEQ ID NO: 13870 - protein, 16 aa, Homo sapiens
  Heavy chain CDR3 for antibody 6935 (IGHV3-33)
AKDAFYYGSGSHLFDY

SEQ ID NO: 13871 - protein, 9 aa, Homo sapiens
  Light chain CDR3 for antibody 6936 (IGKV1-27)
QKYNSAPYT

SEQ ID NO: 13872 - protein, 17 aa, Homo sapiens
  Heavy chain CDR3 for antibody 6936 (IGHV4-59)
ARRITMVREIIITAFDY

SEQ ID NO: 13873 - protein, 9 aa, Homo sapiens
  Light chain CDR3 for antibody 6937 (IGKV3D-7)
QQDYNLPLT

SEQ ID NO: 13874 - protein, 13 aa, Homo sapiens
  Heavy chain CDR3 for antibody 6937 (IGHV3-23)
AKDRGLRYYGMDV

SEQ ID NO: 13875 - protein, 9 aa, Homo sapiens
  Light chain CDR3 for antibody 6938 (IGKV1-6)
LQDYKSPFT

SEQ ID NO: 13876 - protein, 17 aa, Homo sapiens
  Heavy chain CDR3 for antibody 6938 (IGHV3-23)
AKDGIGELSYYYYGMDV

SEQ ID NO: 13877 - protein, 9 aa, Homo sapiens
  Light chain CDR3 for antibody 6939 (IGKV3D-7)
QQDYEFPIT

SEQ ID NO: 13878 - protein, 13 aa, Homo sapiens
  Heavy chain CDR3 for antibody 6939 (IGHV3-33)
ARDYCGGDCYLDY

SEQ ID NO: 13879 - protein, 9 aa, Homo sapiens
  Light chain CDR3 for antibody 6940 (IGKV2D-28)
MQALQTPPT

SEQ ID NO: 13880 - protein, 12 aa, Homo sapiens
  Heavy chain CDR3 for antibody 6940 (IGHV3-33)
ARDRAYRGSLDY

SEQ ID NO: 13881 - protein, 9 aa, Homo sapiens
  Light chain CDR3 for antibody 6941 (IGKV1-9)
QQLNSYPWP

SEQ ID NO: 13882 - protein, 14 aa, Homo sapiens
  Heavy chain CDR3 for antibody 6941 (IGHV3-23)
AKSRIVGALYYFDY

SEQ ID NO: 13883 - protein, 9 aa, Homo sapiens
  Light chain CDR3 for antibody 6942 (IGKV1-6)
LQDYNYPFT

SEQ ID NO: 13884 - protein, 14 aa, Homo sapiens
  Heavy chain CDR3 for antibody 6942 (IGHV3-33)
ARGGYNWNDDWFDP

SEQ ID NO: 13885 - protein, 9 aa, Homo sapiens
  Light chain CDR3 for antibody 6943 (IGKV1-6)
QQEYNYPLT

SEQ ID NO: 13886 - protein, 12 aa, Homo sapiens
  Heavy chain CDR3 for antibody 6943 (IGHV3-33)
ARKGYDMHEFDI

SEQ ID NO: 13887 - protein, 9 aa, Homo sapiens
  Light chain CDR3 for antibody 6944 (IGKV1D-13)
QHFNNYMYT

SEQ ID NO: 13888 - protein, 13 aa, Homo sapiens
  Heavy chain CDR3 for antibody 6944 (IGHV3-53)
ARSGSYWGYYFDY

SEQ ID NO: 13889 - protein, 9 aa, Homo sapiens
  Light chain CDR3 for antibody 6945 (IGKV2-30)
MQGTHWPLT

SEQ ID NO: 13890 - protein, 14 aa, Homo sapiens
  Heavy chain CDR3 for antibody 6945 (IGHV3-33)
ARGGYSGYRYYFDY

SEQ ID NO: 13891 - protein, 9 aa, Homo sapiens
  Light chain CDR3 for antibody 6946 (IGKV6-21)
HQSTSLPFT

SEQ ID NO: 13892 - protein, 15 aa, Homo sapiens
  Heavy chain CDR3 for antibody 6946 (IGHV3-33)
ARRVCSGGSCSLFDY

SEQ ID NO: 13893 - protein, 9 aa, Homo sapiens
  Light chain CDR3 for antibody 6947 (IGKV1-39)
QQSYSTPYT

SEQ ID NO: 13894 - protein, 19 aa, Homo sapiens
  Heavy chain CDR3 for antibody 6947 (IGHV1-18)
ARGGHIGVVTAFHGYGMDV

SEQ ID NO: 13895 - protein, 9 aa, Homo sapiens
  Light chain CDR3 for antibody 6948 (IGKV2-30)
MQGTHWPLT

SEQ ID NO: 13896 - protein, 11 aa, Homo sapiens
  Heavy chain CDR3 for antibody 6948 (IGHV4-59)
ARDGVRGVFDI

SEQ ID NO: 13897 - protein, 11 aa, Homo sapiens
  Light chain CDR3 for antibody 6949 (IGKV3-11)
QQRSNWPPTWT

SEQ ID NO: 13898 - protein, 13 aa, Homo sapiens
  Heavy chain CDR3 for antibody 6949 (IGHV4-39)
APFRVMVRGVLDY

SEQ ID NO: 13899 - protein, 10 aa, Homo sapiens
  Light chain CDR3 for antibody 6950 (IGKV1-39)
QQSYSTPMYT

SEQ ID NO: 13900 - protein, 12 aa, Homo sapiens
  Heavy chain CDR3 for antibody 6950 (IGHV4-39)
ARHGSGSSYFDY

SEQ ID NO: 13901 - protein, 9 aa, Homo sapiens
  Light chain CDR3 for antibody 6951 (IGKV5-2)
LQHDNFPWT

SEQ ID NO: 13902 - protein, 13 aa, Homo sapiens
  Heavy chain CDR3 for antibody 6951 (IGHV3-33)
ARCIVAAMGGFDY

SEQ ID NO: 13903 - protein, 9 aa, Homo sapiens
  Light chain CDR3 for antibody 6952 (IGKV3-20)
QQYGSSPWT

SEQ ID NO: 13904 - protein, 16 aa, Homo sapiens
  Heavy chain CDR3 for antibody 6952 (IGHV1-58)
AAPYCSSTSCHDAFDI

SEQ ID NO: 13905 - protein, 9 aa, Homo sapiens
  Light chain CDR3 for antibody 6953 (IGKV2D-28)
MQVLQTPFT

SEQ ID NO: 13906 - protein, 12 aa, Homo sapiens
  Heavy chain CDR3 for antibody 6953 (IGHV4-59)
ARDRSGWAYFDY

SEQ ID NO: 13907 - protein, 9 aa, Homo sapiens
  Light chain CDR3 for antibody 6954 (IGKV3-11)
QQRSNWPYT

SEQ ID NO: 13908 - protein, 12 aa, Homo sapiens
  Heavy chain CDR3 for antibody 6954 (IGHV3-33)
ARDYISTYGMDV

SEQ ID NO: 13909 - protein, 8 aa, Homo sapiens
  Light chain CDR3 for antibody 6955 (IGKV1-5)
QQYNSYYT

SEQ ID NO: 13910 - protein, 10 aa, Homo sapiens
  Heavy chain CDR3 for antibody 6955 (IGHV3-20)
AKEQWLVLDY

SEQ ID NO: 13911 - protein, 10 aa, Homo sapiens
  Light chain CDR3 for antibody 6956 (IGKV1-17)
LQHNSYPMYT

SEQ ID NO: 13912 - protein, 9 aa, Homo sapiens
  Heavy chain CDR3 for antibody 6956 (IGHV4-59)
ARGGASFDY

SEQ ID NO: 13913 - protein, 9 aa, Homo sapiens
  Light chain CDR3 for antibody 6957 (IGKV6-21)
HQSSSLPYT

SEQ ID NO: 13914 - protein, 17 aa, Homo sapiens
  Heavy chain CDR3 for antibody 6957 (IGHV3-13)
AREGWFGELWGYYGMDV

SEQ ID NO: 13915 - protein, 9 aa, Homo sapiens
  Light chain CDR3 for antibody 6958 (IGKV1-6)
LQDYNYPYT

SEQ ID NO: 13916 - protein, 11 aa, Homo sapiens
  Heavy chain CDR3 for antibody 6958 (IGHV1-24)
ATREYSSSCDY

SEQ ID NO: 13917 - protein, 10 aa, Homo sapiens
  Light chain CDR3 for antibody 6959 (IGKV3-20)
QQYGRSPPVT

SEQ ID NO: 13918 - protein, 15 aa, Homo sapiens
  Heavy chain CDR3 for antibody 6959 (IGHV3-33)
VCVLYDYGDYVGFDY

SEQ ID NO: 13919 - protein, 9 aa, Homo sapiens
  Light chain CDR3 for antibody 6960 (IGKV1-9)
QQVKSYPYT

SEQ ID NO: 13920 - protein, 17 aa, Homo sapiens
  Heavy chain CDR3 for antibody 6960 (IGHV1-46)
ARERYYGSGSYKYNMDV

SEQ ID NO: 13921 - protein, 9 aa, Homo sapiens
  Light chain CDR3 for antibody 6961 (IGKV3-11)
QQRSNWPPT

SEQ ID NO: 13922 - protein, 14 aa, Homo sapiens
  Heavy chain CDR3 for antibody 6961 (IGHV1-18)
AREGGSYFYYGVDV

SEQ ID NO: 13923 - protein, 10 aa, Homo sapiens
  Light chain CDR3 for antibody 6962 (IGKV1-9)
QQLDSYPMYT

SEQ ID NO: 13924 - protein, 12 aa, Homo sapiens
  Heavy chain CDR3 for antibody 6962 (IGHV3-33)
ARGYFGSGYAHF

SEQ ID NO: 13925 - protein, 9 aa, Homo sapiens
  Light chain CDR3 for antibody 6963 (IGKV1-5)
QQYNTYSRT

SEQ ID NO: 13926 - protein, 12 aa, Homo sapiens
  Heavy chain CDR3 for antibody 6963 (IGHV3-33)
ARGYFGSGYAHF

SEQ ID NO: 13927 - protein, 9 aa, Homo sapiens
  Light chain CDR3 for antibody 6964 (IGKV1-16)
QQYNSYPYT

SEQ ID NO: 13928 - protein, 15 aa, Homo sapiens
  Heavy chain CDR3 for antibody 6964 (IGHV3-33)
ARAYDLPHYYDGMDV

SEQ ID NO: 13929 - protein, 9 aa, Homo sapiens
  Light chain CDR3 for antibody 6965 (IGKV5-2)
LQHDNFPYT

SEQ ID NO: 13930 - protein, 12 aa, Homo sapiens
  Heavy chain CDR3 for antibody 6965 (IGHV3-66)
VRDRAAAPYFDL

SEQ ID NO: 13931 - protein, 9 aa, Homo sapiens
  Light chain CDR3 for antibody 6966 (IGKV3-11)
QQRINWPWT

SEQ ID NO: 13932 - protein, 9 aa, Homo sapiens
  Heavy chain CDR3 for antibody 6966 (IGHV1-18)
ARGKDWFDP

SEQ ID NO: 13933 - protein, 10 aa, Homo sapiens
  Light chain CDR3 for antibody 6967 (IGKV1-17)
LQHNSYPMYT

SEQ ID NO: 13934 - protein, 18 aa, Homo sapiens
  Heavy chain CDR3 for antibody 6967 (IGHV3-33)
ARREGIVGATTYYYGMDV

SEQ ID NO: 13935 - protein, 8 aa, Homo sapiens
  Light chain CDR3 for antibody 6968 (IGKV3D-7)
QQDYNLLT

SEQ ID NO: 13936 - protein, 16 aa, Homo sapiens
  Heavy chain CDR3 for antibody 6968 (IGHV3-33)
AREVAGSYYYYYGIDV

SEQ ID NO: 13937 - protein, 9 aa, Homo sapiens
  Light chain CDR3 for antibody 6969 (IGKV1-27)
QKYNSAPYT

SEQ ID NO: 13938 - protein, 11 aa, Homo sapiens
  Heavy chain CDR3 for antibody 6969 (IGHV4-59)
TRDRGLGSFDY

SEQ ID NO: 13939 - protein, 9 aa, Homo sapiens
  Light chain CDR3 for antibody 6970 (IGKV1-16)
QQYNSYPLT

SEQ ID NO: 13940 - protein, 11 aa, Homo sapiens
  Heavy chain CDR3 for antibody 6970 (IGHV3-30)
VRVGTGEFFDL

SEQ ID NO: 13941 - protein, 8 aa, Homo sapiens
  Light chain CDR3 for antibody 6971 (IGKV3-20)
QQYGSSLT

SEQ ID NO: 13942 - protein, 13 aa, Homo sapiens
  Heavy chain CDR3 for antibody 6971 (IGHV3-33)
ARVDTMVRGVMAY

SEQ ID NO: 13943 - protein, 9 aa, Homo sapiens
  Light chain CDR3 for antibody 6972 (IGKV1-5)
QQYNTYSRT

SEQ ID NO: 13944 - protein, 13 aa, Homo sapiens
  Heavy chain CDR3 for antibody 6972 (IGHV3-53)
ARSGSYWGYYFDY

SEQ ID NO: 13945 - protein, 8 aa, Homo sapiens
  Light chain CDR3 for antibody 6973 (IGKV1D-13)
QQFNNYPT

SEQ ID NO: 13946 - protein, 13 aa, Homo sapiens
  Heavy chain CDR3 for antibody 6973 (IGHV3-33)
ASGYSGYDWYFDL

SEQ ID NO: 13947 - protein, 9 aa, Homo sapiens
  Light chain CDR3 for antibody 6974 (IGKV1D-13)
QQFNNYPHT

SEQ ID NO: 13948 - protein, 11 aa, Homo sapiens
  Heavy chain CDR3 for antibody 6974 (IGHV4-39)
ARLLVGATTDY

SEQ ID NO: 13949 - protein, 9 aa, Homo sapiens
  Light chain CDR3 for antibody 6975 (IGKV3D-7)
QQDYTLPLT

SEQ ID NO: 13950 - protein, 17 aa, Homo sapiens
  Heavy chain CDR3 for antibody 6975 (IGHV3-33)
ARQGVLLWFGELYYFDY

SEQ ID NO: 13951 - protein, 9 aa, Homo sapiens
  Light chain CDR3 for antibody 6976 (IGKV1-39)
QQSYRTPLT

SEQ ID NO: 13952 - protein, 20 aa, Homo sapiens
  Heavy chain CDR3 for antibody 6976 (IGHV3-33)
ARDLGWATMVRGVIRAPFDY

SEQ ID NO: 13953 - protein, 9 aa, Homo sapiens
  Light chain CDR3 for antibody 6977 (IGKV1-39)
QQSYSTPYT

SEQ ID NO: 13954 - protein, 15 aa, Homo sapiens
  Heavy chain CDR3 for antibody 6977 (IGHV3-33)
ARAYDLPHYYYGMDV

SEQ ID NO: 13955 - protein, 9 aa, Homo sapiens
  Light chain CDR3 for antibody 6978 (IGKV5-2)
LQHDNFPWT

SEQ ID NO: 13956 - protein, 16 aa, Homo sapiens
  Heavy chain CDR3 for antibody 6978 (IGHV4-59)
AREGYNWNDGVNWFDP

SEQ ID NO: 13957 - protein, 9 aa, Homo sapiens
  Light chain CDR3 for antibody 6979 (IGKV1-17)
LQHNSFPLT

SEQ ID NO: 13958 - protein, 18 aa, Homo sapiens
  Heavy chain CDR3 for antibody 6979 (IGHV4-59)
AREGDYVWGSYRSNWFDP

SEQ ID NO: 13959 - protein, 9 aa, Homo sapiens
  Light chain CDR3 for antibody 6980 (IGKV3-15)
QQYNNWPLT

SEQ ID NO: 13960 - protein, 15 aa, Homo sapiens
  Heavy chain CDR3 for antibody 6980 (IGHV1-24)
ATHWDLRYYYYGMDV

SEQ ID NO: 13961 - protein, 9 aa, Homo sapiens
  Light chain CDR3 for antibody 6981 (IGKV1-5)
QQYNTYSRT

SEQ ID NO: 13962 - protein, 13 aa, Homo sapiens
  Heavy chain CDR3 for antibody 6981 (IGHV3-11)
ARDEGYRGYVLDT

SEQ ID NO: 13963 - protein, 8 aa, Homo sapiens
  Light chain CDR3 for antibody 6982 (IGKV3-20)
QQYGRSFT

SEQ ID NO: 13964 - protein, 7 aa, Homo sapiens
  Heavy chain CDR3 for antibody 6982 (IGHV1-46)
AREGGDY

SEQ ID NO: 13965 - protein, 9 aa, Homo sapiens
  Light chain CDR3 for antibody 6983 (IGKV1-6)
LQDYNYPYT

SEQ ID NO: 13966 - protein, 18 aa, Homo sapiens
  Heavy chain CDR3 for antibody 6983 (IGHV4-39)
ARGALTYYDILTGYFFDY

SEQ ID NO: 13967 - protein, 9 aa, Homo sapiens
  Light chain CDR3 for antibody 6984 (IGKV3D-7)
QQDYEFPLT

SEQ ID NO: 13968 - protein, 13 aa, Homo sapiens
  Heavy chain CDR3 for antibody 6984 (IGHV3-33)
ARDWGYSHGYFDY

SEQ ID NO: 13969 - protein, 6 aa, Homo sapiens
  Light chain CDR3 for antibody 6985 (IGKV3-20)
QQYGST

SEQ ID NO: 13970 - protein, 14 aa, Homo sapiens
  Heavy chain CDR3 for antibody 6985 (IGHV3-33)
ARGAAAGNFYGLDV

SEQ ID NO: 13971 - protein, 9 aa, Homo sapiens
  Light chain CDR3 for antibody 6986 (IGKV1-6)
LQDYNYPWT

SEQ ID NO: 13972 - protein, 18 aa, Homo sapiens
  Heavy chain CDR3 for antibody 6986 (IGHV4-39)
ARYITMVRGAIITGPFDY

SEQ ID NO: 13973 - protein, 9 aa, Homo sapiens
  Light chain CDR3 for antibody 6987 (IGKV3-20)
LQYGSSPYT

SEQ ID NO: 13974 - protein, 14 aa, Homo sapiens
  Heavy chain CDR3 for antibody 6987 (IGHV3-33)
ARDRDIMATSYFDY

SEQ ID NO: 13975 - protein, 10 aa, Homo sapiens
  Light chain CDR3 for antibody 6988 (IGKV3-15)
QQYNNWPPYT

SEQ ID NO: 13976 - protein, 13 aa, Homo sapiens
  Heavy chain CDR3 for antibody 6988 (IGHV3-33)
ARKAYGDYFYFDY

SEQ ID NO: 13977 - protein, 9 aa, Homo sapiens
  Light chain CDR3 for antibody 6989 (IGKV1-33)
QQYDNLPFT

SEQ ID NO: 13978 - protein, 11 aa, Homo sapiens
  Heavy chain CDR3 for antibody 6989 (IGHV3-33)
AREAANWGFDY

SEQ ID NO: 13979 - protein, 8 aa, Homo sapiens
  Light chain CDR3 for antibody 6990 (IGKV6-21)
HQSSSLPT

SEQ ID NO: 13980 - protein, 12 aa, Homo sapiens
  Heavy chain CDR3 for antibody 6990 (IGHV4-61)
ARVYSSGWLFDY

SEQ ID NO: 13981 - protein, 8 aa, Homo sapiens
  Light chain CDR3 for antibody 6991 (IGKV1-16)
QQYNSYYT

SEQ ID NO: 13982 - protein, 14 aa, Homo sapiens
  Heavy chain CDR3 for antibody 6991 (IGHV3-33)
ARDRRDFYYYGMDV

SEQ ID NO: 13983 - protein, 10 aa, Homo sapiens
  Light chain CDR3 for antibody 6992 (IGKV1-17)
LQHNSYPMYT

SEQ ID NO: 13984 - protein, 14 aa, Homo sapiens
  Heavy chain CDR3 for antibody 6992 (IGHV3-23)
ARDGYDFLTGPFDY

SEQ ID NO: 13985 - protein, 9 aa, Homo sapiens
  Light chain CDR3 for antibody 6993 (IGKV1-27)
QKYNSAPYT

SEQ ID NO: 13986 - protein, 9 aa, Homo sapiens
  Heavy chain CDR3 for antibody 6993 (IGHV3-23)
AKEQQLFDY

SEQ ID NO: 13987 - protein, 8 aa, Homo sapiens
  Light chain CDR3 for antibody 6994 (IGKV3D-7)
QQDYNLLT

SEQ ID NO: 13988 - protein, 9 aa, Homo sapiens
  Heavy chain CDR3 for antibody 6994 (IGHV3-33)
AREYKEFDY

SEQ ID NO: 13989 - protein, 9 aa, Homo sapiens
  Light chain CDR3 for antibody 6995 (IGKV3-15)
QQYNNWPYT

SEQ ID NO: 13990 - protein, 19 aa, Homo sapiens
  Heavy chain CDR3 for antibody 6995 (IGHV3-33)
ARGVRLRYFDPYYYYGMDV

SEQ ID NO: 13991 - protein, 10 aa, Homo sapiens
  Light chain CDR3 for antibody 6996 (IGKV1-17)
LQHNSYPMYT

SEQ ID NO: 13992 - protein, 10 aa, Homo sapiens
  Heavy chain CDR3 for antibody 6996 (IGHV3-33)
ARDVVVYFDY

SEQ ID NO: 13993 - protein, 9 aa, Homo sapiens
  Light chain CDR3 for antibody 6997 (IGKV3-15)
QQYNNWPLT

SEQ ID NO: 13994 - protein, 11 aa, Homo sapiens
  Heavy chain CDR3 for antibody 6997 (IGHV4-4)
AREAYYYGLDV

SEQ ID NO: 13995 - protein, 10 aa, Homo sapiens
  Light chain CDR3 for antibody 6998 (IGKV3-11)
QQRSNWPPFT

SEQ ID NO: 13996 - protein, 18 aa, Homo sapiens
  Heavy chain CDR3 for antibody 6998 (IGHV3-13)
ARDYYGSGSLYYYYGMDV

SEQ ID NO: 13997 - protein, 9 aa, Homo sapiens
  Light chain CDR3 for antibody 6999 (IGKV1-9)
QQLKSYPYT

SEQ ID NO: 13998 - protein, 12 aa, Homo sapiens
  Heavy chain CDR3 for antibody 6999 (IGHV3-33)
ARDLVGATPFDY

SEQ ID NO: 13999 - protein, 9 aa, Homo sapiens
  Light chain CDR3 for antibody 7000 (IGKV3D-20)
QQYGSSPYT

SEQ ID NO: 14000 - protein, 15 aa, Homo sapiens
  Heavy chain CDR3 for antibody 7000 (IGHV4-39)
ARRDYDISTGYLFDY

SEQ ID NO: 14001 - protein, 8 aa, Homo sapiens
  Light chain CDR3 for antibody 7001 (IGKV1D-13)
QQFNNYPT

SEQ ID NO: 14002 - protein, 11 aa, Homo sapiens
  Heavy chain CDR3 for antibody 7001 (IGHV3-74)
ARDRGNWGFDY

SEQ ID NO: 14003 - protein, 10 aa, Homo sapiens
  Light chain CDR3 for antibody 7002 (IGKV1-39)
QQSYSTPMYT

SEQ ID NO: 14004 - protein, 15 aa, Homo sapiens
  Heavy chain CDR3 for antibody 7002 (IGHV3-33)
ARRGYNDYDPYGMDV

SEQ ID NO: 14005 - protein, 8 aa, Homo sapiens
  Light chain CDR3 for antibody 7003 (IGKV3-11)
LQRGNWPT

SEQ ID NO: 14006 - protein, 14 aa, Homo sapiens
  Heavy chain CDR3 for antibody 7003 (IGHV3-33)
ARGAAAGNFYGLDV

SEQ ID NO: 14007 - protein, 10 aa, Homo sapiens
  Light chain CDR3 for antibody 7004 (IGKV1-27)
QKYNSAPMYT

SEQ ID NO: 14008 - protein, 12 aa, Homo sapiens
  Heavy chain CDR3 for antibody 7004 (IGHV4-61)
ARVYSSGWLFDY

SEQ ID NO: 14009 - protein, 9 aa, Homo sapiens
  Light chain CDR3 for antibody 7005 (IGKV3-11)
QQRSNWPYT

SEQ ID NO: 14010 - protein, 16 aa, Homo sapiens
  Heavy chain CDR3 for antibody 7005 (IGHV3-30)
ARDIAVAGHVYYGMDV

SEQ ID NO: 14011 - protein, 9 aa, Homo sapiens
  Light chain CDR3 for antibody 7006 (IGKV1-17)
LQHNSYPPT

SEQ ID NO: 14012 - protein, 15 aa, Homo sapiens
  Heavy chain CDR3 for antibody 7006 (IGHV1-46)
ARGRFFDWLLSPFDY

SEQ ID NO: 14013 - protein, 9 aa, Homo sapiens
  Light chain CDR3 for antibody 7007 (IGKV1-17)
LQHNSFPLT

SEQ ID NO: 14014 - protein, 13 aa, Homo sapiens
  Heavy chain CDR3 for antibody 7007 (IGHV3-33)
ARGVLWFGELFDY

SEQ ID NO: 14015 - protein, 9 aa, Homo sapiens
  Light chain CDR3 for antibody 7008 (IGKV3-11)
QQRSSWPPT

SEQ ID NO: 14016 - protein, 9 aa, Homo sapiens
  Heavy chain CDR3 for antibody 7008 (IGHV4-59)
AREGGSGSL

SEQ ID NO: 14017 - protein, 9 aa, Homo sapiens
  Light chain CDR3 for antibody 7009 (IGKV1-17)
LHSNNYPWT

SEQ ID NO: 14018 - protein, 14 aa, Homo sapiens
  Heavy chain CDR3 for antibody 7009 (IGHV3-33)
ARQYSYGYPYYFDY

SEQ ID NO: 14019 - protein, 10 aa, Homo sapiens
  Light chain CDR3 for antibody 7010 (IGKV3-15)
QQYNNWPPYT

SEQ ID NO: 14020 - protein, 14 aa, Homo sapiens
  Heavy chain CDR3 for antibody 7010 (IGHV3-33)
ARGAAAGNFYGLDV

SEQ ID NO: 14021 - protein, 9 aa, Homo sapiens
  Light chain CDR3 for antibody 7011 (IGKV5-2)
LQHDKFPYT

SEQ ID NO: 14022 - protein, 15 aa, Homo sapiens
  Heavy chain CDR3 for antibody 7011 (IGHV3-23)
AKAGGRYFDWFPFDY

SEQ ID NO: 14023 - protein, 8 aa, Homo sapiens
  Light chain CDR3 for antibody 7012 (IGKV1-5)
QQYNSYYT

SEQ ID NO: 14024 - protein, 9 aa, Homo sapiens
  Heavy chain CDR3 for antibody 7012 (IGHV3-23)
ARIWWLKDY

SEQ ID NO: 14025 - protein, 10 aa, Homo sapiens
  Light chain CDR3 for antibody 7013 (IGKV1-9)
QQLDSYPMYT

SEQ ID NO: 14026 - protein, 14 aa, Homo sapiens
  Heavy chain CDR3 for antibody 7013 (IGHV3-23)
ARDRIAAASSDFDC

SEQ ID NO: 14027 - protein, 8 aa, Homo sapiens
  Light chain CDR3 for antibody 7014 (IGKV3D-7)
QQDYNLLT

SEQ ID NO: 14028 - protein, 14 aa, Homo sapiens
  Heavy chain CDR3 for antibody 7014 (IGHV3-20)
ARDGGSTCYDWFDP

SEQ ID NO: 14029 - protein, 8 aa, Homo sapiens
  Light chain CDR3 for antibody 7015 (IGKV6-21)
HQSSSLPT

SEQ ID NO: 14030 - protein, 9 aa, Homo sapiens
  Heavy chain CDR3 for antibody 7015 (IGHV3-30)
ARDNWGFDY

SEQ ID NO: 14031 - protein, 10 aa, Homo sapiens
  Light chain CDR3 for antibody 7016 (IGKV1-39)
QQSYSTPMYT

SEQ ID NO: 14032 - protein, 21 aa, Homo sapiens
  Heavy chain CDR3 for antibody 7016 (IGHV3-33)
ARKRLYDILTGYYKAYYGMDV

SEQ ID NO: 14033 - protein, 9 aa, Homo sapiens
  Light chain CDR3 for antibody 7017 (IGKV2-30)
MQGTHWPLT

SEQ ID NO: 14034 - protein, 18 aa, Homo sapiens
  Heavy chain CDR3 for antibody 7017 (IGHV1-46)
ARDLTGRTENYYFYGMDV

SEQ ID NO: 14035 - protein, 10 aa, Homo sapiens
  Light chain CDR3 for antibody 7018 (IGKV1-17)
LQHNSYPMYT

SEQ ID NO: 14036 - protein, 13 aa, Homo sapiens
  Heavy chain CDR3 for antibody 7018 (IGHV3-33)
ARRATLVRGVFDP

SEQ ID NO: 14037 - protein, 9 aa, Homo sapiens
  Light chain CDR3 for antibody 7019 (IGKV1-27)
QKYNSAPYT

SEQ ID NO: 14038 - protein, 11 aa, Homo sapiens
  Heavy chain CDR3 for antibody 7019 (IGHV3-33)
ARGTTVTHFDY

SEQ ID NO: 14039 - protein, 9 aa, Homo sapiens
  Light chain CDR3 for antibody 7020 (IGKV1D-16)
QQYDSYPWT

SEQ ID NO: 14040 - protein, 12 aa, Homo sapiens
  Heavy chain CDR3 for antibody 7020 (IGHV3-33)
AREGTGGNWFDP

SEQ ID NO: 14041 - protein, 8 aa, Homo sapiens
  Light chain CDR3 for antibody 7021 (IGKV3-20)
QQYGRSFT

SEQ ID NO: 14042 - protein, 15 aa, Homo sapiens
  Heavy chain CDR3 for antibody 7021 (IGHV4-39)
ARQGLVATIKGYFQH

SEQ ID NO: 14043 - protein, 9 aa, Homo sapiens
  Light chain CDR3 for antibody 7022 (IGKV1D-13)
QQFNNYPHT

SEQ ID NO: 14044 - protein, 14 aa, Homo sapiens
  Heavy chain CDR3 for antibody 7022 (IGHV4-39)
ARQGGSGSYYNLDY

SEQ ID NO: 14045 - protein, 9 aa, Homo sapiens
  Light chain CDR3 for antibody 7023 (IGKV5-2)
LQHDNFPYT

SEQ ID NO: 14046 - protein, 5 aa, Homo sapiens
  Heavy chain CDR3 for antibody 7023 (IGHV4-39)
ARGDY

SEQ ID NO: 14047 - protein, 10 aa, Homo sapiens
  Light chain CDR3 for antibody 7024 (IGKV1-17)
LQHNSYPMYT

SEQ ID NO: 14048 - protein, 12 aa, Homo sapiens
  Heavy chain CDR3 for antibody 7024 (IGHV3-13)
ARDRGYSGYFDY

SEQ ID NO: 14049 - protein, 10 aa, Homo sapiens
  Light chain CDR3 for antibody 7025 (IGKV1-17)
LQHNSYPMYT

SEQ ID NO: 14050 - protein, 13 aa, Homo sapiens
  Heavy chain CDR3 for antibody 7025 (IGHV3-33)
ARVDTMVRGVMAY

SEQ ID NO: 14051 - protein, 9 aa, Homo sapiens
  Light chain CDR3 for antibody 7026 (IGKV4-1)
QQYYSTPWT

SEQ ID NO: 14052 - protein, 15 aa, Homo sapiens
  Heavy chain CDR3 for antibody 7026 (IGHV1-18)
ARGYCSSTSCYYFDY

SEQ ID NO: 14053 - protein, 8 aa, Homo sapiens
  Light chain CDR3 for antibody 7027 (IGKV1D-13)
QQYNNYPT

SEQ ID NO: 14054 - protein, 11 aa, Homo sapiens
  Heavy chain CDR3 for antibody 7027 (IGHV3-33)
ARGSGSYAFDS

SEQ ID NO: 14055 - protein, 9 aa, Homo sapiens
  Light chain CDR3 for antibody 7028 (IGKV1-9)
QQLKSYLYT

SEQ ID NO: 14056 - protein, 14 aa, Homo sapiens
  Heavy chain CDR3 for antibody 7028 (IGHV3-33)
ARDNILTVYYLFDY

SEQ ID NO: 14057 - protein, 10 aa, Homo sapiens
  Light chain CDR3 for antibody 7029 (IGKV3-20)
QQYGRSPPVT

SEQ ID NO: 14058 - protein, 18 aa, Homo sapiens
  Heavy chain CDR3 for antibody 7029 (IGHV3-33)
ARGYYGSGNFYKDSGMDV

SEQ ID NO: 14059 - protein, 9 aa, Homo sapiens
  Light chain CDR3 for antibody 7030 (IGKV1-9)
QQLNSYPYT

SEQ ID NO: 14060 - protein, 12 aa, Homo sapiens
  Heavy chain CDR3 for antibody 7030 (IGHV3-33)
ARDRAYRGSLDH

SEQ ID NO: 14061 - protein, 9 aa, Homo sapiens
  Light chain CDR3 for antibody 7031 (IGKV3D-7)
QQDYNLPLT

SEQ ID NO: 14062 - protein, 15 aa, Homo sapiens
  Heavy chain CDR3 for antibody 7031 (IGHV3-23)
AKDRYFDWLSDAFDI

SEQ ID NO: 14063 - protein, 9 aa, Homo sapiens
  Light chain CDR3 for antibody 7032 (IGKV5-2)
LQHDNFPWT

SEQ ID NO: 14064 - protein, 8 aa, Homo sapiens
  Heavy chain CDR3 for antibody 7032 (IGHV4-4)
ARGARFDP

SEQ ID NO: 14065 - protein, 10 aa, Homo sapiens
  Light chain CDR3 for antibody 7033 (IGKV1-39)
QQSYSTPMYT

SEQ ID NO: 14066 - protein, 11 aa, Homo sapiens
  Heavy chain CDR3 for antibody 7033 (IGHV3-33)
ARARYTTGLDY

SEQ ID NO: 14067 - protein, 9 aa, Homo sapiens
  Light chain CDR3 for antibody 7034 (IGKV1D-13)
QQFNNYPHT

SEQ ID NO: 14068 - protein, 17 aa, Homo sapiens
  Heavy chain CDR3 for antibody 7034 (IGHV3-33)
ARDPARGNVRSFYGLDV

SEQ ID NO: 14069 - protein, 9 aa, Homo sapiens
  Light chain CDR3 for antibody 7035 (IGKV1-6)
LQDYNYPFT

SEQ ID NO: 14070 - protein, 13 aa, Homo sapiens
  Heavy chain CDR3 for antibody 7035 (IGHV3-33)
ARTDYYYYYGLDA

SEQ ID NO: 14071 - protein, 9 aa, Homo sapiens
  Light chain CDR3 for antibody 7036 (IGKV1-17)
LQYNSYPWT

SEQ ID NO: 14072 - protein, 9 aa, Homo sapiens
  Heavy chain CDR3 for antibody 7036 (IGHV3-13)
ARDHWYFDL

SEQ ID NO: 14073 - protein, 9 aa, Homo sapiens
  Light chain CDR3 for antibody 7037 (IGKV1-17)
LQHNSYPYT

SEQ ID NO: 14074 - protein, 19 aa, Homo sapiens
  Heavy chain CDR3 for antibody 7037 (IGHV3-74)
ARLDYDFLTDYYRPYFFAY

SEQ ID NO: 14075 - protein, 9 aa, Homo sapiens
  Light chain CDR3 for antibody 7038 (IGKV1-39)
QQSYSTPLT

SEQ ID NO: 14076 - protein, 11 aa, Homo sapiens
  Heavy chain CDR3 for antibody 7038 (IGHV4-59)
ARDGSWEPFDY

SEQ ID NO: 14077 - protein, 9 aa, Homo sapiens
  Light chain CDR3 for antibody 7039 (IGKV3-15)
QQYNNWPLT

SEQ ID NO: 14078 - protein, 16 aa, Homo sapiens
  Heavy chain CDR3 for antibody 7039 (IGHV3-20)
AREGYSSSWFDRNFDY

SEQ ID NO: 14079 - protein, 9 aa, Homo sapiens
  Light chain CDR3 for antibody 7040 (IGKV1-39)
QQSYRTPLT

SEQ ID NO: 14080 - protein, 18 aa, Homo sapiens
  Heavy chain CDR3 for antibody 7040 (IGHV3-33)
ARDQGIVVLPGAPWYFDL

SEQ ID NO: 14081 - protein, 9 aa, Homo sapiens
  Light chain CDR3 for antibody 7041 (IGKV1-9)
QQLKSYLYT

SEQ ID NO: 14082 - protein, 12 aa, Homo sapiens
  Heavy chain CDR3 for antibody 7041 (IGHV3-33)
ARDRAYRGSLDY

SEQ ID NO: 14083 - protein, 9 aa, Homo sapiens
  Light chain CDR3 for antibody 7042 (IGKV6-21)
HQSSSLPFT

SEQ ID NO: 14084 - protein, 15 aa, Homo sapiens
  Heavy chain CDR3 for antibody 7042 (IGHV3-33)
AREGSSSWYLYYFDY

SEQ ID NO: 14085 - protein, 8 aa, Homo sapiens
  Light chain CDR3 for antibody 7043 (IGKV1D-13)
QQFNNYPT

SEQ ID NO: 14086 - protein, 13 aa, Homo sapiens
  Heavy chain CDR3 for antibody 7043 (IGHV3-33)
ARGVLWFGELFDY

SEQ ID NO: 14087 - protein, 8 aa, Homo sapiens
  Light chain CDR3 for antibody 7044 (IGKV3-11)
QQRSNWLT

SEQ ID NO: 14088 - protein, 13 aa, Homo sapiens
  Heavy chain CDR3 for antibody 7044 (IGHV3-33)
ARDQRYSSGWYDY

SEQ ID NO: 14089 - protein, 10 aa, Homo sapiens
  Light chain CDR3 for antibody 7045 (IGKV1-17)
LQHNSYPMYT

SEQ ID NO: 14090 - protein, 11 aa, Homo sapiens
  Heavy chain CDR3 for antibody 7045 (IGHV3-13)
AREAIIGPFDY

SEQ ID NO: 14091 - protein, 9 aa, Homo sapiens
  Light chain CDR3 for antibody 7046 (IGKV1-39)
QQSYSTPWT

SEQ ID NO: 14092 - protein, 11 aa, Homo sapiens
  Heavy chain CDR3 for antibody 7046 (IGHV4-59)
AREDYGVPFDY

SEQ ID NO: 14093 - protein, 8 aa, Homo sapiens
  Light chain CDR3 for antibody 7047 (IGKV3-11)
QQRSNWWT

SEQ ID NO: 14094 - protein, 13 aa, Homo sapiens
  Heavy chain CDR3 for antibody 7047 (IGHV3-11)
ARDEGYRGYVLDN

SEQ ID NO: 14095 - protein, 8 aa, Homo sapiens
  Light chain CDR3 for antibody 7048 (IGKV3D-7)
QQDYSLLT

SEQ ID NO: 14096 - protein, 10 aa, Homo sapiens
  Heavy chain CDR3 for antibody 7048 (IGHV3-33)
AREWFGGFDI

SEQ ID NO: 14097 - protein, 9 aa, Homo sapiens
  Light chain CDR3 for antibody 7049 (IGKV1-16)
QQYKSYPYT

SEQ ID NO: 14098 - protein, 14 aa, Homo sapiens
  Heavy chain CDR3 for antibody 7049 (IGHV1-24)
ATWLPLYYYYGMDV

SEQ ID NO: 14099 - protein, 9 aa, Homo sapiens
  Light chain CDR3 for antibody 7050 (IGKV3-11)
QQRSNWPYT

SEQ ID NO: 14100 - protein, 18 aa, Homo sapiens
  Heavy chain CDR3 for antibody 7050 (IGHV3-33)
ARDGRISLVRGIIDAFDI

SEQ ID NO: 14101 - protein, 8 aa, Homo sapiens
  Light chain CDR3 for antibody 7051 (IGKV1-5)
QQYNSYYT

SEQ ID NO: 14102 - protein, 13 aa, Homo sapiens
  Heavy chain CDR3 for antibody 7051 (IGHV3-33)
ARAITMVRGVIDY

SEQ ID NO: 14103 - protein, 8 aa, Homo sapiens
  Light chain CDR3 for antibody 7052 (IGKV3-20)
QQYGSSLT

SEQ ID NO: 14104 - protein, 11 aa, Homo sapiens
  Heavy chain CDR3 for antibody 7052 (IGHV3-33)
ARAGIAALFDY

SEQ ID NO: 14105 - protein, 8 aa, Homo sapiens
  Light chain CDR3 for antibody 7053 (IGKV1D-13)
QQFNNYYT

SEQ ID NO: 14106 - protein, 17 aa, Homo sapiens
  Heavy chain CDR3 for antibody 7053 (IGHV1-18)
ARERYYGSGSYKYNMDV

SEQ ID NO: 14107 - protein, 8 aa, Homo sapiens
  Light chain CDR3 for antibody 7054 (IGKV3D-7)
QQDYNLLT

SEQ ID NO: 14108 - protein, 14 aa, Homo sapiens
  Heavy chain CDR3 for antibody 7054 (IGHV3-33)
ARDGYDILTGPFDY

SEQ ID NO: 14109 - protein, 9 aa, Homo sapiens
  Light chain CDR3 for antibody 7055 (IGKV1-6)
LQDYKSPFT

SEQ ID NO: 14110 - protein, 10 aa, Homo sapiens
  Heavy chain CDR3 for antibody 7055 (IGHV3-33)
ARDGSGSQPI

SEQ ID NO: 14111 - protein, 9 aa, Homo sapiens
  Light chain CDR3 for antibody 7056 (IGKV2-30)
MQGTHWPLT

SEQ ID NO: 14112 - protein, 17 aa, Homo sapiens
  Heavy chain CDR3 for antibody 7056 (IGHV3-33)
ARGDGDILTGYYEWFDP

SEQ ID NO: 14113 - protein, 8 aa, Homo sapiens
  Light chain CDR3 for antibody 7057 (IGKV1-5)
QQYNSYWT

SEQ ID NO: 14114 - protein, 16 aa, Homo sapiens
  Heavy chain CDR3 for antibody 7057 (IGHV1-24)
ATEDSSSTYYYYGLDV

SEQ ID NO: 14115 - protein, 9 aa, Homo sapiens
  Light chain CDR3 for antibody 7058 (IGKV1-6)
QQEYNYPLT

SEQ ID NO: 14116 - protein, 11 aa, Homo sapiens
  Heavy chain CDR3 for antibody 7058 (IGHV1-24)
ATELGLYYFDY

SEQ ID NO: 14117 - protein, 9 aa, Homo sapiens
  Light chain CDR3 for antibody 7059 (IGKV3-15)
QQYNNWPLT

SEQ ID NO: 14118 - protein, 11 aa, Homo sapiens
  Heavy chain CDR3 for antibody 7059 (IGHV4-59)
ARDGSWEPFDY

SEQ ID NO: 14119 - protein, 10 aa, Homo sapiens
  Light chain CDR3 for antibody 7060 (IGKV1-9)
QQLDSYPMYT

SEQ ID NO: 14120 - protein, 13 aa, Homo sapiens
  Heavy chain CDR3 for antibody 7060 (IGHV3-33)
ASTGDSYYYGMDV

SEQ ID NO: 14121 - protein, 9 aa, Homo sapiens
  Light chain CDR3 for antibody 7061 (IGKV1-39)
QQSYRTPLT

SEQ ID NO: 14122 - protein, 14 aa, Homo sapiens
  Heavy chain CDR3 for antibody 7061 (IGHV3-33)
ARDNILTVYYLFDY

SEQ ID NO: 14123 - protein, 9 aa, Homo sapiens
  Light chain CDR3 for antibody 7062 (IGKV1-39)
QQSYSTPLT

SEQ ID NO: 14124 - protein, 12 aa, Homo sapiens
  Heavy chain CDR3 for antibody 7062 (IGHV3-20)
AIGTMVRGIPDY

SEQ ID NO: 14125 - protein, 9 aa, Homo sapiens
  Light chain CDR3 for antibody 7063 (IGKV1-6)
LQVYSYPWT

SEQ ID NO: 14126 - protein, 13 aa, Homo sapiens
  Heavy chain CDR3 for antibody 7063 (IGHV3-33)
ARDYCGGDCYLDY

SEQ ID NO: 14127 - protein, 10 aa, Homo sapiens
  Light chain CDR3 for antibody 7064 (IGKV3-20)
QQYGSSPPYT

SEQ ID NO: 14128 - protein, 16 aa, Homo sapiens
  Heavy chain CDR3 for antibody 7064 (IGHV4-59)
ARGRYFEWLLGDVFDI

SEQ ID NO: 14129 - protein, 9 aa, Homo sapiens
  Light chain CDR3 for antibody 7065 (IGKV1-33)
QQYDNLPFT

SEQ ID NO: 14130 - protein, 14 aa, Homo sapiens
  Heavy chain CDR3 for antibody 7065 (IGHV3-64)
VRDQGSMVRGGGDY

SEQ ID NO: 14131 - protein, 8 aa, Homo sapiens
  Light chain CDR3 for antibody 7066 (IGKV6-21)
HQSSSLPT

SEQ ID NO: 14132 - protein, 16 aa, Homo sapiens
  Heavy chain CDR3 for antibody 7066 (IGHV3-33)
ARGGRSDWLYYYGMDV

SEQ ID NO: 14133 - protein, 9 aa, Homo sapiens
  Light chain CDR3 for antibody 7067 (IGKV1-39)
QQSYSTPLT

SEQ ID NO: 14134 - protein, 13 aa, Homo sapiens
  Heavy chain CDR3 for antibody 7067 (IGHV1-18)
ARKWEWDLLNFDY

SEQ ID NO: 14135 - protein, 9 aa, Homo sapiens
  Light chain CDR3 for antibody 7068 (IGKV1D-16)
QQYITYPYT

SEQ ID NO: 14136 - protein, 10 aa, Homo sapiens
  Heavy chain CDR3 for antibody 7068 (IGHV3-23)
AKGDRWRFDP

SEQ ID NO: 14137 - protein, 9 aa, Homo sapiens
  Light chain CDR3 for antibody 7069 (IGKV1D-13)
QQFNNYPHT

SEQ ID NO: 14138 - protein, 10 aa, Homo sapiens
  Heavy chain CDR3 for antibody 7069 (IGHV4-39)
ARQLGNWFDP

SEQ ID NO: 14139 - protein, 9 aa, Homo sapiens
  Light chain CDR3 for antibody 7070 (IGKV1-6)
LQDYNYPRT

SEQ ID NO: 14140 - protein, 16 aa, Homo sapiens
  Heavy chain CDR3 for antibody 7070 (IGHV4-39)
ARRVPYYDILTGYLDY

SEQ ID NO: 14141 - protein, 8 aa, Homo sapiens
  Light chain CDR3 for antibody 7071 (IGKV1-5)
QQYNSYWT

SEQ ID NO: 14142 - protein, 21 aa, Homo sapiens
  Heavy chain CDR3 for antibody 7071 (IGHV3-33)
ARKRLYDILTGYYKAYYGMDV

SEQ ID NO: 14143 - protein, 8 aa, Homo sapiens
  Light chain CDR3 for antibody 7072 (IGKV6-21)
HQSSSLPT

SEQ ID NO: 14144 - protein, 11 aa, Homo sapiens
  Heavy chain CDR3 for antibody 7072 (IGHV3-33)
ARDTWDDYFDY

SEQ ID NO: 14145 - protein, 9 aa, Homo sapiens
  Light chain CDR3 for antibody 7073 (IGKV1-17)
LQHNSYPLT

SEQ ID NO: 14146 - protein, 11 aa, Homo sapiens
  Heavy chain CDR3 for antibody 7073 (IGHV3-33)
ARAGIAAVFDY

SEQ ID NO: 14147 - protein, 8 aa, Homo sapiens
  Light chain CDR3 for antibody 7074 (IGKV3D-7)
QQDYNLLT

SEQ ID NO: 14148 - protein, 15 aa, Homo sapiens
  Heavy chain CDR3 for antibody 7074 (IGHV3-33)
AREGLRYFHYYGMDV

SEQ ID NO: 14149 - protein, 9 aa, Homo sapiens
  Light chain CDR3 for antibody 7075 (IGKV5-2)
LQHDNFPYT

SEQ ID NO: 14150 - protein, 13 aa, Homo sapiens
  Heavy chain CDR3 for antibody 7075 (IGHV3-53)
ARDRDSSGSYFDY

SEQ ID NO: 14151 - protein, 9 aa, Homo sapiens
  Light chain CDR3 for antibody 7076 (IGKV3-15)
QQYNNWPYT

SEQ ID NO: 14152 - protein, 14 aa, Homo sapiens
  Heavy chain CDR3 for antibody 7076 (IGHV3-33)
ARQYSYGYPYYFDY

SEQ ID NO: 14153 - protein, 9 aa, Homo sapiens
  Light chain CDR3 for antibody 7077 (IGKV1-9)
QQLISYPLT

SEQ ID NO: 14154 - protein, 13 aa, Homo sapiens
  Heavy chain CDR3 for antibody 7077 (IGHV3-33)
VSTGDSYYYVMDV

SEQ ID NO: 14155 - protein, 9 aa, Homo sapiens
  Light chain CDR3 for antibody 7078 (IGKV1D-13)
QQFNNYPYT

SEQ ID NO: 14156 - protein, 13 aa, Homo sapiens
  Heavy chain CDR3 for antibody 7078 (IGHV3-33)
ASAGNSYYNVMDV

SEQ ID NO: 14157 - protein, 10 aa, Homo sapiens
  Light chain CDR3 for antibody 7079 (IGKV1-39)
QQSYSTPMYT

SEQ ID NO: 14158 - protein, 13 aa, Homo sapiens
  Heavy chain CDR3 for antibody 7079 (IGHV3-23)
AKDRGGSYSYFDF

SEQ ID NO: 14159 - protein, 9 aa, Homo sapiens
  Light chain CDR3 for antibody 7080 (IGKV1D-13)
QQFNNYPHT

SEQ ID NO: 14160 - protein, 11 aa, Homo sapiens
  Heavy chain CDR3 for antibody 7080 (IGHV3-23)
GEFSSGWSFDY

SEQ ID NO: 14161 - protein, 10 aa, Homo sapiens
  Light chain CDR3 for antibody 7081 (IGKV3-15)
QQYNNWPPIT

SEQ ID NO: 14162 - protein, 9 aa, Homo sapiens
  Heavy chain CDR3 for antibody 7081 (IGHV3-30)
ARDYFHYDY

SEQ ID NO: 14163 - protein, 9 aa, Homo sapiens
  Light chain CDR3 for antibody 7082 (IGKV1D-13)
QQFNNYPHT

SEQ ID NO: 14164 - protein, 18 aa, Homo sapiens
  Heavy chain CDR3 for antibody 7082 (IGHV3-23)
ARYHLYFGSGFGSDGMDV

SEQ ID NO: 14165 - protein, 9 aa, Homo sapiens
  Light chain CDR3 for antibody 7083 (IGKV1D-13)
QQFNNYPST

SEQ ID NO: 14166 - protein, 21 aa, Homo sapiens
  Heavy chain CDR3 for antibody 7083 (IGHV1-18)
ASGVLIWFGELLSEDYYDMDV

SEQ ID NO: 14167 - protein, 10 aa, Homo sapiens
  Light chain CDR3 for antibody 7084 (IGKV3-11)
QQRSNWPTWT

SEQ ID NO: 14168 - protein, 13 aa, Homo sapiens
  Heavy chain CDR3 for antibody 7084 (IGHV4-39)
ARRGVVAPAAFDY

SEQ ID NO: 14169 - protein, 9 aa, Homo sapiens
  Light chain CDR3 for antibody 7085 (IGKV1-9)
QQLKSYLYT

SEQ ID NO: 14170 - protein, 13 aa, Homo sapiens
  Heavy chain CDR3 for antibody 7085 (IGHV3-33)
ARKAYGDYFYFDY

SEQ ID NO: 14171 - protein, 9 aa, Homo sapiens
  Light chain CDR3 for antibody 7086 (IGKV3D-20)
QQYGSSPFT

SEQ ID NO: 14172 - protein, 18 aa, Homo sapiens
  Heavy chain CDR3 for antibody 7086 (IGHV3-23)
AKEGDYYSSGSYWGYFDL

SEQ ID NO: 14173 - protein, 8 aa, Homo sapiens
  Light chain CDR3 for antibody 7087 (IGKV3-15)
QQYNNWLT

SEQ ID NO: 14174 - protein, 13 aa, Homo sapiens
  Heavy chain CDR3 for antibody 7087 (IGHV3-33)
ARTDYYFYYGLDV

SEQ ID NO: 14175 - protein, 9 aa, Homo sapiens
  Light chain CDR3 for antibody 7088 (IGKV1-16)
QQYNRYPYT

SEQ ID NO: 14176 - protein, 18 aa, Homo sapiens
  Heavy chain CDR3 for antibody 7088 (IGHV4-59)
AREGDDVWGSYRPNWFDP

SEQ ID NO: 14177 - protein, 9 aa, Homo sapiens
  Light chain CDR3 for antibody 7089 (IGKV3-20)
QQYGSSPLT

SEQ ID NO: 14178 - protein, 11 aa, Homo sapiens
  Heavy chain CDR3 for antibody 7089 (IGHV3-23)
GEFSSGWSFDY

SEQ ID NO: 14179 - protein, 7 aa, Homo sapiens
  Light chain CDR3 for antibody 7090 (IGKV5-2)
LQHDNFT

SEQ ID NO: 14180 - protein, 13 aa, Homo sapiens
  Heavy chain CDR3 for antibody 7090 (IGHV3-33)
ARDWGYSHGYFDY

SEQ ID NO: 14181 - protein, 9 aa, Homo sapiens
  Light chain CDR3 for antibody 7091 (IGKV1-17)
LQHNSYPWT

SEQ ID NO: 14182 - protein, 16 aa, Homo sapiens
  Heavy chain CDR3 for antibody 7091 (IGHV3-33)
ARPTYYDILTGYPFDY

SEQ ID NO: 14183 - protein, 9 aa, Homo sapiens
  Light chain CDR3 for antibody 7092 (IGKV5-2)
LQHDKFPYT

SEQ ID NO: 14184 - protein, 15 aa, Homo sapiens
  Heavy chain CDR3 for antibody 7092 (IGHV3-33)
SRDHLTGYNYYGMDV

SEQ ID NO: 14185 - protein, 9 aa, Homo sapiens
  Light chain CDR3 for antibody 7093 (IGKV1-17)
LQHNSYPYT

SEQ ID NO: 14186 - protein, 21 aa, Homo sapiens
  Heavy chain CDR3 for antibody 7093 (IGHV3-33)
ARDGGITMGRGVYYYYYGMDV

SEQ ID NO: 14187 - protein, 9 aa, Homo sapiens
  Light chain CDR3 for antibody 7094 (IGKV1-27)
QKYNSAPYT

SEQ ID NO: 14188 - protein, 16 aa, Homo sapiens
  Heavy chain CDR3 for antibody 7094 (IGHV4-59)
ARFYFGSGSYYWYFDL

SEQ ID NO: 14189 - protein, 9 aa, Homo sapiens
  Light chain CDR3 for antibody 7095 (IGKV3-20)
QQYGTSPFP

SEQ ID NO: 14190 - protein, 18 aa, Homo sapiens
  Heavy chain CDR3 for antibody 7095 (IGHV4-59)
AREGDYVWGSYRPNWFDP

SEQ ID NO: 14191 - protein, 10 aa, Homo sapiens
  Light chain CDR3 for antibody 7096 (IGKV1-39)
QQSYSTPMYT

SEQ ID NO: 14192 - protein, 14 aa, Homo sapiens
  Heavy chain CDR3 for antibody 7096 (IGHV3-33)
ARDREQQLVRYFDY

SEQ ID NO: 14193 - protein, 9 aa, Homo sapiens
  Light chain CDR3 for antibody 7097 (IGKV1D-13)
QQFNNYPHT

SEQ ID NO: 14194 - protein, 18 aa, Homo sapiens
  Heavy chain CDR3 for antibody 7097 (IGHV3-11)
ARDGYSSGWNYYYFGLDV

SEQ ID NO: 14195 - protein, 9 aa, Homo sapiens
  Light chain CDR3 for antibody 7098 (IGKV1-9)
QQLNGYPFT

SEQ ID NO: 14196 - protein, 16 aa, Homo sapiens
  Heavy chain CDR3 for antibody 7098 (IGHV4-59)
ARYSGSYYGDYYGMDV

SEQ ID NO: 14197 - protein, 9 aa, Homo sapiens
  Light chain CDR3 for antibody 7099 (IGKV3-11)
QQRSNWPYT

SEQ ID NO: 14198 - protein, 16 aa, Homo sapiens
  Heavy chain CDR3 for antibody 7099 (IGHV3-20)
AREGYSSSWFDRNFDY

SEQ ID NO: 14199 - protein, 9 aa, Homo sapiens
  Light chain CDR3 for antibody 7100 (IGKV1-17)
LQHNSYPRT

SEQ ID NO: 14200 - protein, 13 aa, Homo sapiens
  Heavy chain CDR3 for antibody 7100 (IGHV4-39)
ARRGVVAPAAFDY

SEQ ID NO: 14201 - protein, 8 aa, Homo sapiens
  Light chain CDR3 for antibody 7101 (IGKV3D-7)
QQDYNLVT

SEQ ID NO: 14202 - protein, 11 aa, Homo sapiens
  Heavy chain CDR3 for antibody 7101 (IGHV4-4)
AREAYYYGLDV

SEQ ID NO: 14203 - protein, 9 aa, Homo sapiens
  Light chain CDR3 for antibody 7102 (IGKV3D-7)
QQDYEFPLT

SEQ ID NO: 14204 - protein, 14 aa, Homo sapiens
  Heavy chain CDR3 for antibody 7102 (IGHV4-59)
AKGGSGSYYNWFDP

SEQ ID NO: 14205 - protein, 9 aa, Homo sapiens
  Light chain CDR3 for antibody 7103 (IGKV3-11)
QQRSSWPPT

SEQ ID NO: 14206 - protein, 18 aa, Homo sapiens
  Heavy chain CDR3 for antibody 7103 (IGHV3-23)
AKEGNYYGSGSYWGYFDP

SEQ ID NO: 14207 - protein, 9 aa, Homo sapiens
  Light chain CDR3 for antibody 7104 (IGKV1-17)
LQHNTYPYT

SEQ ID NO: 14208 - protein, 18 aa, Homo sapiens
  Heavy chain CDR3 for antibody 7104 (IGHV3-33)
ARREGITLIFYYYYGMDV

SEQ ID NO: 14209 - protein, 9 aa, Homo sapiens
  Light chain CDR3 for antibody 7105 (IGKV3D-7)
QQDYKLPLT

SEQ ID NO: 14210 - protein, 19 aa, Homo sapiens
  Heavy chain CDR3 for antibody 7105 (IGHV3-33)
ARDSGYSGYDYYYYYGMDV

SEQ ID NO: 14211 - protein, 10 aa, Homo sapiens
  Light chain CDR3 for antibody 7106 (IGKV1-17)
LQHNSYPMYT

SEQ ID NO: 14212 - protein, 15 aa, Homo sapiens
  Heavy chain CDR3 for antibody 7106 (IGHV3-23)
AKEALRYFDWSGMDV

SEQ ID NO: 14213 - protein, 10 aa, Homo sapiens
  Light chain CDR3 for antibody 7107 (IGKV3-11)
QQRSNWPIWT

SEQ ID NO: 14214 - protein, 12 aa, Homo sapiens
  Heavy chain CDR3 for antibody 7107 (IGHV4-39)
ARQMVREGWFDP

SEQ ID NO: 14215 - protein, 9 aa, Homo sapiens
  Light chain CDR3 for antibody 7108 (IGKV1-9)
QQLISYPLT

SEQ ID NO: 14216 - protein, 13 aa, Homo sapiens
  Heavy chain CDR3 for antibody 7108 (IGHV3-33)
ASGYSGYDWYFDL

SEQ ID NO: 14217 - protein, 10 aa, Homo sapiens
  Light chain CDR3 for antibody 7109 (IGKV1-39)
QQSYSSPMYT

SEQ ID NO: 14218 - protein, 17 aa, Homo sapiens
  Heavy chain CDR3 for antibody 7109 (IGHV4-59)
ARDFLVRGEGSYYGMDV

SEQ ID NO: 14219 - protein, 9 aa, Homo sapiens
  Light chain CDR3 for antibody 7110 (IGKV3D-20)
QQYGSSPYT

SEQ ID NO: 14220 - protein, 9 aa, Homo sapiens
  Heavy chain CDR3 for antibody 7110 (IGHV3-33)
ASHSSGEDY

SEQ ID NO: 14221 - protein, 9 aa, Homo sapiens
  Light chain CDR3 for antibody 7111 (IGKV1-9)
QQLNGYPFT

SEQ ID NO: 14222 - protein, 12 aa, Homo sapiens
  Heavy chain CDR3 for antibody 7111 (IGHV1-18)
ARILFYGDYFDY

SEQ ID NO: 14223 - protein, 9 aa, Homo sapiens
  Light chain CDR3 for antibody 7112 (IGKV1-37)
QRTSNAPYT

SEQ ID NO: 14224 - protein, 18 aa, Homo sapiens
  Heavy chain CDR3 for antibody 7112 (IGHV3-33)
ARDRYYDILTGYYMGFDY

SEQ ID NO: 14225 - protein, 8 aa, Homo sapiens
  Light chain CDR3 for antibody 7113 (IGKV1-9)
QQYNSYYT

SEQ ID NO: 14226 - protein, 10 aa, Homo sapiens
  Heavy chain CDR3 for antibody 7113 (IGHV3-30)
ARDGLESFDY

SEQ ID NO: 14227 - protein, 9 aa, Homo sapiens
  Light chain CDR3 for antibody 7114 (IGKV2D-28)
MQALQTPPT

SEQ ID NO: 14228 - protein, 13 aa, Homo sapiens
  Heavy chain CDR3 for antibody 7114 (IGHV3-23)
AKDRGYSSTSTAY

SEQ ID NO: 14229 - protein, 9 aa, Homo sapiens
  Light chain CDR3 for antibody 7115 (IGKV3-11)
QQRSNWMYT

SEQ ID NO: 14230 - protein, 12 aa, Homo sapiens
  Heavy chain CDR3 for antibody 7115 (IGHV3-33)
AREGIAVAGVDP

SEQ ID NO: 14231 - protein, 9 aa, Homo sapiens
  Light chain CDR3 for antibody 7116 (IGKV1-6)
LQDYNYPWT

SEQ ID NO: 14232 - protein, 18 aa, Homo sapiens
  Heavy chain CDR3 for antibody 7116 (IGHV3-33)
ARREGITMIFYYYYGMDA

SEQ ID NO: 14233 - protein, 9 aa, Homo sapiens
  Light chain CDR3 for antibody 7117 (IGKV6-21)
HQSSSLPYT

SEQ ID NO: 14234 - protein, 17 aa, Homo sapiens
  Heavy chain CDR3 for antibody 7117 (IGHV3-23)
ANGGFGESHYNYYGMDV

SEQ ID NO: 14235 - protein, 9 aa, Homo sapiens
  Light chain CDR3 for antibody 7118 (IGKV6-21)
HQSSSLPYT

SEQ ID NO: 14236 - protein, 14 aa, Homo sapiens
  Heavy chain CDR3 for antibody 7118 (IGHV3-64)
ARGGGAVTGTNFDY

SEQ ID NO: 14237 - protein, 9 aa, Homo sapiens
  Light chain CDR3 for antibody 7119 (IGKV1-6)
LQDYNYPRT

SEQ ID NO: 14238 - protein, 10 aa, Homo sapiens
  Heavy chain CDR3 for antibody 7119 (IGHV3-13)
ARDRGSYYDY

SEQ ID NO: 14239 - protein, 8 aa, Homo sapiens
  Light chain CDR3 for antibody 7120 (IGKV3D-7)
QQDYNLLT

SEQ ID NO: 14240 - protein, 16 aa, Homo sapiens
  Heavy chain CDR3 for antibody 7120 (IGHV3-33)
ARDKNTDYDILTGFDY

SEQ ID NO: 14241 - protein, 9 aa, Homo sapiens
  Light chain CDR3 for antibody 7121 (IGKV1-9)
QQLKSYLYT

SEQ ID NO: 14242 - protein, 21 aa, Homo sapiens
  Heavy chain CDR3 for antibody 7121 (IGHV3-33)
ARKRLYDILTGYYKAYYGMDV

SEQ ID NO: 14243 - protein, 8 aa, Homo sapiens
  Light chain CDR3 for antibody 7122 (IGKV3D-7)
QQDYNLLT

SEQ ID NO: 14244 - protein, 12 aa, Homo sapiens
  Heavy chain CDR3 for antibody 7122 (IGHV1-24)
ASDWAYYYGMDV

SEQ ID NO: 14245 - protein, 9 aa, Homo sapiens
  Light chain CDR3 for antibody 7123 (IGKV1-9)
QQLNSYPYT

SEQ ID NO: 14246 - protein, 18 aa, Homo sapiens
  Heavy chain CDR3 for antibody 7123 (IGHV3-33)
ARGGYCSGWDYYYYGMDV

SEQ ID NO: 14247 - protein, 9 aa, Homo sapiens
  Light chain CDR3 for antibody 7124 (IGKV1-9)
QQLKSYLYT

SEQ ID NO: 14248 - protein, 13 aa, Homo sapiens
  Heavy chain CDR3 for antibody 7124 (IGHV4-39)
ARREVVGGRGFDY

SEQ ID NO: 14249 - protein, 9 aa, Homo sapiens
  Light chain CDR3 for antibody 7125 (IGKV1-9)
QQLNSYPPT

SEQ ID NO: 14250 - protein, 17 aa, Homo sapiens
  Heavy chain CDR3 for antibody 7125 (IGHV3-20)
ARDPLYYYGAGSSGMDV

SEQ ID NO: 14251 - protein, 9 aa, Homo sapiens
  Light chain CDR3 for antibody 7126 (IGKV1-6)
LQDNNYPWT

SEQ ID NO: 14252 - protein, 11 aa, Homo sapiens
  Heavy chain CDR3 for antibody 7126 (IGHV4-59)
ARSLRYSVFDY

SEQ ID NO: 14253 - protein, 9 aa, Homo sapiens
  Light chain CDR3 for antibody 7127 (IGKV2D-28)
MQALQTPPT

SEQ ID NO: 14254 - protein, 17 aa, Homo sapiens
  Heavy chain CDR3 for antibody 7127 (IGHV3-33)
ARGFSGYDGYYYYGMDV

SEQ ID NO: 14255 - protein, 9 aa, Homo sapiens
  Light chain CDR3 for antibody 7128 (IGKV2-30)
MQGTHWPLT

SEQ ID NO: 14256 - protein, 18 aa, Homo sapiens
  Heavy chain CDR3 for antibody 7128 (IGHV3-33)
ARERDYYGSGSYPDAFDI

SEQ ID NO: 14257 - protein, 9 aa, Homo sapiens
  Light chain CDR3 for antibody 7129 (IGKV1-9)
QQGNTYSRT

SEQ ID NO: 14258 - protein, 16 aa, Homo sapiens
  Heavy chain CDR3 for antibody 7129 (IGHV4-59)
ARDTPYYSGSGRPFDS

SEQ ID NO: 14259 - protein, 8 aa, Homo sapiens
  Light chain CDR3 for antibody 7130 (IGKV1-5)
QQYNSYWT

SEQ ID NO: 14260 - protein, 20 aa, Homo sapiens
  Heavy chain CDR3 for antibody 7130 (IGHV3-33)
AREDYYGSGSYYPAYNWFDP

SEQ ID NO: 14261 - protein, 8 aa, Homo sapiens
  Light chain CDR3 for antibody 7131 (IGKV3D-7)
QQDYNLLT

SEQ ID NO: 14262 - protein, 12 aa, Homo sapiens
  Heavy chain CDR3 for antibody 7131 (IGHV3-21)
AREGFGESSFDY

SEQ ID NO: 14263 - protein, 9 aa, Homo sapiens
  Light chain CDR3 for antibody 7132 (IGKV3-20)
QQYGSSPYT

SEQ ID NO: 14264 - protein, 20 aa, Homo sapiens
  Heavy chain CDR3 for antibody 7132 (IGHV3-33)
ARRMVRGVKKTYYYYYGLDV

SEQ ID NO: 14265 - protein, 9 aa, Homo sapiens
  Light chain CDR3 for antibody 7133 (IGKV5-2)
LQHDNFPWT

SEQ ID NO: 14266 - protein, 11 aa, Homo sapiens
  Heavy chain CDR3 for antibody 7133 (IGHV3-33)
ARDRATAGLDY

SEQ ID NO: 14267 - protein, 9 aa, Homo sapiens
  Light chain CDR3 for antibody 7134 (IGKV6-21)
HQSSSLPYT

SEQ ID NO: 14268 - protein, 14 aa, Homo sapiens
  Heavy chain CDR3 for antibody 7134 (IGHV1-46)
ARAYYAFLTGALDI

SEQ ID NO: 14269 - protein, 9 aa, Homo sapiens
  Light chain CDR3 for antibody 7135 (IGKV2D-28)
MQALQTPPT

SEQ ID NO: 14270 - protein, 18 aa, Homo sapiens
  Heavy chain CDR3 for antibody 7135 (IGHV3-23)
AKEGNYYGSGSYWGYFDP

SEQ ID NO: 14271 - protein, 9 aa, Homo sapiens
  Light chain CDR3 for antibody 7136 (IGKV1-37)
QRTSNAPYT

SEQ ID NO: 14272 - protein, 14 aa, Homo sapiens
  Heavy chain CDR3 for antibody 7136 (IGHV3-33)
ARDWNDVYYYGMDV

SEQ ID NO: 14273 - protein, 9 aa, Homo sapiens
  Light chain CDR3 for antibody 7137 (IGKV1-9)
QQLNGYPFT

SEQ ID NO: 14274 - protein, 13 aa, Homo sapiens
  Heavy chain CDR3 for antibody 7137 (IGHV1-46)
ARVKLGSLGAFDI

SEQ ID NO: 14275 - protein, 9 aa, Homo sapiens
  Light chain CDR3 for antibody 7138 (IGKV1D-13)
QQFNNYPHT

SEQ ID NO: 14276 - protein, 14 aa, Homo sapiens
  Heavy chain CDR3 for antibody 7138 (IGHV3-23)
AKGGDVLTGYYPDY

SEQ ID NO: 14277 - protein, 9 aa, Homo sapiens
  Light chain CDR3 for antibody 7139 (IGKV1-6)
LQDYNYPWT

SEQ ID NO: 14278 - protein, 10 aa, Homo sapiens
  Heavy chain CDR3 for antibody 7139 (IGHV3-33)
ARDYGDYFDY

SEQ ID NO: 14279 - protein, 9 aa, Homo sapiens
  Light chain CDR3 for antibody 7140 (IGKV5-2)
LQHDNFPYT

SEQ ID NO: 14280 - protein, 11 aa, Homo sapiens
  Heavy chain CDR3 for antibody 7140 (IGHV3-33)
ARDRSTGWLDY

SEQ ID NO: 14281 - protein, 8 aa, Homo sapiens
  Light chain CDR3 for antibody 7141 (IGKV3D-7)
QQDYNLLT

SEQ ID NO: 14282 - protein, 14 aa, Homo sapiens
  Heavy chain CDR3 for antibody 7141 (IGHV3-33)
ARDRRDFYYYGMDV

SEQ ID NO: 14283 - protein, 8 aa, Homo sapiens
  Light chain CDR3 for antibody 7142 (IGKV3-11)
QQRSNWLT

SEQ ID NO: 14284 - protein, 19 aa, Homo sapiens
  Heavy chain CDR3 for antibody 7142 (IGHV5-51)
ARHGEKGKRITMVRGSLDV

SEQ ID NO: 14285 - protein, 8 aa, Homo sapiens
  Light chain CDR3 for antibody 7143 (IGKV3-15)
QQYNNWPT

SEQ ID NO: 14286 - protein, 17 aa, Homo sapiens
  Heavy chain CDR3 for antibody 7143 (IGHV3-33)
ARAYYDILTGYSYYFDY

SEQ ID NO: 14287 - protein, 9 aa, Homo sapiens
  Light chain CDR3 for antibody 7144 (IGKV1-6)
LQDFNYPRT

SEQ ID NO: 14288 - protein, 14 aa, Homo sapiens
  Heavy chain CDR3 for antibody 7144 (IGHV3-33)
ARDKSYPLSYGMDV

SEQ ID NO: 14289 - protein, 9 aa, Homo sapiens
  Light chain CDR3 for antibody 7145 (IGKV5-2)
LQHDKFPYT

SEQ ID NO: 14290 - protein, 19 aa, Homo sapiens
  Heavy chain CDR3 for antibody 7145 (IGHV3-33)
ARGVRLRFFDPYYYYGLDV

SEQ ID NO: 14291 - protein, 9 aa, Homo sapiens
  Light chain CDR3 for antibody 7146 (IGKV1D-13)
QQFNNYPHT

SEQ ID NO: 14292 - protein, 15 aa, Homo sapiens
  Heavy chain CDR3 for antibody 7146 (IGHV3-64)
ARDSHHDLLTGHYEY

SEQ ID NO: 14293 - protein, 10 aa, Homo sapiens
  Light chain CDR3 for antibody 7147 (IGKV3-15)
QQYNKWPPLT

SEQ ID NO: 14294 - protein, 7 aa, Homo sapiens
  Heavy chain CDR3 for antibody 7147 (IGHV1-46)
AREGGDY

SEQ ID NO: 14295 - protein, 9 aa, Homo sapiens
  Light chain CDR3 for antibody 7148 (IGKV3D-7)
QQDYKLPLT

SEQ ID NO: 14296 - protein, 14 aa, Homo sapiens
  Heavy chain CDR3 for antibody 7148 (IGHV1-2)
ARDYYGSGNYYMGY

SEQ ID NO: 14297 - protein, 8 aa, Homo sapiens
  Light chain CDR3 for antibody 7149 (IGKV3D-7)
QQDYNLLT

SEQ ID NO: 14298 - protein, 13 aa, Homo sapiens
  Heavy chain CDR3 for antibody 7149 (IGHV1-46)
ARVKLGSLGAFDI

SEQ ID NO: 14299 - protein, 9 aa, Homo sapiens
  Light chain CDR3 for antibody 7150 (IGKV3-15)
QQYNNWPYT

SEQ ID NO: 14300 - protein, 9 aa, Homo sapiens
  Heavy chain CDR3 for antibody 7150 (IGHV3-33)
ARDNWGFDY

SEQ ID NO: 14301 - protein, 9 aa, Homo sapiens
  Light chain CDR3 for antibody 7151 (IGKV3-15)
QQYINWPLT

SEQ ID NO: 14302 - protein, 15 aa, Homo sapiens
  Heavy chain CDR3 for antibody 7151 (IGHV4-39)
ARRSKYSSAWYPFDY

SEQ ID NO: 14303 - protein, 9 aa, Homo sapiens
  Light chain CDR3 for antibody 7152 (IGKV1-33)
QQYDNLPFT

SEQ ID NO: 14304 - protein, 8 aa, Homo sapiens
  Heavy chain CDR3 for antibody 7152 (IGHV3-33)
ARDRGFDY

SEQ ID NO: 14305 - protein, 9 aa, Homo sapiens
  Light chain CDR3 for antibody 7153 (IGKV1-17)
LHSNNYPWT

SEQ ID NO: 14306 - protein, 21 aa, Homo sapiens
  Heavy chain CDR3 for antibody 7153 (IGHV3-33)
ARKRLYDILTGYYKAYYGMDV

SEQ ID NO: 14307 - protein, 8 aa, Homo sapiens
  Light chain CDR3 for antibody 7154 (IGKV6-21)
HQSSSLPT

SEQ ID NO: 14308 - protein, 14 aa, Homo sapiens
  Heavy chain CDR3 for antibody 7154 (IGHV3-33)
ARDRIAAASSDFDC

SEQ ID NO: 14309 - protein, 9 aa, Homo sapiens
  Light chain CDR3 for antibody 7155 (IGKV1-9)
QQLNRYPYT

SEQ ID NO: 14310 - protein, 17 aa, Homo sapiens
  Heavy chain CDR3 for antibody 7155 (IGHV1-24)
TTVVLYYDILPGYSFDY

SEQ ID NO: 14311 - protein, 9 aa, Homo sapiens
  Light chain CDR3 for antibody 7156 (IGKV1-33)
QQYDNLPFT

SEQ ID NO: 14312 - protein, 10 aa, Homo sapiens
  Heavy chain CDR3 for antibody 7156 (IGHV3-30)
AREWYGGMDV

SEQ ID NO: 14313 - protein, 10 aa, Homo sapiens
  Light chain CDR3 for antibody 7157 (IGKV1-17)
LQHNSYPMYT

SEQ ID NO: 14314 - protein, 11 aa, Homo sapiens
  Heavy chain CDR3 for antibody 7157 (IGHV3-33)
ARGSGSYAFDS

SEQ ID NO: 14315 - protein, 10 aa, Homo sapiens
  Light chain CDR3 for antibody 7158 (IGKV3-11)
QQRSNWPIWT

SEQ ID NO: 14316 - protein, 22 aa, Homo sapiens
  Heavy chain CDR3 for antibody 7158 (IGHV4-59)
AREINYGSGSYYNEDYYYGMDV

SEQ ID NO: 14317 - protein, 9 aa, Homo sapiens
  Light chain CDR3 for antibody 7159 (IGKV1-27)
QKYNSAPYT

SEQ ID NO: 14318 - protein, 12 aa, Homo sapiens
  Heavy chain CDR3 for antibody 7159 (IGHV3-33)
ARKAYALYVLDV

SEQ ID NO: 14319 - protein, 9 aa, Homo sapiens
  Light chain CDR3 for antibody 7160 (IGKV1-27)
QKYNSAPYT

SEQ ID NO: 14320 - protein, 17 aa, Homo sapiens
  Heavy chain CDR3 for antibody 7160 (IGHV3-30)
ARDGVGATSYYYYGMDV

SEQ ID NO: 14321 - protein, 9 aa, Homo sapiens
  Light chain CDR3 for antibody 7161 (IGKV3-11)
QQRSNWPPT

SEQ ID NO: 14322 - protein, 12 aa, Homo sapiens
  Heavy chain CDR3 for antibody 7161 (IGHV3-33)
AREGTRWVYFDY

SEQ ID NO: 14323 - protein, 8 aa, Homo sapiens
  Light chain CDR3 for antibody 7162 (IGKV1D-13)
QQFNNYPT

SEQ ID NO: 14324 - protein, 13 aa, Homo sapiens
  Heavy chain CDR3 for antibody 7162 (IGHV3-33)
ARTDYYFYYGLDV

SEQ ID NO: 14325 - protein, 9 aa, Homo sapiens
  Light chain CDR3 for antibody 7163 (IGKV3-15)
QQYNNWPLT

SEQ ID NO: 14326 - protein, 18 aa, Homo sapiens
  Heavy chain CDR3 for antibody 7163 (IGHV3-33)
ARDYDSLTTYPEDYGMDV

SEQ ID NO: 14327 - protein, 9 aa, Homo sapiens
  Light chain CDR3 for antibody 7164 (IGKV2-30)
MQGTHWPLT

SEQ ID NO: 14328 - protein, 14 aa, Homo sapiens
  Heavy chain CDR3 for antibody 7164 (IGHV1-2)
ARDYYGSGNYYMGY

SEQ ID NO: 14329 - protein, 9 aa, Homo sapiens
  Light chain CDR3 for antibody 7165 (IGKV1-9)
QQLKSYLYT

SEQ ID NO: 14330 - protein, 19 aa, Homo sapiens
  Heavy chain CDR3 for antibody 7165 (IGHV1-18)
ARGGHIGVVTAFHGYGMDV

SEQ ID NO: 14331 - protein, 9 aa, Homo sapiens
  Light chain CDR3 for antibody 7166 (IGKV1-39)
QQGFSTPWT

SEQ ID NO: 14332 - protein, 16 aa, Homo sapiens
  Heavy chain CDR3 for antibody 7166 (IGHV3-23)
AKEGMVLRYFDWLWDY

SEQ ID NO: 14333 - protein, 9 aa, Homo sapiens
  Light chain CDR3 for antibody 7167 (IGKV1-5)
QQYNTYSRT

SEQ ID NO: 14334 - protein, 13 aa, Homo sapiens
  Heavy chain CDR3 for antibody 7167 (IGHV3-33)
ARGDNWNDGGFDY

SEQ ID NO: 14335 - protein, 9 aa, Homo sapiens
  Light chain CDR3 for antibody 7168 (IGKV1-9)
QQLKSYLYT

SEQ ID NO: 14336 - protein, 14 aa, Homo sapiens
  Heavy chain CDR3 for antibody 7168 (IGHV1-18)
AREGGSYFYYGVDV

SEQ ID NO: 14337 - protein, 9 aa, Homo sapiens
  Light chain CDR3 for antibody 7169 (IGKV1-39)
QQGFSTPWT

SEQ ID NO: 14338 - protein, 17 aa, Homo sapiens
  Heavy chain CDR3 for antibody 7169 (IGHV4-59)
ARDFLVRGEGSYYGMDV

SEQ ID NO: 14339 - protein, 8 aa, Homo sapiens
  Light chain CDR3 for antibody 7170 (IGKV3D-7)
QQDYNLLT

SEQ ID NO: 14340 - protein, 15 aa, Homo sapiens
  Heavy chain CDR3 for antibody 7170 (IGHV1-46)
ARGAVDDYYYYGMDV

SEQ ID NO: 14341 - protein, 10 aa, Homo sapiens
  Light chain CDR3 for antibody 7171 (IGKV1-17)
LQHNSYPMYT

SEQ ID NO: 14342 - protein, 16 aa, Homo sapiens
  Heavy chain CDR3 for antibody 7171 (IGHV3-23)
ARNWNDVGDYYYGMDV

SEQ ID NO: 14343 - protein, 9 aa, Homo sapiens
  Light chain CDR3 for antibody 7172 (IGKV1-16)
QQYNSYPLT

SEQ ID NO: 14344 - protein, 13 aa, Homo sapiens
  Heavy chain CDR3 for antibody 7172 (IGHV3-33)
GRTDYYSYYGVDV

SEQ ID NO: 14345 - protein, 9 aa, Homo sapiens
  Light chain CDR3 for antibody 7173 (IGKV1D-16)
QQYNSYPFT

SEQ ID NO: 14346 - protein, 13 aa, Homo sapiens
  Heavy chain CDR3 for antibody 7173 (IGHV3-15)
TTDRLLLFGAFDY

SEQ ID NO: 14347 - protein, 7 aa, Homo sapiens
  Light chain CDR3 for antibody 7174 (IGKV1-17)
LQHNSYP

SEQ ID NO: 14348 - protein, 13 aa, Homo sapiens
  Heavy chain CDR3 for antibody 7174 (IGHV4-34)
ASNFYYYYYGMDV

SEQ ID NO: 14349 - protein, 9 aa, Homo sapiens
  Light chain CDR3 for antibody 7175 (IGKV1-39)
QQSYSTPFT

SEQ ID NO: 14350 - protein, 18 aa, Homo sapiens
  Heavy chain CDR3 for antibody 7175 (IGHV3-33)
ARERYYYGSGSYPDAFDI

SEQ ID NO: 14351 - protein, 9 aa, Homo sapiens
  Light chain CDR3 for antibody 7176 (IGKV1-17)
LQHNSYPYT

SEQ ID NO: 14352 - protein, 13 aa, Homo sapiens
  Heavy chain CDR3 for antibody 7176 (IGHV3-33)
AREGDPQPDAFDI

SEQ ID NO: 14353 - protein, 8 aa, Homo sapiens
  Light chain CDR3 for antibody 7177 (IGKV3D-7)
QQDYSLLT

SEQ ID NO: 14354 - protein, 16 aa, Homo sapiens
  Heavy chain CDR3 for antibody 7177 (IGHV3-30)
ARDIAVAGHVYYGMDV

SEQ ID NO: 14355 - protein, 8 aa, Homo sapiens
  Light chain CDR3 for antibody 7178 (IGKV3D-7)
QQDYNLLT

SEQ ID NO: 14356 - protein, 17 aa, Homo sapiens
  Heavy chain CDR3 for antibody 7178 (IGHV3-33)
ARERYYGSGSYYNWFDP

SEQ ID NO: 14357 - protein, 8 aa, Homo sapiens
  Light chain CDR3 for antibody 7179 (IGKV3-20)
QQYGSSLT

SEQ ID NO: 14358 - protein, 14 aa, Homo sapiens
  Heavy chain CDR3 for antibody 7179 (IGHV3-33)
AREGYSSNWYDFDY

SEQ ID NO: 14359 - protein, 9 aa, Homo sapiens
  Light chain CDR3 for antibody 7180 (IGKV1-16)
QHYNDYPFT

SEQ ID NO: 14360 - protein, 17 aa, Homo sapiens
  Heavy chain CDR3 for antibody 7180 (IGHV1-18)
ARDEGYDILTGYPHFDY

SEQ ID NO: 14361 - protein, 8 aa, Homo sapiens
  Light chain CDR3 for antibody 7181 (IGKV1D-13)
QQFNNYPT

SEQ ID NO: 14362 - protein, 18 aa, Homo sapiens
  Heavy chain CDR3 for antibody 7181 (IGHV3-33)
ARERDYYGSGSYPDAFDI

SEQ ID NO: 14363 - protein, 8 aa, Homo sapiens
  Light chain CDR3 for antibody 7182 (IGKV1-5)
QQYNSYWT

SEQ ID NO: 14364 - protein, 20 aa, Homo sapiens
  Heavy chain CDR3 for antibody 7182 (IGHV3-11)
ARGGATLIRGLIDYYYGMDV

SEQ ID NO: 14365 - protein, 9 aa, Homo sapiens
  Light chain CDR3 for antibody 7183 (IGKV3D-7)
QQDYTLPLT

SEQ ID NO: 14366 - protein, 13 aa, Homo sapiens
  Heavy chain CDR3 for antibody 7183 (IGHV4-4)
ARERGIAAAGPDY

SEQ ID NO: 14367 - protein, 9 aa, Homo sapiens
  Light chain CDR3 for antibody 7184 (IGKV1-6)
QQYNSYPLT

SEQ ID NO: 14368 - protein, 14 aa, Homo sapiens
  Heavy chain CDR3 for antibody 7184 (IGHV3-20)
ARGGSSGWYDWFDP

SEQ ID NO: 14369 - protein, 10 aa, Homo sapiens
  Light chain CDR3 for antibody 7185 (IGKV3-11)
QQRSNWPALT

SEQ ID NO: 14370 - protein, 13 aa, Homo sapiens
  Heavy chain CDR3 for antibody 7185 (IGHV3-33)
ARAFTMVRGVIDY

SEQ ID NO: 14371 - protein, 9 aa, Homo sapiens
  Light chain CDR3 for antibody 7186 (IGKV1-27)
QKYNSAPYT

SEQ ID NO: 14372 - protein, 17 aa, Homo sapiens
  Heavy chain CDR3 for antibody 7186 (IGHV3-23)
AKDRPVTTLYYYFGMDV

SEQ ID NO: 14373 - protein, 10 aa, Homo sapiens
  Light chain CDR3 for antibody 7187 (IGKV3-11)
QQRSNWPIFT

SEQ ID NO: 14374 - protein, 14 aa, Homo sapiens
  Heavy chain CDR3 for antibody 7187 (IGHV1-2)
ARDYYGSGNYYMGY

SEQ ID NO: 14375 - protein, 10 aa, Homo sapiens
  Light chain CDR3 for antibody 7188 (IGKV1-6)
LQDYNYPMYT

SEQ ID NO: 14376 - protein, 20 aa, Homo sapiens
  Heavy chain CDR3 for antibody 7188 (IGHV3-23)
AKDREMAATSHYYYYYGMDV

SEQ ID NO: 14377 - protein, 9 aa, Homo sapiens
  Light chain CDR3 for antibody 7189 (IGKV1D-13)
QRFNNYLYT

SEQ ID NO: 14378 - protein, 18 aa, Homo sapiens
  Heavy chain CDR3 for antibody 7189 (IGHV3-33)
ARDRYYDILTGYYMGFDY

SEQ ID NO: 14379 - protein, 9 aa, Homo sapiens
  Light chain CDR3 for antibody 7190 (IGKV1-6)
LQDYKSPFT

SEQ ID NO: 14380 - protein, 16 aa, Homo sapiens
  Heavy chain CDR3 for antibody 7190 (IGHV4-59)
ARYSGSYYGDYYGMDV

SEQ ID NO: 14381 - protein, 10 aa, Homo sapiens
  Light chain CDR3 for antibody 7191 (IGKV3-11)
QQRSNWPIFT

SEQ ID NO: 14382 - protein, 15 aa, Homo sapiens
  Heavy chain CDR3 for antibody 7191 (IGHV3-23)
AKDGGWNYYYYGMDV

SEQ ID NO: 14383 - protein, 9 aa, Homo sapiens
  Light chain CDR3 for antibody 7192 (IGKV1D-16)
QQYYSYPRT

SEQ ID NO: 14384 - protein, 14 aa, Homo sapiens
  Heavy chain CDR3 for antibody 7192 (IGHV3-20)
ARDGGSTSFDWFDP

SEQ ID NO: 14385 - protein, 9 aa, Homo sapiens
  Light chain CDR3 for antibody 7193 (IGKV1-6)
LQDYNYPYT

SEQ ID NO: 14386 - protein, 15 aa, Homo sapiens
  Heavy chain CDR3 for antibody 7193 (IGHV3-23)
AKEGKLRYFDWLGDY

SEQ ID NO: 14387 - protein, 9 aa, Homo sapiens
  Light chain CDR3 for antibody 7194 (IGKV3D-7)
QQDYKLPLT

SEQ ID NO: 14388 - protein, 15 aa, Homo sapiens
  Heavy chain CDR3 for antibody 7194 (IGHV1-46)
AKDLSSGWYAYFFDY

SEQ ID NO: 14389 - protein, 9 aa, Homo sapiens
  Light chain CDR3 for antibody 7195 (IGKV1-9)
QQLISYPLT

SEQ ID NO: 14390 - protein, 12 aa, Homo sapiens
  Heavy chain CDR3 for antibody 7195 (IGHV1-24)
ASDWAYYYGMDV

SEQ ID NO: 14391 - protein, 10 aa, Homo sapiens
  Light chain CDR3 for antibody 7196 (IGKV1-39)
QQSYSTPMYT

SEQ ID NO: 14392 - protein, 13 aa, Homo sapiens
  Heavy chain CDR3 for antibody 7196 (IGHV3-33)
AKEDGDYHHYFDY

SEQ ID NO: 14393 - protein, 8 aa, Homo sapiens
  Light chain CDR3 for antibody 7197 (IGKV6-21)
HQSSSLPT

SEQ ID NO: 14394 - protein, 15 aa, Homo sapiens
  Heavy chain CDR3 for antibody 7197 (IGHV3-33)
ARDHLTGYYYYGMDV

SEQ ID NO: 14395 - protein, 9 aa, Homo sapiens
  Light chain CDR3 for antibody 7198 (IGKV3D-7)
QQDYNLPLT

SEQ ID NO: 14396 - protein, 18 aa, Homo sapiens
  Heavy chain CDR3 for antibody 7198 (IGHV3-13)
ARDYYGSGSLYYYYGMDV

SEQ ID NO: 14397 - protein, 9 aa, Homo sapiens
  Light chain CDR3 for antibody 7199 (IGKV1D-16)
QQYNSYPLT

SEQ ID NO: 14398 - protein, 18 aa, Homo sapiens
  Heavy chain CDR3 for antibody 7199 (IGHV3-33)
ARREGITMIFYYYYGMDV

SEQ ID NO: 14399 - protein, 9 aa, Homo sapiens
  Light chain CDR3 for antibody 7200 (IGKV5-2)
LQHDKFPYT

SEQ ID NO: 14400 - protein, 13 aa, Homo sapiens
  Heavy chain CDR3 for antibody 7200 (IGHV4-39)
ARHEVMIRGVFDY

SEQ ID NO: 14401 - protein, 8 aa, Homo sapiens
  Light chain CDR3 for antibody 7201 (IGKV1-17)
QQFNNYPT

SEQ ID NO: 14402 - protein, 13 aa, Homo sapiens
  Heavy chain CDR3 for antibody 7201 (IGHV3-33)
AKEDGDYHHYFDY

SEQ ID NO: 14403 - protein, 9 aa, Homo sapiens
  Light chain CDR3 for antibody 7202 (IGKV4-1)
QQYYSTPWT

SEQ ID NO: 14404 - protein, 9 aa, Homo sapiens
  Heavy chain CDR3 for antibody 7202 (IGHV3-33)
ARATVGVDY

SEQ ID NO: 14405 - protein, 9 aa, Homo sapiens
  Light chain CDR3 for antibody 7203 (IGKV6-21)
HQSYSLPHT

SEQ ID NO: 14406 - protein, 17 aa, Homo sapiens
  Heavy chain CDR3 for antibody 7203 (IGHV1-18)
ARERYYGSGNYKYNMDV

SEQ ID NO: 14407 - protein, 9 aa, Homo sapiens
  Light chain CDR3 for antibody 7204 (IGKV3-15)
QQYNNWPRT

SEQ ID NO: 14408 - protein, 9 aa, Homo sapiens
  Heavy chain CDR3 for antibody 7204 (IGHV3-30)
ARDYFHYDY

SEQ ID NO: 14409 - protein, 10 aa, Homo sapiens
  Light chain CDR3 for antibody 7205 (IGKV3-11)
QQRSNWPIWT

SEQ ID NO: 14410 - protein, 17 aa, Homo sapiens
  Heavy chain CDR3 for antibody 7205 (IGHV3-15)
TTERYPRRYYYYFGMDV

SEQ ID NO: 14411 - protein, 9 aa, Homo sapiens
  Light chain CDR3 for antibody 7206 (IGKV3-15)
QQYNNWPRT

SEQ ID NO: 14412 - protein, 18 aa, Homo sapiens
  Heavy chain CDR3 for antibody 7206 (IGHV3-33)
ARGGVLYDILTGFYGMDV

SEQ ID NO: 14413 - protein, 9 aa, Homo sapiens
  Light chain CDR3 for antibody 7207 (IGKV3D-7)
QQDYNLPWT

SEQ ID NO: 14414 - protein, 9 aa, Homo sapiens
  Heavy chain CDR3 for antibody 7207 (IGHV3-33)
AREYKEFDY

SEQ ID NO: 14415 - protein, 10 aa, Homo sapiens
  Light chain CDR3 for antibody 7208 (IGKV1-39)
QQSYSTPMYT

SEQ ID NO: 14416 - protein, 10 aa, Homo sapiens
  Heavy chain CDR3 for antibody 7208 (IGHV3-33)
ARDGSGSQPI

SEQ ID NO: 14417 - protein, 9 aa, Homo sapiens
  Light chain CDR3 for antibody 7209 (IGKV3D-7)
QQDYNLPWT

SEQ ID NO: 14418 - protein, 10 aa, Homo sapiens
  Heavy chain CDR3 for antibody 7209 (IGHV3-23)
AKDHWGDFDY

SEQ ID NO: 14419 - protein, 9 aa, Homo sapiens
  Light chain CDR3 for antibody 7210 (IGKV6-21)
HQSSSLPYT

SEQ ID NO: 14420 - protein, 20 aa, Homo sapiens
  Heavy chain CDR3 for antibody 7210 (IGHV3-23)
TKDRYSDSSGYYLYYNDMDV

SEQ ID NO: 14421 - protein, 10 aa, Homo sapiens
  Light chain CDR3 for antibody 7211 (IGKV3-11)
QQRSNWPIFT

SEQ ID NO: 14422 - protein, 16 aa, Homo sapiens
  Heavy chain CDR3 for antibody 7211 (IGHV3-23)
ARDQGILTGYYTALDY

SEQ ID NO: 14423 - protein, 9 aa, Homo sapiens
  Light chain CDR3 for antibody 7212 (IGKV1-6)
LQDYKSPFT

SEQ ID NO: 14424 - protein, 20 aa, Homo sapiens
  Heavy chain CDR3 for antibody 7212 (IGHV3-33)
SRGGATLVRGVIDYYYGMDV

SEQ ID NO: 14425 - protein, 8 aa, Homo sapiens
  Light chain CDR3 for antibody 7213 (IGKV3D-7)
QQDYNLLT

SEQ ID NO: 14426 - protein, 18 aa, Homo sapiens
  Heavy chain CDR3 for antibody 7213 (IGHV3-33)
VRDRERYGSGSYPDAFDI

SEQ ID NO: 14427 - protein, 9 aa, Homo sapiens
  Light chain CDR3 for antibody 7214 (IGKV1-16)
QQYTSYPFT

SEQ ID NO: 14428 - protein, 18 aa, Homo sapiens
  Heavy chain CDR3 for antibody 7214 (IGHV1-46)
ARDGDYVWGSYRSNWFDP

SEQ ID NO: 14429 - protein, 9 aa, Homo sapiens
  Light chain CDR3 for antibody 7215 (IGKV1-6)
LQDYKSPFT

SEQ ID NO: 14430 - protein, 13 aa, Homo sapiens
  Heavy chain CDR3 for antibody 7215 (IGHV1-46)
ARVKLGSLGAFDI

SEQ ID NO: 14431 - protein, 9 aa, Homo sapiens
  Light chain CDR3 for antibody 7216 (IGKV1-9)
QQYNTYSRT

SEQ ID NO: 14432 - protein, 11 aa, Homo sapiens
  Heavy chain CDR3 for antibody 7216 (IGHV3-33)
AREAANWGFDY

SEQ ID NO: 14433 - protein, 9 aa, Homo sapiens
  Light chain CDR3 for antibody 7217 (IGKV1-27)
QKYNSAPYT

SEQ ID NO: 14434 - protein, 17 aa, Homo sapiens
  Heavy chain CDR3 for antibody 7217 (IGHV3-33)
ARKDYGILSGYYSPFDY

SEQ ID NO: 14435 - protein, 9 aa, Homo sapiens
  Light chain CDR3 for antibody 7218 (IGKV1D-16)
QQYDSYPYT

SEQ ID NO: 14436 - protein, 19 aa, Homo sapiens
  Heavy chain CDR3 for antibody 7218 (IGHV3-33)
ARGSDYDILTGYSSDAFDI

SEQ ID NO: 14437 - protein, 9 aa, Homo sapiens
  Light chain CDR3 for antibody 7219 (IGKV3-15)
QQYNNWPLT

SEQ ID NO: 14438 - protein, 24 aa, Homo sapiens
  Heavy chain CDR3 for antibody 7219 (IGHV3-20)
ARGRITMVRGVIINPLDYYNGMDV

SEQ ID NO: 14439 - protein, 9 aa, Homo sapiens
  Light chain CDR3 for antibody 7220 (IGKV1-9)
QQLISYPLT

SEQ ID NO: 14440 - protein, 14 aa, Homo sapiens
  Heavy chain CDR3 for antibody 7220 (IGHV3-33)
ARDREQQLVRYFDY

SEQ ID NO: 14441 - protein, 10 aa, Homo sapiens
  Light chain CDR3 for antibody 7221 (IGKV3-11)
QQRSNWPALT

SEQ ID NO: 14442 - protein, 12 aa, Homo sapiens
  Heavy chain CDR3 for antibody 7221 (IGHV3-33)
ARKGYDMHEFDI

SEQ ID NO: 14443 - protein, 9 aa, Homo sapiens
  Light chain CDR3 for antibody 7222 (IGKV3-15)
QQYNNWPYT

SEQ ID NO: 14444 - protein, 11 aa, Homo sapiens
  Heavy chain CDR3 for antibody 7222 (IGHV3-33)
ARARYTTGLDY

SEQ ID NO: 14445 - protein, 8 aa, Homo sapiens
  Light chain CDR3 for antibody 7223 (IGKV1D-13)
QQFNNYPT

SEQ ID NO: 14446 - protein, 13 aa, Homo sapiens
  Heavy chain CDR3 for antibody 7223 (IGHV3-33)
ARDYTMVRGVMNY

SEQ ID NO: 14447 - protein, 9 aa, Homo sapiens
  Light chain CDR3 for antibody 7224 (IGKV1-6)
LQDYKSPFT

SEQ ID NO: 14448 - protein, 18 aa, Homo sapiens
  Heavy chain CDR3 for antibody 7224 (IGHV3-33)
ARERYYYGSGSYPDAFDI

SEQ ID NO: 14449 - protein, 9 aa, Homo sapiens
  Light chain CDR3 for antibody 7225 (IGKV1-9)
QQGNTYSRT

SEQ ID NO: 14450 - protein, 12 aa, Homo sapiens
  Heavy chain CDR3 for antibody 7225 (IGHV4-59)
ARDRSGWAYFDY

SEQ ID NO: 14451 - protein, 10 aa, Homo sapiens
  Light chain CDR3 for antibody 7226 (IGKV1-39)
QQSYSSPMYT

SEQ ID NO: 14452 - protein, 14 aa, Homo sapiens
  Heavy chain CDR3 for antibody 7226 (IGHV3-33)
ARDGYDFLTGPFDY

SEQ ID NO: 14453 - protein, 9 aa, Homo sapiens
  Light chain CDR3 for antibody 7227 (IGKV1D-16)
QQYNSYPYT

SEQ ID NO: 14454 - protein, 12 aa, Homo sapiens
  Heavy chain CDR3 for antibody 7227 (IGHV3-h)
AGEDYYYYGMDV

SEQ ID NO: 14455 - protein, 8 aa, Homo sapiens
  Light chain CDR3 for antibody 7228 (IGKV3D-7)
QQDYNLLT

SEQ ID NO: 14456 - protein, 12 aa, Homo sapiens
  Heavy chain CDR3 for antibody 7228 (IGHV1-18)
AGVLFDGDYFDY

SEQ ID NO: 14457 - protein, 10 aa, Homo sapiens
  Light chain CDR3 for antibody 7229 (IGKV1-17)
LQHNSYPMYT

SEQ ID NO: 14458 - protein, 18 aa, Homo sapiens
  Heavy chain CDR3 for antibody 7229 (IGHV3-33)
ARDYDSLTTYPEDYGMDV

SEQ ID NO: 14459 - protein, 9 aa, Homo sapiens
  Light chain CDR3 for antibody 7230 (IGKV1-9)
QQLNSYPLT

SEQ ID NO: 14460 - protein, 11 aa, Homo sapiens
  Heavy chain CDR3 for antibody 7230 (IGHV1-24)
ATYFGSGSLDY

SEQ ID NO: 14461 - protein, 9 aa, Homo sapiens
  Light chain CDR3 for antibody 7231 (IGKV1-9)
QQLKSYLYT

SEQ ID NO: 14462 - protein, 13 aa, Homo sapiens
  Heavy chain CDR3 for antibody 7231 (IGHV1-18)
ARRQVGYYYGMDV

SEQ ID NO: 14463 - protein, 9 aa, Homo sapiens
  Light chain CDR3 for antibody 7232 (IGKV1-33)
QQYDNLPFT

SEQ ID NO: 14464 - protein, 14 aa, Homo sapiens
  Heavy chain CDR3 for antibody 7232 (IGHV3-33)
ARDKSYPLSYGMDV

SEQ ID NO: 14465 - protein, 9 aa, Homo sapiens
  Light chain CDR3 for antibody 7233 (IGKV1-9)
QQLKSYLYT

SEQ ID NO: 14466 - protein, 16 aa, Homo sapiens
  Heavy chain CDR3 for antibody 7233 (IGHV1-8)
AREGTMVRGVTYAFDI

SEQ ID NO: 14467 - protein, 9 aa, Homo sapiens
  Light chain CDR3 for antibody 7234 (IGKV3D-7)
QQDYEFPLT

SEQ ID NO: 14468 - protein, 26 aa, Homo sapiens
  Heavy chain CDR3 for antibody 7234 (IGHV4-39)
ARQGLLWFGDLKAYDSSGYYYGYFHH

SEQ ID NO: 14469 - protein, 9 aa, Homo sapiens
  Light chain CDR3 for antibody 7235 (IGKV6-21)
HQSSSLPLT

SEQ ID NO: 14470 - protein, 11 aa, Homo sapiens
  Heavy chain CDR3 for antibody 7235 (IGHV3-33)
ARDPLTGDIDL

SEQ ID NO: 14471 - protein, 9 aa, Homo sapiens
  Light chain CDR3 for antibody 7236 (IGKV1-6)
QQEYNYPLT

SEQ ID NO: 14472 - protein, 15 aa, Homo sapiens
  Heavy chain CDR3 for antibody 7236 (IGHV3-33)
ARDRVVRGVMGYFDY

SEQ ID NO: 14473 - protein, 9 aa, Homo sapiens
  Light chain CDR3 for antibody 7237 (IGKV1-39)
QQSYSSPFT

SEQ ID NO: 14474 - protein, 13 aa, Homo sapiens
  Heavy chain CDR3 for antibody 7237 (IGHV3-33)
ARDYCGGDCYLDY

SEQ ID NO: 14475 - protein, 10 aa, Homo sapiens
  Light chain CDR3 for antibody 7238 (IGKV3-11)
QQRSNWPMYT

SEQ ID NO: 14476 - protein, 9 aa, Homo sapiens
  Heavy chain CDR3 for antibody 7238 (IGHV3-13)
ARDHWYFDL

SEQ ID NO: 14477 - protein, 9 aa, Homo sapiens
  Light chain CDR3 for antibody 7239 (IGKV1D-16)
QQYNSYPYT

SEQ ID NO: 14478 - protein, 13 aa, Homo sapiens
  Heavy chain CDR3 for antibody 7239 (IGHV3-20)
ASDYGDYVGAFDI

SEQ ID NO: 14479 - protein, 9 aa, Homo sapiens
  Light chain CDR3 for antibody 7240 (IGKV6-21)
HQSSSLPYT

SEQ ID NO: 14480 - protein, 17 aa, Homo sapiens
  Heavy chain CDR3 for antibody 7240 (IGHV4-59)
AREEDYFGSGSFGTFDI

SEQ ID NO: 14481 - protein, 9 aa, Homo sapiens
  Light chain CDR3 for antibody 7241 (IGKV1-39)
QQSYRTPLT

SEQ ID NO: 14482 - protein, 16 aa, Homo sapiens
  Heavy chain CDR3 for antibody 7241 (IGHV4-59)
ARDTPYYSGSGRPFDH

SEQ ID NO: 14483 - protein, 9 aa, Homo sapiens
  Light chain CDR3 for antibody 7242 (IGKV1-33)
QQYDNLPFT

SEQ ID NO: 14484 - protein, 20 aa, Homo sapiens
  Heavy chain CDR3 for antibody 7242 (IGHV3-33)
ARDPAQLERRYYYFYYGMDV

SEQ ID NO: 14485 - protein, 9 aa, Homo sapiens
  Light chain CDR3 for antibody 7243 (IGKV3D-7)
QQDYNLPWT

SEQ ID NO: 14486 - protein, 17 aa, Homo sapiens
  Heavy chain CDR3 for antibody 7243 (IGHV4-39)
AGRLTYYFGSGSPSFDY

SEQ ID NO: 14487 - protein, 8 aa, Homo sapiens
  Light chain CDR3 for antibody 7244 (IGKV6-21)
HQSSSLPT

SEQ ID NO: 14488 - protein, 17 aa, Homo sapiens
  Heavy chain CDR3 for antibody 7244 (IGHV1-18)
ARDEGYDILTGYPHFDY

SEQ ID NO: 14489 - protein, 9 aa, Homo sapiens
  Light chain CDR3 for antibody 7245 (IGKV1D-13)
QQFNNYPHT

SEQ ID NO: 14490 - protein, 14 aa, Homo sapiens
  Heavy chain CDR3 for antibody 7245 (IGHV3-23)
ARDGIVRATDAFAI

SEQ ID NO: 14491 - protein, 8 aa, Homo sapiens
  Light chain CDR3 for antibody 7246 (IGKV3D-7)
QQDYNLLT

SEQ ID NO: 14492 - protein, 12 aa, Homo sapiens
  Heavy chain CDR3 for antibody 7246 (IGHV3-33)
ARDGYSSRNFDY

SEQ ID NO: 14493 - protein, 9 aa, Homo sapiens
  Light chain CDR3 for antibody 7247 (IGKV3D-7)
QQDYNLPLT

SEQ ID NO: 14494 - protein, 24 aa, Homo sapiens
  Heavy chain CDR3 for antibody 7247 (IGHV3-20)
ARGRITMVRGVIINPLDYYNGMDV

SEQ ID NO: 14495 - protein, 9 aa, Homo sapiens
  Light chain CDR3 for antibody 7248 (IGKV1-17)
LQQNSYPWT

SEQ ID NO: 14496 - protein, 12 aa, Homo sapiens
  Heavy chain CDR3 for antibody 7248 (IGHV3-33)
ARKDSGYDWFDY

SEQ ID NO: 14497 - protein, 10 aa, Homo sapiens
  Light chain CDR3 for antibody 7249 (IGKV1-39)
QQSYSTPMYT

SEQ ID NO: 14498 - protein, 20 aa, Homo sapiens
  Heavy chain CDR3 for antibody 7249 (IGHV3-20)
ARDLCSSTSCYGYYYYGMDV

SEQ ID NO: 14499 - protein, 8 aa, Homo sapiens
  Light chain CDR3 for antibody 7250 (IGKV3-11)
QQRSNWLT

SEQ ID NO: 14500 - protein, 16 aa, Homo sapiens
  Heavy chain CDR3 for antibody 7250 (IGHV3-33)
ARAVYYGSGSSLIMDV

SEQ ID NO: 14501 - protein, 9 aa, Homo sapiens
  Light chain CDR3 for antibody 7251 (IGKV1D-16)
QQYYSYPRT

SEQ ID NO: 14502 - protein, 19 aa, Homo sapiens
  Heavy chain CDR3 for antibody 7251 (IGHV3-33)
ARGVRLRYFDPYYYYGMDV

SEQ ID NO: 14503 - protein, 11 aa, Homo sapiens
  Light chain CDR3 for antibody 7252 (IGKV3-11)
QQRSNWPPTWT

SEQ ID NO: 14504 - protein, 9 aa, Homo sapiens
  Heavy chain CDR3 for antibody 7252 (IGHV4-59)
ARGGASFDY

SEQ ID NO: 14505 - protein, 9 aa, Homo sapiens
  Light chain CDR3 for antibody 7253 (IGKV1-6)
LQDYIYPWT

SEQ ID NO: 14506 - protein, 11 aa, Homo sapiens
  Heavy chain CDR3 for antibody 7253 (IGHV3-20)
ARDGAVAGLDY

SEQ ID NO: 14507 - protein, 10 aa, Homo sapiens
  Light chain CDR3 for antibody 7254 (IGKV3-11)
QQRSNWPIFT

SEQ ID NO: 14508 - protein, 23 aa, Homo sapiens
  Heavy chain CDR3 for antibody 7254 (IGHV3-11)
ARDEGVTMVRGVISYYYYYGMDV

SEQ ID NO: 14509 - protein, 10 aa, Homo sapiens
  Light chain CDR3 for antibody 7255 (IGKV1-39)
QQSYSTPMYT

SEQ ID NO: 14510 - protein, 17 aa, Homo sapiens
  Heavy chain CDR3 for antibody 7255 (IGHV3-33)
ARESLKLGIYYYYGMDV

SEQ ID NO: 14511 - protein, 9 aa, Homo sapiens
  Light chain CDR3 for antibody 7256 (IGKV3D-20)
HQYGSSPLT

SEQ ID NO: 14512 - protein, 15 aa, Homo sapiens
  Heavy chain CDR3 for antibody 7256 (IGHV4-39)
ARRDYDILTGYLFDY

SEQ ID NO: 14513 - protein, 9 aa, Homo sapiens
  Light chain CDR3 for antibody 7257 (IGKV3D-20)
QQYGTSPYT

SEQ ID NO: 14514 - protein, 8 aa, Homo sapiens
  Heavy chain CDR3 for antibody 7257 (IGHV3-33)
ARGGYDIL

SEQ ID NO: 14515 - protein, 9 aa, Homo sapiens
  Light chain CDR3 for antibody 7258 (IGKV2-30)
MQGTHWPLT

SEQ ID NO: 14516 - protein, 13 aa, Homo sapiens
  Heavy chain CDR3 for antibody 7258 (IGHV1-46)
ARVKLGSLGAFDI

SEQ ID NO: 14517 - protein, 9 aa, Homo sapiens
  Light chain CDR3 for antibody 7259 (IGKV3-11)
QQRSNWPPT

SEQ ID NO: 14518 - protein, 17 aa, Homo sapiens
  Heavy chain CDR3 for antibody 7259 (IGHV4-59)
ARRITMVREIIITAFDY

SEQ ID NO: 14519 - protein, 9 aa, Homo sapiens
  Light chain CDR3 for antibody 7260 (IGKV3-20)
QQYGSSPYT

SEQ ID NO: 14520 - protein, 17 aa, Homo sapiens
  Heavy chain CDR3 for antibody 7260 (IGHV3-33)
AKGDYYGSGSYSTFFDY

SEQ ID NO: 14521 - protein, 9 aa, Homo sapiens
  Light chain CDR3 for antibody 7261 (IGKV6-21)
HQSNRLPLT

SEQ ID NO: 14522 - protein, 16 aa, Homo sapiens
  Heavy chain CDR3 for antibody 7261 (IGHV3-23)
AKEGMVLRYFDWLWDY

SEQ ID NO: 14523 - protein, 9 aa, Homo sapiens
  Light chain CDR3 for antibody 7262 (IGKV3D-7)
QQDYNLPYT

SEQ ID NO: 14524 - protein, 22 aa, Homo sapiens
  Heavy chain CDR3 for antibody 7262 (IGHV3-74)
AKDDLPYYDILTHSTTTGGMDV

SEQ ID NO: 14525 - protein, 8 aa, Homo sapiens
  Light chain CDR3 for antibody 7263 (IGKV3-20)
QQYGSSFT

SEQ ID NO: 14526 - protein, 13 aa, Homo sapiens
  Heavy chain CDR3 for antibody 7263 (IGHV3-33)
ARGDNWNDGGFDY

SEQ ID NO: 14527 - protein, 9 aa, Homo sapiens
  Light chain CDR3 for antibody 7264 (IGKV1-16)
QQYNSYPLT

SEQ ID NO: 14528 - protein, 15 aa, Homo sapiens
  Heavy chain CDR3 for antibody 7264 (IGHV3-30)
TKDEYPGNQIEAFDI

SEQ ID NO: 14529 - protein, 9 aa, Homo sapiens
  Light chain CDR3 for antibody 7265 (IGKV1-6)
LQDYNYPRT

SEQ ID NO: 14530 - protein, 9 aa, Homo sapiens
  Heavy chain CDR3 for antibody 7265 (IGHV3-33)
ARGRVSLDV

SEQ ID NO: 14531 - protein, 10 aa, Homo sapiens
  Light chain CDR3 for antibody 7266 (IGKV3-15)
QQYNNWPPLT

SEQ ID NO: 14532 - protein, 20 aa, Homo sapiens
  Heavy chain CDR3 for antibody 7266 (IGHV1-18)
AREVGIAVAGTLYYYYGMDV

SEQ ID NO: 14533 - protein, 9 aa, Homo sapiens
  Light chain CDR3 for antibody 7267 (IGKV2D-28)
MQALQTPPT

SEQ ID NO: 14534 - protein, 15 aa, Homo sapiens
  Heavy chain CDR3 for antibody 7267 (IGHV1-18)
ARGYCSSTSCYYFDY

SEQ ID NO: 14535 - protein, 9 aa, Homo sapiens
  Light chain CDR3 for antibody 7268 (IGKV1-6)
LQDFHYPWT

SEQ ID NO: 14536 - protein, 18 aa, Homo sapiens
  Heavy chain CDR3 for antibody 7268 (IGHV3-11)
AKDRITGTTYGYYSGLDV

SEQ ID NO: 14537 - protein, 8 aa, Homo sapiens
  Light chain CDR3 for antibody 7269 (IGKV3-11)
QQRGNWPS

SEQ ID NO: 14538 - protein, 13 aa, Homo sapiens
  Heavy chain CDR3 for antibody 7269 (IGHV4-34)
ASNFYYYYYGMDV

SEQ ID NO: 14539 - protein, 8 aa, Homo sapiens
  Light chain CDR3 for antibody 7270 (IGKV3D-7)
QQDYNLLT

SEQ ID NO: 14540 - protein, 13 aa, Homo sapiens
  Heavy chain CDR3 for antibody 7270 (IGHV3-30)
AAPFMVRGDGMDV

SEQ ID NO: 14541 - protein, 8 aa, Homo sapiens
  Light chain CDR3 for antibody 7271 (IGKV1-5)
QQYNSYWT

SEQ ID NO: 14542 - protein, 24 aa, Homo sapiens
  Heavy chain CDR3 for antibody 7271 (IGHV3-20)
ARGRITMVRGVIINPLDYYNGMDV

SEQ ID NO: 14543 - protein, 9 aa, Homo sapiens
  Light chain CDR3 for antibody 7272 (IGKV5-2)
LQHDKFPYT

SEQ ID NO: 14544 - protein, 16 aa, Homo sapiens
  Heavy chain CDR3 for antibody 7272 (IGHV3-23)
ARNDILTASGYYGMDV

SEQ ID NO: 14545 - protein, 10 aa, Homo sapiens
  Light chain CDR3 for antibody 7273 (IGKV3-11)
QQRSNWPTWT

SEQ ID NO: 14546 - protein, 14 aa, Homo sapiens
  Heavy chain CDR3 for antibody 7273 (IGHV1-46)
ARKGIVGAFDAFDI

SEQ ID NO: 14547 - protein, 9 aa, Homo sapiens
  Light chain CDR3 for antibody 7274 (IGKV3-11)
QQRSNWPRT

SEQ ID NO: 14548 - protein, 21 aa, Homo sapiens
  Heavy chain CDR3 for antibody 7274 (IGHV1-18)
ASGVLIWFGELLSEDYYDMDV

SEQ ID NO: 14549 - protein, 9 aa, Homo sapiens
  Light chain CDR3 for antibody 7275 (IGKV3-20)
QQFGRSPRT

SEQ ID NO: 14550 - protein, 12 aa, Homo sapiens
  Heavy chain CDR3 for antibody 7275 (IGHV1-18)
ARILFYGDYFDY

SEQ ID NO: 14551 - protein, 10 aa, Homo sapiens
  Light chain CDR3 for antibody 7276 (IGKV1-39)
QQSYSTPMYT

SEQ ID NO: 14552 - protein, 12 aa, Homo sapiens
  Heavy chain CDR3 for antibody 7276 (IGHV3-33)
AREGTRWVYFDY

SEQ ID NO: 14553 - protein, 9 aa, Homo sapiens
  Light chain CDR3 for antibody 7277 (IGKV1-39)
QQSYRTPLT

SEQ ID NO: 14554 - protein, 11 aa, Homo sapiens
  Heavy chain CDR3 for antibody 7277 (IGHV3-33)
ARAGIAAVFDY

SEQ ID NO: 14555 - protein, 8 aa, Homo sapiens
  Light chain CDR3 for antibody 7278 (IGKV3D-7)
QQDYNLLT

SEQ ID NO: 14556 - protein, 17 aa, Homo sapiens
  Heavy chain CDR3 for antibody 7278 (IGHV3-33)
ARGDGDILTGYYEWFDP

SEQ ID NO: 14557 - protein, 9 aa, Homo sapiens
  Light chain CDR3 for antibody 7279 (IGKV1D-13)
QRFNNYLYT

SEQ ID NO: 14558 - protein, 19 aa, Homo sapiens
  Heavy chain CDR3 for antibody 7279 (IGHV3-33)
ARGVRLRYFDPYYYYGMDV

SEQ ID NO: 14559 - protein, 10 aa, Homo sapiens
  Light chain CDR3 for antibody 7280 (IGKV1-17)
LQHNSYPMYT

SEQ ID NO: 14560 - protein, 20 aa, Homo sapiens
  Heavy chain CDR3 for antibody 7280 (IGHV3-23)
AKDREMAATSHYYYYYGMDV

SEQ ID NO: 14561 - protein, 9 aa, Homo sapiens
  Light chain CDR3 for antibody 7281 (IGKV3D-7)
QQDYNLPYT

SEQ ID NO: 14562 - protein, 16 aa, Homo sapiens
  Heavy chain CDR3 for antibody 7281 (IGHV3-30)
ARDIAVAGHVYYGMDV

SEQ ID NO: 14563 - protein, 6 aa, Homo sapiens
  Light chain CDR3 for antibody 7282 (IGKV3-20)
QQYGST

SEQ ID NO: 14564 - protein, 15 aa, Homo sapiens
  Heavy chain CDR3 for antibody 7282 (IGHV3-33)
ARRICSGGSCSLFDY

SEQ ID NO: 14565 - protein, 9 aa, Homo sapiens
  Light chain CDR3 for antibody 7283 (IGKV1-9)
QQLKSYLYT

SEQ ID NO: 14566 - protein, 14 aa, Homo sapiens
  Heavy chain CDR3 for antibody 7283 (IGHV3-33)
ARQYSYGYPYYFDY

SEQ ID NO: 14567 - protein, 8 aa, Homo sapiens
  Light chain CDR3 for antibody 7284 (IGKV3D-7)
QQDYNLLT

SEQ ID NO: 14568 - protein, 20 aa, Homo sapiens
  Heavy chain CDR3 for antibody 7284 (IGHV3-33)
AREDYYGSGSYYPAYNWFDP

SEQ ID NO: 14569 - protein, 8 aa, Homo sapiens
  Light chain CDR3 for antibody 7285 (IGKV1-5)
QQYNSYYT

SEQ ID NO: 14570 - protein, 11 aa, Homo sapiens
  Heavy chain CDR3 for antibody 7285 (IGHV3-23)
AKGLWSYYFDY

SEQ ID NO: 14571 - protein, 9 aa, Homo sapiens
  Light chain CDR3 for antibody 7286 (IGKV3-15)
QQYNNWPLT

SEQ ID NO: 14572 - protein, 14 aa, Homo sapiens
  Heavy chain CDR3 for antibody 7286 (IGHV3-33)
AREGYSSNWYDFDY

SEQ ID NO: 14573 - protein, 6 aa, Homo sapiens
  Light chain CDR3 for antibody 7287 (IGKV3-20)
QQYGST

SEQ ID NO: 14574 - protein, 18 aa, Homo sapiens
  Heavy chain CDR3 for antibody 7287 (IGHV3-23)
AKDRITGTTYGYYSGLDV

SEQ ID NO: 14575 - protein, 8 aa, Homo sapiens
  Light chain CDR3 for antibody 7288 (IGKV3D-7)
QQYGSSLT

SEQ ID NO: 14576 - protein, 19 aa, Homo sapiens
  Heavy chain CDR3 for antibody 7288 (IGHV3-33)
ARGPYYDILTGYGYYGMDV

SEQ ID NO: 14577 - protein, 9 aa, Homo sapiens
  Light chain CDR3 for antibody 7289 (IGKV1-9)
QQLNSYPWT

SEQ ID NO: 14578 - protein, 12 aa, Homo sapiens
  Heavy chain CDR3 for antibody 7289 (IGHV4-61)
ARVGSSGWYFDY

SEQ ID NO: 14579 - protein, 8 aa, Homo sapiens
  Light chain CDR3 for antibody 7290 (IGKV1-5)
QQYNSYYT

SEQ ID NO: 14580 - protein, 18 aa, Homo sapiens
  Heavy chain CDR3 for antibody 7290 (IGHV3-33)
ARERGYYGSDIYPAAFDI

SEQ ID NO: 14581 - protein, 8 aa, Homo sapiens
  Light chain CDR3 for antibody 7291 (IGKV3D-7)
QQDYNLLT

SEQ ID NO: 14582 - protein, 12 aa, Homo sapiens
  Heavy chain CDR3 for antibody 7291 (IGHV3-33)
ARDSSGWSHFDY

SEQ ID NO: 14583 - protein, 9 aa, Homo sapiens
  Light chain CDR3 for antibody 7292 (IGKV3-11)
QQRSNWPYT

SEQ ID NO: 14584 - protein, 18 aa, Homo sapiens
  Heavy chain CDR3 for antibody 7292 (IGHV1-18)
ARDRYYYDSGSYYYGMDV

SEQ ID NO: 14585 - protein, 9 aa, Homo sapiens
  Light chain CDR3 for antibody 7293 (IGKV1-39)
QQSYSTPLT

SEQ ID NO: 14586 - protein, 14 aa, Homo sapiens
  Heavy chain CDR3 for antibody 7293 (IGHV3-33)
ARDRDIMATSYFDY

SEQ ID NO: 14587 - protein, 10 aa, Homo sapiens
  Light chain CDR3 for antibody 7294 (IGKV1-39)
QQSYSTPMYT

SEQ ID NO: 14588 - protein, 16 aa, Homo sapiens
  Heavy chain CDR3 for antibody 7294 (IGHV3-33)
ARGYDMLTGDYYGMDV

SEQ ID NO: 14589 - protein, 9 aa, Homo sapiens
  Light chain CDR3 for antibody 7295 (IGKV1D-16)
QQYHSYPYT

SEQ ID NO: 14590 - protein, 17 aa, Homo sapiens
  Heavy chain CDR3 for antibody 7295 (IGHV1-8)
ARGDYYGSGSPYWYFDL

SEQ ID NO: 14591 - protein, 6 aa, Homo sapiens
  Light chain CDR3 for antibody 7296 (IGKV3-20)
QQYGST

SEQ ID NO: 14592 - protein, 12 aa, Homo sapiens
  Heavy chain CDR3 for antibody 7296 (IGHV3-33)
ARDLVGATPFDY

SEQ ID NO: 14593 - protein, 9 aa, Homo sapiens
  Light chain CDR3 for antibody 7297 (IGKV2D-28)
MQVLQTPFT

SEQ ID NO: 14594 - protein, 9 aa, Homo sapiens
  Heavy chain CDR3 for antibody 7297 (IGHV4-59)
AREGGSGSL

SEQ ID NO: 14595 - protein, 8 aa, Homo sapiens
  Light chain CDR3 for antibody 7298 (IGKV3-20)
QQYGRSFT

SEQ ID NO: 14596 - protein, 26 aa, Homo sapiens
  Heavy chain CDR3 for antibody 7298 (IGHV4-39)
ARQGLLWFGDLKAYDSSGYYYGYFHH

SEQ ID NO: 14597 - protein, 9 aa, Homo sapiens
  Light chain CDR3 for antibody 7299 (IGKV1-5)
QQYNTYSRT

SEQ ID NO: 14598 - protein, 15 aa, Homo sapiens
  Heavy chain CDR3 for antibody 7299 (IGHV3-74)
ARGAMVRGVDYGMDV

SEQ ID NO: 14599 - protein, 8 aa, Homo sapiens
  Light chain CDR3 for antibody 7300 (IGKV1-5)
QQYNSYYT

SEQ ID NO: 14600 - protein, 15 aa, Homo sapiens
  Heavy chain CDR3 for antibody 7300 (IGHV3-33)
ARDHLTGYYYYGMDV

SEQ ID NO: 14601 - protein, 9 aa, Homo sapiens
  Light chain CDR3 for antibody 7301 (IGKV1-9)
QQGNTYSRT

SEQ ID NO: 14602 - protein, 9 aa, Homo sapiens
  Heavy chain CDR3 for antibody 7301 (IGHV4-59)
AGGSWDFDY

SEQ ID NO: 14603 - protein, 9 aa, Homo sapiens
  Light chain CDR3 for antibody 7302 (IGKV2-30)
MQGTHWPLT

SEQ ID NO: 14604 - protein, 16 aa, Homo sapiens
  Heavy chain CDR3 for antibody 7302 (IGHV3-23)
AKEGEVLRYFDWLFNY

SEQ ID NO: 14605 - protein, 10 aa, Homo sapiens
  Light chain CDR3 for antibody 7303 (IGKV3-20)
QQYGSSPMYT

SEQ ID NO: 14606 - protein, 13 aa, Homo sapiens
  Heavy chain CDR3 for antibody 7303 (IGHV3-33)
ARGYGSGSPHFGY

SEQ ID NO: 14607 - protein, 10 aa, Homo sapiens
  Light chain CDR3 for antibody 7304 (IGKV1-39)
QQSYSTPMYT

SEQ ID NO: 14608 - protein, 13 aa, Homo sapiens
  Heavy chain CDR3 for antibody 7304 (IGHV3-33)
ARREVVGGRGFDY

SEQ ID NO: 14609 - protein, 9 aa, Homo sapiens
  Light chain CDR3 for antibody 7305 (IGKV1-9)
QQLISYPLT

SEQ ID NO: 14610 - protein, 13 aa, Homo sapiens
  Heavy chain CDR3 for antibody 7305 (IGHV4-28)
ARKGATGYYGMDV

SEQ ID NO: 14611 - protein, 10 aa, Homo sapiens
  Light chain CDR3 for antibody 7306 (IGKV3-11)
QQRSNWPIFT

SEQ ID NO: 14612 - protein, 20 aa, Homo sapiens
  Heavy chain CDR3 for antibody 7306 (IGHV1-18)
AREVGIAVAGTLYYYYGMDV

SEQ ID NO: 14613 - protein, 9 aa, Homo sapiens
  Light chain CDR3 for antibody 7307 (IGKV1-9)
QQLNGYPFT

SEQ ID NO: 14614 - protein, 12 aa, Homo sapiens
  Heavy chain CDR3 for antibody 7307 (IGHV3-33)
AREGDILTGYSL

SEQ ID NO: 14615 - protein, 11 aa, Homo sapiens
  Light chain CDR3 for antibody 7308 (IGKV3-11)
QQRSNWPPTWT

SEQ ID NO: 14616 - protein, 17 aa, Homo sapiens
  Heavy chain CDR3 for antibody 7308 (IGHV4-34)
AGLRFFDWLFDYYGMDV

SEQ ID NO: 14617 - protein, 9 aa, Homo sapiens
  Light chain CDR3 for antibody 7309 (IGKV3-20)
QQYGSSPYT

SEQ ID NO: 14618 - protein, 10 aa, Homo sapiens
  Heavy chain CDR3 for antibody 7309 (IGHV3-11)
ARGQWPPLDY

SEQ ID NO: 14619 - protein, 10 aa, Homo sapiens
  Light chain CDR3 for antibody 7310 (IGKV1-17)
LQHNSYPMYT

SEQ ID NO: 14620 - protein, 13 aa, Homo sapiens
  Heavy chain CDR3 for antibody 7310 (IGHV3-23)
AKDRGGSYSYFDF

SEQ ID NO: 14621 - protein, 9 aa, Homo sapiens
  Light chain CDR3 for antibody 7311 (IGKV1D-13)
QHFNNYMYT

SEQ ID NO: 14622 - protein, 11 aa, Homo sapiens
  Heavy chain CDR3 for antibody 7311 (IGHV4-39)
ARSLRYSFFDY

SEQ ID NO: 14623 - protein, 9 aa, Homo sapiens
  Light chain CDR3 for antibody 7312 (IGKV1-27)
QKYNSAPYT

SEQ ID NO: 14624 - protein, 15 aa, Homo sapiens
  Heavy chain CDR3 for antibody 7312 (IGHV3-33)
ARHSSGFYYYYGMDV

SEQ ID NO: 14625 - protein, 9 aa, Homo sapiens
  Light chain CDR3 for antibody 7313 (IGKV3-20)
LQYGSSPYT

SEQ ID NO: 14626 - protein, 18 aa, Homo sapiens
  Heavy chain CDR3 for antibody 7313 (IGHV4-59)
AREGDYVWGSYRPNWFDH

SEQ ID NO: 14627 - protein, 9 aa, Homo sapiens
  Light chain CDR3 for antibody 7314 (IGKV1-39)
QQSYSTPYT

SEQ ID NO: 14628 - protein, 19 aa, Homo sapiens
  Heavy chain CDR3 for antibody 7314 (IGHV3-33)
ARDRYYDILTGYSSYYFDY

SEQ ID NO: 14629 - protein, 9 aa, Homo sapiens
  Light chain CDR3 for antibody 7315 (IGKV3D-7)
QQDYDLPYP

SEQ ID NO: 14630 - protein, 13 aa, Homo sapiens
  Heavy chain CDR3 for antibody 7315 (IGHV4-39)
ARREVVGGRGFDY

SEQ ID NO: 14631 - protein, 9 aa, Homo sapiens
  Light chain CDR3 for antibody 7316 (IGKV3D-7)
QQDYNLPYT

SEQ ID NO: 14632 - protein, 14 aa, Homo sapiens
  Heavy chain CDR3 for antibody 7316 (IGHV4-39)
ARQGGSGSYYNLDY

SEQ ID NO: 14633 - protein, 9 aa, Homo sapiens
  Light chain CDR3 for antibody 7317 (IGKV1-9)
QQLNSYPLT

SEQ ID NO: 14634 - protein, 13 aa, Homo sapiens
  Heavy chain CDR3 for antibody 7317 (IGHV4-39)
ARQWPSGYWYFDL

SEQ ID NO: 14635 - protein, 10 aa, Homo sapiens
  Light chain CDR3 for antibody 7318 (IGKV3-11)
QQRSNWPIFT

SEQ ID NO: 14636 - protein, 17 aa, Homo sapiens
  Heavy chain CDR3 for antibody 7318 (IGHV3-23)
AKDRPVTTLYYYFGMDV

SEQ ID NO: 14637 - protein, 9 aa, Homo sapiens
  Light chain CDR3 for antibody 7319 (IGKV1-27)
QKYNSAPYT

SEQ ID NO: 14638 - protein, 18 aa, Homo sapiens
  Heavy chain CDR3 for antibody 7319 (IGHV3-11)
ARDGYFSGWNYYYFGMDV

SEQ ID NO: 14639 - protein, 9 aa, Homo sapiens
  Light chain CDR3 for antibody 7320 (IGKV1-39)
QQSYSTPLT

SEQ ID NO: 14640 - protein, 15 aa, Homo sapiens
  Heavy chain CDR3 for antibody 7320 (IGHV3-11)
ARDRAVAGTIHAFDI

SEQ ID NO: 14641 - protein, 9 aa, Homo sapiens
  Light chain CDR3 for antibody 7321 (IGKV5-2)
LQHDKFPYT

SEQ ID NO: 14642 - protein, 10 aa, Homo sapiens
  Heavy chain CDR3 for antibody 7321 (IGHV1-46)
AREWELLFDY

SEQ ID NO: 14643 - protein, 9 aa, Homo sapiens
  Light chain CDR3 for antibody 7322 (IGKV1-6)
LQDYNYPWT

SEQ ID NO: 14644 - protein, 10 aa, Homo sapiens
  Heavy chain CDR3 for antibody 7322 (IGHV3-23)
ANSGNYYFDY

SEQ ID NO: 14645 - protein, 9 aa, Homo sapiens
  Light chain CDR3 for antibody 7323 (IGKV1-6)
LQDYSYPRT

SEQ ID NO: 14646 - protein, 12 aa, Homo sapiens
  Heavy chain CDR3 for antibody 7323 (IGHV1-18)
ARDSFGLNWFDP

SEQ ID NO: 14647 - protein, 9 aa, Homo sapiens
  Light chain CDR3 for antibody 7324 (IGKV3D-7)
QQDYNLPYT

SEQ ID NO: 14648 - protein, 14 aa, Homo sapiens
  Heavy chain CDR3 for antibody 7324 (IGHV3-33)
ARASSGSSYWYIDL

SEQ ID NO: 14649 - protein, 9 aa, Homo sapiens
  Light chain CDR3 for antibody 7325 (IGKV3-15)
QQYNNWPRT

SEQ ID NO: 14650 - protein, 13 aa, Homo sapiens
  Heavy chain CDR3 for antibody 7325 (IGHV3-33)
VSTGDSYYYVMDV

SEQ ID NO: 14651 - protein, 8 aa, Homo sapiens
  Light chain CDR3 for antibody 7326 (IGKV1-5)
QQYNSYWT

SEQ ID NO: 14652 - protein, 15 aa, Homo sapiens
  Heavy chain CDR3 for antibody 7326 (IGHV3-33)
ARAYDLPHYYYGMDV

SEQ ID NO: 14653 - protein, 9 aa, Homo sapiens
  Light chain CDR3 for antibody 7327 (IGKV3-15)
QQYNNWPLT

SEQ ID NO: 14654 - protein, 19 aa, Homo sapiens
  Heavy chain CDR3 for antibody 7327 (IGHV4-39)
ARQGDALRYFDWLLGAFDI

SEQ ID NO: 14655 - protein, 8 aa, Homo sapiens
  Light chain CDR3 for antibody 7328 (IGKV3D-7)
QQDYNLVT

SEQ ID NO: 14656 - protein, 11 aa, Homo sapiens
  Heavy chain CDR3 for antibody 7328 (IGHV4-59)
VRERGYYGMDV

SEQ ID NO: 14657 - protein, 9 aa, Homo sapiens
  Light chain CDR3 for antibody 7329 (IGKV2-30)
MQGTHWPLT

SEQ ID NO: 14658 - protein, 16 aa, Homo sapiens
  Heavy chain CDR3 for antibody 7329 (IGHV1-18)
ARYFDWLLRDYYGMDV

SEQ ID NO: 14659 - protein, 8 aa, Homo sapiens
  Light chain CDR3 for antibody 7330 (IGKV1D-13)
QQFNNYPT

SEQ ID NO: 14660 - protein, 14 aa, Homo sapiens
  Heavy chain CDR3 for antibody 7330 (IGHV4-39)
ARDSGYDYYYGMDV

SEQ ID NO: 14661 - protein, 9 aa, Homo sapiens
  Light chain CDR3 for antibody 7331 (IGKV6-21)
HQSSSLPFT

SEQ ID NO: 14662 - protein, 15 aa, Homo sapiens
  Heavy chain CDR3 for antibody 7331 (IGHV4-39)
ARQGLVATIKGYFQH

SEQ ID NO: 14663 - protein, 9 aa, Homo sapiens
  Light chain CDR3 for antibody 7332 (IGKV1-39)
QQSDSTPRT

SEQ ID NO: 14664 - protein, 18 aa, Homo sapiens
  Heavy chain CDR3 for antibody 7332 (IGHV1-18)
ARDSGYGGYDYWEPPLDY

SEQ ID NO: 14665 - protein, 9 aa, Homo sapiens
  Light chain CDR3 for antibody 7333 (IGKV1-9)
QQLNSYPWT

SEQ ID NO: 14666 - protein, 12 aa, Homo sapiens
  Heavy chain CDR3 for antibody 7333 (IGHV6-1)
ARLDWNYRAFDI

SEQ ID NO: 14667 - protein, 9 aa, Homo sapiens
  Light chain CDR3 for antibody 7334 (IGKV1D-13)
QQFNNYPST

SEQ ID NO: 14668 - protein, 16 aa, Homo sapiens
  Heavy chain CDR3 for antibody 7334 (IGHV3-20)
AREGYSSSWFDRNFDY

SEQ ID NO: 14669 - protein, 9 aa, Homo sapiens
  Light chain CDR3 for antibody 7335 (IGKV1-9)
QQLNSYPYT

SEQ ID NO: 14670 - protein, 15 aa, Homo sapiens
  Heavy chain CDR3 for antibody 7335 (IGHV3-30)
ARGAMVRGVDYGMDV

SEQ ID NO: 14671 - protein, 10 aa, Homo sapiens
  Light chain CDR3 for antibody 7336 (IGKV1-17)
LQHNSYPMYT

SEQ ID NO: 14672 - protein, 14 aa, Homo sapiens
  Heavy chain CDR3 for antibody 7336 (IGHV3-33)
ARDREQQLVRYFDY

SEQ ID NO: 14673 - protein, 8 aa, Homo sapiens
  Light chain CDR3 for antibody 7337 (IGKV3D-7)
QQDYNLLT

SEQ ID NO: 14674 - protein, 10 aa, Homo sapiens
  Heavy chain CDR3 for antibody 7337 (IGHV3-74)
ARENWGGFDY

SEQ ID NO: 14675 - protein, 10 aa, Homo sapiens
  Light chain CDR3 for antibody 7338 (IGKV3-11)
QQRSNWPTWT

SEQ ID NO: 14676 - protein, 12 aa, Homo sapiens
  Heavy chain CDR3 for antibody 7338 (IGHV3-33)
ASRDILTGYLGY

SEQ ID NO: 14677 - protein, 9 aa, Homo sapiens
  Light chain CDR3 for antibody 7339 (IGKV5-2)
LQHDNFPYT

SEQ ID NO: 14678 - protein, 12 aa, Homo sapiens
  Heavy chain CDR3 for antibody 7339 (IGHV3-33)
AREEAVAEAFDI

SEQ ID NO: 14679 - protein, 8 aa, Homo sapiens
  Light chain CDR3 for antibody 7340 (IGKV3D-7)
QQDYNLLT

SEQ ID NO: 14680 - protein, 9 aa, Homo sapiens
  Heavy chain CDR3 for antibody 7340 (IGHV3-23)
ARIWWLKDY

SEQ ID NO: 14681 - protein, 9 aa, Homo sapiens
  Light chain CDR3 for antibody 7341 (IGKV3D-7)
QQDYNLPFT

SEQ ID NO: 14682 - protein, 18 aa, Homo sapiens
  Heavy chain CDR3 for antibody 7341 (IGHV6-1)
ARDQYSYGPYYYYYGMDV

SEQ ID NO: 14683 - protein, 9 aa, Homo sapiens
  Light chain CDR3 for antibody 7342 (IGKV3-20)
QQYGSSPRT

SEQ ID NO: 14684 - protein, 15 aa, Homo sapiens
  Heavy chain CDR3 for antibody 7342 (IGHV1-18)
ARLRWFGELSGWFDP

SEQ ID NO: 14685 - protein, 9 aa, Homo sapiens
  Light chain CDR3 for antibody 7343 (IGKV1D-13)
QQFNNYPST

SEQ ID NO: 14686 - protein, 15 aa, Homo sapiens
  Heavy chain CDR3 for antibody 7343 (IGHV3-33)
ARERYSSAWSSGMDV

SEQ ID NO: 14687 - protein, 9 aa, Homo sapiens
  Light chain CDR3 for antibody 7344 (IGKV3-20)
QQYGSSPLT

SEQ ID NO: 14688 - protein, 11 aa, Homo sapiens
  Heavy chain CDR3 for antibody 7344 (IGHV3-33)
ARDILTGYFDY

SEQ ID NO: 14689 - protein, 9 aa, Homo sapiens
  Light chain CDR3 for antibody 7345 (IGKV3-15)
QQYNNWPYT

SEQ ID NO: 14690 - protein, 11 aa, Homo sapiens
  Heavy chain CDR3 for antibody 7345 (IGHV1-24)
ATELGLYYFDY

SEQ ID NO: 14691 - protein, 9 aa, Homo sapiens
  Light chain CDR3 for antibody 7346 (IGKV1-17)
QQYYSYPRT

SEQ ID NO: 14692 - protein, 12 aa, Homo sapiens
  Heavy chain CDR3 for antibody 7346 (IGHV4-39)
ARHGSGSSYFDY

SEQ ID NO: 14693 - protein, 9 aa, Homo sapiens
  Light chain CDR3 for antibody 7347 (IGKV1D-13)
QQFNNYPHT

SEQ ID NO: 14694 - protein, 18 aa, Homo sapiens
  Heavy chain CDR3 for antibody 7347 (IGHV1-8)
ARSRIAAAGIYYYYGMDV

SEQ ID NO: 14695 - protein, 9 aa, Homo sapiens
  Light chain CDR3 for antibody 7348 (IGKV1-6)
LQDYNYPYT

SEQ ID NO: 14696 - protein, 15 aa, Homo sapiens
  Heavy chain CDR3 for antibody 7348 (IGHV3-64)
ARDSRPEITGAPFDY

SEQ ID NO: 14697 - protein, 9 aa, Homo sapiens
  Light chain CDR3 for antibody 7349 (IGKV3-20)
QQYGSSIFT

SEQ ID NO: 14698 - protein, 13 aa, Homo sapiens
  Heavy chain CDR3 for antibody 7349 (IGHV3-33)
VSTGDSYYYVMDV

SEQ ID NO: 14699 - protein, 10 aa, Homo sapiens
  Light chain CDR3 for antibody 7350 (IGKV3-11)
QQRSNWPPFT

SEQ ID NO: 14700 - protein, 17 aa, Homo sapiens
  Heavy chain CDR3 for antibody 7350 (IGHV3-23)
AKDTITMVRGALFGMDV

SEQ ID NO: 14701 - protein, 10 aa, Homo sapiens
  Light chain CDR3 for antibody 7351 (IGKV1-39)
QQSYSTPMYT

SEQ ID NO: 14702 - protein, 15 aa, Homo sapiens
  Heavy chain CDR3 for antibody 7351 (IGHV3-33)
ARDGSGSYSLYGMDV

SEQ ID NO: 14703 - protein, 9 aa, Homo sapiens
  Light chain CDR3 for antibody 7352 (IGKV3-11)
QQRSNWMYT

SEQ ID NO: 14704 - protein, 10 aa, Homo sapiens
  Heavy chain CDR3 for antibody 7352 (IGHV3-33)
ARNILTPLDY

SEQ ID NO: 14705 - protein, 8 aa, Homo sapiens
  Light chain CDR3 for antibody 7353 (IGKV1-5)
QQYNSYWT

SEQ ID NO: 14706 - protein, 8 aa, Homo sapiens
  Heavy chain CDR3 for antibody 7353 (IGHV3-33)
ARDRGFDY

SEQ ID NO: 14707 - protein, 9 aa, Homo sapiens
  Light chain CDR3 for antibody 7354 (IGKV2D-28)
MQALQTPPT

SEQ ID NO: 14708 - protein, 9 aa, Homo sapiens
  Heavy chain CDR3 for antibody 7354 (IGHV3-23)
ARIWWLKDY

SEQ ID NO: 14709 - protein, 9 aa, Homo sapiens
  Light chain CDR3 for antibody 7355 (IGKV1-6)
LQDYNYPYT

SEQ ID NO: 14710 - protein, 8 aa, Homo sapiens
  Heavy chain CDR3 for antibody 7355 (IGHV3-33)
AREDYDIL

SEQ ID NO: 14711 - protein, 9 aa, Homo sapiens
  Light chain CDR3 for antibody 7356 (IGKV1-6)
LQDYKSPFT

SEQ ID NO: 14712 - protein, 18 aa, Homo sapiens
  Heavy chain CDR3 for antibody 7356 (IGHV3-23)
AKDRITGTTYGYYSGLDV

SEQ ID NO: 14713 - protein, 9 aa, Homo sapiens
  Light chain CDR3 for antibody 7357 (IGKV3-20)
QQYGSSPWT

SEQ ID NO: 14714 - protein, 13 aa, Homo sapiens
  Heavy chain CDR3 for antibody 7357 (IGHV4-59)
ARESPGPYDAFDI

SEQ ID NO: 14715 - protein, 9 aa, Homo sapiens
  Light chain CDR3 for antibody 7358 (IGKV1-39)
QQGFSTPWT

SEQ ID NO: 14716 - protein, 11 aa, Homo sapiens
  Heavy chain CDR3 for antibody 7358 (IGHV4-59)
AREMGHDTFDI

SEQ ID NO: 14717 - protein, 6 aa, Homo sapiens
  Light chain CDR3 for antibody 7359 (IGKV3-20)
QQYGST

SEQ ID NO: 14718 - protein, 18 aa, Homo sapiens
  Heavy chain CDR3 for antibody 7359 (IGHV4-59)
AREGDYVWGSYRPNWFDP

SEQ ID NO: 14719 - protein, 9 aa, Homo sapiens
  Light chain CDR3 for antibody 7360 (IGKV1-5)
QQYNTYSRT

SEQ ID NO: 14720 - protein, 9 aa, Homo sapiens
  Heavy chain CDR3 for antibody 7360 (IGHV1-18)
ARGKDWFDP

SEQ ID NO: 14721 - protein, 9 aa, Homo sapiens
  Light chain CDR3 for antibody 7361 (IGKV1D-16)
QQYNSYPYT

SEQ ID NO: 14722 - protein, 13 aa, Homo sapiens
  Heavy chain CDR3 for antibody 7361 (IGHV3-23)
ASTGDSYSYGMDV

SEQ ID NO: 14723 - protein, 9 aa, Homo sapiens
  Light chain CDR3 for antibody 7362 (IGKV1-9)
QQLNSYPYT

SEQ ID NO: 14724 - protein, 15 aa, Homo sapiens
  Heavy chain CDR3 for antibody 7362 (IGHV3-33)
ARGCYYGSGSFPVDY

SEQ ID NO: 14725 - protein, 8 aa, Homo sapiens
  Light chain CDR3 for antibody 7363 (IGKV1-5)
QQYNSYWT

SEQ ID NO: 14726 - protein, 12 aa, Homo sapiens
  Heavy chain CDR3 for antibody 7363 (IGHV3-33)
AREEAVAEAFDI

SEQ ID NO: 14727 - protein, 9 aa, Homo sapiens
  Light chain CDR3 for antibody 7364 (IGKV1-17)
LQHNSYPYT

SEQ ID NO: 14728 - protein, 15 aa, Homo sapiens
  Heavy chain CDR3 for antibody 7364 (IGHV3-33)
ARPPIAVAGPEYFQH

SEQ ID NO: 14729 - protein, 8 aa, Homo sapiens
  Light chain CDR3 for antibody 7365 (IGKV3-20)
QQYGRSFT

SEQ ID NO: 14730 - protein, 10 aa, Homo sapiens
  Heavy chain CDR3 for antibody 7365 (IGHV4-39)
ARQLGNWFDP

SEQ ID NO: 14731 - protein, 10 aa, Homo sapiens
  Light chain CDR3 for antibody 7366 (IGKV3-11)
QQRSNWPMYT

SEQ ID NO: 14732 - protein, 11 aa, Homo sapiens
  Heavy chain CDR3 for antibody 7366 (IGHV3-33)
ARGSGSYAFDY

SEQ ID NO: 14733 - protein, 9 aa, Homo sapiens
  Light chain CDR3 for antibody 7367 (IGKV1-39)
QQSYRTPLT

SEQ ID NO: 14734 - protein, 10 aa, Homo sapiens
  Heavy chain CDR3 for antibody 7367 (IGHV3-11)
AKDQVGATDC

SEQ ID NO: 14735 - protein, 10 aa, Homo sapiens
  Light chain CDR3 for antibody 7368 (IGKV3-11)
QQRSNWPIFT

SEQ ID NO: 14736 - protein, 15 aa, Homo sapiens
  Heavy chain CDR3 for antibody 7368 (IGHV4-39)
ARQGLVATIKGYFQH

SEQ ID NO: 14737 - protein, 10 aa, Homo sapiens
  Light chain CDR3 for antibody 7369 (IGKV1-9)
QQLDSYPMYT

SEQ ID NO: 14738 - protein, 16 aa, Homo sapiens
  Heavy chain CDR3 for antibody 7369 (IGHV3-23)
AKEGMVLRYFDWLWDY

SEQ ID NO: 14739 - protein, 9 aa, Homo sapiens
  Light chain CDR3 for antibody 7370 (IGKV3-15)
QQYNNWPRT

SEQ ID NO: 14740 - protein, 12 aa, Homo sapiens
  Heavy chain CDR3 for antibody 7370 (IGHV3-33)
AREGDILTGYSL

SEQ ID NO: 14741 - protein, 9 aa, Homo sapiens
  Light chain CDR3 for antibody 7371 (IGKV3-11)
QQRSNWPPT

SEQ ID NO: 14742 - protein, 12 aa, Homo sapiens
  Heavy chain CDR3 for antibody 7371 (IGHV3-33)
AREGTGGNWFDP

SEQ ID NO: 14743 - protein, 9 aa, Homo sapiens
  Light chain CDR3 for antibody 7372 (IGKV1-39)
QQSYSTPFT

SEQ ID NO: 14744 - protein, 10 aa, Homo sapiens
  Heavy chain CDR3 for antibody 7372 (IGHV3-30)
ARDGLESFDY

SEQ ID NO: 14745 - protein, 9 aa, Homo sapiens
  Light chain CDR3 for antibody 7373 (IGKV1D-13)
QRFNNYLYT

SEQ ID NO: 14746 - protein, 13 aa, Homo sapiens
  Heavy chain CDR3 for antibody 7373 (IGHV3-33)
ARDWGYSHGYFDY

SEQ ID NO: 14747 - protein, 9 aa, Homo sapiens
  Light chain CDR3 for antibody 7374 (IGKV1-9)
QQLISYPLT

SEQ ID NO: 14748 - protein, 11 aa, Homo sapiens
  Heavy chain CDR3 for antibody 7374 (IGHV3-13)
AREAIIGPFDY

SEQ ID NO: 14749 - protein, 9 aa, Homo sapiens
  Light chain CDR3 for antibody 7375 (IGKV1-39)
QQSYRTPLT

SEQ ID NO: 14750 - protein, 13 aa, Homo sapiens
  Heavy chain CDR3 for antibody 7375 (IGHV3-11)
ARDYGDYLNWFDP

SEQ ID NO: 14751 - protein, 9 aa, Homo sapiens
  Light chain CDR3 for antibody 7376 (IGKV1-39)
QQSYRTPLT

SEQ ID NO: 14752 - protein, 14 aa, Homo sapiens
  Heavy chain CDR3 for antibody 7376 (IGHV3-33)
ARDTVAAGFNGMDV

SEQ ID NO: 14753 - protein, 9 aa, Homo sapiens
  Light chain CDR3 for antibody 7377 (IGKV1D-13)
QQFNNYPHT

SEQ ID NO: 14754 - protein, 15 aa, Homo sapiens
  Heavy chain CDR3 for antibody 7377 (IGHV3-33)
ARDEHYDILTGYWGY

SEQ ID NO: 14755 - protein, 9 aa, Homo sapiens
  Light chain CDR3 for antibody 7378 (IGKV2-30)
MQGTHWPLT

SEQ ID NO: 14756 - protein, 18 aa, Homo sapiens
  Heavy chain CDR3 for antibody 7378 (IGHV3-33)
ARGGVLYDILTGFYGMDV

SEQ ID NO: 14757 - protein, 9 aa, Homo sapiens
  Light chain CDR3 for antibody 7379 (IGKV1-39)
QQSYSTPLT

SEQ ID NO: 14758 - protein, 17 aa, Homo sapiens
  Heavy chain CDR3 for antibody 7379 (IGHV3-30)
ARDGVGATSYYYYGMDV

SEQ ID NO: 14759 - protein, 9 aa, Homo sapiens
  Light chain CDR3 for antibody 7380 (IGKV3-20)
QQYGSSPRT

SEQ ID NO: 14760 - protein, 12 aa, Homo sapiens
  Heavy chain CDR3 for antibody 7380 (IGHV3-33)
ARKAYALYVLDV

SEQ ID NO: 14761 - protein, 9 aa, Homo sapiens
  Light chain CDR3 for antibody 7381 (IGKV3-11)
QQRSNWPPT

SEQ ID NO: 14762 - protein, 20 aa, Homo sapiens
  Heavy chain CDR3 for antibody 7381 (IGHV1-8)
ARGDGTMVRGIYYYYYGMDV

SEQ ID NO: 14763 - protein, 9 aa, Homo sapiens
  Light chain CDR3 for antibody 7382 (IGKV1-39)
QQGFSTPWT

SEQ ID NO: 14764 - protein, 9 aa, Homo sapiens
  Heavy chain CDR3 for antibody 7382 (IGHV4-59)
AGGSWDFDY

SEQ ID NO: 14765 - protein, 9 aa, Homo sapiens
  Light chain CDR3 for antibody 7383 (IGKV2-30)
MQGTHWPLT

SEQ ID NO: 14766 - protein, 12 aa, Homo sapiens
  Heavy chain CDR3 for antibody 7383 (IGHV3-33)
ARDGYSSRNFDY

SEQ ID NO: 14767 - protein, 9 aa, Homo sapiens
  Light chain CDR3 for antibody 7384 (IGKV5-2)
LQHDNFPYT

SEQ ID NO: 14768 - protein, 18 aa, Homo sapiens
  Heavy chain CDR3 for antibody 7384 (IGHV3-23)
AKPDYYGSGSYYNVPFDY

SEQ ID NO: 14769 - protein, 10 aa, Homo sapiens
  Light chain CDR3 for antibody 7385 (IGKV3-20)
QQYGSSPPYT

SEQ ID NO: 14770 - protein, 13 aa, Homo sapiens
  Heavy chain CDR3 for antibody 7385 (IGHV4-59)
ARDAGYSSSWFDY

SEQ ID NO: 14771 - protein, 9 aa, Homo sapiens
  Light chain CDR3 for antibody 7386 (IGKV1-33)
QQYDNLPFT

SEQ ID NO: 14772 - protein, 11 aa, Homo sapiens
  Heavy chain CDR3 for antibody 7386 (IGHV3-33)
ARGSGSYAFDS

SEQ ID NO: 14773 - protein, 8 aa, Homo sapiens
  Light chain CDR3 for antibody 7387 (IGKV6-21)
HQSSSLYT

SEQ ID NO: 14774 - protein, 18 aa, Homo sapiens
  Heavy chain CDR3 for antibody 7387 (IGHV1-18)
ARDGDYVWGSYRSDWFDP

SEQ ID NO: 14775 - protein, 9 aa, Homo sapiens
  Light chain CDR3 for antibody 7388 (IGKV1-27)
QKYNSAPYT

SEQ ID NO: 14776 - protein, 12 aa, Homo sapiens
  Heavy chain CDR3 for antibody 7388 (IGHV3-33)
VRKWFGELYFDY

SEQ ID NO: 14777 - protein, 9 aa, Homo sapiens
  Light chain CDR3 for antibody 7389 (IGKV1D-16)
QQLISYPLT

SEQ ID NO: 14778 - protein, 12 aa, Homo sapiens
  Heavy chain CDR3 for antibody 7389 (IGHV1-18)
ARILFYGDYFDY

SEQ ID NO: 14779 - protein, 9 aa, Homo sapiens
  Light chain CDR3 for antibody 7390 (IGKV6-21)
HQSTSLPFT

SEQ ID NO: 14780 - protein, 16 aa, Homo sapiens
  Heavy chain CDR3 for antibody 7390 (IGHV4-39)
ARDTPYYSGSGRPFDY

SEQ ID NO: 14781 - protein, 9 aa, Homo sapiens
  Light chain CDR3 for antibody 7391 (IGKV1-6)
LQDFNYPRT

SEQ ID NO: 14782 - protein, 18 aa, Homo sapiens
  Heavy chain CDR3 for antibody 7391 (IGHV4-59)
AREGHYYTSGSYYSHFHY

SEQ ID NO: 14783 - protein, 8 aa, Homo sapiens
  Light chain CDR3 for antibody 7392 (IGKV1D-13)
QQFNNYPT

SEQ ID NO: 14784 - protein, 12 aa, Homo sapiens
  Heavy chain CDR3 for antibody 7392 (IGHV3-33)
AREGTRWVYFDY

SEQ ID NO: 14785 - protein, 9 aa, Homo sapiens
  Light chain CDR3 for antibody 7393 (IGKV3D-7)
QQDYKLPLT

SEQ ID NO: 14786 - protein, 18 aa, Homo sapiens
  Heavy chain CDR3 for antibody 7393 (IGHV4-59)
AREGDYVWGSYRSNWFDP

SEQ ID NO: 14787 - protein, 9 aa, Homo sapiens
  Light chain CDR3 for antibody 7394 (IGKV5-2)
LQHDKFPYT

SEQ ID NO: 14788 - protein, 16 aa, Homo sapiens
  Heavy chain CDR3 for antibody 7394 (IGHV3-33)
AREVGAKDYYYYGMDV

SEQ ID NO: 14789 - protein, 9 aa, Homo sapiens
  Light chain CDR3 for antibody 7395 (IGKV3D-20)
QQYGSSPWT

SEQ ID NO: 14790 - protein, 15 aa, Homo sapiens
  Heavy chain CDR3 for antibody 7395 (IGHV3-33)
ARGYYYGSGSYPLDY

SEQ ID NO: 14791 - protein, 10 aa, Homo sapiens
  Light chain CDR3 for antibody 7396 (IGKV3-11)
QQRSNWPALT

SEQ ID NO: 14792 - protein, 17 aa, Homo sapiens
  Heavy chain CDR3 for antibody 7396 (IGHV3-33)
ARCGYSSSWYDPYYFDY

SEQ ID NO: 14793 - protein, 8 aa, Homo sapiens
  Light chain CDR3 for antibody 7397 (IGKV3-20)
QQYGRSFT

SEQ ID NO: 14794 - protein, 15 aa, Homo sapiens
  Heavy chain CDR3 for antibody 7397 (IGHV1-24)
ATHWDLRYYYYGMDV

SEQ ID NO: 14795 - protein, 9 aa, Homo sapiens
  Light chain CDR3 for antibody 7398 (IGKV3-20)
QQYGSSPYT

SEQ ID NO: 14796 - protein, 12 aa, Homo sapiens
  Heavy chain CDR3 for antibody 7398 (IGHV3-64)
AREFPWGDYFDY

SEQ ID NO: 14797 - protein, 9 aa, Homo sapiens
  Light chain CDR3 for antibody 7399 (IGKV1D-16)
QQLNSYPYT

SEQ ID NO: 14798 - protein, 15 aa, Homo sapiens
  Heavy chain CDR3 for antibody 7399 (IGHV3-33)
ARDTGYSSSWNWFDH

SEQ ID NO: 14799 - protein, 9 aa, Homo sapiens
  Light chain CDR3 for antibody 7400 (IGKV1-6)
LQDYNFPFT

SEQ ID NO: 14800 - protein, 11 aa, Homo sapiens
  Heavy chain CDR3 for antibody 7400 (IGHV4-59)
AREMGHDIFDI

SEQ ID NO: 14801 - protein, 10 aa, Homo sapiens
  Light chain CDR3 for antibody 7401 (IGKV3-11)
QQRSNWLMYT

SEQ ID NO: 14802 - protein, 14 aa, Homo sapiens
  Heavy chain CDR3 for antibody 7401 (IGHV3-23)
ARDGYDFLTGPFDY

SEQ ID NO: 14803 - protein, 9 aa, Homo sapiens
  Light chain CDR3 for antibody 7402 (IGKV1-16)
QHYNDYPFT

SEQ ID NO: 14804 - protein, 11 aa, Homo sapiens
  Heavy chain CDR3 for antibody 7402 (IGHV3-33)
ARDRVLTPFDY

SEQ ID NO: 14805 - protein, 9 aa, Homo sapiens
  Light chain CDR3 for antibody 7403 (IGKV3D-7)
QQLNSYPYT

SEQ ID NO: 14806 - protein, 16 aa, Homo sapiens
  Heavy chain CDR3 for antibody 7403 (IGHV1-46)
ARGGGYSGSYSNWFDP

SEQ ID NO: 14807 - protein, 8 aa, Homo sapiens
  Light chain CDR3 for antibody 7404 (IGKV1-5)
QQYNSYYT

SEQ ID NO: 14808 - protein, 19 aa, Homo sapiens
  Heavy chain CDR3 for antibody 7404 (IGHV3-33)
AREDYYGSGSYYNEDWFDP

SEQ ID NO: 14809 - protein, 9 aa, Homo sapiens
  Light chain CDR3 for antibody 7405 (IGKV1-5)
QQYNSYSYT

SEQ ID NO: 14810 - protein, 13 aa, Homo sapiens
  Heavy chain CDR3 for antibody 7405 (IGHV4-59)
ARTMVRGVAPFDY

SEQ ID NO: 14811 - protein, 9 aa, Homo sapiens
  Light chain CDR3 for antibody 7406 (IGKV1-17)
LQHNSYPPT

SEQ ID NO: 14812 - protein, 17 aa, Homo sapiens
  Heavy chain CDR3 for antibody 7406 (IGHV1-24)
ATHYGSGSHYKGYGMDV

SEQ ID NO: 14813 - protein, 9 aa, Homo sapiens
  Light chain CDR3 for antibody 7407 (IGKV5-2)
LQHDNFPYT

SEQ ID NO: 14814 - protein, 10 aa, Homo sapiens
  Heavy chain CDR3 for antibody 7407 (IGHV3-33)
AREGLRYFDH

SEQ ID NO: 14815 - protein, 8 aa, Homo sapiens
  Light chain CDR3 for antibody 7408 (IGKV3D-7)
QQDYNLLT

SEQ ID NO: 14816 - protein, 15 aa, Homo sapiens
  Heavy chain CDR3 for antibody 7408 (IGHV3-33)
ARAYDLPHYYYGMDV

SEQ ID NO: 14817 - protein, 9 aa, Homo sapiens
  Light chain CDR3 for antibody 7409 (IGKV1D-13)
QHFNNYMYT

SEQ ID NO: 14818 - protein, 18 aa, Homo sapiens
  Heavy chain CDR3 for antibody 7409 (IGHV3-33)
ARREGITLIFYYYYGMDV

SEQ ID NO: 14819 - protein, 9 aa, Homo sapiens
  Light chain CDR3 for antibody 7410 (IGKV6-21)
HQSSSLPHT

SEQ ID NO: 14820 - protein, 18 aa, Homo sapiens
  Heavy chain CDR3 for antibody 7410 (IGHV3-33)
ARDHYDILTGYYKGWFDP

SEQ ID NO: 14821 - protein, 10 aa, Homo sapiens
  Light chain CDR3 for antibody 7411 (IGKV3-11)
QQRSNWPPYT

SEQ ID NO: 14822 - protein, 11 aa, Homo sapiens
  Heavy chain CDR3 for antibody 7411 (IGHV4-59)
ARETGDDAFDI

SEQ ID NO: 14823 - protein, 9 aa, Homo sapiens
  Light chain CDR3 for antibody 7412 (IGKV2-30)
MQGTHWPLT

SEQ ID NO: 14824 - protein, 18 aa, Homo sapiens
  Heavy chain CDR3 for antibody 7412 (IGHV3-33)
ARDRGDILTGYYKGWFDP

SEQ ID NO: 14825 - protein, 8 aa, Homo sapiens
  Light chain CDR3 for antibody 7413 (IGKV3D-7)
QQDYNLLT

SEQ ID NO: 14826 - protein, 18 aa, Homo sapiens
  Heavy chain CDR3 for antibody 7413 (IGHV1-8)
ARSRIAAAGIYYYYGMDV

SEQ ID NO: 14827 - protein, 8 aa, Homo sapiens
  Light chain CDR3 for antibody 7414 (IGKV3-11)
QQRSNWLT

SEQ ID NO: 14828 - protein, 13 aa, Homo sapiens
  Heavy chain CDR3 for antibody 7414 (IGHV3-53)
ARSGSYWGYYFDY

SEQ ID NO: 14829 - protein, 9 aa, Homo sapiens
  Light chain CDR3 for antibody 7415 (IGKV3D-7)
QQDYKLPLT

SEQ ID NO: 14830 - protein, 15 aa, Homo sapiens
  Heavy chain CDR3 for antibody 7415 (IGHV1-2)
ARDLGYYGSGSRMDV

SEQ ID NO: 14831 - protein, 9 aa, Homo sapiens
  Light chain CDR3 for antibody 7416 (IGKV1-6)
LQGYNYPRS

SEQ ID NO: 14832 - protein, 14 aa, Homo sapiens
  Heavy chain CDR3 for antibody 7416 (IGHV3-33)
ARGAAAGNFYGLDV

SEQ ID NO: 14833 - protein, 9 aa, Homo sapiens
  Light chain CDR3 for antibody 7417 (IGKV2D-28)
MQALQTPPT

SEQ ID NO: 14834 - protein, 15 aa, Homo sapiens
  Heavy chain CDR3 for antibody 7417 (IGHV3-33)
ARDHLTGYYYYGMDV

SEQ ID NO: 14835 - protein, 7 aa, Homo sapiens
  Light chain CDR3 for antibody 7418 (IGKV3-11)
QQRSKFT

SEQ ID NO: 14836 - protein, 18 aa, Homo sapiens
  Heavy chain CDR3 for antibody 7418 (IGHV1-46)
ARDGDYVWGSYRSNWFDP

SEQ ID NO: 14837 - protein, 9 aa, Homo sapiens
  Light chain CDR3 for antibody 7419 (IGKV2D-28)
MQALQTPPT

SEQ ID NO: 14838 - protein, 16 aa, Homo sapiens
  Heavy chain CDR3 for antibody 7419 (IGHV4-59)
ARGRYFDWLLGDVFDI

SEQ ID NO: 14839 - protein, 10 aa, Homo sapiens
  Light chain CDR3 for antibody 7420 (IGKV1-39)
QQSYSTPMYT

SEQ ID NO: 14840 - protein, 16 aa, Homo sapiens
  Heavy chain CDR3 for antibody 7420 (IGHV3-33)
ARDGSMVRRIHDAFDF

SEQ ID NO: 14841 - protein, 9 aa, Homo sapiens
  Light chain CDR3 for antibody 7421 (IGKV1D-13)
QQFNNYPST

SEQ ID NO: 14842 - protein, 17 aa, Homo sapiens
  Heavy chain CDR3 for antibody 7421 (IGHV3-33)
ARREGITLIFYYYGMDV

SEQ ID NO: 14843 - protein, 11 aa, Homo sapiens
  Light chain CDR3 for antibody 7422 (IGKV3D-7)
QQRSNWPPTWT

SEQ ID NO: 14844 - protein, 9 aa, Homo sapiens
  Heavy chain CDR3 for antibody 7422 (IGHV3-30)
ARDYFHYDY

SEQ ID NO: 14845 - protein, 10 aa, Homo sapiens
  Light chain CDR3 for antibody 7423 (IGKV3-20)
QQYGRSPPVT

SEQ ID NO: 14846 - protein, 11 aa, Homo sapiens
  Heavy chain CDR3 for antibody 7423 (IGHV3-74)
ARDRGNWGFDY

SEQ ID NO: 14847 - protein, 9 aa, Homo sapiens
  Light chain CDR3 for antibody 7424 (IGKV3-11)
QQRSNWMYT

SEQ ID NO: 14848 - protein, 10 aa, Homo sapiens
  Heavy chain CDR3 for antibody 7424 (IGHV3-33)
AREWFGGFDI

SEQ ID NO: 14849 - protein, 8 aa, Homo sapiens
  Light chain CDR3 for antibody 7425 (IGKV1-16)
QQDYNLVT

SEQ ID NO: 14850 - protein, 23 aa, Homo sapiens
  Heavy chain CDR3 for antibody 7425 (IGHV4-59)
ARERTYSDILPGYYEDYYYGMDV

SEQ ID NO: 14851 - protein, 10 aa, Homo sapiens
  Light chain CDR3 for antibody 7426 (IGKV1-17)
LQHNSYPMYT

SEQ ID NO: 14852 - protein, 13 aa, Homo sapiens
  Heavy chain CDR3 for antibody 7426 (IGHV3-23)
AKDRGYSSTSTAY

SEQ ID NO: 14853 - protein, 9 aa, Homo sapiens
  Light chain CDR3 for antibody 7427 (IGKV1-9)
QQVKSYPYT

SEQ ID NO: 14854 - protein, 13 aa, Homo sapiens
  Heavy chain CDR3 for antibody 7427 (IGHV4-39)
ARHEVMVRGVFDY

SEQ ID NO: 14855 - protein, 9 aa, Homo sapiens
  Light chain CDR3 for antibody 7428 (IGKV6-21)
HQSSSLPYT

SEQ ID NO: 14856 - protein, 18 aa, Homo sapiens
  Heavy chain CDR3 for antibody 7428 (IGHV3-33)
ARGAYSSGWDYYYYGLDV

SEQ ID NO: 14857 - protein, 9 aa, Homo sapiens
  Light chain CDR3 for antibody 7429 (IGKV1-9)
QQLNSYLFT

SEQ ID NO: 14858 - protein, 10 aa, Homo sapiens
  Heavy chain CDR3 for antibody 7429 (IGHV3-23)
AKGDRWRFDP

SEQ ID NO: 14859 - protein, 8 aa, Homo sapiens
  Light chain CDR3 for antibody 7430 (IGKV3-20)
QQYGSSLT

SEQ ID NO: 14860 - protein, 13 aa, Homo sapiens
  Heavy chain CDR3 for antibody 7430 (IGHV3-33)
ARTDYYFYYGLDV

SEQ ID NO: 14861 - protein, 11 aa, Homo sapiens
  Light chain CDR3 for antibody 7431 (IGKV3-11)
QQRSNWPPTWT

SEQ ID NO: 14862 - protein, 11 aa, Homo sapiens
  Heavy chain CDR3 for antibody 7431 (IGHV3-33)
ARAGIAALFDY

SEQ ID NO: 14863 - protein, 8 aa, Homo sapiens
  Light chain CDR3 for antibody 7432 (IGKV3D-7)
QQDYNLVT

SEQ ID NO: 14864 - protein, 14 aa, Homo sapiens
  Heavy chain CDR3 for antibody 7432 (IGHV4-39)
ARQGTMIRGGYFDY

SEQ ID NO: 14865 - protein, 9 aa, Homo sapiens
  Light chain CDR3 for antibody 7433 (IGKV3D-20)
QQYGSSPYT

SEQ ID NO: 14866 - protein, 19 aa, Homo sapiens
  Heavy chain CDR3 for antibody 7433 (IGHV3-33)
AREYFDILTGYYKTGFFQH

SEQ ID NO: 14867 - protein, 8 aa, Homo sapiens
  Light chain CDR3 for antibody 7434 (IGKV1D-13)
QQFNNYPT

SEQ ID NO: 14868 - protein, 17 aa, Homo sapiens
  Heavy chain CDR3 for antibody 7434 (IGHV4-34)
AGLRFFDWLFDYYGMDV

SEQ ID NO: 14869 - protein, 9 aa, Homo sapiens
  Light chain CDR3 for antibody 7435 (IGKV3D-11)
QQRSNWQYT

SEQ ID NO: 14870 - protein, 19 aa, Homo sapiens
  Heavy chain CDR3 for antibody 7435 (IGHV3-33)
ARGPYYDILTGYGYYGMDV

SEQ ID NO: 14871 - protein, 9 aa, Homo sapiens
  Light chain CDR3 for antibody 7436 (IGKV1-17)
LQHNSYPRT

SEQ ID NO: 14872 - protein, 15 aa, Homo sapiens
  Heavy chain CDR3 for antibody 7436 (IGHV3-33)
ARGYYYGSGSFPVDY

SEQ ID NO: 14873 - protein, 8 aa, Homo sapiens
  Light chain CDR3 for antibody 7437 (IGKV3-11)
QQRSNWLT

SEQ ID NO: 14874 - protein, 11 aa, Homo sapiens
  Heavy chain CDR3 for antibody 7437 (IGHV4-59)
ARDGVRGVFDI

SEQ ID NO: 14875 - protein, 10 aa, Homo sapiens
  Light chain CDR3 for antibody 7438 (IGKV1-17)
LQHNSYPMYT

SEQ ID NO: 14876 - protein, 14 aa, Homo sapiens
  Heavy chain CDR3 for antibody 7438 (IGHV3-33)
ARGGYSGYRYYFDY

SEQ ID NO: 14877 - protein, 9 aa, Homo sapiens
  Light chain CDR3 for antibody 7439 (IGKV5-2)
LQHDKFPYT

SEQ ID NO: 14878 - protein, 9 aa, Homo sapiens
  Heavy chain CDR3 for antibody 7439 (IGHV3-33)
ARGSGWSDY

SEQ ID NO: 14879 - protein, 8 aa, Homo sapiens
  Light chain CDR3 for antibody 7440 (IGKV3D-7)
QQDYNLLT

SEQ ID NO: 14880 - protein, 13 aa, Homo sapiens
  Heavy chain CDR3 for antibody 7440 (IGHV3-33)
AREYCSGGSCYDY

SEQ ID NO: 14881 - protein, 9 aa, Homo sapiens
  Light chain CDR3 for antibody 7441 (IGKV1-17)
LQDYKSPFT

SEQ ID NO: 14882 - protein, 14 aa, Homo sapiens
  Heavy chain CDR3 for antibody 7441 (IGHV3-33)
ARDKTYPLSYGMDV

SEQ ID NO: 14883 - protein, 9 aa, Homo sapiens
  Light chain CDR3 for antibody 7442 (IGKV1-5)
QQYNTYSRT

SEQ ID NO: 14884 - protein, 10 aa, Homo sapiens
  Heavy chain CDR3 for antibody 7442 (IGHV3-23)
AKDHYGDYPY

SEQ ID NO: 14885 - protein, 9 aa, Homo sapiens
  Light chain CDR3 for antibody 7443 (IGKV1-33)
QQYDNLPFT

SEQ ID NO: 14886 - protein, 18 aa, Homo sapiens
  Heavy chain CDR3 for antibody 7443 (IGHV3-33)
ARREGITLIFYYYYGMDV

SEQ ID NO: 14887 - protein, 9 aa, Homo sapiens
  Light chain CDR3 for antibody 7444 (IGKV2-30)
MQGTHWPLT

SEQ ID NO: 14888 - protein, 10 aa, Homo sapiens
  Heavy chain CDR3 for antibody 7444 (IGHV3-33)
ARDLGWSFDH

SEQ ID NO: 14889 - protein, 9 aa, Homo sapiens
  Light chain CDR3 for antibody 7445 (IGKV1-27)
QKYNSAPYT

SEQ ID NO: 14890 - protein, 14 aa, Homo sapiens
  Heavy chain CDR3 for antibody 7445 (IGHV3-33)
ARGYGSGSYYSFDY

SEQ ID NO: 14891 - protein, 9 aa, Homo sapiens
  Light chain CDR3 for antibody 7446 (IGKV3-15)
QQYNNWPLT

SEQ ID NO: 14892 - protein, 17 aa, Homo sapiens
  Heavy chain CDR3 for antibody 7446 (IGHV3-33)
ARSPYDILTGYSYYFDY

SEQ ID NO: 14893 - protein, 9 aa, Homo sapiens
  Light chain CDR3 for antibody 7447 (IGKV1D-13)
QHFNNYMYT

SEQ ID NO: 14894 - protein, 17 aa, Homo sapiens
  Heavy chain CDR3 for antibody 7447 (IGHV4-39)
ARVLRYFDWLSHDAFDI

SEQ ID NO: 14895 - protein, 9 aa, Homo sapiens
  Light chain CDR3 for antibody 7448 (IGKV3-11)
QQRSNWPPT

SEQ ID NO: 14896 - protein, 12 aa, Homo sapiens
  Heavy chain CDR3 for antibody 7448 (IGHV3-33)
ARKQWLVQAFDI

SEQ ID NO: 14897 - protein, 9 aa, Homo sapiens
  Light chain CDR3 for antibody 7449 (IGKV1D-13)
QQFNNYPHT

SEQ ID NO: 14898 - protein, 15 aa, Homo sapiens
  Heavy chain CDR3 for antibody 7449 (IGHV3-23)
AKDRSGSGSYNLFDY

SEQ ID NO: 14899 - protein, 9 aa, Homo sapiens
  Light chain CDR3 for antibody 7450 (IGKV1-9)
QQLNSYPFT

SEQ ID NO: 14900 - protein, 11 aa, Homo sapiens
  Heavy chain CDR3 for antibody 7450 (IGHV3-23)
AKGLWSYYFDY

SEQ ID NO: 14901 - protein, 9 aa, Homo sapiens
  Light chain CDR3 for antibody 7451 (IGKV3D-20)
QQFGSLPLT

SEQ ID NO: 14902 - protein, 13 aa, Homo sapiens
  Heavy chain CDR3 for antibody 7451 (IGHV4-39)
ARQWPSGYWYFDL

SEQ ID NO: 14903 - protein, 9 aa, Homo sapiens
  Light chain CDR3 for antibody 7452 (IGKV1-9)
QQSYSTPLT

SEQ ID NO: 14904 - protein, 11 aa, Homo sapiens
  Heavy chain CDR3 for antibody 7452 (IGHV3-33)
ARGTTVTHFDY

SEQ ID NO: 14905 - protein, 9 aa, Homo sapiens
  Light chain CDR3 for antibody 7453 (IGKV3-11)
QQRSNWPYT

SEQ ID NO: 14906 - protein, 19 aa, Homo sapiens
  Heavy chain CDR3 for antibody 7453 (IGHV3-33)
ARDRYYDILTGYSSYYFDY

SEQ ID NO: 14907 - protein, 9 aa, Homo sapiens
  Light chain CDR3 for antibody 7454 (IGKV1-39)
QQSYSTPFT

SEQ ID NO: 14908 - protein, 12 aa, Homo sapiens
  Heavy chain CDR3 for antibody 7454 (IGHV1-46)
ARGLTGDHAVDI

SEQ ID NO: 14909 - protein, 9 aa, Homo sapiens
  Light chain CDR3 for antibody 7455 (IGKV1-6)
LQDYKSPFT

SEQ ID NO: 14910 - protein, 13 aa, Homo sapiens
  Heavy chain CDR3 for antibody 7455 (IGHV3-33)
ARKAYGDYFYFDY

SEQ ID NO: 14911 - protein, 9 aa, Homo sapiens
  Light chain CDR3 for antibody 7456 (IGKV1-9)
QQLKSYLYT

SEQ ID NO: 14912 - protein, 8 aa, Homo sapiens
  Heavy chain CDR3 for antibody 7456 (IGHV1-18)
AKETGNNY

SEQ ID NO: 14913 - protein, 9 aa, Homo sapiens
  Light chain CDR3 for antibody 7457 (IGKV1-8)
QQYYSYPPT

SEQ ID NO: 14914 - protein, 12 aa, Homo sapiens
  Heavy chain CDR3 for antibody 7457 (IGHV3-33)
ARVDTAAPYFDY

SEQ ID NO: 14915 - protein, 9 aa, Homo sapiens
  Light chain CDR3 for antibody 7458 (IGKV1-37)
QRTYNAPFT

SEQ ID NO: 14916 - protein, 18 aa, Homo sapiens
  Heavy chain CDR3 for antibody 7458 (IGHV1-46)
ARDGDYVWGSYRSDWFDP

SEQ ID NO: 14917 - protein, 9 aa, Homo sapiens
  Light chain CDR3 for antibody 7459 (IGKV3-20)
LQYGSSPYT

SEQ ID NO: 14918 - protein, 13 aa, Homo sapiens
  Heavy chain CDR3 for antibody 7459 (IGHV3-11)
ARDEGYRGYGLDS

SEQ ID NO: 14919 - protein, 9 aa, Homo sapiens
  Light chain CDR3 for antibody 7460 (IGKV1-17)
LQHNSYPRT

SEQ ID NO: 14920 - protein, 11 aa, Homo sapiens
  Heavy chain CDR3 for antibody 7460 (IGHV1-18)
SRGGFSVGYDS

SEQ ID NO: 14921 - protein, 10 aa, Homo sapiens
  Light chain CDR3 for antibody 7461 (IGKV1-9)
QQYNNWPPIT

SEQ ID NO: 14922 - protein, 12 aa, Homo sapiens
  Heavy chain CDR3 for antibody 7461 (IGHV3-33)
ARVDAAAPYFDY

SEQ ID NO: 14923 - protein, 9 aa, Homo sapiens
  Light chain CDR3 for antibody 7462 (IGKV1-6)
QQEYNYPLT

SEQ ID NO: 14924 - protein, 16 aa, Homo sapiens
  Heavy chain CDR3 for antibody 7462 (IGHV3-23)
AKEGMVLRYFDWLWDY

SEQ ID NO: 14925 - protein, 9 aa, Homo sapiens
  Light chain CDR3 for antibody 7463 (IGKV6-21)
HQSSSLPLT

SEQ ID NO: 14926 - protein, 12 aa, Homo sapiens
  Heavy chain CDR3 for antibody 7463 (IGHV3-33)
ASGYFGSGSAHY

SEQ ID NO: 14927 - protein, 9 aa, Homo sapiens
  Light chain CDR3 for antibody 7464 (IGKV1-17)
LQHNSYPYT

SEQ ID NO: 14928 - protein, 16 aa, Homo sapiens
  Heavy chain CDR3 for antibody 7464 (IGHV3-23)
AKDGIGELSYYYGMDV

SEQ ID NO: 14929 - protein, 8 aa, Homo sapiens
  Light chain CDR3 for antibody 7465 (IGKV3-11)
QQRSNWLT

SEQ ID NO: 14930 - protein, 12 aa, Homo sapiens
  Heavy chain CDR3 for antibody 7465 (IGHV4-59)
ARDRSGWAYFDY

SEQ ID NO: 14931 - protein, 9 aa, Homo sapiens
  Light chain CDR3 for antibody 7466 (IGKV3-20)
QQYGSSIFT

SEQ ID NO: 14932 - protein, 16 aa, Homo sapiens
  Heavy chain CDR3 for antibody 7466 (IGHV3-33)
ARGGRSDWLYYYGMDV

SEQ ID NO: 14933 - protein, 9 aa, Homo sapiens
  Light chain CDR3 for antibody 7467 (IGKV1-9)
QQLNSYPLT

SEQ ID NO: 14934 - protein, 14 aa, Homo sapiens
  Heavy chain CDR3 for antibody 7467 (IGHV3-64)
ARGRASSGPYYFDY

SEQ ID NO: 14935 - protein, 9 aa, Homo sapiens
  Light chain CDR3 for antibody 7468 (IGKV1-6)
QQEYNYPLT

SEQ ID NO: 14936 - protein, 17 aa, Homo sapiens
  Heavy chain CDR3 for antibody 7468 (IGHV3-66)
ARVQYDILTGYSPYFDN

SEQ ID NO: 14937 - protein, 8 aa, Homo sapiens
  Light chain CDR3 for antibody 7469 (IGKV3-20)
QQYGRSFT

SEQ ID NO: 14938 - protein, 14 aa, Homo sapiens
  Heavy chain CDR3 for antibody 7469 (IGHV3-23)
ANWAYDILTGYLDY

SEQ ID NO: 14939 - protein, 10 aa, Homo sapiens
  Light chain CDR3 for antibody 7470 (IGKV3-11)
QQRSNWPPFT

SEQ ID NO: 14940 - protein, 18 aa, Homo sapiens
  Heavy chain CDR3 for antibody 7470 (IGHV3-33)
AREGSYYGSGSFPNWFDP

SEQ ID NO: 14941 - protein, 8 aa, Homo sapiens
  Light chain CDR3 for antibody 7471 (IGKV3D-7)
QQYGRSFT

SEQ ID NO: 14942 - protein, 14 aa, Homo sapiens
  Heavy chain CDR3 for antibody 7471 (IGHV4-39)
AKGGSGSYYNWFDP

SEQ ID NO: 14943 - protein, 9 aa, Homo sapiens
  Light chain CDR3 for antibody 7472 (IGKV1D-13)
QQFNNYPYT

SEQ ID NO: 14944 - protein, 18 aa, Homo sapiens
  Heavy chain CDR3 for antibody 7472 (IGHV3-33)
VRERGHYGSGSFPDAFDI

SEQ ID NO: 14945 - protein, 9 aa, Homo sapiens
  Light chain CDR3 for antibody 7473 (IGKV3D-7)
QQDYTLPRT

SEQ ID NO: 14946 - protein, 16 aa, Homo sapiens
  Heavy chain CDR3 for antibody 7473 (IGHV4-59)
ARQLLWFGELKGVFDY

SEQ ID NO: 14947 - protein, 10 aa, Homo sapiens
  Light chain CDR3 for antibody 7474 (IGKV1-39)
QQSYSTPMYT

SEQ ID NO: 14948 - protein, 10 aa, Homo sapiens
  Heavy chain CDR3 for antibody 7474 (IGHV3-33)
ARDGLRYFDW

SEQ ID NO: 14949 - protein, 10 aa, Homo sapiens
  Light chain CDR3 for antibody 7475 (IGKV1-17)
LQHNSYPMYT

SEQ ID NO: 14950 - protein, 12 aa, Homo sapiens
  Heavy chain CDR3 for antibody 7475 (IGHV3-33)
AKDPGWQQLAEY

SEQ ID NO: 14951 - protein, 8 aa, Homo sapiens
  Light chain CDR3 for antibody 7476 (IGKV3-11)
QQRSNWLT

SEQ ID NO: 14952 - protein, 11 aa, Homo sapiens
  Heavy chain CDR3 for antibody 7476 (IGHV3-33)
ARDTWDDYFDY

SEQ ID NO: 14953 - protein, 9 aa, Homo sapiens
  Light chain CDR3 for antibody 7477 (IGKV1-17)
LQHNSYPFT

SEQ ID NO: 14954 - protein, 15 aa, Homo sapiens
  Heavy chain CDR3 for antibody 7477 (IGHV4-39)
ARDEYSSGWYDAFDI

SEQ ID NO: 14955 - protein, 10 aa, Homo sapiens
  Light chain CDR3 for antibody 7478 (IGKV3-11)
QQRSNWPPYT

SEQ ID NO: 14956 - protein, 14 aa, Homo sapiens
  Heavy chain CDR3 for antibody 7478 (IGHV3-33)
ARKGYSGRYYYFDY

SEQ ID NO: 14957 - protein, 9 aa, Homo sapiens
  Light chain CDR3 for antibody 7479 (IGKV1D-16)
QQYYSYPRT

SEQ ID NO: 14958 - protein, 12 aa, Homo sapiens
  Heavy chain CDR3 for antibody 7479 (IGHV4-39)
ARQMVREGWFDP

SEQ ID NO: 14959 - protein, 9 aa, Homo sapiens
  Light chain CDR3 for antibody 7480 (IGKV1-27)
QKYNSAPYT

SEQ ID NO: 14960 - protein, 23 aa, Homo sapiens
  Heavy chain CDR3 for antibody 7480 (IGHV3-11)
ARDRGITMVRGVITYYYFYGMDV

SEQ ID NO: 14961 - protein, 9 aa, Homo sapiens
  Light chain CDR3 for antibody 7481 (IGKV1-6)
LQDFHYPWT

SEQ ID NO: 14962 - protein, 13 aa, Homo sapiens
  Heavy chain CDR3 for antibody 7481 (IGHV3-33)
ARRATLVRGVFDP

SEQ ID NO: 14963 - protein, 9 aa, Homo sapiens
  Light chain CDR3 for antibody 7482 (IGKV1-6)
LQDYKSPFT

SEQ ID NO: 14964 - protein, 14 aa, Homo sapiens
  Heavy chain CDR3 for antibody 7482 (IGHV3-33)
AREDYYGPLNWFDP

SEQ ID NO: 14965 - protein, 10 aa, Homo sapiens
  Light chain CDR3 for antibody 7483 (IGKV3-15)
QQYNNWPPYT

SEQ ID NO: 14966 - protein, 13 aa, Homo sapiens
  Heavy chain CDR3 for antibody 7483 (IGHV3-33)
AREYFDWLLPLDY

SEQ ID NO: 14967 - protein, 8 aa, Homo sapiens
  Light chain CDR3 for antibody 7484 (IGKV3-15)
QQYNNWLT

SEQ ID NO: 14968 - protein, 13 aa, Homo sapiens
  Heavy chain CDR3 for antibody 7484 (IGHV3-23)
ASPFNWNDGFFDY

SEQ ID NO: 14969 - protein, 9 aa, Homo sapiens
  Light chain CDR3 for antibody 7485 (IGKV1-6)
LQDYNYPWT

SEQ ID NO: 14970 - protein, 16 aa, Homo sapiens
  Heavy chain CDR3 for antibody 7485 (IGHV4-61)
ARDTPYYSGSGRPFDY

SEQ ID NO: 14971 - protein, 8 aa, Homo sapiens
  Light chain CDR3 for antibody 7486 (IGKV1-5)
QQYNSYWT

SEQ ID NO: 14972 - protein, 13 aa, Homo sapiens
  Heavy chain CDR3 for antibody 7486 (IGHV3-30)
AAPFMVRGDGMDV

SEQ ID NO: 14973 - protein, 8 aa, Homo sapiens
  Light chain CDR3 for antibody 7487 (IGKV6-21)
HQSSSLPT

SEQ ID NO: 14974 - protein, 9 aa, Homo sapiens
  Heavy chain CDR3 for antibody 7487 (IGHV3-13)
ARDRWYFDL

SEQ ID NO: 14975 - protein, 9 aa, Homo sapiens
  Light chain CDR3 for antibody 7488 (IGKV3-20)
LQYGSSPYT

SEQ ID NO: 14976 - protein, 20 aa, Homo sapiens
  Heavy chain CDR3 for antibody 7488 (IGHV3-23)
AKGMGGLRYFDWPHYYGMDV

SEQ ID NO: 14977 - protein, 8 aa, Homo sapiens
  Light chain CDR3 for antibody 7489 (IGKV3D-7)
QQDYNLLT

SEQ ID NO: 14978 - protein, 20 aa, Homo sapiens
  Heavy chain CDR3 for antibody 7489 (IGHV3-33)
SRGGATLVRGVIDYYYGMDV

SEQ ID NO: 14979 - protein, 7 aa, Homo sapiens
  Light chain CDR3 for antibody 7490 (IGKV1-17)
LQHNSYP

SEQ ID NO: 14980 - protein, 9 aa, Homo sapiens
  Heavy chain CDR3 for antibody 7490 (IGHV1-18)
ARGRLDFDY

SEQ ID NO: 14981 - protein, 9 aa, Homo sapiens
  Light chain CDR3 for antibody 7491 (IGKV3-15)
QQYNNWPRT

SEQ ID NO: 14982 - protein, 17 aa, Homo sapiens
  Heavy chain CDR3 for antibody 7491 (IGHV3-53)
TTERYPRRYYYYFGMDV

SEQ ID NO: 14983 - protein, 9 aa, Homo sapiens
  Light chain CDR3 for antibody 7492 (IGKV3-11)
QQRINWPWT

SEQ ID NO: 14984 - protein, 14 aa, Homo sapiens
  Heavy chain CDR3 for antibody 7492 (IGHV4-59)
ARASSGSSYWYFDL

SEQ ID NO: 14985 - protein, 9 aa, Homo sapiens
  Light chain CDR3 for antibody 7493 (IGKV1-6)
LQDYNYPYT

SEQ ID NO: 14986 - protein, 23 aa, Homo sapiens
  Heavy chain CDR3 for antibody 7493 (IGHV4/OR15-8)
ARERTYSGILPGYYEDYYYGMDV

SEQ ID NO: 14987 - protein, 8 aa, Homo sapiens
  Light chain CDR3 for antibody 7494 (IGKV6-21)
HQSSSLPT

SEQ ID NO: 14988 - protein, 9 aa, Homo sapiens
  Heavy chain CDR3 for antibody 7494 (IGHV4-59)
AREGGSGSL

SEQ ID NO: 14989 - protein, 9 aa, Homo sapiens
  Light chain CDR3 for antibody 7495 (IGKV3-15)
QQYNNWPLT

SEQ ID NO: 14990 - protein, 14 aa, Homo sapiens
  Heavy chain CDR3 for antibody 7495 (IGHV3-33)
ARDNILTAYYLFDY

SEQ ID NO: 14991 - protein, 9 aa, Homo sapiens
  Light chain CDR3 for antibody 7496 (IGKV3-11)
QQRSNWPLT

SEQ ID NO: 14992 - protein, 12 aa, Homo sapiens
  Heavy chain CDR3 for antibody 7496 (IGHV4-39)
ARREVILGAFDY

SEQ ID NO: 14993 - protein, 9 aa, Homo sapiens
  Light chain CDR3 for antibody 7497 (IGKV2D-28)
MQALQTPPT

SEQ ID NO: 14994 - protein, 18 aa, Homo sapiens
  Heavy chain CDR3 for antibody 7497 (IGHV1-46)
ARDGDYVWGSYRSDWFDP

SEQ ID NO: 14995 - protein, 9 aa, Homo sapiens
  Light chain CDR3 for antibody 7498 (IGKV2-30)
MQGTHWPLT

SEQ ID NO: 14996 - protein, 20 aa, Homo sapiens
  Heavy chain CDR3 for antibody 7498 (IGHV1-18)
AREVGIAVAGTLYYYYGMDV

SEQ ID NO: 14997 - protein, 9 aa, Homo sapiens
  Light chain CDR3 for antibody 7499 (IGKV4-1)
QQYYTTPYT

SEQ ID NO: 14998 - protein, 14 aa, Homo sapiens
  Heavy chain CDR3 for antibody 7499 (IGHV3-33)
ARDGYDILTGPFDY

SEQ ID NO: 14999 - protein, 9 aa, Homo sapiens
  Light chain CDR3 for antibody 7500 (IGKV1-17)
LQHNSYPYT

SEQ ID NO: 15000 - protein, 16 aa, Homo sapiens
  Heavy chain CDR3 for antibody 7500 (IGHV3-23)
ARGAWYSNGWYGTFDI

SEQ ID NO: 15001 - protein, 9 aa, Homo sapiens
  Light chain CDR3 for antibody 7501 (IGKV1-39)
QQSYRTPLT

SEQ ID NO: 15002 - protein, 11 aa, Homo sapiens
  Heavy chain CDR3 for antibody 7501 (IGHV3-23)
GEFSSGWSFDY

SEQ ID NO: 15003 - protein, 9 aa, Homo sapiens
  Light chain CDR3 for antibody 7502 (IGKV3D-15)
QQYNNWPIT

SEQ ID NO: 15004 - protein, 18 aa, Homo sapiens
  Heavy chain CDR3 for antibody 7502 (IGHV1-24)
ATGLRYFDWPIISNLFDY

SEQ ID NO: 15005 - protein, 9 aa, Homo sapiens
  Light chain CDR3 for antibody 7503 (IGKV1-6)
LQDYNYPRT

SEQ ID NO: 15006 - protein, 15 aa, Homo sapiens
  Heavy chain CDR3 for antibody 7503 (IGHV3-33)
ARRGGIAAAGYYFDY

SEQ ID NO: 15007 - protein, 9 aa, Homo sapiens
  Light chain CDR3 for antibody 7504 (IGKV3-11)
QQRSNWPLT

SEQ ID NO: 15008 - protein, 17 aa, Homo sapiens
  Heavy chain CDR3 for antibody 7504 (IGHV3-33)
ARQGVLLWFGELYYFDY

SEQ ID NO: 15009 - protein, 9 aa, Homo sapiens
  Light chain CDR3 for antibody 7505 (IGKV6-21)
HQSSSLPYT

SEQ ID NO: 15010 - protein, 18 aa, Homo sapiens
  Heavy chain CDR3 for antibody 7505 (IGHV1-18)
ARDPNYYGSGSYYNYFDY

SEQ ID NO: 15011 - protein, 10 aa, Homo sapiens
  Light chain CDR3 for antibody 7506 (IGKV3-11)
QQRSNWPIYT

SEQ ID NO: 15012 - protein, 17 aa, Homo sapiens
  Heavy chain CDR3 for antibody 7506 (IGHV3-13)
AREGWFGELWGYYGMDV

SEQ ID NO: 15013 - protein, 9 aa, Homo sapiens
  Light chain CDR3 for antibody 7507 (IGKV1-17)
QQYNSYSYT

SEQ ID NO: 15014 - protein, 14 aa, Homo sapiens
  Heavy chain CDR3 for antibody 7507 (IGHV4-39)
ARRGVVVPPGGMDV

SEQ ID NO: 15015 - protein, 10 aa, Homo sapiens
  Light chain CDR3 for antibody 7508 (IGKV1-39)
QQSYSTPMYT

SEQ ID NO: 15016 - protein, 13 aa, Homo sapiens
  Heavy chain CDR3 for antibody 7508 (IGHV1-18)
ARSITMVRGVIGY

SEQ ID NO: 15017 - protein, 10 aa, Homo sapiens
  Light chain CDR3 for antibody 7509 (IGKV3-11)
QQRSNWPIFT

SEQ ID NO: 15018 - protein, 15 aa, Homo sapiens
  Heavy chain CDR3 for antibody 7509 (IGHV3-23)
AKDPRGYYYYYGMDV

SEQ ID NO: 15019 - protein, 8 aa, Homo sapiens
  Light chain CDR3 for antibody 7510 (IGKV1-6)
QQYNSYWT

SEQ ID NO: 15020 - protein, 13 aa, Homo sapiens
  Heavy chain CDR3 for antibody 7510 (IGHV3-33)
ARGVLWFGELFDY

SEQ ID NO: 15021 - protein, 9 aa, Homo sapiens
  Light chain CDR3 for antibody 7511 (IGKV1-17)
LQHNSFPWT

SEQ ID NO: 15022 - protein, 9 aa, Homo sapiens
  Heavy chain CDR3 for antibody 7511 (IGHV3-30)
ARDNWGFDY

SEQ ID NO: 15023 - protein, 9 aa, Homo sapiens
  Light chain CDR3 for antibody 7512 (IGKV1-9)
QQLISYPLT

SEQ ID NO: 15024 - protein, 15 aa, Homo sapiens
  Heavy chain CDR3 for antibody 7512 (IGHV1-2)
ARDLGYYGSGSRMDV

SEQ ID NO: 15025 - protein, 9 aa, Homo sapiens
  Light chain CDR3 for antibody 7513 (IGKV1-27)
QKYNSAPYT

SEQ ID NO: 15026 - protein, 19 aa, Homo sapiens
  Heavy chain CDR3 for antibody 7513 (IGHV3-33)
ARRKNYYGSGSWHYYGMDV

SEQ ID NO: 15027 - protein, 9 aa, Homo sapiens
  Light chain CDR3 for antibody 7514 (IGKV1-39)
QQSYSTPYT

SEQ ID NO: 15028 - protein, 18 aa, Homo sapiens
  Heavy chain CDR3 for antibody 7514 (IGHV3-33)
ARREGIVGTTTYYYGMDV

SEQ ID NO: 15029 - protein, 9 aa, Homo sapiens
  Light chain CDR3 for antibody 7515 (IGKV3D-7)
QQDYEFPLT

SEQ ID NO: 15030 - protein, 10 aa, Homo sapiens
  Heavy chain CDR3 for antibody 7515 (IGHV3-33)
ARDGSGSQPI

SEQ ID NO: 15031 - protein, 9 aa, Homo sapiens
  Light chain CDR3 for antibody 7516 (IGKV1-16)
QHYNDYPFT

SEQ ID NO: 15032 - protein, 12 aa, Homo sapiens
  Heavy chain CDR3 for antibody 7516 (IGHV3-23)
AKDGWFGESLDY

SEQ ID NO: 15033 - protein, 10 aa, Homo sapiens
  Light chain CDR3 for antibody 7517 (IGKV3-15)
QQYNNWPPYT

SEQ ID NO: 15034 - protein, 14 aa, Homo sapiens
  Heavy chain CDR3 for antibody 7517 (IGHV4-39)
ARDSGYDYYYAMDV

SEQ ID NO: 15035 - protein, 9 aa, Homo sapiens
  Light chain CDR3 for antibody 7518 (IGKV1D-16)
QQYHSYPYT

SEQ ID NO: 15036 - protein, 15 aa, Homo sapiens
  Heavy chain CDR3 for antibody 7518 (IGHV1-18)
ARGSYDSSGYYYFDY

SEQ ID NO: 15037 - protein, 10 aa, Homo sapiens
  Light chain CDR3 for antibody 7519 (IGKV1-17)
LQHNSYPMYT

SEQ ID NO: 15038 - protein, 19 aa, Homo sapiens
  Heavy chain CDR3 for antibody 7519 (IGHV3-30)
ARRFSGYSGYDHYYYGMDV

SEQ ID NO: 15039 - protein, 9 aa, Homo sapiens
  Light chain CDR3 for antibody 7520 (IGKV6-21)
HQSTSLPFT

SEQ ID NO: 15040 - protein, 20 aa, Homo sapiens
  Heavy chain CDR3 for antibody 7520 (IGHV1-8)
ARGDGTMVRGIYYYYYGMDV

SEQ ID NO: 15041 - protein, 10 aa, Homo sapiens
  Light chain CDR3 for antibody 7521 (IGKV3-11)
QQRSNWLMYT

SEQ ID NO: 15042 - protein, 9 aa, Homo sapiens
  Heavy chain CDR3 for antibody 7521 (IGHV3-33)
ARATVGVDY

SEQ ID NO: 15043 - protein, 9 aa, Homo sapiens
  Light chain CDR3 for antibody 7522 (IGKV1-39)
QQSYSTPLT

SEQ ID NO: 15044 - protein, 10 aa, Homo sapiens
  Heavy chain CDR3 for antibody 7522 (IGHV1-46)
AREWELLFDY

SEQ ID NO: 15045 - protein, 10 aa, Homo sapiens
  Light chain CDR3 for antibody 7523 (IGKV3-11)
QQRSNWPIFT

SEQ ID NO: 15046 - protein, 15 aa, Homo sapiens
  Heavy chain CDR3 for antibody 7523 (IGHV1-24)
ATHWDLRYYYYGMDV

SEQ ID NO: 15047 - protein, 8 aa, Homo sapiens
  Light chain CDR3 for antibody 7524 (IGKV3-20)
QQYGSSFT

SEQ ID NO: 15048 - protein, 17 aa, Homo sapiens
  Heavy chain CDR3 for antibody 7524 (IGHV3-23)
AKDYDILTGYSHNWFDP

SEQ ID NO: 15049 - protein, 10 aa, Homo sapiens
  Light chain CDR3 for antibody 7525 (IGKV1-39)
QQSYSTPMYT

SEQ ID NO: 15050 - protein, 16 aa, Homo sapiens
  Heavy chain CDR3 for antibody 7525 (IGHV3-33)
ARAVYYGSGSSLIMDV

SEQ ID NO: 15051 - protein, 9 aa, Homo sapiens
  Light chain CDR3 for antibody 7526 (IGKV3D-7)
QQDYNLPYT

SEQ ID NO: 15052 - protein, 17 aa, Homo sapiens
  Heavy chain CDR3 for antibody 7526 (IGHV3-33)
ARSGIVGATDYYYGLDV

SEQ ID NO: 15053 - protein, 8 aa, Homo sapiens
  Light chain CDR3 for antibody 7527 (IGKV3D-7)
QQDYNLLT

SEQ ID NO: 15054 - protein, 13 aa, Homo sapiens
  Heavy chain CDR3 for antibody 7527 (IGHV3-33)
ARDSSSWYHWFDP

SEQ ID NO: 15055 - protein, 9 aa, Homo sapiens
  Light chain CDR3 for antibody 7528 (IGKV3-15)
QQYNNWPLT

SEQ ID NO: 15056 - protein, 11 aa, Homo sapiens
  Heavy chain CDR3 for antibody 7528 (IGHV3-20)
ARGGYYGPFDY

SEQ ID NO: 15057 - protein, 8 aa, Homo sapiens
  Light chain CDR3 for antibody 7529 (IGKV3-20)
QQYGRSFT

SEQ ID NO: 15058 - protein, 14 aa, Homo sapiens
  Heavy chain CDR3 for antibody 7529 (IGHV3-33)
ARDREQQLVRYFDY

SEQ ID NO: 15059 - protein, 9 aa, Homo sapiens
  Light chain CDR3 for antibody 7530 (IGKV1-33)
QQYDNLPFT

SEQ ID NO: 15060 - protein, 15 aa, Homo sapiens
  Heavy chain CDR3 for antibody 7530 (IGHV3-30)
ARRGYGSGSPDAFDL

SEQ ID NO: 15061 - protein, 9 aa, Homo sapiens
  Light chain CDR3 for antibody 7531 (IGKV1-17)
LQHNSYPYT

SEQ ID NO: 15062 - protein, 14 aa, Homo sapiens
  Heavy chain CDR3 for antibody 7531 (IGHV3-33)
AKSYDILTGEAFDI

SEQ ID NO: 15063 - protein, 9 aa, Homo sapiens
  Light chain CDR3 for antibody 7532 (IGKV1-16)
QQYNRYPYT

SEQ ID NO: 15064 - protein, 15 aa, Homo sapiens
  Heavy chain CDR3 for antibody 7532 (IGHV4-59)
ARDGHGNWGSGTFDY

SEQ ID NO: 15065 - protein, 10 aa, Homo sapiens
  Light chain CDR3 for antibody 7533 (IGKV3-11)
QQRSNWLMYT

SEQ ID NO: 15066 - protein, 13 aa, Homo sapiens
  Heavy chain CDR3 for antibody 7533 (IGHV3-11)
ARDGGAAAGTWDS

SEQ ID NO: 15067 - protein, 9 aa, Homo sapiens
  Light chain CDR3 for antibody 7534 (IGKV5-2)
LQHDNFPWT

SEQ ID NO: 15068 - protein, 12 aa, Homo sapiens
  Heavy chain CDR3 for antibody 7534 (IGHV3-23)
AKEGLGNDYESY

SEQ ID NO: 15069 - protein, 9 aa, Homo sapiens
  Light chain CDR3 for antibody 7535 (IGKV1-6)
LQDYNFPFT

SEQ ID NO: 15070 - protein, 14 aa, Homo sapiens
  Heavy chain CDR3 for antibody 7535 (IGHV3-33)
ARDWNDVYYYGMDV

SEQ ID NO: 15071 - protein, 9 aa, Homo sapiens
  Light chain CDR3 for antibody 7536 (IGKV1-17)
LQHNSYPYT

SEQ ID NO: 15072 - protein, 14 aa, Homo sapiens
  Heavy chain CDR3 for antibody 7536 (IGHV3-20)
ARNGGSTWYDWFDP

SEQ ID NO: 15073 - protein, 9 aa, Homo sapiens
  Light chain CDR3 for antibody 7537 (IGKV3D-20)
QQYSSYPYT

SEQ ID NO: 15074 - protein, 14 aa, Homo sapiens
  Heavy chain CDR3 for antibody 7537 (IGHV3-15)
SIYFYGSGRDYFDY

SEQ ID NO: 15075 - protein, 9 aa, Homo sapiens
  Light chain CDR3 for antibody 7538 (IGKV2D-28)
MQALQTPYT

SEQ ID NO: 15076 - protein, 17 aa, Homo sapiens
  Heavy chain CDR3 for antibody 7538 (IGHV3-33)
ARGYCSRTSCYLYYFDY

SEQ ID NO: 15077 - protein, 8 aa, Homo sapiens
  Light chain CDR3 for antibody 7539 (IGKV3D-7)
QQDYNLLT

SEQ ID NO: 15078 - protein, 18 aa, Homo sapiens
  Heavy chain CDR3 for antibody 7539 (IGHV3-23)
AKPDYYGSGSYYNVPFDY

SEQ ID NO: 15079 - protein, 9 aa, Homo sapiens
  Light chain CDR3 for antibody 7540 (IGKV1D-16)
QQYNSYPFT

SEQ ID NO: 15080 - protein, 14 aa, Homo sapiens
  Heavy chain CDR3 for antibody 7540 (IGHV4-59)
AKGGSGSYYNWFDP

SEQ ID NO: 15081 - protein, 9 aa, Homo sapiens
  Light chain CDR3 for antibody 7541 (IGKV5-2)
LQHDKFPYT

SEQ ID NO: 15082 - protein, 18 aa, Homo sapiens
  Heavy chain CDR3 for antibody 7541 (IGHV3-33)
ARDRYHDILTGYYMGFDY

SEQ ID NO: 15083 - protein, 9 aa, Homo sapiens
  Light chain CDR3 for antibody 7542 (IGKV2-30)
MQGTHWPLT

SEQ ID NO: 15084 - protein, 24 aa, Homo sapiens
  Heavy chain CDR3 for antibody 7542 (IGHV1-46)
ARDEARGLLTGYYNMREYYYGMDV

SEQ ID NO: 15085 - protein, 11 aa, Homo sapiens
  Light chain CDR3 for antibody 7543 (IGKV3-11)
QQRSNWPPTWT

SEQ ID NO: 15086 - protein, 18 aa, Homo sapiens
  Heavy chain CDR3 for antibody 7543 (IGHV3-33)
ARGGYSSGWDYYYYGMDV

SEQ ID NO: 15087 - protein, 9 aa, Homo sapiens
  Light chain CDR3 for antibody 7544 (IGKV3-20)
QQYGSSPYT

SEQ ID NO: 15088 - protein, 14 aa, Homo sapiens
  Heavy chain CDR3 for antibody 7544 (IGHV4-39)
ARQGDILTGYSFDN

SEQ ID NO: 15089 - protein, 9 aa, Homo sapiens
  Light chain CDR3 for antibody 7545 (IGKV2D-28)
MQALQTPPT

SEQ ID NO: 15090 - protein, 9 aa, Homo sapiens
  Heavy chain CDR3 for antibody 7545 (IGHV3-13)
ARDRWYFDL

SEQ ID NO: 15091 - protein, 9 aa, Homo sapiens
  Light chain CDR3 for antibody 7546 (IGKV1D-16)
QQYNSYPYT

SEQ ID NO: 15092 - protein, 12 aa, Homo sapiens
  Heavy chain CDR3 for antibody 7546 (IGHV4-39)
ASQMVREGWFDP

SEQ ID NO: 15093 - protein, 9 aa, Homo sapiens
  Light chain CDR3 for antibody 7547 (IGKV1D-13)
QQFNHYPRT

SEQ ID NO: 15094 - protein, 11 aa, Homo sapiens
  Heavy chain CDR3 for antibody 7547 (IGHV3-33)
ARDPSIDGMDV

SEQ ID NO: 15095 - protein, 9 aa, Homo sapiens
  Light chain CDR3 for antibody 7548 (IGKV1-6)
QQEYNYPLT

SEQ ID NO: 15096 - protein, 18 aa, Homo sapiens
  Heavy chain CDR3 for antibody 7548 (IGHV4-59)
AREGDYVWGSYRPNWFDP

SEQ ID NO: 15097 - protein, 9 aa, Homo sapiens
  Light chain CDR3 for antibody 7549 (IGKV1D-16)
QQYDSYPYT

SEQ ID NO: 15098 - protein, 14 aa, Homo sapiens
  Heavy chain CDR3 for antibody 7549 (IGHV3-33)
ARDWNDVYSYGMDV

SEQ ID NO: 15099 - protein, 9 aa, Homo sapiens
  Light chain CDR3 for antibody 7550 (IGKV3-20)
QQYGSSIFT

SEQ ID NO: 15100 - protein, 17 aa, Homo sapiens
  Heavy chain CDR3 for antibody 7550 (IGHV3-33)
ARGFSGYDGYYYYGMDV

SEQ ID NO: 15101 - protein, 9 aa, Homo sapiens
  Light chain CDR3 for antibody 7551 (IGKV6-21)
HQSSSLPYT

SEQ ID NO: 15102 - protein, 16 aa, Homo sapiens
  Heavy chain CDR3 for antibody 7551 (IGHV4-39)
ARRVPYYDILTGYLDY

SEQ ID NO: 15103 - protein, 10 aa, Homo sapiens
  Light chain CDR3 for antibody 7552 (IGKV1-39)
QQSYSTPMYT

SEQ ID NO: 15104 - protein, 16 aa, Homo sapiens
  Heavy chain CDR3 for antibody 7552 (IGHV1-24)
ATEDSSSTYYYYGLDV

SEQ ID NO: 15105 - protein, 9 aa, Homo sapiens
  Light chain CDR3 for antibody 7553 (IGKV1-6)
LQDYNYPFT

SEQ ID NO: 15106 - protein, 13 aa, Homo sapiens
  Heavy chain CDR3 for antibody 7553 (IGHV3-11)
ARDEGYRGYVLGS

SEQ ID NO: 15107 - protein, 9 aa, Homo sapiens
  Light chain CDR3 for antibody 7554 (IGKV1-17)
LQHNSYPRT

SEQ ID NO: 15108 - protein, 12 aa, Homo sapiens
  Heavy chain CDR3 for antibody 7554 (IGHV3-33)
AREGYSSSWFDY

SEQ ID NO: 15109 - protein, 8 aa, Homo sapiens
  Light chain CDR3 for antibody 7555 (IGKV1-17)
QQYNSYYT

SEQ ID NO: 15110 - protein, 14 aa, Homo sapiens
  Heavy chain CDR3 for antibody 7555 (IGHV3-33)
ARRGYSGYDWYFDY

SEQ ID NO: 15111 - protein, 10 aa, Homo sapiens
  Light chain CDR3 for antibody 7556 (IGKV3-11)
QQRSTWPTLT

SEQ ID NO: 15112 - protein, 13 aa, Homo sapiens
  Heavy chain CDR3 for antibody 7556 (IGHV3-33)
ARDWGYSHGYFDY

SEQ ID NO: 15113 - protein, 8 aa, Homo sapiens
  Light chain CDR3 for antibody 7557 (IGKV3-20)
QQYGRSFT

SEQ ID NO: 15114 - protein, 16 aa, Homo sapiens
  Heavy chain CDR3 for antibody 7557 (IGHV3-30)
ARDIAVAGHVYYGMDV

SEQ ID NO: 15115 - protein, 9 aa, Homo sapiens
  Light chain CDR3 for antibody 7558 (IGKV3-11)
QQRSNWPYT

SEQ ID NO: 15116 - protein, 18 aa, Homo sapiens
  Heavy chain CDR3 for antibody 7558 (IGHV3-33)
ARGGYDILTGYYRTGMDV

SEQ ID NO: 15117 - protein, 10 aa, Homo sapiens
  Light chain CDR3 for antibody 7559 (IGKV3-11)
QQRSNWPALT

SEQ ID NO: 15118 - protein, 18 aa, Homo sapiens
  Heavy chain CDR3 for antibody 7559 (IGHV3-33)
ARDGRISLVRGIIDAFDI

SEQ ID NO: 15119 - protein, 9 aa, Homo sapiens
  Light chain CDR3 for antibody 7560 (IGKV3D-7)
QQDSNLPYT

SEQ ID NO: 15120 - protein, 20 aa, Homo sapiens
  Heavy chain CDR3 for antibody 7560 (IGHV3-33)
AREDYYGSGSYYPAYNWFDP

SEQ ID NO: 15121 - protein, 8 aa, Homo sapiens
  Light chain CDR3 for antibody 7561 (IGKV1D-13)
QQFNNYPT

SEQ ID NO: 15122 - protein, 21 aa, Homo sapiens
  Heavy chain CDR3 for antibody 7561 (IGHV3-33)
ARDEYYEIVTGYGYYHYGMDV

SEQ ID NO: 15123 - protein, 8 aa, Homo sapiens
  Light chain CDR3 for antibody 7562 (IGKV3-20)
QQYGRSWT

SEQ ID NO: 15124 - protein, 11 aa, Homo sapiens
  Heavy chain CDR3 for antibody 7562 (IGHV3-33)
ARDKSSGWSDY

SEQ ID NO: 15125 - protein, 9 aa, Homo sapiens
  Light chain CDR3 for antibody 7563 (IGKV1-9)
QQGNTYSRT

SEQ ID NO: 15126 - protein, 13 aa, Homo sapiens
  Heavy chain CDR3 for antibody 7563 (IGHV4-39)
ARQWPSGYWYFDL

SEQ ID NO: 15127 - protein, 9 aa, Homo sapiens
  Light chain CDR3 for antibody 7564 (IGKV6-21)
HQSSSLPYT

SEQ ID NO: 15128 - protein, 14 aa, Homo sapiens
  Heavy chain CDR3 for antibody 7564 (IGHV3-15)
SIYFYGSGRDYFDY

SEQ ID NO: 15129 - protein, 9 aa, Homo sapiens
  Light chain CDR3 for antibody 7565 (IGKV1-9)
QQLKSYLYT

SEQ ID NO: 15130 - protein, 11 aa, Homo sapiens
  Heavy chain CDR3 for antibody 7565 (IGHV1-24)
ATELGLYYFDY

SEQ ID NO: 15131 - protein, 11 aa, Homo sapiens
  Light chain CDR3 for antibody 7566 (IGKV1-9)
QQRSNWPPMYT

SEQ ID NO: 15132 - protein, 16 aa, Homo sapiens
  Heavy chain CDR3 for antibody 7566 (IGHV4-59)
AGGSGSYRDYYYGIDV

SEQ ID NO: 15133 - protein, 8 aa, Homo sapiens
  Light chain CDR3 for antibody 7567 (IGKV6-21)
HQSSSLPT

SEQ ID NO: 15134 - protein, 15 aa, Homo sapiens
  Heavy chain CDR3 for antibody 7567 (IGHV3-33)
AKDRNSGYDWGGFDY

SEQ ID NO: 15135 - protein, 9 aa, Homo sapiens
  Light chain CDR3 for antibody 7568 (IGKV3D-7)
QQDYNLPYT

SEQ ID NO: 15136 - protein, 18 aa, Homo sapiens
  Heavy chain CDR3 for antibody 7568 (IGHV3-33)
ARGGYDILTGYYRTGMDV

SEQ ID NO: 15137 - protein, 9 aa, Homo sapiens
  Light chain CDR3 for antibody 7569 (IGKV1-16)
QHYNDYPFT

SEQ ID NO: 15138 - protein, 15 aa, Homo sapiens
  Heavy chain CDR3 for antibody 7569 (IGHV3-33)
ARGYYYGSGSFPFDY

SEQ ID NO: 15139 - protein, 9 aa, Homo sapiens
  Light chain CDR3 for antibody 7570 (IGKV3-20)
QQFDSSPYT

SEQ ID NO: 15140 - protein, 16 aa, Homo sapiens
  Heavy chain CDR3 for antibody 7570 (IGHV3-23)
AKEGMVLRYFDWLWDY

SEQ ID NO: 15141 - protein, 9 aa, Homo sapiens
  Light chain CDR3 for antibody 7571 (IGKV1D-16)
QQYNSYPLT

SEQ ID NO: 15142 - protein, 18 aa, Homo sapiens
  Heavy chain CDR3 for antibody 7571 (IGHV3-33)
ARGSYSSGWNDYHYGMDV

SEQ ID NO: 15143 - protein, 9 aa, Homo sapiens
  Light chain CDR3 for antibody 7572 (IGKV1-16)
QKYNSNPLT

SEQ ID NO: 15144 - protein, 13 aa, Homo sapiens
  Heavy chain CDR3 for antibody 7572 (IGHV3-33)
ARRATLVRGVFDP

SEQ ID NO: 15145 - protein, 9 aa, Homo sapiens
  Light chain CDR3 for antibody 7573 (IGKV1-9)
QQLISYPLT

SEQ ID NO: 15146 - protein, 17 aa, Homo sapiens
  Heavy chain CDR3 for antibody 7573 (IGHV3-33)
ARDLIGPLSSSWYPFDY

SEQ ID NO: 15147 - protein, 8 aa, Homo sapiens
  Light chain CDR3 for antibody 7574 (IGKV2D-28)
MQALQTPT

SEQ ID NO: 15148 - protein, 13 aa, Homo sapiens
  Heavy chain CDR3 for antibody 7574 (IGHV3-33)
ARDQRYSSGWYDY

SEQ ID NO: 15149 - protein, 9 aa, Homo sapiens
  Light chain CDR3 for antibody 7575 (IGKV3-11)
QQRSNWPYT

SEQ ID NO: 15150 - protein, 15 aa, Homo sapiens
  Heavy chain CDR3 for antibody 7575 (IGHV3-33)
ARDRDYYYYYYGMDV

SEQ ID NO: 15151 - protein, 9 aa, Homo sapiens
  Light chain CDR3 for antibody 7576 (IGKV3D-20)
QQYGSSPYT

SEQ ID NO: 15152 - protein, 20 aa, Homo sapiens
  Heavy chain CDR3 for antibody 7576 (IGHV3-33)
AKDRETGTTSYHYYYYGMDV

SEQ ID NO: 15153 - protein, 8 aa, Homo sapiens
  Light chain CDR3 for antibody 7577 (IGKV1D-13)
QQFNNYPT

SEQ ID NO: 15154 - protein, 9 aa, Homo sapiens
  Heavy chain CDR3 for antibody 7577 (IGHV3-23)
AKEQLLFDY

SEQ ID NO: 15155 - protein, 10 aa, Homo sapiens
  Light chain CDR3 for antibody 7578 (IGKV1-27)
QKYNSAPMYT

SEQ ID NO: 15156 - protein, 13 aa, Homo sapiens
  Heavy chain CDR3 for antibody 7578 (IGHV4-28)
ARKGATGYYGMDV

SEQ ID NO: 15157 - protein, 9 aa, Homo sapiens
  Light chain CDR3 for antibody 7579 (IGKV1-6)
LQDYKSPFT

SEQ ID NO: 15158 - protein, 17 aa, Homo sapiens
  Heavy chain CDR3 for antibody 7579 (IGHV3-33)
ARESLKLGIYYYYGMDV

SEQ ID NO: 15159 - protein, 9 aa, Homo sapiens
  Light chain CDR3 for antibody 7580 (IGKV1-6)
LQDYNYPYT

SEQ ID NO: 15160 - protein, 12 aa, Homo sapiens
  Heavy chain CDR3 for antibody 7580 (IGHV3-33)
AREGVMGYSGSY

SEQ ID NO: 15161 - protein, 9 aa, Homo sapiens
  Light chain CDR3 for antibody 7581 (IGKV1D-16)
QQYSSYPYT

SEQ ID NO: 15162 - protein, 17 aa, Homo sapiens
  Heavy chain CDR3 for antibody 7581 (IGHV3-33)
ARGYSGYVGYYYYGMDV

SEQ ID NO: 15163 - protein, 9 aa, Homo sapiens
  Light chain CDR3 for antibody 7582 (IGKV3-11)
QQRSNWPYT

SEQ ID NO: 15164 - protein, 13 aa, Homo sapiens
  Heavy chain CDR3 for antibody 7582 (IGHV3-23)
AKDRGLRYYGMDV

SEQ ID NO: 15165 - protein, 9 aa, Homo sapiens
  Light chain CDR3 for antibody 7583 (IGKV1D-13)
QQFYNYPRT

SEQ ID NO: 15166 - protein, 11 aa, Homo sapiens
  Heavy chain CDR3 for antibody 7583 (IGHV4-39)
ARKIVGAHFDY

SEQ ID NO: 15167 - protein, 8 aa, Homo sapiens
  Light chain CDR3 for antibody 7584 (IGKV1D-16)
HQSGSLPT

SEQ ID NO: 15168 - protein, 14 aa, Homo sapiens
  Heavy chain CDR3 for antibody 7584 (IGHV3-33)
VRDAMGATTAWFDP

SEQ ID NO: 15169 - protein, 9 aa, Homo sapiens
  Light chain CDR3 for antibody 7585 (IGKV3-11)
QQRSNWMYT

SEQ ID NO: 15170 - protein, 11 aa, Homo sapiens
  Heavy chain CDR3 for antibody 7585 (IGHV3-23)
GEFSSGWSFDY

SEQ ID NO: 15171 - protein, 9 aa, Homo sapiens
  Light chain CDR3 for antibody 7586 (IGKV1D-16)
QQYHSYPYT

SEQ ID NO: 15172 - protein, 18 aa, Homo sapiens
  Heavy chain CDR3 for antibody 7586 (IGHV4-39)
ARYITMVRGAIITGPFDY

SEQ ID NO: 15173 - protein, 9 aa, Homo sapiens
  Light chain CDR3 for antibody 7587 (IGKV1-17)
LQHNSYPIT

SEQ ID NO: 15174 - protein, 14 aa, Homo sapiens
  Heavy chain CDR3 for antibody 7587 (IGHV3-53)
ARDGLVGASSWFDP

SEQ ID NO: 15175 - protein, 9 aa, Homo sapiens
  Light chain CDR3 for antibody 7588 (IGKV1-6)
HQSSSLPYT

SEQ ID NO: 15176 - protein, 11 aa, Homo sapiens
  Heavy chain CDR3 for antibody 7588 (IGHV4-39)
ARLSGEGHFDS

SEQ ID NO: 15177 - protein, 9 aa, Homo sapiens
  Light chain CDR3 for antibody 7589 (IGKV3-11)
QQRSNWMYT

SEQ ID NO: 15178 - protein, 8 aa, Homo sapiens
  Heavy chain CDR3 for antibody 7589 (IGHV3-20)
APHWIFDY

SEQ ID NO: 15179 - protein, 9 aa, Homo sapiens
  Light chain CDR3 for antibody 7590 (IGKV1-6)
LQDYNYPYT

SEQ ID NO: 15180 - protein, 14 aa, Homo sapiens
  Heavy chain CDR3 for antibody 7590 (IGHV1-46)
ARGAVDDYYYGMDV

SEQ ID NO: 15181 - protein, 9 aa, Homo sapiens
  Light chain CDR3 for antibody 7591 (IGKV1-6)
LQDYKSPFT

SEQ ID NO: 15182 - protein, 13 aa, Homo sapiens
  Heavy chain CDR3 for antibody 7591 (IGHV4-59)
ARTMVRGVAPFDY

SEQ ID NO: 15183 - protein, 9 aa, Homo sapiens
  Light chain CDR3 for antibody 7592 (IGKV3-20)
QQYGSSPYT

SEQ ID NO: 15184 - protein, 18 aa, Homo sapiens
  Heavy chain CDR3 for antibody 7592 (IGHV3-33)
ARDYDSLTTYPEDYGMDV

SEQ ID NO: 15185 - protein, 10 aa, Homo sapiens
  Light chain CDR3 for antibody 7593 (IGKV3-11)
QQRSNWPTWT

SEQ ID NO: 15186 - protein, 17 aa, Homo sapiens
  Heavy chain CDR3 for antibody 7593 (IGHV4-39)
AGRLTYYYGSGSPSFDY

SEQ ID NO: 15187 - protein, 9 aa, Homo sapiens
  Light chain CDR3 for antibody 7594 (IGKV1-16)
QQYKSYPYT

SEQ ID NO: 15188 - protein, 18 aa, Homo sapiens
  Heavy chain CDR3 for antibody 7594 (IGHV1-46)
ARDGDYVWGSYRSSWFGP

SEQ ID NO: 15189 - protein, 9 aa, Homo sapiens
  Light chain CDR3 for antibody 7595 (IGKV5-2)
LQHDNFPWT

SEQ ID NO: 15190 - protein, 14 aa, Homo sapiens
  Heavy chain CDR3 for antibody 7595 (IGHV3-20)
ARDGGSGSYDGLDV

SEQ ID NO: 15191 - protein, 9 aa, Homo sapiens
  Light chain CDR3 for antibody 7596 (IGKV1-27)
QKYNSAPYT

SEQ ID NO: 15192 - protein, 12 aa, Homo sapiens
  Heavy chain CDR3 for antibody 7596 (IGHV3-33)
ARESGGSFGMDV

SEQ ID NO: 15193 - protein, 9 aa, Homo sapiens
  Light chain CDR3 for antibody 7597 (IGKV1-9)
QQLYTYPYT

SEQ ID NO: 15194 - protein, 14 aa, Homo sapiens
  Heavy chain CDR3 for antibody 7597 (IGHV3-33)
ARDRIAAASSDFDC

SEQ ID NO: 15195 - protein, 10 aa, Homo sapiens
  Light chain CDR3 for antibody 7598 (IGKV3-11)
QQRSNWPIFT

SEQ ID NO: 15196 - protein, 13 aa, Homo sapiens
  Heavy chain CDR3 for antibody 7598 (IGHV4-39)
ARPGIVAAGWFDP

SEQ ID NO: 15197 - protein, 8 aa, Homo sapiens
  Light chain CDR3 for antibody 7599 (IGKV1-5)
QQYNSYWT

SEQ ID NO: 15198 - protein, 17 aa, Homo sapiens
  Heavy chain CDR3 for antibody 7599 (IGHV3-23)
AKDGIGELSYYYYGMDV

SEQ ID NO: 15199 - protein, 9 aa, Homo sapiens
  Light chain CDR3 for antibody 7600 (IGKV1-16)
QQYNSYPYT

SEQ ID NO: 15200 - protein, 17 aa, Homo sapiens
  Heavy chain CDR3 for antibody 7600 (IGHV4-59)
AREEDYYGSGSFGTFDI

SEQ ID NO: 15201 - protein, 9 aa, Homo sapiens
  Light chain CDR3 for antibody 7601 (IGKV3D-7)
QQDYSFPLT

SEQ ID NO: 15202 - protein, 9 aa, Homo sapiens
  Heavy chain CDR3 for antibody 7601 (IGHV3-23)
AKEQQLFDY

SEQ ID NO: 15203 - protein, 9 aa, Homo sapiens
  Light chain CDR3 for antibody 7602 (IGKV1-5)
QQYNSYSYT

SEQ ID NO: 15204 - protein, 16 aa, Homo sapiens
  Heavy chain CDR3 for antibody 7602 (IGHV4-59)
ARFYFGSGSYYWYFDL

SEQ ID NO: 15205 - protein, 9 aa, Homo sapiens
  Light chain CDR3 for antibody 7603 (IGKV6-21)
HQSSSLPYT

SEQ ID NO: 15206 - protein, 22 aa, Homo sapiens
  Heavy chain CDR3 for antibody 7603 (IGHV3-33)
ARMYYDILTGYYKDYYYYGMDV

SEQ ID NO: 15207 - protein, 10 aa, Homo sapiens
  Light chain CDR3 for antibody 7604 (IGKV3-11)
QQRSNWPIFT

SEQ ID NO: 15208 - protein, 11 aa, Homo sapiens
  Heavy chain CDR3 for antibody 7604 (IGHV3-23)
ARDRATATVDY

SEQ ID NO: 15209 - protein, 9 aa, Homo sapiens
  Light chain CDR3 for antibody 7605 (IGKV1-17)
LQHNSYPLT

SEQ ID NO: 15210 - protein, 13 aa, Homo sapiens
  Heavy chain CDR3 for antibody 7605 (IGHV4-61)
ARRYSSGWYPFDY

SEQ ID NO: 15211 - protein, 9 aa, Homo sapiens
  Light chain CDR3 for antibody 7606 (IGKV1-6)
LQDYNYPWT

SEQ ID NO: 15212 - protein, 13 aa, Homo sapiens
  Heavy chain CDR3 for antibody 7606 (IGHV4-39)
ARRGVLAPAAFDH

SEQ ID NO: 15213 - protein, 10 aa, Homo sapiens
  Light chain CDR3 for antibody 7607 (IGKV1-17)
LQHNSYPMYT

SEQ ID NO: 15214 - protein, 15 aa, Homo sapiens
  Heavy chain CDR3 for antibody 7607 (IGHV3-33)
VCVLYDYGDYVGFDY

SEQ ID NO: 15215 - protein, 9 aa, Homo sapiens
  Light chain CDR3 for antibody 7608 (IGKV4-1)
QQYYTTPPT

SEQ ID NO: 15216 - protein, 16 aa, Homo sapiens
  Heavy chain CDR3 for antibody 7608 (IGHV4-59)
ARGRYFEWLLGDVFDI

SEQ ID NO: 15217 - protein, 9 aa, Homo sapiens
  Light chain CDR3 for antibody 7609 (IGKV1D-16)
QQYYSYPRT

SEQ ID NO: 15218 - protein, 14 aa, Homo sapiens
  Heavy chain CDR3 for antibody 7609 (IGHV3-33)
ARDDYVSGSYYFDY

SEQ ID NO: 15219 - protein, 9 aa, Homo sapiens
  Light chain CDR3 for antibody 7610 (IGKV3-11)
QQRSNWPYT

SEQ ID NO: 15220 - protein, 15 aa, Homo sapiens
  Heavy chain CDR3 for antibody 7610 (IGHV4-59)
ARDLGYYGSGSPLAY

SEQ ID NO: 15221 - protein, 9 aa, Homo sapiens
  Light chain CDR3 for antibody 7611 (IGKV1-6)
HQSSSLPYT

SEQ ID NO: 15222 - protein, 13 aa, Homo sapiens
  Heavy chain CDR3 for antibody 7611 (IGHV3-21)
ATGAWASSWWGDY

SEQ ID NO: 15223 - protein, 8 aa, Homo sapiens
  Light chain CDR3 for antibody 7612 (IGKV3D-7)
QQDYNLLT

SEQ ID NO: 15224 - protein, 14 aa, Homo sapiens
  Heavy chain CDR3 for antibody 7612 (IGHV3-33)
ARDHAAGGYSHSDY

SEQ ID NO: 15225 - protein, 9 aa, Homo sapiens
  Light chain CDR3 for antibody 7613 (IGKV1-9)
QQLNSYPYT

SEQ ID NO: 15226 - protein, 18 aa, Homo sapiens
  Heavy chain CDR3 for antibody 7613 (IGHV3-33)
ARDGYSGYDYYYYYGMDV

SEQ ID NO: 15227 - protein, 9 aa, Homo sapiens
  Light chain CDR3 for antibody 7614 (IGKV1-6)
LQDYKSPFT

SEQ ID NO: 15228 - protein, 13 aa, Homo sapiens
  Heavy chain CDR3 for antibody 7614 (IGHV3-33)
AKEDGDYHHYFDY

SEQ ID NO: 15229 - protein, 9 aa, Homo sapiens
  Light chain CDR3 for antibody 7615 (IGKV2-30)
MQGTHWPYT

SEQ ID NO: 15230 - protein, 17 aa, Homo sapiens
  Heavy chain CDR3 for antibody 7615 (IGHV1-18)
ARERYYGSGNYKYNMDV

SEQ ID NO: 15231 - protein, 9 aa, Homo sapiens
  Light chain CDR3 for antibody 7616 (IGKV1-9)
QQLISYPLT

SEQ ID NO: 15232 - protein, 18 aa, Homo sapiens
  Heavy chain CDR3 for antibody 7616 (IGHV3-33)
ARERGYYGSDIYPAAFDI

SEQ ID NO: 15233 - protein, 9 aa, Homo sapiens
  Light chain CDR3 for antibody 7617 (IGKV5-2)
LQHDKFPYT

SEQ ID NO: 15234 - protein, 16 aa, Homo sapiens
  Heavy chain CDR3 for antibody 7617 (IGHV1-46)
ARGGGYSESYSNWFDP

SEQ ID NO: 15235 - protein, 8 aa, Homo sapiens
  Light chain CDR3 for antibody 7618 (IGKV1D-13)
QQFNNYPT

SEQ ID NO: 15236 - protein, 13 aa, Homo sapiens
  Heavy chain CDR3 for antibody 7618 (IGHV3-23)
AKDRGGSYSYFDF

SEQ ID NO: 15237 - protein, 9 aa, Homo sapiens
  Light chain CDR3 for antibody 7619 (IGKV1-6)
LQDYKSPFT

SEQ ID NO: 15238 - protein, 10 aa, Homo sapiens
  Heavy chain CDR3 for antibody 7619 (IGHV3-23)
AKGDRWRFDP

SEQ ID NO: 15239 - protein, 9 aa, Homo sapiens
  Light chain CDR3 for antibody 7620 (IGKV3-11)
QQRSNWPPT

SEQ ID NO: 15240 - protein, 15 aa, Homo sapiens
  Heavy chain CDR3 for antibody 7620 (IGHV1-24)
ATHWDLRYYYYGMDV

SEQ ID NO: 15241 - protein, 9 aa, Homo sapiens
  Light chain CDR3 for antibody 7621 (IGKV1-6)
LQDYKSPFT

SEQ ID NO: 15242 - protein, 12 aa, Homo sapiens
  Heavy chain CDR3 for antibody 7621 (IGHV1-46)
ARGLTGDHAVDI

SEQ ID NO: 15243 - protein, 11 aa, Homo sapiens
  Light chain CDR3 for antibody 7622 (IGKV3-11)
QQRSNWPPTWT

SEQ ID NO: 15244 - protein, 14 aa, Homo sapiens
  Heavy chain CDR3 for antibody 7622 (IGHV3-33)
ARAGSGYDRDWFDP

SEQ ID NO: 15245 - protein, 8 aa, Homo sapiens
  Light chain CDR3 for antibody 7623 (IGKV1-5)
QQYNSYWT

SEQ ID NO: 15246 - protein, 10 aa, Homo sapiens
  Heavy chain CDR3 for antibody 7623 (IGHV3-33)
ARDVVVYFDY

SEQ ID NO: 15247 - protein, 10 aa, Homo sapiens
  Light chain CDR3 for antibody 7624 (IGKV3-15)
QQYNNWPPLT

SEQ ID NO: 15248 - protein, 12 aa, Homo sapiens
  Heavy chain CDR3 for antibody 7624 (IGHV3-13)
AREAGIPDAFDI

SEQ ID NO: 15249 - protein, 9 aa, Homo sapiens
  Light chain CDR3 for antibody 7625 (IGKV1-33)
QQYDNLPRT

SEQ ID NO: 15250 - protein, 12 aa, Homo sapiens
  Heavy chain CDR3 for antibody 7625 (IGHV3-66)
ARDCLGIPSMDV

SEQ ID NO: 15251 - protein, 9 aa, Homo sapiens
  Light chain CDR3 for antibody 7626 (IGKV3D-20)
QQYGSSPWT

SEQ ID NO: 15252 - protein, 17 aa, Homo sapiens
  Heavy chain CDR3 for antibody 7626 (IGHV3-33)
ARGFSGYDGYYYYGMHV

SEQ ID NO: 15253 - protein, 9 aa, Homo sapiens
  Light chain CDR3 for antibody 7627 (IGKV1D-13)
QRFNNYLYT

SEQ ID NO: 15254 - protein, 14 aa, Homo sapiens
  Heavy chain CDR3 for antibody 7627 (IGHV3-33)
ARDREQQLVRYFDY

SEQ ID NO: 15255 - protein, 9 aa, Homo sapiens
  Light chain CDR3 for antibody 7628 (IGKV1-9)
QQLNSYPWT

SEQ ID NO: 15256 - protein, 16 aa, Homo sapiens
  Heavy chain CDR3 for antibody 7628 (IGHV4-59)
ARGRYFEWLLGDVFDI

SEQ ID NO: 15257 - protein, 9 aa, Homo sapiens
  Light chain CDR3 for antibody 7629 (IGKV1-16)
QQYNSYPYT

SEQ ID NO: 15258 - protein, 10 aa, Homo sapiens
  Heavy chain CDR3 for antibody 7629 (IGHV4-59)
ASSGTSLLAY

SEQ ID NO: 15259 - protein, 6 aa, Homo sapiens
  Light chain CDR3 for antibody 7630 (IGKV3-20)
QQYGST

SEQ ID NO: 15260 - protein, 13 aa, Homo sapiens
  Heavy chain CDR3 for antibody 7630 (IGHV3-33)
ARDWGYSHGYFDY

SEQ ID NO: 15261 - protein, 8 aa, Homo sapiens
  Light chain CDR3 for antibody 7631 (IGKV6-21)
HQSSSLPT

SEQ ID NO: 15262 - protein, 13 aa, Homo sapiens
  Heavy chain CDR3 for antibody 7631 (IGHV3-33)
ARGDNWNDGGFDY

SEQ ID NO: 15263 - protein, 8 aa, Homo sapiens
  Light chain CDR3 for antibody 7632 (IGKV3-20)
QQYGRSFT

SEQ ID NO: 15264 - protein, 15 aa, Homo sapiens
  Heavy chain CDR3 for antibody 7632 (IGHV1-18)
ARGYCSSTSCYYFDY

SEQ ID NO: 15265 - protein, 10 aa, Homo sapiens
  Light chain CDR3 for antibody 7633 (IGKV1-17)
LQHNSYPMYT

SEQ ID NO: 15266 - protein, 13 aa, Homo sapiens
  Heavy chain CDR3 for antibody 7633 (IGHV3-33)
ARTDYYFYYGLDV

SEQ ID NO: 15267 - protein, 9 aa, Homo sapiens
  Light chain CDR3 for antibody 7634 (IGKV3-20)
QQYGSSPRT

SEQ ID NO: 15268 - protein, 18 aa, Homo sapiens
  Heavy chain CDR3 for antibody 7634 (IGHV3-23)
AKERGYYGSGSYSNWFDP

SEQ ID NO: 15269 - protein, 9 aa, Homo sapiens
  Light chain CDR3 for antibody 7635 (IGKV1D-16)
QQYNSFPLT

SEQ ID NO: 15270 - protein, 16 aa, Homo sapiens
  Heavy chain CDR3 for antibody 7635 (IGHV4-59)
ARGRYCDWLLGDVFDI

SEQ ID NO: 15271 - protein, 9 aa, Homo sapiens
  Light chain CDR3 for antibody 7636 (IGKV1-6)
LQVHSYPWT

SEQ ID NO: 15272 - protein, 13 aa, Homo sapiens
  Heavy chain CDR3 for antibody 7636 (IGHV3-33)
ARGVLWFGELFDY

SEQ ID NO: 15273 - protein, 9 aa, Homo sapiens
  Light chain CDR3 for antibody 7637 (IGKV2-30)
MQGTHWPLT

SEQ ID NO: 15274 - protein, 15 aa, Homo sapiens
  Heavy chain CDR3 for antibody 7637 (IGHV3-23)
AKDRNYDFLTGPFDP

SEQ ID NO: 15275 - protein, 10 aa, Homo sapiens
  Light chain CDR3 for antibody 7638 (IGKV1-27)
QKYNSAPMYT

SEQ ID NO: 15276 - protein, 15 aa, Homo sapiens
  Heavy chain CDR3 for antibody 7638 (IGHV3-23)
AKDGSYYDYYYGMDV

SEQ ID NO: 15277 - protein, 9 aa, Homo sapiens
  Light chain CDR3 for antibody 7639 (IGKV1-39)
QQSYSTPFT

SEQ ID NO: 15278 - protein, 11 aa, Homo sapiens
  Heavy chain CDR3 for antibody 7639 (IGHV4-59)
ARESFYGSGNL

SEQ ID NO: 15279 - protein, 8 aa, Homo sapiens
  Light chain CDR3 for antibody 7640 (IGKV6-21)
HQSSSLPT

SEQ ID NO: 15280 - protein, 19 aa, Homo sapiens
  Heavy chain CDR3 for antibody 7640 (IGHV3-33)
AREDYYGSGSYYNEDWFDP

SEQ ID NO: 15281 - protein, 8 aa, Homo sapiens
  Light chain CDR3 for antibody 7641 (IGKV1D-13)
QQFNNYYT

SEQ ID NO: 15282 - protein, 15 aa, Homo sapiens
  Heavy chain CDR3 for antibody 7641 (IGHV3-23)
AKDGGWNYYYYGMDV

SEQ ID NO: 15283 - protein, 9 aa, Homo sapiens
  Light chain CDR3 for antibody 7642 (IGKV1-27)
QKYNSAPYT

SEQ ID NO: 15284 - protein, 14 aa, Homo sapiens
  Heavy chain CDR3 for antibody 7642 (IGHV3-33)
ARRGYSGYDWYFDY

SEQ ID NO: 15285 - protein, 9 aa, Homo sapiens
  Light chain CDR3 for antibody 7643 (IGKV6-21)
HQSSSLPYT

SEQ ID NO: 15286 - protein, 12 aa, Homo sapiens
  Heavy chain CDR3 for antibody 7643 (IGHV3-33)
AREGVMGYSGSY

SEQ ID NO: 15287 - protein, 8 aa, Homo sapiens
  Light chain CDR3 for antibody 7644 (IGKV1D-13)
QQFNNYYT

SEQ ID NO: 15288 - protein, 23 aa, Homo sapiens
  Heavy chain CDR3 for antibody 7644 (IGHV1-18)
ARNLHYDILTGYFPYYFYYGMDV

SEQ ID NO: 15289 - protein, 9 aa, Homo sapiens
  Light chain CDR3 for antibody 7645 (IGKV3-15)
QQYNNWPLT

SEQ ID NO: 15290 - protein, 17 aa, Homo sapiens
  Heavy chain CDR3 for antibody 7645 (IGHV3-23)
AKDGIGELSYYYYGMDV

SEQ ID NO: 15291 - protein, 9 aa, Homo sapiens
  Light chain CDR3 for antibody 7646 (IGKV1-16)
QQHNSYPYT

SEQ ID NO: 15292 - protein, 12 aa, Homo sapiens
  Heavy chain CDR3 for antibody 7646 (IGHV3-33)
ARKKWEEGAFDI

SEQ ID NO: 15293 - protein, 10 aa, Homo sapiens
  Light chain CDR3 for antibody 7647 (IGKV3-11)
QQRSNWPIYT

SEQ ID NO: 15294 - protein, 17 aa, Homo sapiens
  Heavy chain CDR3 for antibody 7647 (IGHV4-39)
ARVLRYFDWLSHDAFDI

SEQ ID NO: 15295 - protein, 8 aa, Homo sapiens
  Light chain CDR3 for antibody 7648 (IGKV1-5)
QQYNSYWT

SEQ ID NO: 15296 - protein, 17 aa, Homo sapiens
  Heavy chain CDR3 for antibody 7648 (IGHV3-33)
ARDPARGNVRSFYGLDV

SEQ ID NO: 15297 - protein, 9 aa, Homo sapiens
  Light chain CDR3 for antibody 7649 (IGKV6-21)
LQSSSLLYT

SEQ ID NO: 15298 - protein, 12 aa, Homo sapiens
  Heavy chain CDR3 for antibody 7649 (IGHV3-33)
TRGYSSKSYFDY

SEQ ID NO: 15299 - protein, 9 aa, Homo sapiens
  Light chain CDR3 for antibody 7650 (IGKV3D-20)
QQYGNSPRT

SEQ ID NO: 15300 - protein, 16 aa, Homo sapiens
  Heavy chain CDR3 for antibody 7650 (IGHV3-33)
ARGYDMLTGDYHGMDV

SEQ ID NO: 15301 - protein, 9 aa, Homo sapiens
  Light chain CDR3 for antibody 7651 (IGKV1-16)
QQYHSYPYT

SEQ ID NO: 15302 - protein, 16 aa, Homo sapiens
  Heavy chain CDR3 for antibody 7651 (IGHV1-24)
TTEGGTVDYYYYGMDV

SEQ ID NO: 15303 - protein, 9 aa, Homo sapiens
  Light chain CDR3 for antibody 7652 (IGKV1-27)
QKYNSAPYT

SEQ ID NO: 15304 - protein, 12 aa, Homo sapiens
  Heavy chain CDR3 for antibody 7652 (IGHV1-18)
AGVLFDGDYFDY

SEQ ID NO: 15305 - protein, 9 aa, Homo sapiens
  Light chain CDR3 for antibody 7653 (IGKV1-39)
QQSYRTPLT

SEQ ID NO: 15306 - protein, 14 aa, Homo sapiens
  Heavy chain CDR3 for antibody 7653 (IGHV3-23)
ARGRRDFYYYGMDV

SEQ ID NO: 15307 - protein, 9 aa, Homo sapiens
  Light chain CDR3 for antibody 7654 (IGKV1-6)
LQDYNYPFT

SEQ ID NO: 15308 - protein, 15 aa, Homo sapiens
  Heavy chain CDR3 for antibody 7654 (IGHV3-23)
ARRVCSGGSCALFDY

SEQ ID NO: 15309 - protein, 9 aa, Homo sapiens
  Light chain CDR3 for antibody 7655 (IGKV1-9)
QQLNNYLFT

SEQ ID NO: 15310 - protein, 13 aa, Homo sapiens
  Heavy chain CDR3 for antibody 7655 (IGHV3-33)
ARDQRYSSGWYDY

SEQ ID NO: 15311 - protein, 9 aa, Homo sapiens
  Light chain CDR3 for antibody 7656 (IGKV1-17)
LQYNSYPWT

SEQ ID NO: 15312 - protein, 14 aa, Homo sapiens
  Heavy chain CDR3 for antibody 7656 (IGHV3-33)
ARDGYDILTGPFDY

SEQ ID NO: 15313 - protein, 10 aa, Homo sapiens
  Light chain CDR3 for antibody 7657 (IGKV1-27)
QKYNSAPMYT

SEQ ID NO: 15314 - protein, 11 aa, Homo sapiens
  Heavy chain CDR3 for antibody 7657 (IGHV3-33)
AREAANWGFDY

SEQ ID NO: 15315 - protein, 9 aa, Homo sapiens
  Light chain CDR3 for antibody 7658 (IGKV2D-28)
MQALQTPPT

SEQ ID NO: 15316 - protein, 18 aa, Homo sapiens
  Heavy chain CDR3 for antibody 7658 (IGHV4-39)
ARQYYFGSGNYYRGWFDP

SEQ ID NO: 15317 - protein, 11 aa, Homo sapiens
  Light chain CDR3 for antibody 7659 (IGKV3-11)
QQRSNWPPTWT

SEQ ID NO: 15318 - protein, 11 aa, Homo sapiens
  Heavy chain CDR3 for antibody 7659 (IGHV1-46)
AREEDLGAFDI

SEQ ID NO: 15319 - protein, 9 aa, Homo sapiens
  Light chain CDR3 for antibody 7660 (IGKV1-6)
LQDYNYPYT

SEQ ID NO: 15320 - protein, 14 aa, Homo sapiens
  Heavy chain CDR3 for antibody 7660 (IGHV1-18)
ARDEGSTWSDIFDI

SEQ ID NO: 15321 - protein, 9 aa, Homo sapiens
  Light chain CDR3 for antibody 7661 (IGKV4-1)
QQYYTTPPT

SEQ ID NO: 15322 - protein, 14 aa, Homo sapiens
  Heavy chain CDR3 for antibody 7661 (IGHV3-66)
ARAGSGYDRDWFDP

SEQ ID NO: 15323 - protein, 10 aa, Homo sapiens
  Light chain CDR3 for antibody 7662 (IGKV1-27)
QKYNSAPMYT

SEQ ID NO: 15324 - protein, 13 aa, Homo sapiens
  Heavy chain CDR3 for antibody 7662 (IGHV4-39)
ARQWPSGYWYFDL

SEQ ID NO: 15325 - protein, 8 aa, Homo sapiens
  Light chain CDR3 for antibody 7663 (IGKV3D-7)
QQDYNLLT

SEQ ID NO: 15326 - protein, 17 aa, Homo sapiens
  Heavy chain CDR3 for antibody 7663 (IGHV3-23)
AKDYDILTGYSHNWFDP

SEQ ID NO: 15327 - protein, 9 aa, Homo sapiens
  Light chain CDR3 for antibody 7664 (IGKV1-5)
QQYNTYSRT

SEQ ID NO: 15328 - protein, 13 aa, Homo sapiens
  Heavy chain CDR3 for antibody 7664 (IGHV3-33)
ARDWGYSHGYFDY

SEQ ID NO: 15329 - protein, 9 aa, Homo sapiens
  Light chain CDR3 for antibody 7665 (IGKV1-16)
QHYNDYPFT

SEQ ID NO: 15330 - protein, 9 aa, Homo sapiens
  Heavy chain CDR3 for antibody 7665 (IGHV3-30)
ARDYFHYDY

SEQ ID NO: 15331 - protein, 10 aa, Homo sapiens
  Light chain CDR3 for antibody 7666 (IGKV3-11)
QQRSNWPILT

SEQ ID NO: 15332 - protein, 15 aa, Homo sapiens
  Heavy chain CDR3 for antibody 7666 (IGHV3-33)
ARRGYNDYDPYGMDV

SEQ ID NO: 15333 - protein, 8 aa, Homo sapiens
  Light chain CDR3 for antibody 7667 (IGKV3D-7)
QQDYNLLT

SEQ ID NO: 15334 - protein, 16 aa, Homo sapiens
  Heavy chain CDR3 for antibody 7667 (IGHV3-33)
ARGDDILTHQYYGVDV

SEQ ID NO: 15335 - protein, 9 aa, Homo sapiens
  Light chain CDR3 for antibody 7668 (IGKV3-20)
QQYGSSPYT

SEQ ID NO: 15336 - protein, 18 aa, Homo sapiens
  Heavy chain CDR3 for antibody 7668 (IGHV3-23)
AKDGDYFGSGSYWGYFDL

SEQ ID NO: 15337 - protein, 8 aa, Homo sapiens
  Light chain CDR3 for antibody 7669 (IGKV6-21)
HQSSSLPT

SEQ ID NO: 15338 - protein, 17 aa, Homo sapiens
  Heavy chain CDR3 for antibody 7669 (IGHV3-33)
ARVRGVIEGYYYYGMDV

SEQ ID NO: 15339 - protein, 9 aa, Homo sapiens
  Light chain CDR3 for antibody 7670 (IGKV3-20)
QQYGSSPYT

SEQ ID NO: 15340 - protein, 15 aa, Homo sapiens
  Heavy chain CDR3 for antibody 7670 (IGHV3-23)
AKDGSYSYYYYGMDV

SEQ ID NO: 15341 - protein, 9 aa, Homo sapiens
  Light chain CDR3 for antibody 7671 (IGKV3D-7)
QQDYNLPRT

SEQ ID NO: 15342 - protein, 13 aa, Homo sapiens
  Heavy chain CDR3 for antibody 7671 (IGHV3-11)
ARDEGYSGYNLDN

SEQ ID NO: 15343 - protein, 9 aa, Homo sapiens
  Light chain CDR3 for antibody 7672 (IGKV1-9)
QQLKSYPYT

SEQ ID NO: 15344 - protein, 17 aa, Homo sapiens
  Heavy chain CDR3 for antibody 7672 (IGHV3-15)
TTERYPRRYYYYFGMDV

SEQ ID NO: 15345 - protein, 8 aa, Homo sapiens
  Light chain CDR3 for antibody 7673 (IGKV3-11)
QQRSNWWT

SEQ ID NO: 15346 - protein, 14 aa, Homo sapiens
  Heavy chain CDR3 for antibody 7673 (IGHV3-33)
ARRGSPLRPSHLDV

SEQ ID NO: 15347 - protein, 9 aa, Homo sapiens
  Light chain CDR3 for antibody 7674 (IGKV1-39)
QQSYSTPFT

SEQ ID NO: 15348 - protein, 16 aa, Homo sapiens
  Heavy chain CDR3 for antibody 7674 (IGHV4-59)
AGGSGSYRDYYYGMDV

SEQ ID NO: 15349 - protein, 10 aa, Homo sapiens
  Light chain CDR3 for antibody 7675 (IGKV1-39)
QQSYSTPMYT

SEQ ID NO: 15350 - protein, 20 aa, Homo sapiens
  Heavy chain CDR3 for antibody 7675 (IGHV3-33)
SRGGATLVRGVIDYYYGMDV

SEQ ID NO: 15351 - protein, 9 aa, Homo sapiens
  Light chain CDR3 for antibody 7676 (IGKV3-15)
QQYNNWPFT

SEQ ID NO: 15352 - protein, 18 aa, Homo sapiens
  Heavy chain CDR3 for antibody 7676 (IGHV1-8)
ARSRIAAAGIYYYYGMDV

SEQ ID NO: 15353 - protein, 8 aa, Homo sapiens
  Light chain CDR3 for antibody 7677 (IGKV1-5)
QQYNSYWT

SEQ ID NO: 15354 - protein, 19 aa, Homo sapiens
  Heavy chain CDR3 for antibody 7677 (IGHV4-59)
ARDRVVGATTYYYYYGMDV

SEQ ID NO: 15355 - protein, 9 aa, Homo sapiens
  Light chain CDR3 for antibody 7678 (IGKV5-2)
LQHDNFPYT

SEQ ID NO: 15356 - protein, 18 aa, Homo sapiens
  Heavy chain CDR3 for antibody 7678 (IGHV1-46)
ARDGGITMVRGILRGMDV

SEQ ID NO: 15357 - protein, 9 aa, Homo sapiens
  Light chain CDR3 for antibody 7679 (IGKV1-39)
QQSYRTPLT

SEQ ID NO: 15358 - protein, 13 aa, Homo sapiens
  Heavy chain CDR3 for antibody 7679 (IGHV3-33)
ARDPLYSGSYFDY

SEQ ID NO: 15359 - protein, 8 aa, Homo sapiens
  Light chain CDR3 for antibody 7680 (IGKV3-15)
QQYNNWWT

SEQ ID NO: 15360 - protein, 15 aa, Homo sapiens
  Heavy chain CDR3 for antibody 7680 (IGHV1-18)
ARIYYGSGSSYYFDY

SEQ ID NO: 15361 - protein, 9 aa, Homo sapiens
  Light chain CDR3 for antibody 7681 (IGKV3D-7)
QQDSNLPYT

SEQ ID NO: 15362 - protein, 13 aa, Homo sapiens
  Heavy chain CDR3 for antibody 7681 (IGHV3-11)
ARDGGAAAGTWDS

SEQ ID NO: 15363 - protein, 10 aa, Homo sapiens
  Light chain CDR3 for antibody 7682 (IGKV3-15)
QQYNNWPPIT

SEQ ID NO: 15364 - protein, 13 aa, Homo sapiens
  Heavy chain CDR3 for antibody 7682 (IGHV3-53)
ARSGSYWGYYFDY

SEQ ID NO: 15365 - protein, 9 aa, Homo sapiens
  Light chain CDR3 for antibody 7683 (IGKV3D-20)
QQYGSSPYT

SEQ ID NO: 15366 - protein, 13 aa, Homo sapiens
  Heavy chain CDR3 for antibody 7683 (IGHV3-33)
ARDPLYSGSYFDY

SEQ ID NO: 15367 - protein, 9 aa, Homo sapiens
  Light chain CDR3 for antibody 7684 (IGKV3D-7)
QQDYNLPWT

SEQ ID NO: 15368 - protein, 16 aa, Homo sapiens
  Heavy chain CDR3 for antibody 7684 (IGHV4-39)
ARHPLIWTGYPNWFDP

SEQ ID NO: 15369 - protein, 9 aa, Homo sapiens
  Light chain CDR3 for antibody 7685 (IGKV1-6)
LQDYKSPFT

SEQ ID NO: 15370 - protein, 13 aa, Homo sapiens
  Heavy chain CDR3 for antibody 7685 (IGHV3-33)
ARGVLWFGELFDY

SEQ ID NO: 15371 - protein, 9 aa, Homo sapiens
  Light chain CDR3 for antibody 7686 (IGKV3-11)
QQRSNWPPT

SEQ ID NO: 15372 - protein, 12 aa, Homo sapiens
  Heavy chain CDR3 for antibody 7686 (IGHV3-33)
ARVDTAAPYFDY

SEQ ID NO: 15373 - protein, 9 aa, Homo sapiens
  Light chain CDR3 for antibody 7687 (IGKV1D-13)
QQFNNYPHT

SEQ ID NO: 15374 - protein, 17 aa, Homo sapiens
  Heavy chain CDR3 for antibody 7687 (IGHV4-59)
ARRITMVREIIITAFDY

SEQ ID NO: 15375 - protein, 9 aa, Homo sapiens
  Light chain CDR3 for antibody 7688 (IGKV1-6)
LQDYNYPYT

SEQ ID NO: 15376 - protein, 12 aa, Homo sapiens
  Heavy chain CDR3 for antibody 7688 (IGHV6-1)
ARLDWNYRAFDI

SEQ ID NO: 15377 - protein, 10 aa, Homo sapiens
  Light chain CDR3 for antibody 7689 (IGKV3-20)
QQYGRSPPVT

SEQ ID NO: 15378 - protein, 11 aa, Homo sapiens
  Heavy chain CDR3 for antibody 7689 (IGHV3-33)
ARDRVLTPFDY

SEQ ID NO: 15379 - protein, 9 aa, Homo sapiens
  Light chain CDR3 for antibody 7690 (IGKV1-9)
QQLNSYPRT

SEQ ID NO: 15380 - protein, 18 aa, Homo sapiens
  Heavy chain CDR3 for antibody 7690 (IGHV4-39)
VKYITMVRGDIITGPFAY

SEQ ID NO: 15381 - protein, 8 aa, Homo sapiens
  Light chain CDR3 for antibody 7691 (IGKV3D-7)
QQDYNLLT

SEQ ID NO: 15382 - protein, 17 aa, Homo sapiens
  Heavy chain CDR3 for antibody 7691 (IGHV3-33)
ARQGVLLWFGELYYFDY

SEQ ID NO: 15383 - protein, 10 aa, Homo sapiens
  Light chain CDR3 for antibody 7692 (IGKV1-17)
LQHNSYPMYT

SEQ ID NO: 15384 - protein, 13 aa, Homo sapiens
  Heavy chain CDR3 for antibody 7692 (IGHV3-33)
ARAFTMVRGVIDY

SEQ ID NO: 15385 - protein, 9 aa, Homo sapiens
  Light chain CDR3 for antibody 7693 (IGKV1-6)
LQDYKSPFT

SEQ ID NO: 15386 - protein, 18 aa, Homo sapiens
  Heavy chain CDR3 for antibody 7693 (IGHV3-23)
AKERGYYGSGSYSNWFDP

SEQ ID NO: 15387 - protein, 9 aa, Homo sapiens
  Light chain CDR3 for antibody 7694 (IGKV1D-16)
QQYAGYPPT

SEQ ID NO: 15388 - protein, 11 aa, Homo sapiens
  Heavy chain CDR3 for antibody 7694 (IGHV4-39)
ARSLRYSVFDY

SEQ ID NO: 15389 - protein, 10 aa, Homo sapiens
  Light chain CDR3 for antibody 7695 (IGKV3-11)
QQRSNWPILT

SEQ ID NO: 15390 - protein, 18 aa, Homo sapiens
  Heavy chain CDR3 for antibody 7695 (IGHV3-33)
ARKGGYYSGSGSYRHFDF

SEQ ID NO: 15391 - protein, 10 aa, Homo sapiens
  Light chain CDR3 for antibody 7696 (IGKV1-17)
LQHNSYPMYT

SEQ ID NO: 15392 - protein, 14 aa, Homo sapiens
  Heavy chain CDR3 for antibody 7696 (IGHV3-33)
ARRGYSGYDWYFDY

SEQ ID NO: 15393 - protein, 9 aa, Homo sapiens
  Light chain CDR3 for antibody 7697 (IGKV1-9)
QQLNTYPYT

SEQ ID NO: 15394 - protein, 10 aa, Homo sapiens
  Heavy chain CDR3 for antibody 7697 (IGHV3-33)
AREWFGGFDI

SEQ ID NO: 15395 - protein, 9 aa, Homo sapiens
  Light chain CDR3 for antibody 7698 (IGKV1D-16)
QQYHSYPYT

SEQ ID NO: 15396 - protein, 10 aa, Homo sapiens
  Heavy chain CDR3 for antibody 7698 (IGHV3-13)
ARDRGSYYDY

SEQ ID NO: 15397 - protein, 9 aa, Homo sapiens
  Light chain CDR3 for antibody 7699 (IGKV1D-13)
QQFNNYPYT

SEQ ID NO: 15398 - protein, 15 aa, Homo sapiens
  Heavy chain CDR3 for antibody 7699 (IGHV3-33)
ARRICSGGSCSLFEY

SEQ ID NO: 15399 - protein, 9 aa, Homo sapiens
  Light chain CDR3 for antibody 7700 (IGKV3D-7)
QQDYNLPYS

SEQ ID NO: 15400 - protein, 19 aa, Homo sapiens
  Heavy chain CDR3 for antibody 7700 (IGHV1-18)
ARDDILTGYSLYYYYGMDV

SEQ ID NO: 15401 - protein, 10 aa, Homo sapiens
  Light chain CDR3 for antibody 7701 (IGKV3-11)
QQRSNWPIFT

SEQ ID NO: 15402 - protein, 10 aa, Homo sapiens
  Heavy chain CDR3 for antibody 7701 (IGHV3-23)
AKENWNDFDY

SEQ ID NO: 15403 - protein, 10 aa, Homo sapiens
  Light chain CDR3 for antibody 7702 (IGKV3-11)
QQRSNWPALT

SEQ ID NO: 15404 - protein, 19 aa, Homo sapiens
  Heavy chain CDR3 for antibody 7702 (IGHV3-23)
AKDGRSGSYDYYYYYGMDV

SEQ ID NO: 15405 - protein, 9 aa, Homo sapiens
  Light chain CDR3 for antibody 7703 (IGKV3-15)
QQYHNWPLT

SEQ ID NO: 15406 - protein, 17 aa, Homo sapiens
  Heavy chain CDR3 for antibody 7703 (IGHV3-33)
ARGGGYENDHYYYGMDV

SEQ ID NO: 15407 - protein, 9 aa, Homo sapiens
  Light chain CDR3 for antibody 7704 (IGKV5-2)
LQHDKFPYT

SEQ ID NO: 15408 - protein, 14 aa, Homo sapiens
  Heavy chain CDR3 for antibody 7704 (IGHV3-23)
ARGRRDFYYYGMDV

SEQ ID NO: 15409 - protein, 10 aa, Homo sapiens
  Light chain CDR3 for antibody 7705 (IGKV3-11)
QQRSNWLMYT

SEQ ID NO: 15410 - protein, 14 aa, Homo sapiens
  Heavy chain CDR3 for antibody 7705 (IGHV3-33)
ARGAAAGNFYGLDV

SEQ ID NO: 15411 - protein, 9 aa, Homo sapiens
  Light chain CDR3 for antibody 7706 (IGKV1-9)
QQLNTYPWT

SEQ ID NO: 15412 - protein, 17 aa, Homo sapiens
  Heavy chain CDR3 for antibody 7706 (IGHV3-33)
ARGFSGYDGYYYYGMDV

SEQ ID NO: 15413 - protein, 9 aa, Homo sapiens
  Light chain CDR3 for antibody 7707 (IGKV3D-7)
QQDYNLPFT

SEQ ID NO: 15414 - protein, 15 aa, Homo sapiens
  Heavy chain CDR3 for antibody 7707 (IGHV4-39)
ARRDYDILTGYLFDY

SEQ ID NO: 15415 - protein, 11 aa, Homo sapiens
  Light chain CDR3 for antibody 7708 (IGKV3-11)
QQRSNWPPTWT

SEQ ID NO: 15416 - protein, 12 aa, Homo sapiens
  Heavy chain CDR3 for antibody 7708 (IGHV3-33)
TRGYSSKSYFDY

SEQ ID NO: 15417 - protein, 9 aa, Homo sapiens
  Light chain CDR3 for antibody 7709 (IGKV3D-20)
QQHGNSPLT

SEQ ID NO: 15418 - protein, 12 aa, Homo sapiens
  Heavy chain CDR3 for antibody 7709 (IGHV4-61)
ARVYSSGWLFDY

SEQ ID NO: 15419 - protein, 9 aa, Homo sapiens
  Light chain CDR3 for antibody 7710 (IGKV5-2)
LQHDNFPWT

SEQ ID NO: 15420 - protein, 16 aa, Homo sapiens
  Heavy chain CDR3 for antibody 7710 (IGHV1-8)
ARGHYYGSGSYYNFDY

SEQ ID NO: 15421 - protein, 9 aa, Homo sapiens
  Light chain CDR3 for antibody 7711 (IGKV1-16)
QQYNSYPYT

SEQ ID NO: 15422 - protein, 12 aa, Homo sapiens
  Heavy chain CDR3 for antibody 7711 (IGHV3-33)
ARVIDWLKPMDV

SEQ ID NO: 15423 - protein, 9 aa, Homo sapiens
  Light chain CDR3 for antibody 7712 (IGKV1-27)
QKYNSAPYT

SEQ ID NO: 15424 - protein, 12 aa, Homo sapiens
  Heavy chain CDR3 for antibody 7712 (IGHV3-33)
ARDGPVAGLFDY

SEQ ID NO: 15425 - protein, 8 aa, Homo sapiens
  Light chain CDR3 for antibody 7713 (IGKV3-11)
LQRGNWPT

SEQ ID NO: 15426 - protein, 15 aa, Homo sapiens
  Heavy chain CDR3 for antibody 7713 (IGHV3-33)
ARDTGYSSSWNWFDP

SEQ ID NO: 15427 - protein, 9 aa, Homo sapiens
  Light chain CDR3 for antibody 7714 (IGKV1-6)
LQDYNYPRT

SEQ ID NO: 15428 - protein, 14 aa, Homo sapiens
  Heavy chain CDR3 for antibody 7714 (IGHV3-23)
AKSRIVGALYYFGY

SEQ ID NO: 15429 - protein, 8 aa, Homo sapiens
  Light chain CDR3 for antibody 7715 (IGKV1D-13)
QQFNNYPT

SEQ ID NO: 15430 - protein, 14 aa, Homo sapiens
  Heavy chain CDR3 for antibody 7715 (IGHV3-33)
AREMVRGVPNWFDP

SEQ ID NO: 15431 - protein, 9 aa, Homo sapiens
  Light chain CDR3 for antibody 7716 (IGKV2D-28)
MQALQTPWT

SEQ ID NO: 15432 - protein, 17 aa, Homo sapiens
  Heavy chain CDR3 for antibody 7716 (IGHV3-33)
ARVQYDILTGYSPYFDN

SEQ ID NO: 15433 - protein, 9 aa, Homo sapiens
  Light chain CDR3 for antibody 7717 (IGKV3D-7)
QQDYNLPYT

SEQ ID NO: 15434 - protein, 12 aa, Homo sapiens
  Heavy chain CDR3 for antibody 7717 (IGHV3-13)
AIGTMVRGIPDY

SEQ ID NO: 15435 - protein, 10 aa, Homo sapiens
  Light chain CDR3 for antibody 7718 (IGKV3-15)
QQYNNWPPIT

SEQ ID NO: 15436 - protein, 19 aa, Homo sapiens
  Heavy chain CDR3 for antibody 7718 (IGHV1-18)
ARDDILTGYSLYYYYGMDV

SEQ ID NO: 15437 - protein, 10 aa, Homo sapiens
  Light chain CDR3 for antibody 7719 (IGKV3-20)
QQYGRSPPVT

SEQ ID NO: 15438 - protein, 17 aa, Homo sapiens
  Heavy chain CDR3 for antibody 7719 (IGHV1-18)
ARDEGYDILTGYPHFDY

SEQ ID NO: 15439 - protein, 9 aa, Homo sapiens
  Light chain CDR3 for antibody 7720 (IGKV2-30)
MQGTHWPLT

SEQ ID NO: 15440 - protein, 17 aa, Homo sapiens
  Heavy chain CDR3 for antibody 7720 (IGHV3-33)
ARKDYGILSGYYSPFDY

SEQ ID NO: 15441 - protein, 9 aa, Homo sapiens
  Light chain CDR3 for antibody 7721 (IGKV3-11)
QQRSNWPPT

SEQ ID NO: 15442 - protein, 15 aa, Homo sapiens
  Heavy chain CDR3 for antibody 7721 (IGHV1-46)
ARGRFFDWLLSPFDY

SEQ ID NO: 15443 - protein, 8 aa, Homo sapiens
  Light chain CDR3 for antibody 7722 (IGKV3D-7)
QQDYNLLT

SEQ ID NO: 15444 - protein, 12 aa, Homo sapiens
  Heavy chain CDR3 for antibody 7722 (IGHV3-33)
AREGTRWVYFDY

SEQ ID NO: 15445 - protein, 10 aa, Homo sapiens
  Light chain CDR3 for antibody 7723 (IGKV3-11)
QQRSNWPIFT

SEQ ID NO: 15446 - protein, 18 aa, Homo sapiens
  Heavy chain CDR3 for antibody 7723 (IGHV3-33)
ARGGVLYDILTGFYGMDV

SEQ ID NO: 15447 - protein, 9 aa, Homo sapiens
  Light chain CDR3 for antibody 7724 (IGKV1-17)
LQHNSYPPT

SEQ ID NO: 15448 - protein, 16 aa, Homo sapiens
  Heavy chain CDR3 for antibody 7724 (IGHV3-23)
AKDLRYFDWSLYAFDI

SEQ ID NO: 15449 - protein, 10 aa, Homo sapiens
  Light chain CDR3 for antibody 7725 (IGKV3-11)
QQRSNWPIFT

SEQ ID NO: 15450 - protein, 12 aa, Homo sapiens
  Heavy chain CDR3 for antibody 7725 (IGHV3-33)
ARNYDILDYFDY

SEQ ID NO: 15451 - protein, 9 aa, Homo sapiens
  Light chain CDR3 for antibody 7726 (IGKV1-37)
QRTYNAPFT

SEQ ID NO: 15452 - protein, 11 aa, Homo sapiens
  Heavy chain CDR3 for antibody 7726 (IGHV3-33)
ARDRVLTPFDY

SEQ ID NO: 15453 - protein, 9 aa, Homo sapiens
  Light chain CDR3 for antibody 7727 (IGKV1-33)
QQYDNLPFT

SEQ ID NO: 15454 - protein, 13 aa, Homo sapiens
  Heavy chain CDR3 for antibody 7727 (IGHV3-33)
ARRYRSGWYPFDY

SEQ ID NO: 15455 - protein, 10 aa, Homo sapiens
  Light chain CDR3 for antibody 7728 (IGKV3-15)
QQYNNWPPIT

SEQ ID NO: 15456 - protein, 10 aa, Homo sapiens
  Heavy chain CDR3 for antibody 7728 (IGHV3-74)
ARENWGGFDY

SEQ ID NO: 15457 - protein, 9 aa, Homo sapiens
  Light chain CDR3 for antibody 7729 (IGKV3D-7)
QQDYKLPLT

SEQ ID NO: 15458 - protein, 8 aa, Homo sapiens
  Heavy chain CDR3 for antibody 7729 (IGHV4-39)
ARRGGLDY

SEQ ID NO: 15459 - protein, 8 aa, Homo sapiens
  Light chain CDR3 for antibody 7730 (IGKV3-11)
QQRRNWLT

SEQ ID NO: 15460 - protein, 12 aa, Homo sapiens
  Heavy chain CDR3 for antibody 7730 (IGHV3-13)
AREAGIPDAFDI

SEQ ID NO: 15461 - protein, 9 aa, Homo sapiens
  Light chain CDR3 for antibody 7731 (IGKV3-11)
QQRSNWQYT

SEQ ID NO: 15462 - protein, 11 aa, Homo sapiens
  Heavy chain CDR3 for antibody 7731 (IGHV3-23)
AKGLWSYYFDY

SEQ ID NO: 15463 - protein, 9 aa, Homo sapiens
  Light chain CDR3 for antibody 7732 (IGKV1-6)
LQDYSYPWT

SEQ ID NO: 15464 - protein, 16 aa, Homo sapiens
  Heavy chain CDR3 for antibody 7732 (IGHV4-59)
ARDTPYYSGSGRPFDH

SEQ ID NO: 15465 - protein, 8 aa, Homo sapiens
  Light chain CDR3 for antibody 7733 (IGKV1-13)
QQFNNYPT

SEQ ID NO: 15466 - protein, 20 aa, Homo sapiens
  Heavy chain CDR3 for antibody 7733 (IGHV3-33)
ARDRCSSTSCYGYYYYGMDV

SEQ ID NO: 15467 - protein, 9 aa, Homo sapiens
  Light chain CDR3 for antibody 7734 (IGKV3-15)
QQYNNWPRT

SEQ ID NO: 15468 - protein, 17 aa, Homo sapiens
  Heavy chain CDR3 for antibody 7734 (IGHV3-33)
ARVQYDILTGYSPYFDN

SEQ ID NO: 15469 - protein, 9 aa, Homo sapiens
  Light chain CDR3 for antibody 7735 (IGKV1-6)
LQDYNYPYT

SEQ ID NO: 15470 - protein, 9 aa, Homo sapiens
  Heavy chain CDR3 for antibody 7735 (IGHV3-30)
ARDDYGVDA

SEQ ID NO: 15471 - protein, 10 aa, Homo sapiens
  Light chain CDR3 for antibody 7736 (IGKV3-15)
QQYNNWPPIT

SEQ ID NO: 15472 - protein, 9 aa, Homo sapiens
  Heavy chain CDR3 for antibody 7736 (IGHV1-8)
ARGRLDFDY

SEQ ID NO: 15473 - protein, 9 aa, Homo sapiens
  Light chain CDR3 for antibody 7737 (IGKV1D-13)
QQFNNYPYT

SEQ ID NO: 15474 - protein, 16 aa, Homo sapiens
  Heavy chain CDR3 for antibody 7737 (IGHV3-33)
ARIAAPGSEYYYGMDV

SEQ ID NO: 15475 - protein, 9 aa, Homo sapiens
  Light chain CDR3 for antibody 7738 (IGKV1-27)
QKYNSAPYT

SEQ ID NO: 15476 - protein, 22 aa, Homo sapiens
  Heavy chain CDR3 for antibody 7738 (IGHV3-11)
AREAYYDILTGYYTGYYYGMDV

SEQ ID NO: 15477 - protein, 9 aa, Homo sapiens
  Light chain CDR3 for antibody 7739 (IGKV1-5)
QQYNTYSRT

SEQ ID NO: 15478 - protein, 10 aa, Homo sapiens
  Heavy chain CDR3 for antibody 7739 (IGHV3-33)
ARDGSGSQPI

SEQ ID NO: 15479 - protein, 8 aa, Homo sapiens
  Light chain CDR3 for antibody 7740 (IGKV3D-7)
QQDYNLVT

SEQ ID NO: 15480 - protein, 18 aa, Homo sapiens
  Heavy chain CDR3 for antibody 7740 (IGHV6-1)
ARDQYSYGPYYYYYGMDV

SEQ ID NO: 15481 - protein, 10 aa, Homo sapiens
  Light chain CDR3 for antibody 7741 (IGKV1-17)
LQHNSYPMYT

SEQ ID NO: 15482 - protein, 8 aa, Homo sapiens
  Heavy chain CDR3 for antibody 7741 (IGHV3-23)
EKSAGEDV

SEQ ID NO: 15483 - protein, 9 aa, Homo sapiens
  Light chain CDR3 for antibody 7742 (IGKV2-30)
MQGTHWPLT

SEQ ID NO: 15484 - protein, 14 aa, Homo sapiens
  Heavy chain CDR3 for antibody 7742 (IGHV4-39)
ARHGYYGSSNWFDP

SEQ ID NO: 15485 - protein, 9 aa, Homo sapiens
  Light chain CDR3 for antibody 7743 (IGKV1-6)
LQDYNYPYT

SEQ ID NO: 15486 - protein, 13 aa, Homo sapiens
  Heavy chain CDR3 for antibody 7743 (IGHV3-21)
AKEGSAPGPDFEY

SEQ ID NO: 15487 - protein, 9 aa, Homo sapiens
  Light chain CDR3 for antibody 7744 (IGKV6-21)
HQSSSLPLT

SEQ ID NO: 15488 - protein, 14 aa, Homo sapiens
  Heavy chain CDR3 for antibody 7744 (IGHV3-33)
ARGLEWGGDNWFDP

SEQ ID NO: 15489 - protein, 9 aa, Homo sapiens
  Light chain CDR3 for antibody 7745 (IGKV1-27)
QKYNSAPYT

SEQ ID NO: 15490 - protein, 14 aa, Homo sapiens
  Heavy chain CDR3 for antibody 7745 (IGHV1-46)
ARAYYAFLTGAFDI

SEQ ID NO: 15491 - protein, 9 aa, Homo sapiens
  Light chain CDR3 for antibody 7746 (IGKV1-6)
LQVYNYPWT

SEQ ID NO: 15492 - protein, 10 aa, Homo sapiens
  Heavy chain CDR3 for antibody 7746 (IGHV3-33)
VRDVVVYFDY

SEQ ID NO: 15493 - protein, 9 aa, Homo sapiens
  Light chain CDR3 for antibody 7747 (IGKV2D-28)
MQVLQTPFT

SEQ ID NO: 15494 - protein, 11 aa, Homo sapiens
  Heavy chain CDR3 for antibody 7747 (IGHV4-4)
AREAYYYGLDV

SEQ ID NO: 15495 - protein, 10 aa, Homo sapiens
  Light chain CDR3 for antibody 7748 (IGKV3-11)
QQRSNWPALT

SEQ ID NO: 15496 - protein, 13 aa, Homo sapiens
  Heavy chain CDR3 for antibody 7748 (IGHV3-33)
ASAGNSYYNVMDV

SEQ ID NO: 15497 - protein, 9 aa, Homo sapiens
  Light chain CDR3 for antibody 7749 (IGKV1D-16)
QQYNSFPLT

SEQ ID NO: 15498 - protein, 9 aa, Homo sapiens
  Heavy chain CDR3 for antibody 7749 (IGHV1-18)
ARGKDWFDP

SEQ ID NO: 15499 - protein, 10 aa, Homo sapiens
  Light chain CDR3 for antibody 7750 (IGKV3-15)
QQYNNWPPLT

SEQ ID NO: 15500 - protein, 15 aa, Homo sapiens
  Heavy chain CDR3 for antibody 7750 (IGHV3-33)
ARRGYNDYDPYGMDV

SEQ ID NO: 15501 - protein, 7 aa, Homo sapiens
  Light chain CDR3 for antibody 7751 (IGKV1-17)
LQHNSYP

SEQ ID NO: 15502 - protein, 12 aa, Homo sapiens
  Heavy chain CDR3 for antibody 7751 (IGHV1-18)
ARGLTGDHAVDI

SEQ ID NO: 15503 - protein, 9 aa, Homo sapiens
  Light chain CDR3 for antibody 7752 (IGKV2-30)
MQGTHWPLT

SEQ ID NO: 15504 - protein, 12 aa, Homo sapiens
  Heavy chain CDR3 for antibody 7752 (IGHV3-33)
AREGIAVAGVDP

SEQ ID NO: 15505 - protein, 9 aa, Homo sapiens
  Light chain CDR3 for antibody 7753 (IGKV1-6)
LQDYKSPFT

SEQ ID NO: 15506 - protein, 16 aa, Homo sapiens
  Heavy chain CDR3 for antibody 7753 (IGHV1-24)
ATEDSSSTYYYYGLDV

SEQ ID NO: 15507 - protein, 8 aa, Homo sapiens
  Light chain CDR3 for antibody 7754 (IGKV1-5)
QQYNSYWT

SEQ ID NO: 15508 - protein, 19 aa, Homo sapiens
  Heavy chain CDR3 for antibody 7754 (IGHV3-30)
ARRFSGYSGYDHYYYGMDV

SEQ ID NO: 15509 - protein, 9 aa, Homo sapiens
  Light chain CDR3 for antibody 7755 (IGKV6-21)
HQSSSLPYT

SEQ ID NO: 15510 - protein, 19 aa, Homo sapiens
  Heavy chain CDR3 for antibody 7755 (IGHV3-23)
ARGGVVRGVIEYYYYGMDV

SEQ ID NO: 15511 - protein, 9 aa, Homo sapiens
  Light chain CDR3 for antibody 7756 (IGKV1-9)
QQLHIYPWT

SEQ ID NO: 15512 - protein, 17 aa, Homo sapiens
  Heavy chain CDR3 for antibody 7756 (IGHV3-33)
AKDGSFYSSGWYDAFDI

SEQ ID NO: 15513 - protein, 10 aa, Homo sapiens
  Light chain CDR3 for antibody 7757 (IGKV3-20)
QQYGSSPPYT

SEQ ID NO: 15514 - protein, 17 aa, Homo sapiens
  Heavy chain CDR3 for antibody 7757 (IGHV3-h)
AKDGIGELSYYYYGMDV

SEQ ID NO: 15515 - protein, 9 aa, Homo sapiens
  Light chain CDR3 for antibody 7758 (IGKV1D-16)
QQSYSTPLT

SEQ ID NO: 15516 - protein, 20 aa, Homo sapiens
  Heavy chain CDR3 for antibody 7758 (IGHV1-8)
ARGDGTMVRGIYYYYYGMDV

SEQ ID NO: 15517 - protein, 9 aa, Homo sapiens
  Light chain CDR3 for antibody 7759 (IGKV1D-13)
QRFNNYLYT

SEQ ID NO: 15518 - protein, 13 aa, Homo sapiens
  Heavy chain CDR3 for antibody 7759 (IGHV3-11)
ARDEGYRGYVLDT

SEQ ID NO: 15519 - protein, 9 aa, Homo sapiens
  Light chain CDR3 for antibody 7760 (IGKV3D-20)
QQYGNSPRT

SEQ ID NO: 15520 - protein, 7 aa, Homo sapiens
  Heavy chain CDR3 for antibody 7760 (IGHV3-33)
ARELFDY

SEQ ID NO: 15521 - protein, 9 aa, Homo sapiens
  Light chain CDR3 for antibody 7761 (IGKV1-6)
LQVYSYPWT

SEQ ID NO: 15522 - protein, 15 aa, Homo sapiens
  Heavy chain CDR3 for antibody 7761 (IGHV3-33)
ARDTGYSSSWNWFDP

SEQ ID NO: 15523 - protein, 9 aa, Homo sapiens
  Light chain CDR3 for antibody 7762 (IGKV5-2)
LQHDNFPYT

SEQ ID NO: 15524 - protein, 9 aa, Homo sapiens
  Heavy chain CDR3 for antibody 7762 (IGHV3-23)
ATWGSAFDV

SEQ ID NO: 15525 - protein, 9 aa, Homo sapiens
  Light chain CDR3 for antibody 7763 (IGKV1-5)
QQYNTYSRT

SEQ ID NO: 15526 - protein, 12 aa, Homo sapiens
  Heavy chain CDR3 for antibody 7763 (IGHV3-33)
AREGTRWVYFDY

SEQ ID NO: 15527 - protein, 10 aa, Homo sapiens
  Light chain CDR3 for antibody 7764 (IGKV1-39)
QQSYSTPMYT

SEQ ID NO: 15528 - protein, 12 aa, Homo sapiens
  Heavy chain CDR3 for antibody 7764 (IGHV3-33)
AREGTGGNWFDP

SEQ ID NO: 15529 - protein, 10 aa, Homo sapiens
  Light chain CDR3 for antibody 7765 (IGKV3-11)
QQRSNWPAYT

SEQ ID NO: 15530 - protein, 15 aa, Homo sapiens
  Heavy chain CDR3 for antibody 7765 (IGHV3-33)
ARRSILTGSYWYFDL

SEQ ID NO: 15531 - protein, 9 aa, Homo sapiens
  Light chain CDR3 for antibody 7766 (IGKV1D-16)
QQYNSYPFT

SEQ ID NO: 15532 - protein, 15 aa, Homo sapiens
  Heavy chain CDR3 for antibody 7766 (IGHV4-59)
ARDLGHYYGSVSIDY

SEQ ID NO: 15533 - protein, 9 aa, Homo sapiens
  Light chain CDR3 for antibody 7767 (IGKV1-9)
QQLKSYLYT

SEQ ID NO: 15534 - protein, 14 aa, Homo sapiens
  Heavy chain CDR3 for antibody 7767 (IGHV4-59)
AKGGSGSYYNWFDP

SEQ ID NO: 15535 - protein, 8 aa, Homo sapiens
  Light chain CDR3 for antibody 7768 (IGKV3D-7)
QQDYNLLT

SEQ ID NO: 15536 - protein, 12 aa, Homo sapiens
  Heavy chain CDR3 for antibody 7768 (IGHV3-33)
ARDLVRGIRMDV

SEQ ID NO: 15537 - protein, 8 aa, Homo sapiens
  Light chain CDR3 for antibody 7769 (IGKV3D-7)
QQDYNLLT

SEQ ID NO: 15538 - protein, 16 aa, Homo sapiens
  Heavy chain CDR3 for antibody 7769 (IGHV3-33)
AREGGLIAAAGTGFDY

SEQ ID NO: 15539 - protein, 10 aa, Homo sapiens
  Light chain CDR3 for antibody 7770 (IGKV1-27)
QKYNSAPMYT

SEQ ID NO: 15540 - protein, 12 aa, Homo sapiens
  Heavy chain CDR3 for antibody 7770 (IGHV4-59)
ARDRSGWAYFDY

SEQ ID NO: 15541 - protein, 9 aa, Homo sapiens
  Light chain CDR3 for antibody 7771 (IGKV1-27)
QKYNSAPYT

SEQ ID NO: 15542 - protein, 11 aa, Homo sapiens
  Heavy chain CDR3 for antibody 7771 (IGHV4-59)
AREDYGVPFDY

SEQ ID NO: 15543 - protein, 10 aa, Homo sapiens
  Light chain CDR3 for antibody 7772 (IGKV3-20)
QQYGSSPPYT

SEQ ID NO: 15544 - protein, 17 aa, Homo sapiens
  Heavy chain CDR3 for antibody 7772 (IGHV3-33)
ARGYCSRTSCYLYYFDY

SEQ ID NO: 15545 - protein, 10 aa, Homo sapiens
  Light chain CDR3 for antibody 7773 (IGKV3-15)
QQYNNWPPIT

SEQ ID NO: 15546 - protein, 16 aa, Homo sapiens
  Heavy chain CDR3 for antibody 7773 (IGHV3-33)
ARGYDMLTGDYYGMDV

SEQ ID NO: 15547 - protein, 10 aa, Homo sapiens
  Light chain CDR3 for antibody 7774 (IGKV1-39)
QQSYSTPMYT

SEQ ID NO: 15548 - protein, 19 aa, Homo sapiens
  Heavy chain CDR3 for antibody 7774 (IGHV3-33)
ARDSGYSGYDYYYYYGMDV

SEQ ID NO: 15549 - protein, 9 aa, Homo sapiens
  Light chain CDR3 for antibody 7775 (IGKV1-16)
QQYNSYPYT

SEQ ID NO: 15550 - protein, 9 aa, Homo sapiens
  Heavy chain CDR3 for antibody 7775 (IGHV4-59)
ARGRSNFRI

SEQ ID NO: 15551 - protein, 9 aa, Homo sapiens
  Light chain CDR3 for antibody 7776 (IGKV2D-28)
MQALQTPPT

SEQ ID NO: 15552 - protein, 16 aa, Homo sapiens
  Heavy chain CDR3 for antibody 7776 (IGHV3-33)
ARDSSSLDYYYYGMDV

SEQ ID NO: 15553 - protein, 9 aa, Homo sapiens
  Light chain CDR3 for antibody 7777 (IGKV6-21)
HQSTSLPFT

SEQ ID NO: 15554 - protein, 12 aa, Homo sapiens
  Heavy chain CDR3 for antibody 7777 (IGHV4-39)
ARQMVREGWFDP

SEQ ID NO: 15555 - protein, 9 aa, Homo sapiens
  Light chain CDR3 for antibody 7778 (IGKV3-15)
QQYNNWPLT

SEQ ID NO: 15556 - protein, 12 aa, Homo sapiens
  Heavy chain CDR3 for antibody 7778 (IGHV3-33)
ARDPGYFFGLDV

SEQ ID NO: 15557 - protein, 9 aa, Homo sapiens
  Light chain CDR3 for antibody 7779 (IGKV1-6)
LQDYKSPFT

SEQ ID NO: 15558 - protein, 19 aa, Homo sapiens
  Heavy chain CDR3 for antibody 7779 (IGHV3-33)
ARDSGYSGYDYYYYYGMDV

SEQ ID NO: 15559 - protein, 9 aa, Homo sapiens
  Light chain CDR3 for antibody 7780 (IGKV2D-28)
MQALQTPPT

SEQ ID NO: 15560 - protein, 15 aa, Homo sapiens
  Heavy chain CDR3 for antibody 7780 (IGHV3-33)
ARRGYNDYDPYGMDV

SEQ ID NO: 15561 - protein, 10 aa, Homo sapiens
  Light chain CDR3 for antibody 7781 (IGKV3-11)
QQRSNWPIFT

SEQ ID NO: 15562 - protein, 18 aa, Homo sapiens
  Heavy chain CDR3 for antibody 7781 (IGHV3-33)
AREGDYYGSGGFPNWFDP

SEQ ID NO: 15563 - protein, 9 aa, Homo sapiens
  Light chain CDR3 for antibody 7782 (IGKV3-11)
QQRSNWPPT

SEQ ID NO: 15564 - protein, 14 aa, Homo sapiens
  Heavy chain CDR3 for antibody 7782 (IGHV3-33)
ARDGYDILTGPMDV

SEQ ID NO: 15565 - protein, 11 aa, Homo sapiens
  Light chain CDR3 for antibody 7783 (IGKV3-11)
QQRSNWPPTWT

SEQ ID NO: 15566 - protein, 12 aa, Homo sapiens
  Heavy chain CDR3 for antibody 7783 (IGHV3-33)
ARVDTAAPYFDY

SEQ ID NO: 15567 - protein, 10 aa, Homo sapiens
  Light chain CDR3 for antibody 7784 (IGKV1-27)
QKYNSAPMYT

SEQ ID NO: 15568 - protein, 13 aa, Homo sapiens
  Heavy chain CDR3 for antibody 7784 (IGHV4-39)
ARHVLLWFGEFDP

SEQ ID NO: 15569 - protein, 10 aa, Homo sapiens
  Light chain CDR3 for antibody 7785 (IGKV1-39)
QQSYSTPMYT

SEQ ID NO: 15570 - protein, 14 aa, Homo sapiens
  Heavy chain CDR3 for antibody 7785 (IGHV3-33)
ARSTLVRGANWFDP

SEQ ID NO: 15571 - protein, 9 aa, Homo sapiens
  Light chain CDR3 for antibody 7786 (IGKV1-39)
QQSYRTPLT

SEQ ID NO: 15572 - protein, 12 aa, Homo sapiens
  Heavy chain CDR3 for antibody 7786 (IGHV3-33)
AREGIAVAGVDP

SEQ ID NO: 15573 - protein, 9 aa, Homo sapiens
  Light chain CDR3 for antibody 7787 (IGKV1-6)
LQDYNYPWT

SEQ ID NO: 15574 - protein, 15 aa, Homo sapiens
  Heavy chain CDR3 for antibody 7787 (IGHV3-20)
ARDRGSSGWRGWFDP

SEQ ID NO: 15575 - protein, 11 aa, Homo sapiens
  Light chain CDR3 for antibody 7788 (IGKV3-11)
QQRSNWPPTWT

SEQ ID NO: 15576 - protein, 16 aa, Homo sapiens
  Heavy chain CDR3 for antibody 7788 (IGHV1-8)
AREGTMVRGVTYAFDI

SEQ ID NO: 15577 - protein, 9 aa, Homo sapiens
  Light chain CDR3 for antibody 7789 (IGKV1-16)
QHYNDYPFT

SEQ ID NO: 15578 - protein, 11 aa, Homo sapiens
  Heavy chain CDR3 for antibody 7789 (IGHV3-33)
ARARYTTGLDY

SEQ ID NO: 15579 - protein, 9 aa, Homo sapiens
  Light chain CDR3 for antibody 7790 (IGKV1-17)
LQHNSFPYT

SEQ ID NO: 15580 - protein, 23 aa, Homo sapiens
  Heavy chain CDR3 for antibody 7790 (IGHV4-59)
ARERTYSGILPGYYEDYYYGMDV

SEQ ID NO: 15581 - protein, 9 aa, Homo sapiens
  Light chain CDR3 for antibody 7791 (IGKV1-6)
LQVYSYPWT

SEQ ID NO: 15582 - protein, 13 aa, Homo sapiens
  Heavy chain CDR3 for antibody 7791 (IGHV3-33)
ARRYRSGWYPFDY

SEQ ID NO: 15583 - protein, 9 aa, Homo sapiens
  Light chain CDR3 for antibody 7792 (IGKV3D-7)
QQDYNLPLT

SEQ ID NO: 15584 - protein, 16 aa, Homo sapiens
  Heavy chain CDR3 for antibody 7792 (IGHV4-59)
ARFYFGSGSYYWYFDL

SEQ ID NO: 15585 - protein, 9 aa, Homo sapiens
  Light chain CDR3 for antibody 7793 (IGKV3D-7)
QQDYNLPYT

SEQ ID NO: 15586 - protein, 17 aa, Homo sapiens
  Heavy chain CDR3 for antibody 7793 (IGHV1-18)
ARDEGYDILTGYPHFDY

SEQ ID NO: 15587 - protein, 8 aa, Homo sapiens
  Light chain CDR3 for antibody 7794 (IGKV1D-13)
QQFNNYPT

SEQ ID NO: 15588 - protein, 9 aa, Homo sapiens
  Heavy chain CDR3 for antibody 7794 (IGHV3-33)
ARDRYYDIL

SEQ ID NO: 15589 - protein, 9 aa, Homo sapiens
  Light chain CDR3 for antibody 7795 (IGKV1-17)
LQHNSYPWT

SEQ ID NO: 15590 - protein, 12 aa, Homo sapiens
  Heavy chain CDR3 for antibody 7795 (IGHV3-33)
ARESGGSYSFDY

SEQ ID NO: 15591 - protein, 8 aa, Homo sapiens
  Light chain CDR3 for antibody 7796 (IGKV3-20)
QQYGSSLT

SEQ ID NO: 15592 - protein, 9 aa, Homo sapiens
  Heavy chain CDR3 for antibody 7796 (IGHV3-30)
ARDNWGFDY

SEQ ID NO: 15593 - protein, 9 aa, Homo sapiens
  Light chain CDR3 for antibody 7797 (IGKV1-6)
LQDFHYPWT

SEQ ID NO: 15594 - protein, 15 aa, Homo sapiens
  Heavy chain CDR3 for antibody 7797 (IGHV3-33)
ARDTGYSSSWNWFDP

SEQ ID NO: 15595 - protein, 9 aa, Homo sapiens
  Light chain CDR3 for antibody 7798 (IGKV1-16)
QHYNDYPFT

SEQ ID NO: 15596 - protein, 14 aa, Homo sapiens
  Heavy chain CDR3 for antibody 7798 (IGHV3-33)
ARDNILTAYYLFDY

SEQ ID NO: 15597 - protein, 9 aa, Homo sapiens
  Light chain CDR3 for antibody 7799 (IGKV1-16)
QQYYSYPRT

SEQ ID NO: 15598 - protein, 11 aa, Homo sapiens
  Heavy chain CDR3 for antibody 7799 (IGHV3-33)
ARDRSTGWLDY

SEQ ID NO: 15599 - protein, 10 aa, Homo sapiens
  Light chain CDR3 for antibody 7800 (IGKV1-17)
LQHNSYPMYT

SEQ ID NO: 15600 - protein, 14 aa, Homo sapiens
  Heavy chain CDR3 for antibody 7800 (IGHV3-23)
ANWAYDILTGYLDY

SEQ ID NO: 15601 - protein, 9 aa, Homo sapiens
  Light chain CDR3 for antibody 7801 (IGKV1-9)
QQLNSYPLT

SEQ ID NO: 15602 - protein, 15 aa, Homo sapiens
  Heavy chain CDR3 for antibody 7801 (IGHV3-23)
AKDRSGSGSYNLFDY

SEQ ID NO: 15603 - protein, 8 aa, Homo sapiens
  Light chain CDR3 for antibody 7802 (IGKV6-21)
HQSGSLPT

SEQ ID NO: 15604 - protein, 14 aa, Homo sapiens
  Heavy chain CDR3 for antibody 7802 (IGHV3-33)
ARDWNDVYYYGMDV

SEQ ID NO: 15605 - protein, 9 aa, Homo sapiens
  Light chain CDR3 for antibody 7803 (IGKV3D-7)
QQDYNLPLT

SEQ ID NO: 15606 - protein, 17 aa, Homo sapiens
  Heavy chain CDR3 for antibody 7803 (IGHV3-33)
AREDYDILTGYPFYFDY

SEQ ID NO: 15607 - protein, 9 aa, Homo sapiens
  Light chain CDR3 for antibody 7804 (IGKV1-6)
QQYSSYQYT

SEQ ID NO: 15608 - protein, 14 aa, Homo sapiens
  Heavy chain CDR3 for antibody 7804 (IGHV3-33)
ARASSGSSYWYFDL

SEQ ID NO: 15609 - protein, 9 aa, Homo sapiens
  Light chain CDR3 for antibody 7805 (IGKV1-5)
QQYNTYSRT

SEQ ID NO: 15610 - protein, 18 aa, Homo sapiens
  Heavy chain CDR3 for antibody 7805 (IGHV4-59)
ARERGNWNDVDYYYGMDV

SEQ ID NO: 15611 - protein, 9 aa, Homo sapiens
  Light chain CDR3 for antibody 7806 (IGKV1-9)
QQLISYPLT

SEQ ID NO: 15612 - protein, 15 aa, Homo sapiens
  Heavy chain CDR3 for antibody 7806 (IGHV3-23)
AKEALRYFDWSGMDV

SEQ ID NO: 15613 - protein, 9 aa, Homo sapiens
  Light chain CDR3 for antibody 7807 (IGKV1D-16)
QQYNSYPYT

SEQ ID NO: 15614 - protein, 15 aa, Homo sapiens
  Heavy chain CDR3 for antibody 7807 (IGHV3-33)
ARDRRGIAAAGTGDY

SEQ ID NO: 15615 - protein, 8 aa, Homo sapiens
  Light chain CDR3 for antibody 7808 (IGKV3D-7)
QQDYNLPT

SEQ ID NO: 15616 - protein, 16 aa, Homo sapiens
  Heavy chain CDR3 for antibody 7808 (IGHV1-18)
ARYFDWLLRDYYGMDV

SEQ ID NO: 15617 - protein, 8 aa, Homo sapiens
  Light chain CDR3 for antibody 7809 (IGKV6-21)
HQSSSLPT

SEQ ID NO: 15618 - protein, 13 aa, Homo sapiens
  Heavy chain CDR3 for antibody 7809 (IGHV3-33)
ARDWGYSHGYFDY

SEQ ID NO: 15619 - protein, 9 aa, Homo sapiens
  Light chain CDR3 for antibody 7810 (IGKV1-9)
QQLNTYPWT

SEQ ID NO: 15620 - protein, 11 aa, Homo sapiens
  Heavy chain CDR3 for antibody 7810 (IGHV1-46)
AREEDLGAFDI

SEQ ID NO: 15621 - protein, 10 aa, Homo sapiens
  Light chain CDR3 for antibody 7811 (IGKV1-17)
LQHNSYPMYT

SEQ ID NO: 15622 - protein, 13 aa, Homo sapiens
  Heavy chain CDR3 for antibody 7811 (IGHV4-28)
ARKGATGYYGMDV

SEQ ID NO: 15623 - protein, 10 aa, Homo sapiens
  Light chain CDR3 for antibody 7812 (IGKV1-39)
QQSYSTPMYT

SEQ ID NO: 15624 - protein, 18 aa, Homo sapiens
  Heavy chain CDR3 for antibody 7812 (IGHV3-33)
ARERGYYGSDIYPAAFDI

SEQ ID NO: 15625 - protein, 9 aa, Homo sapiens
  Light chain CDR3 for antibody 7813 (IGKV3-15)
QQYNNWPLT

SEQ ID NO: 15626 - protein, 11 aa, Homo sapiens
  Heavy chain CDR3 for antibody 7813 (IGHV4-30-2)
ARDRGHYGMDV

SEQ ID NO: 15627 - protein, 9 aa, Homo sapiens
  Light chain CDR3 for antibody 7814 (IGKV1D-13)
QRFNNYLYT

SEQ ID NO: 15628 - protein, 14 aa, Homo sapiens
  Heavy chain CDR3 for antibody 7814 (IGHV3-33)
ARQYSYGYPYYFDY

SEQ ID NO: 15629 - protein, 9 aa, Homo sapiens
  Light chain CDR3 for antibody 7815 (IGKV1D-13)
QQFNNYPYT

SEQ ID NO: 15630 - protein, 17 aa, Homo sapiens
  Heavy chain CDR3 for antibody 7815 (IGHV3-23)
SKERNWNDGYYYFGMDA

SEQ ID NO: 15631 - protein, 9 aa, Homo sapiens
  Light chain CDR3 for antibody 7816 (IGKV5-2)
LQHDNFPWT

SEQ ID NO: 15632 - protein, 12 aa, Homo sapiens
  Heavy chain CDR3 for antibody 7816 (IGHV3-33)
ARNYDILDYFDY

SEQ ID NO: 15633 - protein, 8 aa, Homo sapiens
  Light chain CDR3 for antibody 7817 (IGKV3-15)
QQYNNWPT

SEQ ID NO: 15634 - protein, 18 aa, Homo sapiens
  Heavy chain CDR3 for antibody 7817 (IGHV4-59)
AREGDYVWGSYRSNWFDP

SEQ ID NO: 15635 - protein, 9 aa, Homo sapiens
  Light chain CDR3 for antibody 7818 (IGKV3-15)
QQYNNWPLT

SEQ ID NO: 15636 - protein, 13 aa, Homo sapiens
  Heavy chain CDR3 for antibody 7818 (IGHV1-46)
ARVKLGSLGAFDI

SEQ ID NO: 15637 - protein, 8 aa, Homo sapiens
  Light chain CDR3 for antibody 7819 (IGKV3D-7)
QQDYNLLT

SEQ ID NO: 15638 - protein, 9 aa, Homo sapiens
  Heavy chain CDR3 for antibody 7819 (IGHV1-8)
ARGRLDFDY

SEQ ID NO: 15639 - protein, 9 aa, Homo sapiens
  Light chain CDR3 for antibody 7820 (IGKV3-15)
QQYNNWPRT

SEQ ID NO: 15640 - protein, 16 aa, Homo sapiens
  Heavy chain CDR3 for antibody 7820 (IGHV3-11)
ATEDSSSYYYYYGMDV

SEQ ID NO: 15641 - protein, 9 aa, Homo sapiens
  Light chain CDR3 for antibody 7821 (IGKV1-27)
QKYNSAPYT

SEQ ID NO: 15642 - protein, 12 aa, Homo sapiens
  Heavy chain CDR3 for antibody 7821 (IGHV1-18)
ARRDGSGTSFDY

SEQ ID NO: 15643 - protein, 9 aa, Homo sapiens
  Light chain CDR3 for antibody 7822 (IGKV1-9)
QQVNSYPYT

SEQ ID NO: 15644 - protein, 18 aa, Homo sapiens
  Heavy chain CDR3 for antibody 7822 (IGHV4-59)
ARERGNWNDVDYYYGMGV

SEQ ID NO: 15645 - protein, 9 aa, Homo sapiens
  Light chain CDR3 for antibody 7823 (IGKV1-9)
QQLNSYPRT

SEQ ID NO: 15646 - protein, 16 aa, Homo sapiens
  Heavy chain CDR3 for antibody 7823 (IGHV4-59)
ARDAAYSSGSGRPFDH

SEQ ID NO: 15647 - protein, 9 aa, Homo sapiens
  Light chain CDR3 for antibody 7824 (IGKV1D-16)
QQYNSYPYT

SEQ ID NO: 15648 - protein, 12 aa, Homo sapiens
  Heavy chain CDR3 for antibody 7824 (IGHV4-59)
ARVIGVWSPFDD

SEQ ID NO: 15649 - protein, 9 aa, Homo sapiens
  Light chain CDR3 for antibody 7825 (IGKV2D-28)
MQVLQTPFT

SEQ ID NO: 15650 - protein, 12 aa, Homo sapiens
  Heavy chain CDR3 for antibody 7825 (IGHV1-46)
ARGLTGDHAVDI

SEQ ID NO: 15651 - protein, 9 aa, Homo sapiens
  Light chain CDR3 for antibody 7826 (IGKV1-33)
QQYDNLPFT

SEQ ID NO: 15652 - protein, 14 aa, Homo sapiens
  Heavy chain CDR3 for antibody 7826 (IGHV3-33)
AREGYSSNWYDFDY

SEQ ID NO: 15653 - protein, 9 aa, Homo sapiens
  Light chain CDR3 for antibody 7827 (IGKV1-5)
QQGNTYSRT

SEQ ID NO: 15654 - protein, 17 aa, Homo sapiens
  Heavy chain CDR3 for antibody 7827 (IGHV3-74)
VREGGLLWVGELSLFDY

SEQ ID NO: 15655 - protein, 9 aa, Homo sapiens
  Light chain CDR3 for antibody 7828 (IGKV1-9)
QQLYSYPYT

SEQ ID NO: 15656 - protein, 17 aa, Homo sapiens
  Heavy chain CDR3 for antibody 7828 (IGHV3-33)
ARAYYDILTGYSYYFDY

SEQ ID NO: 15657 - protein, 8 aa, Homo sapiens
  Light chain CDR3 for antibody 7829 (IGKV1-6)
QQYNSYYT

SEQ ID NO: 15658 - protein, 14 aa, Homo sapiens
  Heavy chain CDR3 for antibody 7829 (IGHV1-46)
ARKGIVGAFDAFGI

SEQ ID NO: 15659 - protein, 8 aa, Homo sapiens
  Light chain CDR3 for antibody 7830 (IGKV1D-13)
QQFNNYPT

SEQ ID NO: 15660 - protein, 13 aa, Homo sapiens
  Heavy chain CDR3 for antibody 7830 (IGHV3-66)
ANTGDSYYYGFYV

SEQ ID NO: 15661 - protein, 9 aa, Homo sapiens
  Light chain CDR3 for antibody 7831 (IGKV3-15)
QQYHNWPLT

SEQ ID NO: 15662 - protein, 13 aa, Homo sapiens
  Heavy chain CDR3 for antibody 7831 (IGHV3-23)
ARAFFMVRGVIDF

SEQ ID NO: 15663 - protein, 9 aa, Homo sapiens
  Light chain CDR3 for antibody 7832 (IGKV1D-16)
QQYNSYPYT

SEQ ID NO: 15664 - protein, 10 aa, Homo sapiens
  Heavy chain CDR3 for antibody 7832 (IGHV3-23)
ANSGNYYFDY

SEQ ID NO: 15665 - protein, 9 aa, Homo sapiens
  Light chain CDR3 for antibody 7833 (IGKV3D-7)
QQDYEFPIT

SEQ ID NO: 15666 - protein, 18 aa, Homo sapiens
  Heavy chain CDR3 for antibody 7833 (IGHV1-8)
ARSRIAAAGIYYYYGMDV

SEQ ID NO: 15667 - protein, 8 aa, Homo sapiens
  Light chain CDR3 for antibody 7834 (IGKV3-20)
QQYGRSFT

SEQ ID NO: 15668 - protein, 14 aa, Homo sapiens
  Heavy chain CDR3 for antibody 7834 (IGHV4-39)
ARHGYYGSSNWFDP

SEQ ID NO: 15669 - protein, 9 aa, Homo sapiens
  Light chain CDR3 for antibody 7835 (IGKV1-9)
QQLNGYPFT

SEQ ID NO: 15670 - protein, 13 aa, Homo sapiens
  Heavy chain CDR3 for antibody 7835 (IGHV4-59)
ARDAGYSSSWFDY

SEQ ID NO: 15671 - protein, 10 aa, Homo sapiens
  Light chain CDR3 for antibody 7836 (IGKV3-15)
QQYNNWPPLT

SEQ ID NO: 15672 - protein, 21 aa, Homo sapiens
  Heavy chain CDR3 for antibody 7836 (IGHV3-33)
ARKRLYDILTGYYKAYYGMDV

SEQ ID NO: 15673 - protein, 9 aa, Homo sapiens
  Light chain CDR3 for antibody 7837 (IGKV3D-7)
QQDYNLPYT

SEQ ID NO: 15674 - protein, 17 aa, Homo sapiens
  Heavy chain CDR3 for antibody 7837 (IGHV3-33)
ARDRGIAVAGTPDGFDI

SEQ ID NO: 15675 - protein, 9 aa, Homo sapiens
  Light chain CDR3 for antibody 7838 (IGKV1D-16)
QQYDSYPWT

SEQ ID NO: 15676 - protein, 18 aa, Homo sapiens
  Heavy chain CDR3 for antibody 7838 (IGHV4-59)
AREGDYVWGSYRPNWFDP

SEQ ID NO: 15677 - protein, 8 aa, Homo sapiens
  Light chain CDR3 for antibody 7839 (IGKV3D-7)
QQDYNLLT

SEQ ID NO: 15678 - protein, 13 aa, Homo sapiens
  Heavy chain CDR3 for antibody 7839 (IGHV3-33)
ASAGNSYYNVMDV

SEQ ID NO: 15679 - protein, 9 aa, Homo sapiens
  Light chain CDR3 for antibody 7840 (IGKV3D-7)
QQDYNLPYT

SEQ ID NO: 15680 - protein, 16 aa, Homo sapiens
  Heavy chain CDR3 for antibody 7840 (IGHV1-8)
AREGTMVRGVTYAFDI

SEQ ID NO: 15681 - protein, 8 aa, Homo sapiens
  Light chain CDR3 for antibody 7841 (IGKV1D-13)
QQFNNYPT

SEQ ID NO: 15682 - protein, 15 aa, Homo sapiens
  Heavy chain CDR3 for antibody 7841 (IGHV3-33)
ARDSRPEIIGPPFDY

SEQ ID NO: 15683 - protein, 9 aa, Homo sapiens
  Light chain CDR3 for antibody 7842 (IGKV2-30)
MQGTHWPLT

SEQ ID NO: 15684 - protein, 19 aa, Homo sapiens
  Heavy chain CDR3 for antibody 7842 (IGHV3-11)
ARDSGYSGYDYYYYYGMDV

SEQ ID NO: 15685 - protein, 9 aa, Homo sapiens
  Light chain CDR3 for antibody 7843 (IGKV1-17)
QQLNGYPFT

SEQ ID NO: 15686 - protein, 20 aa, Homo sapiens
  Heavy chain CDR3 for antibody 7843 (IGHV3-23)
AKDREMAATSHYYYYYGMDV

SEQ ID NO: 15687 - protein, 8 aa, Homo sapiens
  Light chain CDR3 for antibody 7844 (IGKV3-11)
QQRSNWLT

SEQ ID NO: 15688 - protein, 13 aa, Homo sapiens
  Heavy chain CDR3 for antibody 7844 (IGHV3-33)
ARAFTMVRGVIDY

SEQ ID NO: 15689 - protein, 10 aa, Homo sapiens
  Light chain CDR3 for antibody 7845 (IGKV3-11)
QQRSNWPIFT

SEQ ID NO: 15690 - protein, 9 aa, Homo sapiens
  Heavy chain CDR3 for antibody 7845 (IGHV1-8)
ARGPRIMDV

SEQ ID NO: 15691 - protein, 9 aa, Homo sapiens
  Light chain CDR3 for antibody 7846 (IGKV1-17)
QQYDSYPWT

SEQ ID NO: 15692 - protein, 17 aa, Homo sapiens
  Heavy chain CDR3 for antibody 7846 (IGHV3-33)
AREGTMVRGYYYYGMDV

SEQ ID NO: 15693 - protein, 9 aa, Homo sapiens
  Light chain CDR3 for antibody 7847 (IGKV1-39)
QQSYSTPWT

SEQ ID NO: 15694 - protein, 13 aa, Homo sapiens
  Heavy chain CDR3 for antibody 7847 (IGHV4-59)
ARESPGPYDAFDI

SEQ ID NO: 15695 - protein, 9 aa, Homo sapiens
  Light chain CDR3 for antibody 7848 (IGKV1-6)
LQDYNYPHT

SEQ ID NO: 15696 - protein, 12 aa, Homo sapiens
  Heavy chain CDR3 for antibody 7848 (IGHV1-46)
ARGLTGDHASDT

SEQ ID NO: 15697 - protein, 9 aa, Homo sapiens
  Light chain CDR3 for antibody 7849 (IGKV1-6)
LQDYNYPWT

SEQ ID NO: 15698 - protein, 12 aa, Homo sapiens
  Heavy chain CDR3 for antibody 7849 (IGHV6-1)
ARDTMVRGVIDY

SEQ ID NO: 15699 - protein, 10 aa, Homo sapiens
  Light chain CDR3 for antibody 7850 (IGKV3-11)
QQRSNWPIFT

SEQ ID NO: 15700 - protein, 15 aa, Homo sapiens
  Heavy chain CDR3 for antibody 7850 (IGHV3-33)
ARDEHYDILTGYWGY

SEQ ID NO: 15701 - protein, 8 aa, Homo sapiens
  Light chain CDR3 for antibody 7851 (IGKV3D-7)
QQDYNLLT

SEQ ID NO: 15702 - protein, 13 aa, Homo sapiens
  Heavy chain CDR3 for antibody 7851 (IGHV3-33)
ARGVLWFGELFDY

SEQ ID NO: 15703 - protein, 9 aa, Homo sapiens
  Light chain CDR3 for antibody 7852 (IGKV1D-13)
QRFNNYLYT

SEQ ID NO: 15704 - protein, 14 aa, Homo sapiens
  Heavy chain CDR3 for antibody 7852 (IGHV4-59)
AKGGSGSYYNWFDP

SEQ ID NO: 15705 - protein, 9 aa, Homo sapiens
  Light chain CDR3 for antibody 7853 (IGKV3-11)
QQRSNWPPT

SEQ ID NO: 15706 - protein, 18 aa, Homo sapiens
  Heavy chain CDR3 for antibody 7853 (IGHV3-23)
AKEGDYYSSGSYWGYFDL

SEQ ID NO: 15707 - protein, 9 aa, Homo sapiens
  Light chain CDR3 for antibody 7854 (IGKV1-39)
QQSYSTPIT

SEQ ID NO: 15708 - protein, 13 aa, Homo sapiens
  Heavy chain CDR3 for antibody 7854 (IGHV3-33)
TRRIAVAGAEGDY

SEQ ID NO: 15709 - protein, 10 aa, Homo sapiens
  Light chain CDR3 for antibody 7855 (IGKV3-11)
QQRSNWPALT

SEQ ID NO: 15710 - protein, 20 aa, Homo sapiens
  Heavy chain CDR3 for antibody 7855 (IGHV3-33)
ARGDGTMVRGIYYYYYGMDV

SEQ ID NO: 15711 - protein, 9 aa, Homo sapiens
  Light chain CDR3 for antibody 7856 (IGKV3-20)
QQYGSSPYT

SEQ ID NO: 15712 - protein, 15 aa, Homo sapiens
  Heavy chain CDR3 for antibody 7856 (IGHV3-33)
ARDRVQLGYYYGMDV

SEQ ID NO: 15713 - protein, 9 aa, Homo sapiens
  Light chain CDR3 for antibody 7857 (IGKV6-21)
HQSSSLPYT

SEQ ID NO: 15714 - protein, 18 aa, Homo sapiens
  Heavy chain CDR3 for antibody 7857 (IGHV3-33)
AGGGSGSYSSYYYYGMDV

SEQ ID NO: 15715 - protein, 9 aa, Homo sapiens
  Light chain CDR3 for antibody 7858 (IGKV1D-17)
LQHNGYPLT

SEQ ID NO: 15716 - protein, 14 aa, Homo sapiens
  Heavy chain CDR3 for antibody 7858 (IGHV3-33)
ARDNILTVYYLFDY

SEQ ID NO: 15717 - protein, 10 aa, Homo sapiens
  Light chain CDR3 for antibody 7859 (IGKV3-11)
QQRSNWPIFT

SEQ ID NO: 15718 - protein, 13 aa, Homo sapiens
  Heavy chain CDR3 for antibody 7859 (IGHV4-39)
ARHHYGSGSLRDY

SEQ ID NO: 15719 - protein, 9 aa, Homo sapiens
  Light chain CDR3 for antibody 7860 (IGKV1-6)
LQDYKSPFT

SEQ ID NO: 15720 - protein, 15 aa, Homo sapiens
  Heavy chain CDR3 for antibody 7860 (IGHV3-23)
AKDGGWNYYYYGMDV

SEQ ID NO: 15721 - protein, 9 aa, Homo sapiens
  Light chain CDR3 for antibody 7861 (IGKV1-17)
LQHNSFPLT

SEQ ID NO: 15722 - protein, 18 aa, Homo sapiens
  Heavy chain CDR3 for antibody 7861 (IGHV3-30)
ARDQGIVVLPGAPWYFDL

SEQ ID NO: 15723 - protein, 9 aa, Homo sapiens
  Light chain CDR3 for antibody 7862 (IGKV1-9)
QQLISYPLT

SEQ ID NO: 15724 - protein, 18 aa, Homo sapiens
  Heavy chain CDR3 for antibody 7862 (IGHV3-33)
ARGYYGSGNFYKDSGMDV

SEQ ID NO: 15725 - protein, 10 aa, Homo sapiens
  Light chain CDR3 for antibody 7863 (IGKV1-39)
QQSYSTPMYT

SEQ ID NO: 15726 - protein, 11 aa, Homo sapiens
  Heavy chain CDR3 for antibody 7863 (IGHV3-13)
AREAIIGPFDY

SEQ ID NO: 15727 - protein, 9 aa, Homo sapiens
  Light chain CDR3 for antibody 7864 (IGKV6-21)
HQSTSLPFT

SEQ ID NO: 15728 - protein, 8 aa, Homo sapiens
  Heavy chain CDR3 for antibody 7864 (IGHV4-4)
ARGARFDP

SEQ ID NO: 15729 - protein, 9 aa, Homo sapiens
  Light chain CDR3 for antibody 7865 (IGKV3D-7)
QQDYNLPLT

SEQ ID NO: 15730 - protein, 15 aa, Homo sapiens
  Heavy chain CDR3 for antibody 7865 (IGHV1-18)
ARRSPNWGHYYGMDV

SEQ ID NO: 15731 - protein, 9 aa, Homo sapiens
  Light chain CDR3 for antibody 7866 (IGKV5-2)
LQHDNFPWT

SEQ ID NO: 15732 - protein, 15 aa, Homo sapiens
  Heavy chain CDR3 for antibody 7866 (IGHV4-34)
ARPPIAVAGPEYFQH

SEQ ID NO: 15733 - protein, 9 aa, Homo sapiens
  Light chain CDR3 for antibody 7867 (IGKV1-6)
LQDFNYPRT

SEQ ID NO: 15734 - protein, 12 aa, Homo sapiens
  Heavy chain CDR3 for antibody 7867 (IGHV3-33)
ARVDTAAPYFDY

SEQ ID NO: 15735 - protein, 9 aa, Homo sapiens
  Light chain CDR3 for antibody 7868 (IGKV1-9)
QQGNTYSRT

SEQ ID NO: 15736 - protein, 14 aa, Homo sapiens
  Heavy chain CDR3 for antibody 7868 (IGHV4-39)
ARQDYDILTGLFDY

SEQ ID NO: 15737 - protein, 9 aa, Homo sapiens
  Light chain CDR3 for antibody 7869 (IGKV1-39)
QQSYSTPYT

SEQ ID NO: 15738 - protein, 18 aa, Homo sapiens
  Heavy chain CDR3 for antibody 7869 (IGHV3-33)
ARGAYSSGWDYYYYGLDV

SEQ ID NO: 15739 - protein, 10 aa, Homo sapiens
  Light chain CDR3 for antibody 7870 (IGKV1-39)
QQSYSTPMYT

SEQ ID NO: 15740 - protein, 14 aa, Homo sapiens
  Heavy chain CDR3 for antibody 7870 (IGHV3-33)
ARDAMGTSTAWFDP

SEQ ID NO: 15741 - protein, 8 aa, Homo sapiens
  Light chain CDR3 for antibody 7871 (IGKV1-5)
QQYNSYWT

SEQ ID NO: 15742 - protein, 15 aa, Homo sapiens
  Heavy chain CDR3 for antibody 7871 (IGHV3-33)
AREGLRYFHYYGMDV

SEQ ID NO: 15743 - protein, 8 aa, Homo sapiens
  Light chain CDR3 for antibody 7872 (IGKV3D-7)
QQDYNLAT

SEQ ID NO: 15744 - protein, 14 aa, Homo sapiens
  Heavy chain CDR3 for antibody 7872 (IGHV4-39)
ARRGVVVPPGGMDV

SEQ ID NO: 15745 - protein, 9 aa, Homo sapiens
  Light chain CDR3 for antibody 7873 (IGKV1-37)
QRTSNAPYT

SEQ ID NO: 15746 - protein, 17 aa, Homo sapiens
  Heavy chain CDR3 for antibody 7873 (IGHV3-33)
ARGYCSRTSCYLYYFDY

SEQ ID NO: 15747 - protein, 9 aa, Homo sapiens
  Light chain CDR3 for antibody 7874 (IGKV1D-16)
QQYNSFPLT

SEQ ID NO: 15748 - protein, 14 aa, Homo sapiens
  Heavy chain CDR3 for antibody 7874 (IGHV1-46)
ARSYYDILTGAFDI

SEQ ID NO: 15749 - protein, 9 aa, Homo sapiens
  Light chain CDR3 for antibody 7875 (IGKV1-6)
LQDYNYPRT

SEQ ID NO: 15750 - protein, 14 aa, Homo sapiens
  Heavy chain CDR3 for antibody 7875 (IGHV3-15)
SIYFYGSGRDYFDY

SEQ ID NO: 15751 - protein, 9 aa, Homo sapiens
  Light chain CDR3 for antibody 7876 (IGKV3D-7)
QQDYNLPWT

SEQ ID NO: 15752 - protein, 16 aa, Homo sapiens
  Heavy chain CDR3 for antibody 7876 (IGHV1-24)
ATDWNDRGYYYYGMDV

SEQ ID NO: 15753 - protein, 9 aa, Homo sapiens
  Light chain CDR3 for antibody 7877 (IGKV1D-13)
QRFNNYLYT

SEQ ID NO: 15754 - protein, 13 aa, Homo sapiens
  Heavy chain CDR3 for antibody 7877 (IGHV3-33)
ARKAYGDYFYFDY

SEQ ID NO: 15755 - protein, 10 aa, Homo sapiens
  Light chain CDR3 for antibody 7878 (IGKV1-39)
QQSYSTPMYT

SEQ ID NO: 15756 - protein, 14 aa, Homo sapiens
  Heavy chain CDR3 for antibody 7878 (IGHV3-23)
AKGGDVLTGYYPDY

SEQ ID NO: 15757 - protein, 9 aa, Homo sapiens
  Light chain CDR3 for antibody 7879 (IGKV3D-7)
QQDYDLPYP

SEQ ID NO: 15758 - protein, 18 aa, Homo sapiens
  Heavy chain CDR3 for antibody 7879 (IGHV4-59)
AREGDYVWGSYRPNWFDP

SEQ ID NO: 15759 - protein, 10 aa, Homo sapiens
  Light chain CDR3 for antibody 7880 (IGKV1-39)
QQSYSTPMYT

SEQ ID NO: 15760 - protein, 17 aa, Homo sapiens
  Heavy chain CDR3 for antibody 7880 (IGHV3-33)
ARGGGYENDHYYYGMDV

SEQ ID NO: 15761 - protein, 10 aa, Homo sapiens
  Light chain CDR3 for antibody 7881 (IGKV3-11)
QQRSNWPALT

SEQ ID NO: 15762 - protein, 18 aa, Homo sapiens
  Heavy chain CDR3 for antibody 7881 (IGHV3-23)
AKVGDFFASGNYWDYFDY

SEQ ID NO: 15763 - protein, 9 aa, Homo sapiens
  Light chain CDR3 for antibody 7882 (IGKV1-6)
LQDYNHPFT

SEQ ID NO: 15764 - protein, 8 aa, Homo sapiens
  Heavy chain CDR3 for antibody 7882 (IGHV3-33)
ARVYYDIL

SEQ ID NO: 15765 - protein, 9 aa, Homo sapiens
  Light chain CDR3 for antibody 7883 (IGKV3-11)
QQRSNWPPT

SEQ ID NO: 15766 - protein, 11 aa, Homo sapiens
  Heavy chain CDR3 for antibody 7883 (IGHV3-33)
ARDRVLTPFDY

SEQ ID NO: 15767 - protein, 9 aa, Homo sapiens
  Light chain CDR3 for antibody 7884 (IGKV3-11)
QQRSNWPWT

SEQ ID NO: 15768 - protein, 14 aa, Homo sapiens
  Heavy chain CDR3 for antibody 7884 (IGHV3-33)
AREDYYGPLNWFDP

SEQ ID NO: 15769 - protein, 9 aa, Homo sapiens
  Light chain CDR3 for antibody 7885 (IGKV1-9)
LQDYNSPFT

SEQ ID NO: 15770 - protein, 13 aa, Homo sapiens
  Heavy chain CDR3 for antibody 7885 (IGHV3-33)
ARTDYYSYYGLDV

SEQ ID NO: 15771 - protein, 9 aa, Homo sapiens
  Light chain CDR3 for antibody 7886 (IGKV1-33)
QQYDNLPRT

SEQ ID NO: 15772 - protein, 11 aa, Homo sapiens
  Heavy chain CDR3 for antibody 7886 (IGHV3-33)
ARARYTTGLDY

SEQ ID NO: 15773 - protein, 9 aa, Homo sapiens
  Light chain CDR3 for antibody 7887 (IGKV3-11)
QQRSNWMYT

SEQ ID NO: 15774 - protein, 12 aa, Homo sapiens
  Heavy chain CDR3 for antibody 7887 (IGHV4-59)
ARDRSGWAYFDY

SEQ ID NO: 15775 - protein, 9 aa, Homo sapiens
  Light chain CDR3 for antibody 7888 (IGKV1-6)
LQDYNYPRT

SEQ ID NO: 15776 - protein, 13 aa, Homo sapiens
  Heavy chain CDR3 for antibody 7888 (IGHV3-33)
AREGDILTGYYDY

SEQ ID NO: 15777 - protein, 10 aa, Homo sapiens
  Light chain CDR3 for antibody 7889 (IGKV1-39)
QQSYSTPMYT

SEQ ID NO: 15778 - protein, 12 aa, Homo sapiens
  Heavy chain CDR3 for antibody 7889 (IGHV3-33)
AKDPGWQQLAEY

SEQ ID NO: 15779 - protein, 9 aa, Homo sapiens
  Light chain CDR3 for antibody 7890 (IGKV1-27)
QKYNSAPYT

SEQ ID NO: 15780 - protein, 11 aa, Homo sapiens
  Heavy chain CDR3 for antibody 7890 (IGHV3-23)
AKAGIVGCLDV

SEQ ID NO: 15781 - protein, 9 aa, Homo sapiens
  Light chain CDR3 for antibody 7891 (IGKV1-6)
LQDYNYPWT

SEQ ID NO: 15782 - protein, 15 aa, Homo sapiens
  Heavy chain CDR3 for antibody 7891 (IGHV3-33)
ATERAYGSGSSYCDY

SEQ ID NO: 15783 - protein, 9 aa, Homo sapiens
  Light chain CDR3 for antibody 7892 (IGKV1-27)
QKYNSAPYT

SEQ ID NO: 15784 - protein, 10 aa, Homo sapiens
  Heavy chain CDR3 for antibody 7892 (IGHV3-30)
ARDNFEGMDV

SEQ ID NO: 15785 - protein, 9 aa, Homo sapiens
  Light chain CDR3 for antibody 7893 (IGKV1-27)
QKYNSAPYT

SEQ ID NO: 15786 - protein, 13 aa, Homo sapiens
  Heavy chain CDR3 for antibody 7893 (IGHV3-53)
ARSGSYWGYYFDY

SEQ ID NO: 15787 - protein, 9 aa, Homo sapiens
  Light chain CDR3 for antibody 7894 (IGKV1D-16)
QQYNSFPLT

SEQ ID NO: 15788 - protein, 15 aa, Homo sapiens
  Heavy chain CDR3 for antibody 7894 (IGHV3-74)
ARGSGSHYHYYGMDV

SEQ ID NO: 15789 - protein, 10 aa, Homo sapiens
  Light chain CDR3 for antibody 7895 (IGKV1-17)
LQHNSYPMYT

SEQ ID NO: 15790 - protein, 10 aa, Homo sapiens
  Heavy chain CDR3 for antibody 7895 (IGHV3-23)
AKDHYGDYPY

SEQ ID NO: 15791 - protein, 9 aa, Homo sapiens
  Light chain CDR3 for antibody 7896 (IGKV3-11)
QQRSNWPYT

SEQ ID NO: 15792 - protein, 17 aa, Homo sapiens
  Heavy chain CDR3 for antibody 7896 (IGHV3-15)
TTERYPRRYYYYFGMDV

SEQ ID NO: 15793 - protein, 9 aa, Homo sapiens
  Light chain CDR3 for antibody 7897 (IGKV1-9)
QQLNSYPWT

SEQ ID NO: 15794 - protein, 13 aa, Homo sapiens
  Heavy chain CDR3 for antibody 7897 (IGHV3-30)
ARVDTMVRGVMAY

SEQ ID NO: 15795 - protein, 9 aa, Homo sapiens
  Light chain CDR3 for antibody 7898 (IGKV1-6)
LQDYNSPFT

SEQ ID NO: 15796 - protein, 12 aa, Homo sapiens
  Heavy chain CDR3 for antibody 7898 (IGHV3-33)
ARVDTAAPYFDY

SEQ ID NO: 15797 - protein, 9 aa, Homo sapiens
  Light chain CDR3 for antibody 7899 (IGKV2-30)
MQGTHWPLT

SEQ ID NO: 15798 - protein, 15 aa, Homo sapiens
  Heavy chain CDR3 for antibody 7899 (IGHV3-33)
ARAYDLPHYYYGMDV

SEQ ID NO: 15799 - protein, 9 aa, Homo sapiens
  Light chain CDR3 for antibody 7900 (IGKV1-6)
LQDYNHPFT

SEQ ID NO: 15800 - protein, 17 aa, Homo sapiens
  Heavy chain CDR3 for antibody 7900 (IGHV1-18)
ARVRAFTMVRGVPPFDY

SEQ ID NO: 15801 - protein, 8 aa, Homo sapiens
  Light chain CDR3 for antibody 7901 (IGKV3-20)
QQYGRSFT

SEQ ID NO: 15802 - protein, 12 aa, Homo sapiens
  Heavy chain CDR3 for antibody 7901 (IGHV3-23)
AKGAVVTAIFDY

SEQ ID NO: 15803 - protein, 9 aa, Homo sapiens
  Light chain CDR3 for antibody 7902 (IGKV1D-16)
QQYHSYPWT

SEQ ID NO: 15804 - protein, 12 aa, Homo sapiens
  Heavy chain CDR3 for antibody 7902 (IGHV3-23)
AKGAVVTAIFDY

SEQ ID NO: 15805 - protein, 9 aa, Homo sapiens
  Light chain CDR3 for antibody 7903 (IGKV1-33)
QQYDNLPFT

SEQ ID NO: 15806 - protein, 17 aa, Homo sapiens
  Heavy chain CDR3 for antibody 7903 (IGHV4-59)
ARDFLVRGEGSYYGMDV

SEQ ID NO: 15807 - protein, 8 aa, Homo sapiens
  Light chain CDR3 for antibody 7904 (IGKV6-21)
HQSSSLPT

SEQ ID NO: 15808 - protein, 15 aa, Homo sapiens
  Heavy chain CDR3 for antibody 7904 (IGHV1-18)
ARGYCSSTSCYYFDY

SEQ ID NO: 15809 - protein, 10 aa, Homo sapiens
  Light chain CDR3 for antibody 7905 (IGKV1-39)
QQSYSTPMYT

SEQ ID NO: 15810 - protein, 16 aa, Homo sapiens
  Heavy chain CDR3 for antibody 7905 (IGHV4-59)
ARDTPYYSGSGRPFDS

SEQ ID NO: 15811 - protein, 10 aa, Homo sapiens
  Light chain CDR3 for antibody 7906 (IGKV3-11)
QQRSNWPTLT

SEQ ID NO: 15812 - protein, 16 aa, Homo sapiens
  Heavy chain CDR3 for antibody 7906 (IGHV3-23)
AKDLRYFDWSLYAFDI

SEQ ID NO: 15813 - protein, 9 aa, Homo sapiens
  Light chain CDR3 for antibody 7907 (IGKV1-37)
QRTSNAPYT

SEQ ID NO: 15814 - protein, 13 aa, Homo sapiens
  Heavy chain CDR3 for antibody 7907 (IGHV3-33)
ARSGSYWGYYFDY

SEQ ID NO: 15815 - protein, 9 aa, Homo sapiens
  Light chain CDR3 for antibody 7908 (IGKV1-6)
LQDYNYPWT

SEQ ID NO: 15816 - protein, 14 aa, Homo sapiens
  Heavy chain CDR3 for antibody 7908 (IGHV3-33)
ARDNILTAYYLFDY

SEQ ID NO: 15817 - protein, 9 aa, Homo sapiens
  Light chain CDR3 for antibody 7909 (IGKV1D-13)
QRFNNYLYT

SEQ ID NO: 15818 - protein, 17 aa, Homo sapiens
  Heavy chain CDR3 for antibody 7909 (IGHV3-33)
ARAYYDILTGYSYYFDY

SEQ ID NO: 15819 - protein, 9 aa, Homo sapiens
  Light chain CDR3 for antibody 7910 (IGKV1-6)
LQDFNYPRT

SEQ ID NO: 15820 - protein, 19 aa, Homo sapiens
  Heavy chain CDR3 for antibody 7910 (IGHV4-59)
AREGHYYTSGSYRPNWFDP

SEQ ID NO: 15821 - protein, 8 aa, Homo sapiens
  Light chain CDR3 for antibody 7911 (IGKV1-5)
QQYNSYWT

SEQ ID NO: 15822 - protein, 13 aa, Homo sapiens
  Heavy chain CDR3 for antibody 7911 (IGHV3-33)
ARQSSGWFDAFDI

SEQ ID NO: 15823 - protein, 9 aa, Homo sapiens
  Light chain CDR3 for antibody 7912 (IGKV1D-13)
QQFNNYPRT

SEQ ID NO: 15824 - protein, 11 aa, Homo sapiens
  Heavy chain CDR3 for antibody 7912 (IGHV1-24)
ATYFGSGSLDY

SEQ ID NO: 15825 - protein, 9 aa, Homo sapiens
  Light chain CDR3 for antibody 7913 (IGKV1D-13)
QQFNNYPHT

SEQ ID NO: 15826 - protein, 13 aa, Homo sapiens
  Heavy chain CDR3 for antibody 7913 (IGHV1-18)
ARGGGVRGAPLDY

SEQ ID NO: 15827 - protein, 9 aa, Homo sapiens
  Light chain CDR3 for antibody 7914 (IGKV1D-13)
QQFNNYPST

SEQ ID NO: 15828 - protein, 15 aa, Homo sapiens
  Heavy chain CDR3 for antibody 7914 (IGHV3-33)
ARGGTGYYSYWYFDL

SEQ ID NO: 15829 - protein, 9 aa, Homo sapiens
  Light chain CDR3 for antibody 7915 (IGKV1-16)
QKYNSNPLT

SEQ ID NO: 15830 - protein, 14 aa, Homo sapiens
  Heavy chain CDR3 for antibody 7915 (IGHV3-33)
ARASSGSSYWYFDL

SEQ ID NO: 15831 - protein, 9 aa, Homo sapiens
  Light chain CDR3 for antibody 7916 (IGKV1-9)
QQLNNYLFT

SEQ ID NO: 15832 - protein, 13 aa, Homo sapiens
  Heavy chain CDR3 for antibody 7916 (IGHV4-34)
ASNFYYYYYGMDV

SEQ ID NO: 15833 - protein, 9 aa, Homo sapiens
  Light chain CDR3 for antibody 7917 (IGKV1-16)
QHYNDYPFT

SEQ ID NO: 15834 - protein, 17 aa, Homo sapiens
  Heavy chain CDR3 for antibody 7917 (IGHV4-59)
ARDFLVRGEGSYYGMDV

SEQ ID NO: 15835 - protein, 9 aa, Homo sapiens
  Light chain CDR3 for antibody 7918 (IGKV1-27)
QKYNSAPYT

SEQ ID NO: 15836 - protein, 9 aa, Homo sapiens
  Heavy chain CDR3 for antibody 7918 (IGHV1-18)
ARGKDWFDH

SEQ ID NO: 15837 - protein, 9 aa, Homo sapiens
  Light chain CDR3 for antibody 7919 (IGKV1-9)
QQLKSYLYT

SEQ ID NO: 15838 - protein, 15 aa, Homo sapiens
  Heavy chain CDR3 for antibody 7919 (IGHV1-18)
ARLRWFGELSGWFDP

SEQ ID NO: 15839 - protein, 9 aa, Homo sapiens
  Light chain CDR3 for antibody 7920 (IGKV1D-16)
QQYHSYPYT

SEQ ID NO: 15840 - protein, 18 aa, Homo sapiens
  Heavy chain CDR3 for antibody 7920 (IGHV4-59)
AREGHDYTSGSYYKAFDY

SEQ ID NO: 15841 - protein, 9 aa, Homo sapiens
  Light chain CDR3 for antibody 7921 (IGKV1-9)
QQFNSYTRT

SEQ ID NO: 15842 - protein, 14 aa, Homo sapiens
  Heavy chain CDR3 for antibody 7921 (IGHV3-33)
ARGGYSGYRYYFDY

SEQ ID NO: 15843 - protein, 9 aa, Homo sapiens
  Light chain CDR3 for antibody 7922 (IGKV1D-16)
QQFNNYPHT

SEQ ID NO: 15844 - protein, 16 aa, Homo sapiens
  Heavy chain CDR3 for antibody 7922 (IGHV4-39)
ARHPLILTGYPNWFDP

SEQ ID NO: 15845 - protein, 9 aa, Homo sapiens
  Light chain CDR3 for antibody 7923 (IGKV1D-13)
QQFNNYPHT

SEQ ID NO: 15846 - protein, 20 aa, Homo sapiens
  Heavy chain CDR3 for antibody 7923 (IGHV3-33)
ARDPAQLERRYYYFYYGMDV

SEQ ID NO: 15847 - protein, 10 aa, Homo sapiens
  Light chain CDR3 for antibody 7924 (IGKV3-11)
QQRSNWPIFT

SEQ ID NO: 15848 - protein, 14 aa, Homo sapiens
  Heavy chain CDR3 for antibody 7924 (IGHV3-20)
AREGWFGDYYGMDV

SEQ ID NO: 15849 - protein, 8 aa, Homo sapiens
  Light chain CDR3 for antibody 7925 (IGKV3-20)
QQYGRSFT

SEQ ID NO: 15850 - protein, 19 aa, Homo sapiens
  Heavy chain CDR3 for antibody 7925 (IGHV4-59)
ARDRVVGATTYYYYYGMDV

SEQ ID NO: 15851 - protein, 9 aa, Homo sapiens
  Light chain CDR3 for antibody 7926 (IGKV1-27)
QKYNSAPYT

SEQ ID NO: 15852 - protein, 12 aa, Homo sapiens
  Heavy chain CDR3 for antibody 7926 (IGHV3-64)
ARVNSGSPYFDY

SEQ ID NO: 15853 - protein, 10 aa, Homo sapiens
  Light chain CDR3 for antibody 7927 (IGKV3-15)
QQYNNWPPIT

SEQ ID NO: 15854 - protein, 15 aa, Homo sapiens
  Heavy chain CDR3 for antibody 7927 (IGHV3-33)
ARGYYYGSGSFPVDY

SEQ ID NO: 15855 - protein, 9 aa, Homo sapiens
  Light chain CDR3 for antibody 7928 (IGKV6-21)
HQSSSLPLT

SEQ ID NO: 15856 - protein, 14 aa, Homo sapiens
  Heavy chain CDR3 for antibody 7928 (IGHV3-33)
ARDGLVGASSWFDP

SEQ ID NO: 15857 - protein, 9 aa, Homo sapiens
  Light chain CDR3 for antibody 7929 (IGKV1-9)
QQLNSYPYT

SEQ ID NO: 15858 - protein, 19 aa, Homo sapiens
  Heavy chain CDR3 for antibody 7929 (IGHV1-46)
ARKGHYDILTGYYPDAFDI

SEQ ID NO: 15859 - protein, 9 aa, Homo sapiens
  Light chain CDR3 for antibody 7930 (IGKV2D-28)
MQALQTPPT

SEQ ID NO: 15860 - protein, 20 aa, Homo sapiens
  Heavy chain CDR3 for antibody 7930 (IGHV3-33)
ARDPAQLERRYYYFYYGMDV

SEQ ID NO: 15861 - protein, 9 aa, Homo sapiens
  Light chain CDR3 for antibody 7931 (IGKV1D-13)
QQFNNYPHT

SEQ ID NO: 15862 - protein, 13 aa, Homo sapiens
  Heavy chain CDR3 for antibody 7931 (IGHV4-39)
ARRDGGYYGYFDY

SEQ ID NO: 15863 - protein, 8 aa, Homo sapiens
  Light chain CDR3 for antibody 7932 (IGKV3D-7)
QQDYSLLT

SEQ ID NO: 15864 - protein, 18 aa, Homo sapiens
  Heavy chain CDR3 for antibody 7932 (IGHV3-33)
ARDYDSLTTYPEDYGMDV

SEQ ID NO: 15865 - protein, 9 aa, Homo sapiens
  Light chain CDR3 for antibody 7933 (IGKV4-1)
QQYYTTPPT

SEQ ID NO: 15866 - protein, 18 aa, Homo sapiens
  Heavy chain CDR3 for antibody 7933 (IGHV3-23)
AKEGNYYGSGSYWGYFDP

SEQ ID NO: 15867 - protein, 8 aa, Homo sapiens
  Light chain CDR3 for antibody 7934 (IGKV3D-7)
QQDYNLVT

SEQ ID NO: 15868 - protein, 15 aa, Homo sapiens
  Heavy chain CDR3 for antibody 7934 (IGHV3-23)
AKDGGWNYYYYGMDV

SEQ ID NO: 15869 - protein, 9 aa, Homo sapiens
  Light chain CDR3 for antibody 7935 (IGKV2-30)
MQGTHWPLT

SEQ ID NO: 15870 - protein, 14 aa, Homo sapiens
  Heavy chain CDR3 for antibody 7935 (IGHV3-33)
AREDYYGPLNWFDP

SEQ ID NO: 15871 - protein, 9 aa, Homo sapiens
  Light chain CDR3 for antibody 7936 (IGKV3-15)
QQYNNWPYT

SEQ ID NO: 15872 - protein, 10 aa, Homo sapiens
  Heavy chain CDR3 for antibody 7936 (IGHV3-33)
AREWFGGFDI

SEQ ID NO: 15873 - protein, 11 aa, Homo sapiens
  Light chain CDR3 for antibody 7937 (IGKV3-11)
QQRSNWPPTWT

SEQ ID NO: 15874 - protein, 19 aa, Homo sapiens
  Heavy chain CDR3 for antibody 7937 (IGHV4-39)
ARQGDVLRYFDWLLGAFDI

SEQ ID NO: 15875 - protein, 10 aa, Homo sapiens
  Light chain CDR3 for antibody 7938 (IGKV1-39)
QQSYSTPMYT

SEQ ID NO: 15876 - protein, 17 aa, Homo sapiens
  Heavy chain CDR3 for antibody 7938 (IGHV3-23)
AKDGIGELSYYYYGMDV

SEQ ID NO: 15877 - protein, 9 aa, Homo sapiens
  Light chain CDR3 for antibody 7939 (IGKV1-9)
QQLNNYLFT

SEQ ID NO: 15878 - protein, 12 aa, Homo sapiens
  Heavy chain CDR3 for antibody 7939 (IGHV4-61)
ARVYSSGWLFDY

SEQ ID NO: 15879 - protein, 9 aa, Homo sapiens
  Light chain CDR3 for antibody 7940 (IGKV1-17)
LQHNSYPYT

SEQ ID NO: 15880 - protein, 12 aa, Homo sapiens
  Heavy chain CDR3 for antibody 7940 (IGHV3-11)
VRVLLWFGESDY

SEQ ID NO: 15881 - protein, 9 aa, Homo sapiens
  Light chain CDR3 for antibody 7941 (IGKV3-20)
QQYGRSPRT

SEQ ID NO: 15882 - protein, 17 aa, Homo sapiens
  Heavy chain CDR3 for antibody 7941 (IGHV4-39)
ARVLRYFDWLSHDAFDI

SEQ ID NO: 15883 - protein, 8 aa, Homo sapiens
  Light chain CDR3 for antibody 7942 (IGKV1-5)
QQYNSYWT

SEQ ID NO: 15884 - protein, 11 aa, Homo sapiens
  Heavy chain CDR3 for antibody 7942 (IGHV3-33)
AREGAVARFDY

SEQ ID NO: 15885 - protein, 10 aa, Homo sapiens
  Light chain CDR3 for antibody 7943 (IGKV1-17)
LQHNSYPMYT

SEQ ID NO: 15886 - protein, 18 aa, Homo sapiens
  Heavy chain CDR3 for antibody 7943 (IGHV3-13)
ARDYYGSGSLYYYYGMDV

SEQ ID NO: 15887 - protein, 9 aa, Homo sapiens
  Light chain CDR3 for antibody 7944 (IGKV1-33)
QQYDNLPFT

SEQ ID NO: 15888 - protein, 13 aa, Homo sapiens
  Heavy chain CDR3 for antibody 7944 (IGHV3-33)
ARTDYYFYYGLDV

SEQ ID NO: 15889 - protein, 9 aa, Homo sapiens
  Light chain CDR3 for antibody 7945 (IGKV1-39)
QQSYRTPLT

SEQ ID NO: 15890 - protein, 17 aa, Homo sapiens
  Heavy chain CDR3 for antibody 7945 (IGHV4-61)
ARDGSGSYTHYYYGMDV

SEQ ID NO: 15891 - protein, 9 aa, Homo sapiens
  Light chain CDR3 for antibody 7946 (IGKV3-15)
QQYNNWPYT

SEQ ID NO: 15892 - protein, 20 aa, Homo sapiens
  Heavy chain CDR3 for antibody 7946 (IGHV3-33)
ARGGATLIRGLIDYYYGMDV

SEQ ID NO: 15893 - protein, 8 aa, Homo sapiens
  Light chain CDR3 for antibody 7947 (IGKV3-15)
QQRSNWLT

SEQ ID NO: 15894 - protein, 14 aa, Homo sapiens
  Heavy chain CDR3 for antibody 7947 (IGHV3-33)
ARGAAAGNFYGLDV

SEQ ID NO: 15895 - protein, 9 aa, Homo sapiens
  Light chain CDR3 for antibody 7948 (IGKV2-30)
MQGTHWPLT

SEQ ID NO: 15896 - protein, 12 aa, Homo sapiens
  Heavy chain CDR3 for antibody 7948 (IGHV3-11)
ARKQWLVQAFDI

SEQ ID NO: 15897 - protein, 10 aa, Homo sapiens
  Light chain CDR3 for antibody 7949 (IGKV3-11)
QQRSNWLMYT

SEQ ID NO: 15898 - protein, 19 aa, Homo sapiens
  Heavy chain CDR3 for antibody 7949 (IGHV3-33)
TRDPHYDILTGYAYYGMDV

SEQ ID NO: 15899 - protein, 10 aa, Homo sapiens
  Light chain CDR3 for antibody 7950 (IGKV1-17)
LQHNSYPMYT

SEQ ID NO: 15900 - protein, 17 aa, Homo sapiens
  Heavy chain CDR3 for antibody 7950 (IGHV4-39)
ARVLRYFDWLSHDAFDI

SEQ ID NO: 15901 - protein, 9 aa, Homo sapiens
  Light chain CDR3 for antibody 7951 (IGKV1-16)
QQYNSYPYT

SEQ ID NO: 15902 - protein, 14 aa, Homo sapiens
  Heavy chain CDR3 for antibody 7951 (IGHV1-18)
ARERGVRGVMYFDY

SEQ ID NO: 15903 - protein, 9 aa, Homo sapiens
  Light chain CDR3 for antibody 7952 (IGKV1-6)
LQDFHYPWT

SEQ ID NO: 15904 - protein, 12 aa, Homo sapiens
  Heavy chain CDR3 for antibody 7952 (IGHV3-33)
ARESGGSYSFDY

SEQ ID NO: 15905 - protein, 11 aa, Homo sapiens
  Light chain CDR3 for antibody 7953 (IGKV3-11)
QQRSNWPPTWT

SEQ ID NO: 15906 - protein, 12 aa, Homo sapiens
  Heavy chain CDR3 for antibody 7953 (IGHV1-46)
AREDYDIDGMDV

SEQ ID NO: 15907 - protein, 9 aa, Homo sapiens
  Light chain CDR3 for antibody 7954 (IGKV1-9)
QQLKSYLYT

SEQ ID NO: 15908 - protein, 18 aa, Homo sapiens
  Heavy chain CDR3 for antibody 7954 (IGHV4-39)
ARQYYFGSGNYYRGWFDP

SEQ ID NO: 15909 - protein, 10 aa, Homo sapiens
  Light chain CDR3 for antibody 7955 (IGKV1-17)
LQHNSYPMYT

SEQ ID NO: 15910 - protein, 15 aa, Homo sapiens
  Heavy chain CDR3 for antibody 7955 (IGHV3-74)
ARGSGSHYHYYGMDV

SEQ ID NO: 15911 - protein, 10 aa, Homo sapiens
  Light chain CDR3 for antibody 7956 (IGKV3-11)
QQRSNWPALT

SEQ ID NO: 15912 - protein, 13 aa, Homo sapiens
  Heavy chain CDR3 for antibody 7956 (IGHV4-39)
ARRDGSYYGYFGY

SEQ ID NO: 15913 - protein, 9 aa, Homo sapiens
  Light chain CDR3 for antibody 7957 (IGKV5-2)
LQHDNFPYT

SEQ ID NO: 15914 - protein, 12 aa, Homo sapiens
  Heavy chain CDR3 for antibody 7957 (IGHV3-9)
AEDPFLGTSFDY

SEQ ID NO: 15915 - protein, 9 aa, Homo sapiens
  Light chain CDR3 for antibody 7958 (IGKV5-2)
LQHDNFPYT

SEQ ID NO: 15916 - protein, 16 aa, Homo sapiens
  Heavy chain CDR3 for antibody 7958 (IGHV3-11)
ARYHYGSGSYYNVGDY

SEQ ID NO: 15917 - protein, 9 aa, Homo sapiens
  Light chain CDR3 for antibody 7959 (IGKV2-30)
MQGTHWPLT

SEQ ID NO: 15918 - protein, 17 aa, Homo sapiens
  Heavy chain CDR3 for antibody 7959 (IGHV3-33)
ARDSYDILTGYYKPFDY

SEQ ID NO: 15919 - protein, 9 aa, Homo sapiens
  Light chain CDR3 for antibody 7960 (IGKV2-30)
MQGTHWPLT

SEQ ID NO: 15920 - protein, 14 aa, Homo sapiens
  Heavy chain CDR3 for antibody 7960 (IGHV3-20)
ARDEGSGGYDVFDI

SEQ ID NO: 15921 - protein, 8 aa, Homo sapiens
  Light chain CDR3 for antibody 7961 (IGKV3D-7)
QQDYNLLT

SEQ ID NO: 15922 - protein, 18 aa, Homo sapiens
  Heavy chain CDR3 for antibody 7961 (IGHV3-33)
ARDRYYDILTGYYMGFDY

SEQ ID NO: 15923 - protein, 10 aa, Homo sapiens
  Light chain CDR3 for antibody 7962 (IGKV3-11)
QQRSNWPALT

SEQ ID NO: 15924 - protein, 12 aa, Homo sapiens
  Heavy chain CDR3 for antibody 7962 (IGHV3-23)
AKEGLGSDYESY

SEQ ID NO: 15925 - protein, 9 aa, Homo sapiens
  Light chain CDR3 for antibody 7963 (IGKV1D-13)
QQFNNYPRT

SEQ ID NO: 15926 - protein, 17 aa, Homo sapiens
  Heavy chain CDR3 for antibody 7963 (IGHV1-24)
ATHYGSGSHYKGYGMDV

SEQ ID NO: 15927 - protein, 8 aa, Homo sapiens
  Light chain CDR3 for antibody 7964 (IGKV2D-28)
MQALQTPT

SEQ ID NO: 15928 - protein, 13 aa, Homo sapiens
  Heavy chain CDR3 for antibody 7964 (IGHV4-34)
ASNFYYYYYGMDV

SEQ ID NO: 15929 - protein, 9 aa, Homo sapiens
  Light chain CDR3 for antibody 7965 (IGKV1-37)
QRTSNAPYT

SEQ ID NO: 15930 - protein, 12 aa, Homo sapiens
  Heavy chain CDR3 for antibody 7965 (IGHV3-h)
AREDYYYYGMDV

SEQ ID NO: 15931 - protein, 9 aa, Homo sapiens
  Light chain CDR3 for antibody 7966 (IGKV1-6)
QQLKSYLYT

SEQ ID NO: 15932 - protein, 9 aa, Homo sapiens
  Heavy chain CDR3 for antibody 7966 (IGHV3-13)
ARDRWYFDL

SEQ ID NO: 15933 - protein, 9 aa, Homo sapiens
  Light chain CDR3 for antibody 7967 (IGKV1-37)
QRTYNAPFT

SEQ ID NO: 15934 - protein, 12 aa, Homo sapiens
  Heavy chain CDR3 for antibody 7967 (IGHV3-23)
AKDGWFGESLDY

SEQ ID NO: 15935 - protein, 10 aa, Homo sapiens
  Light chain CDR3 for antibody 7968 (IGKV3-11)
QQRSNWPIFT

SEQ ID NO: 15936 - protein, 15 aa, Homo sapiens
  Heavy chain CDR3 for antibody 7968 (IGHV3-23)
AKDLSSGWYAYFFDY

SEQ ID NO: 15937 - protein, 9 aa, Homo sapiens
  Light chain CDR3 for antibody 7969 (IGKV1-9)
QQLITYPYT

SEQ ID NO: 15938 - protein, 12 aa, Homo sapiens
  Heavy chain CDR3 for antibody 7969 (IGHV3-33)
ARDPGYYYGLDV

SEQ ID NO: 15939 - protein, 9 aa, Homo sapiens
  Light chain CDR3 for antibody 7970 (IGKV3D-7)
QQDYNLPYT

SEQ ID NO: 15940 - protein, 18 aa, Homo sapiens
  Heavy chain CDR3 for antibody 7970 (IGHV3-33)
AREGYDILTGYYNVKFDY

SEQ ID NO: 15941 - protein, 9 aa, Homo sapiens
  Light chain CDR3 for antibody 7971 (IGKV3D-7)
QQDYKLPLT

SEQ ID NO: 15942 - protein, 12 aa, Homo sapiens
  Heavy chain CDR3 for antibody 7971 (IGHV4-34)
ARGYSSSWYFDY

SEQ ID NO: 15943 - protein, 9 aa, Homo sapiens
  Light chain CDR3 for antibody 7972 (IGKV1-6)
LQDFHYPWT

SEQ ID NO: 15944 - protein, 14 aa, Homo sapiens
  Heavy chain CDR3 for antibody 7972 (IGHV3-21)
ARQDYDILTGLFDY

SEQ ID NO: 15945 - protein, 9 aa, Homo sapiens
  Light chain CDR3 for antibody 7973 (IGKV1-6)
LQDFHYPWT

SEQ ID NO: 15946 - protein, 16 aa, Homo sapiens
  Heavy chain CDR3 for antibody 7973 (IGHV3-33)
ARGYDMLTGDYHGMDV

SEQ ID NO: 15947 - protein, 9 aa, Homo sapiens
  Light chain CDR3 for antibody 7974 (IGKV1-17)
LHSNNYPWT

SEQ ID NO: 15948 - protein, 12 aa, Homo sapiens
  Heavy chain CDR3 for antibody 7974 (IGHV3-13)
VREAGIPDAFDI

SEQ ID NO: 15949 - protein, 10 aa, Homo sapiens
  Light chain CDR3 for antibody 7975 (IGKV3-11)
QQRSNWPIYT

SEQ ID NO: 15950 - protein, 9 aa, Homo sapiens
  Heavy chain CDR3 for antibody 7975 (IGHV3-23)
ARIWWLKDY

SEQ ID NO: 15951 - protein, 8 aa, Homo sapiens
  Light chain CDR3 for antibody 7976 (IGKV6-21)
HQSSSLPT

SEQ ID NO: 15952 - protein, 13 aa, Homo sapiens
  Heavy chain CDR3 for antibody 7976 (IGHV3-11)
ARDEGYRGYVLDT

SEQ ID NO: 15953 - protein, 8 aa, Homo sapiens
  Light chain CDR3 for antibody 7977 (IGKV3D-7)
QQDYNLLT

SEQ ID NO: 15954 - protein, 15 aa, Homo sapiens
  Heavy chain CDR3 for antibody 7977 (IGHV3-33)
ARRSILTGSYWYFDL

SEQ ID NO: 15955 - protein, 9 aa, Homo sapiens
  Light chain CDR3 for antibody 7978 (IGKV1-39)
QQSYSTPIT

SEQ ID NO: 15956 - protein, 14 aa, Homo sapiens
  Heavy chain CDR3 for antibody 7978 (IGHV1-46)
ARKGIVGGFDAFDV

SEQ ID NO: 15957 - protein, 9 aa, Homo sapiens
  Light chain CDR3 for antibody 7979 (IGKV1D-16)
QQYAGYPPT

SEQ ID NO: 15958 - protein, 14 aa, Homo sapiens
  Heavy chain CDR3 for antibody 7979 (IGHV3-33)
ARRGSPLRPSHLDV

SEQ ID NO: 15959 - protein, 9 aa, Homo sapiens
  Light chain CDR3 for antibody 7980 (IGKV1D-13)
QRFNNYLYT

SEQ ID NO: 15960 - protein, 18 aa, Homo sapiens
  Heavy chain CDR3 for antibody 7980 (IGHV3-33)
VRDRERYGSGSYPDAFDI

SEQ ID NO: 15961 - protein, 8 aa, Homo sapiens
  Light chain CDR3 for antibody 7981 (IGKV1D-13)
QQFNNYPT

SEQ ID NO: 15962 - protein, 19 aa, Homo sapiens
  Heavy chain CDR3 for antibody 7981 (IGHV3-33)
ARDSGYSGYDYYYYYGMDV

SEQ ID NO: 15963 - protein, 9 aa, Homo sapiens
  Light chain CDR3 for antibody 7982 (IGKV3-20)
QQYGSSPYT

SEQ ID NO: 15964 - protein, 17 aa, Homo sapiens
  Heavy chain CDR3 for antibody 7982 (IGHV3-23)
AKDRDWKDGYYYFGMDV

SEQ ID NO: 15965 - protein, 9 aa, Homo sapiens
  Light chain CDR3 for antibody 7983 (IGKV1D-16)
QQYNSYPFT

SEQ ID NO: 15966 - protein, 9 aa, Homo sapiens
  Heavy chain CDR3 for antibody 7983 (IGHV4-34)
AREKYYFDY

SEQ ID NO: 15967 - protein, 9 aa, Homo sapiens
  Light chain CDR3 for antibody 7984 (IGKV1-9)
QQLKSYLYT

SEQ ID NO: 15968 - protein, 13 aa, Homo sapiens
  Heavy chain CDR3 for antibody 7984 (IGHV1-18)
ARKWEWDLLNFDY

SEQ ID NO: 15969 - protein, 10 aa, Homo sapiens
  Light chain CDR3 for antibody 7985 (IGKV1-17)
LQHNSYPMYT

SEQ ID NO: 15970 - protein, 11 aa, Homo sapiens
  Heavy chain CDR3 for antibody 7985 (IGHV3-33)
AREGAVARFDY

SEQ ID NO: 15971 - protein, 8 aa, Homo sapiens
  Light chain CDR3 for antibody 7986 (IGKV1-5)
QQYNSYYT

SEQ ID NO: 15972 - protein, 14 aa, Homo sapiens
  Heavy chain CDR3 for antibody 7986 (IGHV4-39)
ARDSGYDYYYGMDV

SEQ ID NO: 15973 - protein, 9 aa, Homo sapiens
  Light chain CDR3 for antibody 7987 (IGKV1-6)
LQDFNYPRT

SEQ ID NO: 15974 - protein, 13 aa, Homo sapiens
  Heavy chain CDR3 for antibody 7987 (IGHV3-11)
ARDGGAAAGTWDY

SEQ ID NO: 15975 - protein, 9 aa, Homo sapiens
  Light chain CDR3 for antibody 7988 (IGKV3-15)
QQYNNWPYT

SEQ ID NO: 15976 - protein, 16 aa, Homo sapiens
  Heavy chain CDR3 for antibody 7988 (IGHV3-33)
ARDKNTDYDILTGFDY

SEQ ID NO: 15977 - protein, 8 aa, Homo sapiens
  Light chain CDR3 for antibody 7989 (IGKV1D-13)
QQFNNYLT

SEQ ID NO: 15978 - protein, 13 aa, Homo sapiens
  Heavy chain CDR3 for antibody 7989 (IGHV3-33)
ARQSSGWFDAFDI

SEQ ID NO: 15979 - protein, 10 aa, Homo sapiens
  Light chain CDR3 for antibody 7990 (IGKV3-11)
QQRSNWPAYT

SEQ ID NO: 15980 - protein, 18 aa, Homo sapiens
  Heavy chain CDR3 for antibody 7990 (IGHV3-33)
ARDRGDILTGYYKGWFDP

SEQ ID NO: 15981 - protein, 9 aa, Homo sapiens
  Light chain CDR3 for antibody 7991 (IGKV1-17)
LQHNSYPYT

SEQ ID NO: 15982 - protein, 10 aa, Homo sapiens
  Heavy chain CDR3 for antibody 7991 (IGHV4-59)
VSSGTSLLAY

SEQ ID NO: 15983 - protein, 10 aa, Homo sapiens
  Light chain CDR3 for antibody 7992 (IGKV1-39)
QQSYSTPMYT

SEQ ID NO: 15984 - protein, 11 aa, Homo sapiens
  Heavy chain CDR3 for antibody 7992 (IGHV3-23)
AKGLWSYYFDY

SEQ ID NO: 15985 - protein, 9 aa, Homo sapiens
  Light chain CDR3 for antibody 7993 (IGKV1-9)
QQLNSYPYT

SEQ ID NO: 15986 - protein, 12 aa, Homo sapiens
  Heavy chain CDR3 for antibody 7993 (IGHV3-13)
AREAGIPDDFDI

SEQ ID NO: 15987 - protein, 9 aa, Homo sapiens
  Light chain CDR3 for antibody 7994 (IGKV1-17)
QQYYSYPRT

SEQ ID NO: 15988 - protein, 15 aa, Homo sapiens
  Heavy chain CDR3 for antibody 7994 (IGHV3-33)
ARDRGSSGWRDWCDP

SEQ ID NO: 15989 - protein, 9 aa, Homo sapiens
  Light chain CDR3 for antibody 7995 (IGKV1-9)
QQLNSYPYT

SEQ ID NO: 15990 - protein, 14 aa, Homo sapiens
  Heavy chain CDR3 for antibody 7995 (IGHV3-15)
SIYFYGSGRDYFDY

SEQ ID NO: 15991 - protein, 9 aa, Homo sapiens
  Light chain CDR3 for antibody 7996 (IGKV1-6)
LQDYNYPYT

SEQ ID NO: 15992 - protein, 23 aa, Homo sapiens
  Heavy chain CDR3 for antibody 7996 (IGHV3-30)
ARDGDYFGSGSQRDYHYYYGLDV

SEQ ID NO: 15993 - protein, 10 aa, Homo sapiens
  Light chain CDR3 for antibody 7997 (IGKV1-9)
QQLDSYPMYT

SEQ ID NO: 15994 - protein, 15 aa, Homo sapiens
  Heavy chain CDR3 for antibody 7997 (IGHV3-74)
ARGSGSHYHYYGMDV

SEQ ID NO: 15995 - protein, 9 aa, Homo sapiens
  Light chain CDR3 for antibody 7998 (IGKV4-1)
QQYYTTPYT

SEQ ID NO: 15996 - protein, 18 aa, Homo sapiens
  Heavy chain CDR3 for antibody 7998 (IGHV3-33)
ARGYYGSGNFYKDSGMDV

SEQ ID NO: 15997 - protein, 9 aa, Homo sapiens
  Light chain CDR3 for antibody 7999 (IGKV6-21)
HQSYSLPHT

SEQ ID NO: 15998 - protein, 12 aa, Homo sapiens
  Heavy chain CDR3 for antibody 7999 (IGHV3-13)
VREAGIPDAFDI

SEQ ID NO: 15999 - protein, 10 aa, Homo sapiens
  Light chain CDR3 for antibody 8000 (IGKV3-15)
QQYNNWPPIT

SEQ ID NO: 16000 - protein, 15 aa, Homo sapiens
  Heavy chain CDR3 for antibody 8000 (IGHV4-59)
ARDLGHYYGSVSIDY

SEQ ID NO: 16001 - protein, 9 aa, Homo sapiens
  Light chain CDR3 for antibody 8001 (IGKV1-39)
QQSYSTPYT

SEQ ID NO: 16002 - protein, 15 aa, Homo sapiens
  Heavy chain CDR3 for antibody 8001 (IGHV3-33)
ARDALAVTGTGWFDP

SEQ ID NO: 16003 - protein, 8 aa, Homo sapiens
  Light chain CDR3 for antibody 8002 (IGKV3D-7)
QQDYNLVT

SEQ ID NO: 16004 - protein, 13 aa, Homo sapiens
  Heavy chain CDR3 for antibody 8002 (IGHV4-39)
ARHHYGSGSLRDY

SEQ ID NO: 16005 - protein, 9 aa, Homo sapiens
  Light chain CDR3 for antibody 8003 (IGKV1-6)
LQDYNYPRT

SEQ ID NO: 16006 - protein, 15 aa, Homo sapiens
  Heavy chain CDR3 for antibody 8003 (IGHV1-18)
AREDAMIRAKWGFDP

SEQ ID NO: 16007 - protein, 10 aa, Homo sapiens
  Light chain CDR3 for antibody 8004 (IGKV3-15)
QQYNNWPPYT

SEQ ID NO: 16008 - protein, 12 aa, Homo sapiens
  Heavy chain CDR3 for antibody 8004 (IGHV4-61)
ARVDSSGWFFDY

SEQ ID NO: 16009 - protein, 9 aa, Homo sapiens
  Light chain CDR3 for antibody 8005 (IGKV1-6)
LQDYNYPWT

SEQ ID NO: 16010 - protein, 17 aa, Homo sapiens
  Heavy chain CDR3 for antibody 8005 (IGHV4-59)
ARRTTMVREIIVTHFDY

SEQ ID NO: 16011 - protein, 9 aa, Homo sapiens
  Light chain CDR3 for antibody 8006 (IGKV1D-13)
QQFNNYPYT

SEQ ID NO: 16012 - protein, 10 aa, Homo sapiens
  Heavy chain CDR3 for antibody 8006 (IGHV3-11)
ARGQWPPLDY

SEQ ID NO: 16013 - protein, 10 aa, Homo sapiens
  Light chain CDR3 for antibody 8007 (IGKV1-17)
LQHNSYPMYT

SEQ ID NO: 16014 - protein, 9 aa, Homo sapiens
  Heavy chain CDR3 for antibody 8007 (IGHV3-33)
ARATVGVDY

SEQ ID NO: 16015 - protein, 8 aa, Homo sapiens
  Light chain CDR3 for antibody 8008 (IGKV1D-13)
QQFNNYPT

SEQ ID NO: 16016 - protein, 11 aa, Homo sapiens
  Heavy chain CDR3 for antibody 8008 (IGHV3-13)
AREAIIGPFDY

SEQ ID NO: 16017 - protein, 9 aa, Homo sapiens
  Light chain CDR3 for antibody 8009 (IGKV1-6)
LQDFHYPWT

SEQ ID NO: 16018 - protein, 24 aa, Homo sapiens
  Heavy chain CDR3 for antibody 8009 (IGHV3-20)
ARGRITMVRGVIINPLDYYNGMDV

SEQ ID NO: 16019 - protein, 9 aa, Homo sapiens
  Light chain CDR3 for antibody 8010 (IGKV1-6)
LQDYNYPYT

SEQ ID NO: 16020 - protein, 13 aa, Homo sapiens
  Heavy chain CDR3 for antibody 8010 (IGHV3-33)
AKCIVAAIGGFDY

SEQ ID NO: 16021 - protein, 9 aa, Homo sapiens
  Light chain CDR3 for antibody 8011 (IGKV1-6)
LQDYKSPFT

SEQ ID NO: 16022 - protein, 17 aa, Homo sapiens
  Heavy chain CDR3 for antibody 8011 (IGHV3-23)
AKDYDILTGYSHNWFDP

SEQ ID NO: 16023 - protein, 9 aa, Homo sapiens
  Light chain CDR3 for antibody 8012 (IGKV5-2)
LQHDKFPYT

SEQ ID NO: 16024 - protein, 15 aa, Homo sapiens
  Heavy chain CDR3 for antibody 8012 (IGHV3-33)
ARDHLTGYYYYGMDV

SEQ ID NO: 16025 - protein, 9 aa, Homo sapiens
  Light chain CDR3 for antibody 8013 (IGKV1-9)
QQLKSYLYT

SEQ ID NO: 16026 - protein, 11 aa, Homo sapiens
  Heavy chain CDR3 for antibody 8013 (IGHV1-18)
ATYFGSGSLDY

SEQ ID NO: 16027 - protein, 9 aa, Homo sapiens
  Light chain CDR3 for antibody 8014 (IGKV1D-16)
QQYNSYPLT

SEQ ID NO: 16028 - protein, 9 aa, Homo sapiens
  Heavy chain CDR3 for antibody 8014 (IGHV3-30)
ARGRVSLDV

SEQ ID NO: 16029 - protein, 9 aa, Homo sapiens
  Light chain CDR3 for antibody 8015 (IGKV1D-13)
QRFNNYLYT

SEQ ID NO: 16030 - protein, 18 aa, Homo sapiens
  Heavy chain CDR3 for antibody 8015 (IGHV3-33)
ARREGIVGATTYYYGMDV

SEQ ID NO: 16031 - protein, 9 aa, Homo sapiens
  Light chain CDR3 for antibody 8016 (IGKV6-21)
HQSSSLPYT

SEQ ID NO: 16032 - protein, 20 aa, Homo sapiens
  Heavy chain CDR3 for antibody 8016 (IGHV3-23)
AKDRETGTTSYHYYYYGMDV

SEQ ID NO: 16033 - protein, 9 aa, Homo sapiens
  Light chain CDR3 for antibody 8017 (IGKV1-6)
LQDYKSPFT

SEQ ID NO: 16034 - protein, 12 aa, Homo sapiens
  Heavy chain CDR3 for antibody 8017 (IGHV3-33)
AREGTRWVYFDY

SEQ ID NO: 16035 - protein, 9 aa, Homo sapiens
  Light chain CDR3 for antibody 8018 (IGKV1-17)
LQHNSYPYT

SEQ ID NO: 16036 - protein, 16 aa, Homo sapiens
  Heavy chain CDR3 for antibody 8018 (IGHV3-33)
AREVGAKDYYYYGMDV

SEQ ID NO: 16037 - protein, 9 aa, Homo sapiens
  Light chain CDR3 for antibody 8019 (IGKV1-27)
QKYNSAPYT

SEQ ID NO: 16038 - protein, 14 aa, Homo sapiens
  Heavy chain CDR3 for antibody 8019 (IGHV3-33)
ARKGYSGRYYYFDY

SEQ ID NO: 16039 - protein, 9 aa, Homo sapiens
  Light chain CDR3 for antibody 8020 (IGKV3D-7)
QQDYNLPLT

SEQ ID NO: 16040 - protein, 11 aa, Homo sapiens
  Heavy chain CDR3 for antibody 8020 (IGHV3-33)
ARDILTGFLDH

SEQ ID NO: 16041 - protein, 11 aa, Homo sapiens
  Light chain CDR3 for antibody 8021 (IGKV3-11)
QQRSNWPPTWT

SEQ ID NO: 16042 - protein, 14 aa, Homo sapiens
  Heavy chain CDR3 for antibody 8021 (IGHV4-59)
AKGGSGSYYNWFDP

SEQ ID NO: 16043 - protein, 8 aa, Homo sapiens
  Light chain CDR3 for antibody 8022 (IGKV3-15)
QQYNNWPT

SEQ ID NO: 16044 - protein, 17 aa, Homo sapiens
  Heavy chain CDR3 for antibody 8022 (IGHV3-33)
ARVRGVIEGYYYYGMDV

SEQ ID NO: 16045 - protein, 9 aa, Homo sapiens
  Light chain CDR3 for antibody 8023 (IGKV3-11)
QQRSNWPPT

SEQ ID NO: 16046 - protein, 22 aa, Homo sapiens
  Heavy chain CDR3 for antibody 8023 (IGHV3-23)
AKDDLPYYDILTHSTTTGGMDV

SEQ ID NO: 16047 - protein, 9 aa, Homo sapiens
  Light chain CDR3 for antibody 8024 (IGKV3D-20)
QQYGSSPRT

SEQ ID NO: 16048 - protein, 15 aa, Homo sapiens
  Heavy chain CDR3 for antibody 8024 (IGHV1-18)
ARIYYGSGSSYYFDY

SEQ ID NO: 16049 - protein, 9 aa, Homo sapiens
  Light chain CDR3 for antibody 8025 (IGKV1D-16)
QQYNSYPLT

SEQ ID NO: 16050 - protein, 19 aa, Homo sapiens
  Heavy chain CDR3 for antibody 8025 (IGHV3-33)
TRDAHYDILTGYAYYGMDV

SEQ ID NO: 16051 - protein, 9 aa, Homo sapiens
  Light chain CDR3 for antibody 8026 (IGKV5-2)
LQHDKFPYT

SEQ ID NO: 16052 - protein, 14 aa, Homo sapiens
  Heavy chain CDR3 for antibody 8026 (IGHV3-33)
ARDKSYPLSYGMDV

SEQ ID NO: 16053 - protein, 9 aa, Homo sapiens
  Light chain CDR3 for antibody 8027 (IGKV2-30)
MQGTHWPYT

SEQ ID NO: 16054 - protein, 21 aa, Homo sapiens
  Heavy chain CDR3 for antibody 8027 (IGHV4-59)
AAGVLLWFGEPNYYYYYGMDV

SEQ ID NO: 16055 - protein, 9 aa, Homo sapiens
  Light chain CDR3 for antibody 8028 (IGKV1-39)
QQSYSTPIT

SEQ ID NO: 16056 - protein, 6 aa, Homo sapiens
  Heavy chain CDR3 for antibody 8028 (IGHV4-59)
AREGTY

SEQ ID NO: 16057 - protein, 9 aa, Homo sapiens
  Light chain CDR3 for antibody 8029 (IGKV3-11)
QQRSNWPPT

SEQ ID NO: 16058 - protein, 13 aa, Homo sapiens
  Heavy chain CDR3 for antibody 8029 (IGHV4-59)
ANRDYYGYYGMDV

SEQ ID NO: 16059 - protein, 9 aa, Homo sapiens
  Light chain CDR3 for antibody 8030 (IGKV2-30)
MQGTHWPLT

SEQ ID NO: 16060 - protein, 16 aa, Homo sapiens
  Heavy chain CDR3 for antibody 8030 (IGHV3-33)
AREVAGSYYYYYGIDV

SEQ ID NO: 16061 - protein, 9 aa, Homo sapiens
  Light chain CDR3 for antibody 8031 (IGKV4-1)
QQYYSTPYT

SEQ ID NO: 16062 - protein, 16 aa, Homo sapiens
  Heavy chain CDR3 for antibody 8031 (IGHV3-23)
AKEGMVLLYFDWLWDY

SEQ ID NO: 16063 - protein, 8 aa, Homo sapiens
  Light chain CDR3 for antibody 8032 (IGKV3D-15)
QQDYNLLT

SEQ ID NO: 16064 - protein, 18 aa, Homo sapiens
  Heavy chain CDR3 for antibody 8032 (IGHV3-33)
ARERGYYGSDIYPAAFDI

SEQ ID NO: 16065 - protein, 9 aa, Homo sapiens
  Light chain CDR3 for antibody 8033 (IGKV1-6)
LQDYNYPWT

SEQ ID NO: 16066 - protein, 16 aa, Homo sapiens
  Heavy chain CDR3 for antibody 8033 (IGHV3-23)
AKEGMVLRYFDWFWDY

SEQ ID NO: 16067 - protein, 9 aa, Homo sapiens
  Light chain CDR3 for antibody 8034 (IGKV1D-16)
QQYNSFPLT

SEQ ID NO: 16068 - protein, 13 aa, Homo sapiens
  Heavy chain CDR3 for antibody 8034 (IGHV3-11)
ARDEGYRGYVLDS

SEQ ID NO: 16069 - protein, 10 aa, Homo sapiens
  Light chain CDR3 for antibody 8035 (IGKV3-20)
QQYGSSPPYT

SEQ ID NO: 16070 - protein, 12 aa, Homo sapiens
  Heavy chain CDR3 for antibody 8035 (IGHV3-13)
AREAGIPDAFDI

SEQ ID NO: 16071 - protein, 9 aa, Homo sapiens
  Light chain CDR3 for antibody 8036 (IGKV1-39)
QQSYRTPLT

SEQ ID NO: 16072 - protein, 16 aa, Homo sapiens
  Heavy chain CDR3 for antibody 8036 (IGHV3-33)
ARGANYYGSGIPNFEY

SEQ ID NO: 16073 - protein, 8 aa, Homo sapiens
  Light chain CDR3 for antibody 8037 (IGKV1-5)
QQYNSYWT

SEQ ID NO: 16074 - protein, 10 aa, Homo sapiens
  Heavy chain CDR3 for antibody 8037 (IGHV3-33)
ARENWGGFDY

SEQ ID NO: 16075 - protein, 9 aa, Homo sapiens
  Light chain CDR3 for antibody 8038 (IGKV1D-13)
QQFNNYPYT

SEQ ID NO: 16076 - protein, 12 aa, Homo sapiens
  Heavy chain CDR3 for antibody 8038 (IGHV3-66)
VRDRAAAPYFDL

SEQ ID NO: 16077 - protein, 8 aa, Homo sapiens
  Light chain CDR3 for antibody 8039 (IGKV3D-7)
QQDYNLLT

SEQ ID NO: 16078 - protein, 10 aa, Homo sapiens
  Heavy chain CDR3 for antibody 8039 (IGHV3-30)
ARDGLESFDY

SEQ ID NO: 16079 - protein, 8 aa, Homo sapiens
  Light chain CDR3 for antibody 8040 (IGKV3-11)
LQRGNWPT

SEQ ID NO: 16080 - protein, 9 aa, Homo sapiens
  Heavy chain CDR3 for antibody 8040 (IGHV4-59)
AREGGSGSL

SEQ ID NO: 16081 - protein, 10 aa, Homo sapiens
  Light chain CDR3 for antibody 8041 (IGKV1-6)
LQDYNYPMYT

SEQ ID NO: 16082 - protein, 17 aa, Homo sapiens
  Heavy chain CDR3 for antibody 8041 (IGHV1-18)
ARDRAFTMVRGVPPFDY

SEQ ID NO: 16083 - protein, 9 aa, Homo sapiens
  Light chain CDR3 for antibody 8042 (IGKV1-39)
QQSYSTPYT

SEQ ID NO: 16084 - protein, 11 aa, Homo sapiens
  Heavy chain CDR3 for antibody 8042 (IGHV4-59)
ARETGDDAFDI

SEQ ID NO: 16085 - protein, 9 aa, Homo sapiens
  Light chain CDR3 for antibody 8043 (IGKV3-15)
QQYNNYPYT

SEQ ID NO: 16086 - protein, 12 aa, Homo sapiens
  Heavy chain CDR3 for antibody 8043 (IGHV4-39)
ARQGAYSRFFDY

SEQ ID NO: 16087 - protein, 10 aa, Homo sapiens
  Light chain CDR3 for antibody 8044 (IGKV3-11)
QQRSNWPALT

SEQ ID NO: 16088 - protein, 17 aa, Homo sapiens
  Heavy chain CDR3 for antibody 8044 (IGHV3-33)
ARSPYDILTGYSYYFDY

SEQ ID NO: 16089 - protein, 9 aa, Homo sapiens
  Light chain CDR3 for antibody 8045 (IGKV1D-13)
QRFNNYLYT

SEQ ID NO: 16090 - protein, 9 aa, Homo sapiens
  Heavy chain CDR3 for antibody 8045 (IGHV3-33)
ARATVGVDY

SEQ ID NO: 16091 - protein, 9 aa, Homo sapiens
  Light chain CDR3 for antibody 8046 (IGKV3D-7)
QQLKSYLYT

SEQ ID NO: 16092 - protein, 12 aa, Homo sapiens
  Heavy chain CDR3 for antibody 8046 (IGHV4-61)
ARVYSSGWLFDY

SEQ ID NO: 16093 - protein, 9 aa, Homo sapiens
  Light chain CDR3 for antibody 8047 (IGKV3-11)
QQRSNWMYT

SEQ ID NO: 16094 - protein, 13 aa, Homo sapiens
  Heavy chain CDR3 for antibody 8047 (IGHV1-8)
ARKWEWDLLNFDY

SEQ ID NO: 16095 - protein, 9 aa, Homo sapiens
  Light chain CDR3 for antibody 8048 (IGKV2-30)
MQGTHWPLT

SEQ ID NO: 16096 - protein, 11 aa, Homo sapiens
  Heavy chain CDR3 for antibody 8048 (IGHV3-33)
ARGSGSYAFDY

SEQ ID NO: 16097 - protein, 10 aa, Homo sapiens
  Light chain CDR3 for antibody 8049 (IGKV3-15)
QQYNNWPPYT

SEQ ID NO: 16098 - protein, 15 aa, Homo sapiens
  Heavy chain CDR3 for antibody 8049 (IGHV1-18)
ARGYCSSTSCYYFDY

SEQ ID NO: 16099 - protein, 8 aa, Homo sapiens
  Light chain CDR3 for antibody 8050 (IGKV1D-13)
QQFNNYPT

SEQ ID NO: 16100 - protein, 14 aa, Homo sapiens
  Heavy chain CDR3 for antibody 8050 (IGHV1-46)
ARDGVGAKEGGFDY

SEQ ID NO: 16101 - protein, 9 aa, Homo sapiens
  Light chain CDR3 for antibody 8051 (IGKV1-39)
QQGFSTPWT

SEQ ID NO: 16102 - protein, 13 aa, Homo sapiens
  Heavy chain CDR3 for antibody 8051 (IGHV3-33)
ARDYCGGDCYLDY

SEQ ID NO: 16103 - protein, 10 aa, Homo sapiens
  Light chain CDR3 for antibody 8052 (IGKV3-15)
QQYNNWPPLT

SEQ ID NO: 16104 - protein, 8 aa, Homo sapiens
  Heavy chain CDR3 for antibody 8052 (IGHV1-18)
AKESLLDY

SEQ ID NO: 16105 - protein, 9 aa, Homo sapiens
  Light chain CDR3 for antibody 8053 (IGKV1-6)
LQDYKSPFT

SEQ ID NO: 16106 - protein, 11 aa, Homo sapiens
  Heavy chain CDR3 for antibody 8053 (IGHV3-33)
ARDTWDDYFDY

SEQ ID NO: 16107 - protein, 9 aa, Homo sapiens
  Light chain CDR3 for antibody 8054 (IGKV1-6)
QQYNSYPPT

SEQ ID NO: 16108 - protein, 13 aa, Homo sapiens
  Heavy chain CDR3 for antibody 8054 (IGHV3-11)
ARDEGYRGYGLDS

SEQ ID NO: 16109 - protein, 11 aa, Homo sapiens
  Light chain CDR3 for antibody 8055 (IGKV3-11)
QQRSNWPPTWT

SEQ ID NO: 16110 - protein, 20 aa, Homo sapiens
  Heavy chain CDR3 for antibody 8055 (IGHV3-33)
SRGGATLVRGVIDYYYGMDV

SEQ ID NO: 16111 - protein, 9 aa, Homo sapiens
  Light chain CDR3 for antibody 8056 (IGKV1-9)
QQLNTYPWT

SEQ ID NO: 16112 - protein, 15 aa, Homo sapiens
  Heavy chain CDR3 for antibody 8056 (IGHV3-23)
AKEFTMVRGVITPDY

SEQ ID NO: 16113 - protein, 8 aa, Homo sapiens
  Light chain CDR3 for antibody 8057 (IGKV6-21)
HQSSSLPT

SEQ ID NO: 16114 - protein, 12 aa, Homo sapiens
  Heavy chain CDR3 for antibody 8057 (IGHV3-23)
AKDGWFGESFDY

SEQ ID NO: 16115 - protein, 10 aa, Homo sapiens
  Light chain CDR3 for antibody 8058 (IGKV1-17)
LQHNSYPMYT

SEQ ID NO: 16116 - protein, 18 aa, Homo sapiens
  Heavy chain CDR3 for antibody 8058 (IGHV3-33)
ARGLLWFGVSYYYYGMDV

SEQ ID NO: 16117 - protein, 9 aa, Homo sapiens
  Light chain CDR3 for antibody 8059 (IGKV1-39)
QQSYRTPLT

SEQ ID NO: 16118 - protein, 15 aa, Homo sapiens
  Heavy chain CDR3 for antibody 8059 (IGHV4-59)
ARDLGYYGSGSPLAY

SEQ ID NO: 16119 - protein, 10 aa, Homo sapiens
  Light chain CDR3 for antibody 8060 (IGKV3-11)
QQRSNWPALT

SEQ ID NO: 16120 - protein, 11 aa, Homo sapiens
  Heavy chain CDR3 for antibody 8060 (IGHV1-18)
ATELGLYYFDY

SEQ ID NO: 16121 - protein, 9 aa, Homo sapiens
  Light chain CDR3 for antibody 8061 (IGKV1-17)
LQHNSYPYT

SEQ ID NO: 16122 - protein, 15 aa, Homo sapiens
  Heavy chain CDR3 for antibody 8061 (IGHV3-33)
ARDRVGVKDYYSMDV

SEQ ID NO: 16123 - protein, 9 aa, Homo sapiens
  Light chain CDR3 for antibody 8062 (IGKV1-16)
QQYSRYPYT

SEQ ID NO: 16124 - protein, 16 aa, Homo sapiens
  Heavy chain CDR3 for antibody 8062 (IGHV3-33)
ARAVYYGSGSSLIMDV

SEQ ID NO: 16125 - protein, 9 aa, Homo sapiens
  Light chain CDR3 for antibody 8063 (IGKV1-6)
LQDFHYPWT

SEQ ID NO: 16126 - protein, 10 aa, Homo sapiens
  Heavy chain CDR3 for antibody 8063 (IGHV3-33)
ARENSTPLDY

SEQ ID NO: 16127 - protein, 9 aa, Homo sapiens
  Light chain CDR3 for antibody 8064 (IGKV1-33)
QQYDNLPFT

SEQ ID NO: 16128 - protein, 13 aa, Homo sapiens
  Heavy chain CDR3 for antibody 8064 (IGHV3-33)
ARKAYGDYFYFDY

SEQ ID NO: 16129 - protein, 9 aa, Homo sapiens
  Light chain CDR3 for antibody 8065 (IGKV1-9)
QQLNTYPWT

SEQ ID NO: 16130 - protein, 12 aa, Homo sapiens
  Heavy chain CDR3 for antibody 8065 (IGHV3-33)
ARDRAYRGSLDY

SEQ ID NO: 16131 - protein, 9 aa, Homo sapiens
  Light chain CDR3 for antibody 8066 (IGKV1-33)
QQYDNLPFT

SEQ ID NO: 16132 - protein, 23 aa, Homo sapiens
  Heavy chain CDR3 for antibody 8066 (IGHV3-11)
ARDEGVTMVRGVISYYYYYGMDV

SEQ ID NO: 16133 - protein, 9 aa, Homo sapiens
  Light chain CDR3 for antibody 8067 (IGKV1-6)
LQDYKSPFT

SEQ ID NO: 16134 - protein, 10 aa, Homo sapiens
  Heavy chain CDR3 for antibody 8067 (IGHV3-30)
AREWYGGMDV

SEQ ID NO: 16135 - protein, 9 aa, Homo sapiens
  Light chain CDR3 for antibody 8068 (IGKV3D-20)
QQYGSSPWT

SEQ ID NO: 16136 - protein, 14 aa, Homo sapiens
  Heavy chain CDR3 for antibody 8068 (IGHV3-23)
AKDDIVRATGAFDI

SEQ ID NO: 16137 - protein, 9 aa, Homo sapiens
  Light chain CDR3 for antibody 8069 (IGKV3D-7)
QQDYNLPLT

SEQ ID NO: 16138 - protein, 8 aa, Homo sapiens
  Heavy chain CDR3 for antibody 8069 (IGHV3-33)
ARDRGFDY

SEQ ID NO: 16139 - protein, 9 aa, Homo sapiens
  Light chain CDR3 for antibody 8070 (IGKV1-17)
QQYNSYPRT

SEQ ID NO: 16140 - protein, 17 aa, Homo sapiens
  Heavy chain CDR3 for antibody 8070 (IGHV3-33)
TRDSGMVRGIIIYGMDV

SEQ ID NO: 16141 - protein, 10 aa, Homo sapiens
  Light chain CDR3 for antibody 8071 (IGKV1-17)
LQHNSYPMYT

SEQ ID NO: 16142 - protein, 17 aa, Homo sapiens
  Heavy chain CDR3 for antibody 8071 (IGHV4-34)
AGLRFFDWLFDYYGMDV

SEQ ID NO: 16143 - protein, 10 aa, Homo sapiens
  Light chain CDR3 for antibody 8072 (IGKV1-17)
LQHNSYPMYT

SEQ ID NO: 16144 - protein, 20 aa, Homo sapiens
  Heavy chain CDR3 for antibody 8072 (IGHV3-33)
ARDLCSSTSCYGYYYYGMDV

SEQ ID NO: 16145 - protein, 9 aa, Homo sapiens
  Light chain CDR3 for antibody 8073 (IGKV1-6)
LQDYNHPFT

SEQ ID NO: 16146 - protein, 14 aa, Homo sapiens
  Heavy chain CDR3 for antibody 8073 (IGHV3-20)
ARDGGSSSFDWFDP

SEQ ID NO: 16147 - protein, 9 aa, Homo sapiens
  Light chain CDR3 for antibody 8074 (IGKV1-39)
QQSYSTPLT

SEQ ID NO: 16148 - protein, 17 aa, Homo sapiens
  Heavy chain CDR3 for antibody 8074 (IGHV3-33)
ARDQDDILTGYYWYFDL

SEQ ID NO: 16149 - protein, 9 aa, Homo sapiens
  Light chain CDR3 for antibody 8075 (IGKV2-30)
MQGTHWPLT

SEQ ID NO: 16150 - protein, 14 aa, Homo sapiens
  Heavy chain CDR3 for antibody 8075 (IGHV3-33)
ARDLNYDILNGGGY

SEQ ID NO: 16151 - protein, 9 aa, Homo sapiens
  Light chain CDR3 for antibody 8076 (IGKV4-1)
QQYYSTPYT

SEQ ID NO: 16152 - protein, 17 aa, Homo sapiens
  Heavy chain CDR3 for antibody 8076 (IGHV1-18)
ARDRAFTMVRGVPPFDC

SEQ ID NO: 16153 - protein, 9 aa, Homo sapiens
  Light chain CDR3 for antibody 8077 (IGKV3D-20)
QQYGSSPFT

SEQ ID NO: 16154 - protein, 14 aa, Homo sapiens
  Heavy chain CDR3 for antibody 8077 (IGHV4-39)
ARDLDIMATSPFAY

SEQ ID NO: 16155 - protein, 9 aa, Homo sapiens
  Light chain CDR3 for antibody 8078 (IGKV1-17)
LQHNSYPWT

SEQ ID NO: 16156 - protein, 17 aa, Homo sapiens
  Heavy chain CDR3 for antibody 8078 (IGHV3-33)
ARGEQWLGYYYYYGMDV

SEQ ID NO: 16157 - protein, 9 aa, Homo sapiens
  Light chain CDR3 for antibody 8079 (IGKV3D-20)
QQHGNSPLT

SEQ ID NO: 16158 - protein, 12 aa, Homo sapiens
  Heavy chain CDR3 for antibody 8079 (IGHV4-59)
ARDRSGWAYFDY

SEQ ID NO: 16159 - protein, 9 aa, Homo sapiens
  Light chain CDR3 for antibody 8080 (IGKV3-20)
QQYGRSPYT

SEQ ID NO: 16160 - protein, 18 aa, Homo sapiens
  Heavy chain CDR3 for antibody 8080 (IGHV1-46)
ARDGDYVWGSDRSDWFDP

SEQ ID NO: 16161 - protein, 9 aa, Homo sapiens
  Light chain CDR3 for antibody 8081 (IGKV3-20)
QQYGSSPYT

SEQ ID NO: 16162 - protein, 12 aa, Homo sapiens
  Heavy chain CDR3 for antibody 8081 (IGHV1-18)
ARLGGFGEFPDC

SEQ ID NO: 16163 - protein, 9 aa, Homo sapiens
  Light chain CDR3 for antibody 8082 (IGKV1D-16)
QQYNSYPYT

SEQ ID NO: 16164 - protein, 13 aa, Homo sapiens
  Heavy chain CDR3 for antibody 8082 (IGHV4-61)
ARDGSSSGWDFDY

SEQ ID NO: 16165 - protein, 9 aa, Homo sapiens
  Light chain CDR3 for antibody 8083 (IGKV3-15)
QQYNNWPRT

SEQ ID NO: 16166 - protein, 14 aa, Homo sapiens
  Heavy chain CDR3 for antibody 8083 (IGHV3-11)
ARRGSPLRPSHLDV

SEQ ID NO: 16167 - protein, 9 aa, Homo sapiens
  Light chain CDR3 for antibody 8084 (IGKV6-21)
QQSYSLPFT

SEQ ID NO: 16168 - protein, 8 aa, Homo sapiens
  Heavy chain CDR3 for antibody 8084 (IGHV3-23)
AKETGINY

SEQ ID NO: 16169 - protein, 8 aa, Homo sapiens
  Light chain CDR3 for antibody 8085 (IGKV3-20)
QQYGSSRT

SEQ ID NO: 16170 - protein, 14 aa, Homo sapiens
  Heavy chain CDR3 for antibody 8085 (IGHV3-33)
ARDRIAAASSDFDC

SEQ ID NO: 16171 - protein, 9 aa, Homo sapiens
  Light chain CDR3 for antibody 8086 (IGKV1D-13)
QQFNNYPYT

SEQ ID NO: 16172 - protein, 13 aa, Homo sapiens
  Heavy chain CDR3 for antibody 8086 (IGHV3-33)
ARTDYYYYYGMDV

SEQ ID NO: 16173 - protein, 9 aa, Homo sapiens
  Light chain CDR3 for antibody 8087 (IGKV3-15)
QQYHDWPLT

SEQ ID NO: 16174 - protein, 18 aa, Homo sapiens
  Heavy chain CDR3 for antibody 8087 (IGHV1-46)
ARDGDYVWGSYRSDWFDP

SEQ ID NO: 16175 - protein, 10 aa, Homo sapiens
  Light chain CDR3 for antibody 8088 (IGKV3-11)
QQRSNWPAYT

SEQ ID NO: 16176 - protein, 18 aa, Homo sapiens
  Heavy chain CDR3 for antibody 8088 (IGHV1-8)
ARSRIAAAGIYYYYGMDV

SEQ ID NO: 16177 - protein, 9 aa, Homo sapiens
  Light chain CDR3 for antibody 8089 (IGKV1D-13)
QQFNNYPST

SEQ ID NO: 16178 - protein, 9 aa, Homo sapiens
  Heavy chain CDR3 for antibody 8089 (IGHV3-33)
AANSYGLDY

SEQ ID NO: 16179 - protein, 9 aa, Homo sapiens
  Light chain CDR3 for antibody 8090 (IGKV3-11)
QQRSNWPPT

SEQ ID NO: 16180 - protein, 13 aa, Homo sapiens
  Heavy chain CDR3 for antibody 8090 (IGHV3-66)
ANTGDSYYYGFYV

SEQ ID NO: 16181 - protein, 9 aa, Homo sapiens
  Light chain CDR3 for antibody 8091 (IGKV1-16)
QKYNSNPLT

SEQ ID NO: 16182 - protein, 15 aa, Homo sapiens
  Heavy chain CDR3 for antibody 8091 (IGHV3-33)
ASRDILTGSYWYFDL

SEQ ID NO: 16183 - protein, 9 aa, Homo sapiens
  Light chain CDR3 for antibody 8092 (IGKV1-39)
QQSYSTPFT

SEQ ID NO: 16184 - protein, 12 aa, Homo sapiens
  Heavy chain CDR3 for antibody 8092 (IGHV4-59)
ARDFLVRGVIDY

SEQ ID NO: 16185 - protein, 8 aa, Homo sapiens
  Light chain CDR3 for antibody 8093 (IGKV3D-7)
QQDYNLLT

SEQ ID NO: 16186 - protein, 15 aa, Homo sapiens
  Heavy chain CDR3 for antibody 8093 (IGHV1-24)
ATHWDLRYYYYGMDV

SEQ ID NO: 16187 - protein, 8 aa, Homo sapiens
  Light chain CDR3 for antibody 8094 (IGKV3D-7)
QQDYNLLT

SEQ ID NO: 16188 - protein, 11 aa, Homo sapiens
  Heavy chain CDR3 for antibody 8094 (IGHV4-59)
ARDRGHYGMDV

SEQ ID NO: 16189 - protein, 10 aa, Homo sapiens
  Light chain CDR3 for antibody 8095 (IGKV1-17)
LQHNSYPIFT

SEQ ID NO: 16190 - protein, 13 aa, Homo sapiens
  Heavy chain CDR3 for antibody 8095 (IGHV3-23)
ARAFFMVRGVIDF

SEQ ID NO: 16191 - protein, 9 aa, Homo sapiens
  Light chain CDR3 for antibody 8096 (IGKV1D-16)
QQYNSYPYT

SEQ ID NO: 16192 - protein, 10 aa, Homo sapiens
  Heavy chain CDR3 for antibody 8096 (IGHV3-33)
ARDPWIYSGY

SEQ ID NO: 16193 - protein, 9 aa, Homo sapiens
  Light chain CDR3 for antibody 8097 (IGKV2-30)
MQGTHWPLT

SEQ ID NO: 16194 - protein, 10 aa, Homo sapiens
  Heavy chain CDR3 for antibody 8097 (IGHV3-30)
ARDGLESFDY

SEQ ID NO: 16195 - protein, 8 aa, Homo sapiens
  Light chain CDR3 for antibody 8098 (IGKV1D-13)
QQFNNYPT

SEQ ID NO: 16196 - protein, 11 aa, Homo sapiens
  Heavy chain CDR3 for antibody 8098 (IGHV3-23)
AKAGIVGCLDV

SEQ ID NO: 16197 - protein, 9 aa, Homo sapiens
  Light chain CDR3 for antibody 8099 (IGKV1-17)
LQHNSYPYT

SEQ ID NO: 16198 - protein, 15 aa, Homo sapiens
  Heavy chain CDR3 for antibody 8099 (IGHV4-39)
ARHSGYSSGWYPFDY

SEQ ID NO: 16199 - protein, 8 aa, Homo sapiens
  Light chain CDR3 for antibody 8100 (IGKV3D-7)
QQDYNLLT

SEQ ID NO: 16200 - protein, 8 aa, Homo sapiens
  Heavy chain CDR3 for antibody 8100 (IGHV3-23)
AKESLLDY

SEQ ID NO: 16201 - protein, 9 aa, Homo sapiens
  Light chain CDR3 for antibody 8101 (IGKV1-6)
LQDYNYPWT

SEQ ID NO: 16202 - protein, 15 aa, Homo sapiens
  Heavy chain CDR3 for antibody 8101 (IGHV3-23)
AKEALRYFDWSGMDV

SEQ ID NO: 16203 - protein, 9 aa, Homo sapiens
  Light chain CDR3 for antibody 8102 (IGKV3-20)
QQYGSSPRT

SEQ ID NO: 16204 - protein, 18 aa, Homo sapiens
  Heavy chain CDR3 for antibody 8102 (IGHV3-33)
ARDGYYGSGSFYYYGMDV

SEQ ID NO: 16205 - protein, 9 aa, Homo sapiens
  Light chain CDR3 for antibody 8103 (IGKV1-17)
LQHNSYPYT

SEQ ID NO: 16206 - protein, 16 aa, Homo sapiens
  Heavy chain CDR3 for antibody 8103 (IGHV3-66)
ARAYTYGSGSFPYFDY

SEQ ID NO: 16207 - protein, 9 aa, Homo sapiens
  Light chain CDR3 for antibody 8104 (IGKV1-9)
QQLNRYPWT

SEQ ID NO: 16208 - protein, 15 aa, Homo sapiens
  Heavy chain CDR3 for antibody 8104 (IGHV4-39)
ARRDYDILTGYLFDY

SEQ ID NO: 16209 - protein, 9 aa, Homo sapiens
  Light chain CDR3 for antibody 8105 (IGKV1-17)
LHSNNYPWT

SEQ ID NO: 16210 - protein, 14 aa, Homo sapiens
  Heavy chain CDR3 for antibody 8105 (IGHV3-33)
ARASSGSSYWYFDL

SEQ ID NO: 16211 - protein, 9 aa, Homo sapiens
  Light chain CDR3 for antibody 8106 (IGKV3-15)
QQYNNWPLT

SEQ ID NO: 16212 - protein, 15 aa, Homo sapiens
  Heavy chain CDR3 for antibody 8106 (IGHV3-33)
AKDRNSGYDWGGFDY

SEQ ID NO: 16213 - protein, 9 aa, Homo sapiens
  Light chain CDR3 for antibody 8107 (IGKV1-17)
LQHNSYPIT

SEQ ID NO: 16214 - protein, 16 aa, Homo sapiens
  Heavy chain CDR3 for antibody 8107 (IGHV4-39)
ARRGVLVVTAIPGFDY

SEQ ID NO: 16215 - protein, 9 aa, Homo sapiens
  Light chain CDR3 for antibody 8108 (IGKV3D-7)
QQDYNLPYS

SEQ ID NO: 16216 - protein, 20 aa, Homo sapiens
  Heavy chain CDR3 for antibody 8108 (IGHV1-f)
ATHYDILTGSPYYYYCALDV

SEQ ID NO: 16217 - protein, 9 aa, Homo sapiens
  Light chain CDR3 for antibody 8109 (IGKV2-30)
MQGTHWPLT

SEQ ID NO: 16218 - protein, 17 aa, Homo sapiens
  Heavy chain CDR3 for antibody 8109 (IGHV4-59)
ARRITMVREIIITAFDY

SEQ ID NO: 16219 - protein, 9 aa, Homo sapiens
  Light chain CDR3 for antibody 8110 (IGKV1-9)
QQYNSYPYT

SEQ ID NO: 16220 - protein, 13 aa, Homo sapiens
  Heavy chain CDR3 for antibody 8110 (IGHV3-33)
ARRGSGSPDGFDI

SEQ ID NO: 16221 - protein, 9 aa, Homo sapiens
  Light chain CDR3 for antibody 8111 (IGKV1-39)
QQSYSTPYT

SEQ ID NO: 16222 - protein, 20 aa, Homo sapiens
  Heavy chain CDR3 for antibody 8111 (IGHV3-23)
AKDRETGTTSYHYYYYGMDV

SEQ ID NO: 16223 - protein, 10 aa, Homo sapiens
  Light chain CDR3 for antibody 8112 (IGKV1-39)
QQSYSTPMYT

SEQ ID NO: 16224 - protein, 14 aa, Homo sapiens
  Heavy chain CDR3 for antibody 8112 (IGHV3-33)
ARDLNYDILNGGGY

SEQ ID NO: 16225 - protein, 9 aa, Homo sapiens
  Light chain CDR3 for antibody 8113 (IGKV6-21)
HQSSSLPLT

SEQ ID NO: 16226 - protein, 14 aa, Homo sapiens
  Heavy chain CDR3 for antibody 8113 (IGHV3-33)
ARDNILTVYYLLDY

SEQ ID NO: 16227 - protein, 9 aa, Homo sapiens
  Light chain CDR3 for antibody 8114 (IGKV3-15)
QQYNNWPLT

SEQ ID NO: 16228 - protein, 11 aa, Homo sapiens
  Heavy chain CDR3 for antibody 8114 (IGHV1-24)
ATYFGSGSLDY

SEQ ID NO: 16229 - protein, 9 aa, Homo sapiens
  Light chain CDR3 for antibody 8115 (IGKV1-17)
LQHNSYPPT

SEQ ID NO: 16230 - protein, 12 aa, Homo sapiens
  Heavy chain CDR3 for antibody 8115 (IGHV1-46)
ARGLTGDHASDT

SEQ ID NO: 16231 - protein, 9 aa, Homo sapiens
  Light chain CDR3 for antibody 8116 (IGKV2D-28)
MQALQTPWT

SEQ ID NO: 16232 - protein, 18 aa, Homo sapiens
  Heavy chain CDR3 for antibody 8116 (IGHV3-33)
ARDGYSGYDYYYYYGMDV

SEQ ID NO: 16233 - protein, 9 aa, Homo sapiens
  Light chain CDR3 for antibody 8117 (IGKV1-9)
QQLNGYPFT

SEQ ID NO: 16234 - protein, 11 aa, Homo sapiens
  Heavy chain CDR3 for antibody 8117 (IGHV4-28)
ARDILTGFLDH

SEQ ID NO: 16235 - protein, 9 aa, Homo sapiens
  Light chain CDR3 for antibody 8118 (IGKV2-30)
MQGTHWPLT

SEQ ID NO: 16236 - protein, 17 aa, Homo sapiens
  Heavy chain CDR3 for antibody 8118 (IGHV4-59)
AREGADSGIYYHWYFDL

SEQ ID NO: 16237 - protein, 9 aa, Homo sapiens
  Light chain CDR3 for antibody 8119 (IGKV1-6)
LQDYNYPYT

SEQ ID NO: 16238 - protein, 12 aa, Homo sapiens
  Heavy chain CDR3 for antibody 8119 (IGHV4-34)
ASNFYYYYGMDV

SEQ ID NO: 16239 - protein, 9 aa, Homo sapiens
  Light chain CDR3 for antibody 8120 (IGKV3D-20)
QQYGNSPRT

SEQ ID NO: 16240 - protein, 12 aa, Homo sapiens
  Heavy chain CDR3 for antibody 8120 (IGHV3-13)
VREAGIPDAFDI

SEQ ID NO: 16241 - protein, 9 aa, Homo sapiens
  Light chain CDR3 for antibody 8121 (IGKV1-9)
QQLISYPLT

SEQ ID NO: 16242 - protein, 12 aa, Homo sapiens
  Heavy chain CDR3 for antibody 8121 (IGHV3-33)
ARDSSGWSHFDY

SEQ ID NO: 16243 - protein, 8 aa, Homo sapiens
  Light chain CDR3 for antibody 8122 (IGKV1-13)
QQYNSYST

SEQ ID NO: 16244 - protein, 14 aa, Homo sapiens
  Heavy chain CDR3 for antibody 8122 (IGHV1-46)
ARSYYDILTGAFDI

SEQ ID NO: 16245 - protein, 8 aa, Homo sapiens
  Light chain CDR3 for antibody 8123 (IGKV3-11)
QQRSNWLT

SEQ ID NO: 16246 - protein, 14 aa, Homo sapiens
  Heavy chain CDR3 for antibody 8123 (IGHV3-33)
ARAISGSSYWYFDL

SEQ ID NO: 16247 - protein, 10 aa, Homo sapiens
  Light chain CDR3 for antibody 8124 (IGKV3-11)
QQRSNWPIFT

SEQ ID NO: 16248 - protein, 15 aa, Homo sapiens
  Heavy chain CDR3 for antibody 8124 (IGHV3-33)
ARDRGMVRGDGYLDY

SEQ ID NO: 16249 - protein, 8 aa, Homo sapiens
  Light chain CDR3 for antibody 8125 (IGKV3D-7)
QQDYNLLT

SEQ ID NO: 16250 - protein, 18 aa, Homo sapiens
  Heavy chain CDR3 for antibody 8125 (IGHV1-8)
AREGAAAGSYYYYNGMDV

SEQ ID NO: 16251 - protein, 9 aa, Homo sapiens
  Light chain CDR3 for antibody 8126 (IGKV1D-13)
QQFNNYPHT

SEQ ID NO: 16252 - protein, 13 aa, Homo sapiens
  Heavy chain CDR3 for antibody 8126 (IGHV3-33)
ARDEGYSGYNLDN

SEQ ID NO: 16253 - protein, 9 aa, Homo sapiens
  Light chain CDR3 for antibody 8127 (IGKV6-21)
HQSSSLPLT

SEQ ID NO: 16254 - protein, 14 aa, Homo sapiens
  Heavy chain CDR3 for antibody 8127 (IGHV1-2)
AREGGSGSSPGMDV

SEQ ID NO: 16255 - protein, 9 aa, Homo sapiens
  Light chain CDR3 for antibody 8128 (IGKV3-20)
QQYGSSPRT

SEQ ID NO: 16256 - protein, 13 aa, Homo sapiens
  Heavy chain CDR3 for antibody 8128 (IGHV3-66)
ARDQRYSSGWYEY

SEQ ID NO: 16257 - protein, 9 aa, Homo sapiens
  Light chain CDR3 for antibody 8129 (IGKV1-6)
LQDYNHPFT

SEQ ID NO: 16258 - protein, 9 aa, Homo sapiens
  Heavy chain CDR3 for antibody 8129 (IGHV3-33)
ARDRCYFDL

SEQ ID NO: 16259 - protein, 10 aa, Homo sapiens
  Light chain CDR3 for antibody 8130 (IGKV1-17)
LQHNSYPMYT

SEQ ID NO: 16260 - protein, 14 aa, Homo sapiens
  Heavy chain CDR3 for antibody 8130 (IGHV1-46)
ARRGIVGALDAFDI

SEQ ID NO: 16261 - protein, 9 aa, Homo sapiens
  Light chain CDR3 for antibody 8131 (IGKV2-30)
MQGTHWPLT

SEQ ID NO: 16262 - protein, 9 aa, Homo sapiens
  Heavy chain CDR3 for antibody 8131 (IGHV4-59)
AGGSWDFDY

SEQ ID NO: 16263 - protein, 9 aa, Homo sapiens
  Light chain CDR3 for antibody 8132 (IGKV3-20)
QQYGSSPLT

SEQ ID NO: 16264 - protein, 11 aa, Homo sapiens
  Heavy chain CDR3 for antibody 8132 (IGHV4-59)
ARDRGHYGMDV

SEQ ID NO: 16265 - protein, 9 aa, Homo sapiens
  Light chain CDR3 for antibody 8133 (IGKV4-1)
QQYYTTPPT

SEQ ID NO: 16266 - protein, 14 aa, Homo sapiens
  Heavy chain CDR3 for antibody 8133 (IGHV3-33)
ARDKTYPLSYGMDV

SEQ ID NO: 16267 - protein, 9 aa, Homo sapiens
  Light chain CDR3 for antibody 8134 (IGKV1-33)
QQYDNLPFT

SEQ ID NO: 16268 - protein, 13 aa, Homo sapiens
  Heavy chain CDR3 for antibody 8134 (IGHV4-39)
ARHPPSRDYGMDV

SEQ ID NO: 16269 - protein, 9 aa, Homo sapiens
  Light chain CDR3 for antibody 8135 (IGKV1-9)
QQLKSYLYT

SEQ ID NO: 16270 - protein, 7 aa, Homo sapiens
  Heavy chain CDR3 for antibody 8135 (IGHV1-46)
AREGGDY

SEQ ID NO: 16271 - protein, 9 aa, Homo sapiens
  Light chain CDR3 for antibody 8136 (IGKV1-16)
QHYNDYPFT

SEQ ID NO: 16272 - protein, 13 aa, Homo sapiens
  Heavy chain CDR3 for antibody 8136 (IGHV3-33)
ARDQRYSSGWYDY

SEQ ID NO: 16273 - protein, 10 aa, Homo sapiens
  Light chain CDR3 for antibody 8137 (IGKV3-15)
QQYNNWPPYT

SEQ ID NO: 16274 - protein, 14 aa, Homo sapiens
  Heavy chain CDR3 for antibody 8137 (IGHV3-33)
ARDRIAAASSDFDC

SEQ ID NO: 16275 - protein, 8 aa, Homo sapiens
  Light chain CDR3 for antibody 8138 (IGKV3D-7)
QQDYNLPT

SEQ ID NO: 16276 - protein, 12 aa, Homo sapiens
  Heavy chain CDR3 for antibody 8138 (IGHV4-39)
ARREVILGAFDY

SEQ ID NO: 16277 - protein, 9 aa, Homo sapiens
  Light chain CDR3 for antibody 8139 (IGKV1D-16)
QQYNSYPLT

SEQ ID NO: 16278 - protein, 19 aa, Homo sapiens
  Heavy chain CDR3 for antibody 8139 (IGHV1-24)
ATAGLQWFGEKVGYYGVDV

SEQ ID NO: 16279 - protein, 9 aa, Homo sapiens
  Light chain CDR3 for antibody 8140 (IGKV1D-13)
QQFNNYMYT

SEQ ID NO: 16280 - protein, 12 aa, Homo sapiens
  Heavy chain CDR3 for antibody 8140 (IGHV3-33)
ARKGYDMHAFDI

SEQ ID NO: 16281 - protein, 8 aa, Homo sapiens
  Light chain CDR3 for antibody 8141 (IGKV1-5)
QQYNSYWT

SEQ ID NO: 16282 - protein, 13 aa, Homo sapiens
  Heavy chain CDR3 for antibody 8141 (IGHV3-33)
ARTDYYFYYGLDV

SEQ ID NO: 16283 - protein, 9 aa, Homo sapiens
  Light chain CDR3 for antibody 8142 (IGKV6-21)
HQSSSLPLT

SEQ ID NO: 16284 - protein, 13 aa, Homo sapiens
  Heavy chain CDR3 for antibody 8142 (IGHV3-33)
ARGTVASIGGLDY

SEQ ID NO: 16285 - protein, 9 aa, Homo sapiens
  Light chain CDR3 for antibody 8143 (IGKV1-17)
LQHNSYPYT

SEQ ID NO: 16286 - protein, 9 aa, Homo sapiens
  Heavy chain CDR3 for antibody 8143 (IGHV4-59)
ARSGSGIYT

SEQ ID NO: 16287 - protein, 9 aa, Homo sapiens
  Light chain CDR3 for antibody 8144 (IGKV1-33)
QQYDNLPFT

SEQ ID NO: 16288 - protein, 17 aa, Homo sapiens
  Heavy chain CDR3 for antibody 8144 (IGHV3-33)
ARGGAAAGPYLYYGLDV

SEQ ID NO: 16289 - protein, 9 aa, Homo sapiens
  Light chain CDR3 for antibody 8145 (IGKV3-11)
QQRSNWPYT

SEQ ID NO: 16290 - protein, 14 aa, Homo sapiens
  Heavy chain CDR3 for antibody 8145 (IGHV3-23)
ARDGIVRATDAFAI

SEQ ID NO: 16291 - protein, 10 aa, Homo sapiens
  Light chain CDR3 for antibody 8146 (IGKV3-11)
QQRSNWPAYT

SEQ ID NO: 16292 - protein, 12 aa, Homo sapiens
  Heavy chain CDR3 for antibody 8146 (IGHV3-33)
VRKWFGELYFDY

SEQ ID NO: 16293 - protein, 9 aa, Homo sapiens
  Light chain CDR3 for antibody 8147 (IGKV1-17)
LHSNNYPWT

SEQ ID NO: 16294 - protein, 18 aa, Homo sapiens
  Heavy chain CDR3 for antibody 8147 (IGHV3-23)
AKEGNYYGSGSYWGYFDP

SEQ ID NO: 16295 - protein, 9 aa, Homo sapiens
  Light chain CDR3 for antibody 8148 (IGKV1-39)
QQSYSTPFT

SEQ ID NO: 16296 - protein, 16 aa, Homo sapiens
  Heavy chain CDR3 for antibody 8148 (IGHV1-24)
ATEDSSSYYYYYGMDV

SEQ ID NO: 16297 - protein, 10 aa, Homo sapiens
  Light chain CDR3 for antibody 8149 (IGKV3-11)
QQRSTWPTLT

SEQ ID NO: 16298 - protein, 13 aa, Homo sapiens
  Heavy chain CDR3 for antibody 8149 (IGHV3-11)
ARDGGAAAGTWDS

SEQ ID NO: 16299 - protein, 9 aa, Homo sapiens
  Light chain CDR3 for antibody 8150 (IGKV3D-7)
QQDYNLPYT

SEQ ID NO: 16300 - protein, 16 aa, Homo sapiens
  Heavy chain CDR3 for antibody 8150 (IGHV3-33)
AREGGLIAAAGTGFDY

SEQ ID NO: 16301 - protein, 9 aa, Homo sapiens
  Light chain CDR3 for antibody 8151 (IGKV1-16)
QHYNDYPFT

SEQ ID NO: 16302 - protein, 8 aa, Homo sapiens
  Heavy chain CDR3 for antibody 8151 (IGHV3-23)
AKETGNNY

SEQ ID NO: 16303 - protein, 9 aa, Homo sapiens
  Light chain CDR3 for antibody 8152 (IGKV6-21)
HQSSSLPYT

SEQ ID NO: 16304 - protein, 16 aa, Homo sapiens
  Heavy chain CDR3 for antibody 8152 (IGHV3-33)
AREMAGSYYYYYGMDV

SEQ ID NO: 16305 - protein, 10 aa, Homo sapiens
  Light chain CDR3 for antibody 8153 (IGKV1-6)
LQDYNYPMYT

SEQ ID NO: 16306 - protein, 13 aa, Homo sapiens
  Heavy chain CDR3 for antibody 8153 (IGHV3-33)
ASTGDSYYYGMDV

SEQ ID NO: 16307 - protein, 9 aa, Homo sapiens
  Light chain CDR3 for antibody 8154 (IGKV1-39)
QQSYSTPLT

SEQ ID NO: 16308 - protein, 18 aa, Homo sapiens
  Heavy chain CDR3 for antibody 8154 (IGHV3-33)
ARAGYYGSGSYYYYGMDV

SEQ ID NO: 16309 - protein, 9 aa, Homo sapiens
  Light chain CDR3 for antibody 8155 (IGKV1-17)
LQHNSYPYT

SEQ ID NO: 16310 - protein, 15 aa, Homo sapiens
  Heavy chain CDR3 for antibody 8155 (IGHV4-59)
ARDLGYYGSGSPLAY

SEQ ID NO: 16311 - protein, 9 aa, Homo sapiens
  Light chain CDR3 for antibody 8156 (IGKV3D-7)
QQDYNLPLT

SEQ ID NO: 16312 - protein, 18 aa, Homo sapiens
  Heavy chain CDR3 for antibody 8156 (IGHV3-33)
ARDEYYGSGIYYNYGMDV

SEQ ID NO: 16313 - protein, 8 aa, Homo sapiens
  Light chain CDR3 for antibody 8157 (IGKV1D-13)
QQFNNYPT

SEQ ID NO: 16314 - protein, 15 aa, Homo sapiens
  Heavy chain CDR3 for antibody 8157 (IGHV3-33)
ARRSILTGSYWYFDL

SEQ ID NO: 16315 - protein, 8 aa, Homo sapiens
  Light chain CDR3 for antibody 8158 (IGKV3-11)
QQRSNWLT

SEQ ID NO: 16316 - protein, 14 aa, Homo sapiens
  Heavy chain CDR3 for antibody 8158 (IGHV3-33)
AREDYYGPLNWFDP

SEQ ID NO: 16317 - protein, 9 aa, Homo sapiens
  Light chain CDR3 for antibody 8159 (IGKV1-6)
LQDYKSPFT

SEQ ID NO: 16318 - protein, 11 aa, Homo sapiens
  Heavy chain CDR3 for antibody 8159 (IGHV3-33)
ARDRVLTPFDY

SEQ ID NO: 16319 - protein, 9 aa, Homo sapiens
  Light chain CDR3 for antibody 8160 (IGKV3-11)
QQRSNWPPT

SEQ ID NO: 16320 - protein, 11 aa, Homo sapiens
  Heavy chain CDR3 for antibody 8160 (IGHV3-33)
ARAGIAALFDY

SEQ ID NO: 16321 - protein, 8 aa, Homo sapiens
  Light chain CDR3 for antibody 8161 (IGKV3-11)
LQRGNWPT

SEQ ID NO: 16322 - protein, 12 aa, Homo sapiens
  Heavy chain CDR3 for antibody 8161 (IGHV3-33)
TRGYSSKSYFDY

SEQ ID NO: 16323 - protein, 10 aa, Homo sapiens
  Light chain CDR3 for antibody 8162 (IGKV1-39)
QQSYSTPMYT

SEQ ID NO: 16324 - protein, 17 aa, Homo sapiens
  Heavy chain CDR3 for antibody 8162 (IGHV3-33)
ARQGVLLWFGELYYFDY

SEQ ID NO: 16325 - protein, 9 aa, Homo sapiens
  Light chain CDR3 for antibody 8163 (IGKV3D-7)
QQDYNLPLT

SEQ ID NO: 16326 - protein, 17 aa, Homo sapiens
  Heavy chain CDR3 for antibody 8163 (IGHV4-34)
ARDGSGSYTHYYYGMDV

SEQ ID NO: 16327 - protein, 9 aa, Homo sapiens
  Light chain CDR3 for antibody 8164 (IGKV1-16)
QQYDSYPPT

SEQ ID NO: 16328 - protein, 11 aa, Homo sapiens
  Heavy chain CDR3 for antibody 8164 (IGHV4-59)
ARSIRYSVFDY

SEQ ID NO: 16329 - protein, 9 aa, Homo sapiens
  Light chain CDR3 for antibody 8165 (IGKV3-11)
QQRINWPWT

SEQ ID NO: 16330 - protein, 8 aa, Homo sapiens
  Heavy chain CDR3 for antibody 8165 (IGHV3-23)
AETFLFDY

SEQ ID NO: 16331 - protein, 9 aa, Homo sapiens
  Light chain CDR3 for antibody 8166 (IGKV1-6)
LQDFHYPWT

SEQ ID NO: 16332 - protein, 16 aa, Homo sapiens
  Heavy chain CDR3 for antibody 8166 (IGHV4-59)
ARDTPYYSGSGRPFDS

SEQ ID NO: 16333 - protein, 8 aa, Homo sapiens
  Light chain CDR3 for antibody 8167 (IGKV1-5)
QQYNSYWT

SEQ ID NO: 16334 - protein, 12 aa, Homo sapiens
  Heavy chain CDR3 for antibody 8167 (IGHV3-23)
AKEYDILTGYFH

SEQ ID NO: 16335 - protein, 9 aa, Homo sapiens
  Light chain CDR3 for antibody 8168 (IGKV1-39)
QQSYSTPYT

SEQ ID NO: 16336 - protein, 12 aa, Homo sapiens
  Heavy chain CDR3 for antibody 8168 (IGHV4-34)
ARGYSSSWYFDY

SEQ ID NO: 16337 - protein, 10 aa, Homo sapiens
  Light chain CDR3 for antibody 8169 (IGKV1-17)
LQHNSYPMYT

SEQ ID NO: 16338 - protein, 19 aa, Homo sapiens
  Heavy chain CDR3 for antibody 8169 (IGHV3-33)
ARGPYYDILTGYGYYGMDV

SEQ ID NO: 16339 - protein, 8 aa, Homo sapiens
  Light chain CDR3 for antibody 8170 (IGKV6-21)
HQSSSLPT

SEQ ID NO: 16340 - protein, 13 aa, Homo sapiens
  Heavy chain CDR3 for antibody 8170 (IGHV3-23)
ASPFNWNDGFFDY

SEQ ID NO: 16341 - protein, 9 aa, Homo sapiens
  Light chain CDR3 for antibody 8171 (IGKV3-15)
QQYNNWPLT

SEQ ID NO: 16342 - protein, 13 aa, Homo sapiens
  Heavy chain CDR3 for antibody 8171 (IGHV3-33)
ANTGDSYYYDMDV

SEQ ID NO: 16343 - protein, 9 aa, Homo sapiens
  Light chain CDR3 for antibody 8172 (IGKV3-11)
QQRSNWPWT

SEQ ID NO: 16344 - protein, 13 aa, Homo sapiens
  Heavy chain CDR3 for antibody 8172 (IGHV4-39)
ARHHYGSGSLRDY

SEQ ID NO: 16345 - protein, 8 aa, Homo sapiens
  Light chain CDR3 for antibody 8173 (IGKV1D-13)
QQFNNYYT

SEQ ID NO: 16346 - protein, 12 aa, Homo sapiens
  Heavy chain CDR3 for antibody 8173 (IGHV3-33)
ARDPGYYYGLDV

SEQ ID NO: 16347 - protein, 9 aa, Homo sapiens
  Light chain CDR3 for antibody 8174 (IGKV1-16)
QHYNDYPFT

SEQ ID NO: 16348 - protein, 11 aa, Homo sapiens
  Heavy chain CDR3 for antibody 8174 (IGHV4-59)
ARSIRYSVFDY

SEQ ID NO: 16349 - protein, 10 aa, Homo sapiens
  Light chain CDR3 for antibody 8175 (IGKV3-20)
QQYGSSPPYT

SEQ ID NO: 16350 - protein, 20 aa, Homo sapiens
  Heavy chain CDR3 for antibody 8175 (IGHV3-20)
ARDLCSSTSCYGYYYYGMDV

SEQ ID NO: 16351 - protein, 10 aa, Homo sapiens
  Light chain CDR3 for antibody 8176 (IGKV3-11)
QQRSNWPALT

SEQ ID NO: 16352 - protein, 14 aa, Homo sapiens
  Heavy chain CDR3 for antibody 8176 (IGHV3-33)
ARDKTYPLSYGMDV

SEQ ID NO: 16353 - protein, 9 aa, Homo sapiens
  Light chain CDR3 for antibody 8177 (IGKV3D-20)
QQYGYSPLT

SEQ ID NO: 16354 - protein, 10 aa, Homo sapiens
  Heavy chain CDR3 for antibody 8177 (IGHV3-33)
ARENSTPLDY

SEQ ID NO: 16355 - protein, 9 aa, Homo sapiens
  Light chain CDR3 for antibody 8178 (IGKV3-20)
QQYCSSPLT

SEQ ID NO: 16356 - protein, 14 aa, Homo sapiens
  Heavy chain CDR3 for antibody 8178 (IGHV3-33)
ARDREQQLVRYFDY

SEQ ID NO: 16357 - protein, 9 aa, Homo sapiens
  Light chain CDR3 for antibody 8179 (IGKV3-11)
QQRINWPWT

SEQ ID NO: 16358 - protein, 15 aa, Homo sapiens
  Heavy chain CDR3 for antibody 8179 (IGHV4-39)
ARRDYDILTGYLFDY

SEQ ID NO: 16359 - protein, 8 aa, Homo sapiens
  Light chain CDR3 for antibody 8180 (IGKV1D-13)
QQFNNYPT

SEQ ID NO: 16360 - protein, 17 aa, Homo sapiens
  Heavy chain CDR3 for antibody 8180 (IGHV3-33)
ARDWFGELSDYYYGMDV

SEQ ID NO: 16361 - protein, 10 aa, Homo sapiens
  Light chain CDR3 for antibody 8181 (IGKV3-15)
QQYNNWPPYT

SEQ ID NO: 16362 - protein, 18 aa, Homo sapiens
  Heavy chain CDR3 for antibody 8181 (IGHV3-33)
AREGTMVRGVIIIDAFDI

SEQ ID NO: 16363 - protein, 10 aa, Homo sapiens
  Light chain CDR3 for antibody 8182 (IGKV1-33)
QQLNSYPGPT

SEQ ID NO: 16364 - protein, 12 aa, Homo sapiens
  Heavy chain CDR3 for antibody 8182 (IGHV3-66)
ARDLSEAGGFDY

SEQ ID NO: 16365 - protein, 11 aa, Homo sapiens
  Light chain CDR3 for antibody 8183 (IGKV3-11)
QQRSNWPPTWT

SEQ ID NO: 16366 - protein, 15 aa, Homo sapiens
  Heavy chain CDR3 for antibody 8183 (IGHV3-33)
ARDSRPEITGPPFDY

SEQ ID NO: 16367 - protein, 9 aa, Homo sapiens
  Light chain CDR3 for antibody 8184 (IGKV1-33)
QQYDNLPFT

SEQ ID NO: 16368 - protein, 17 aa, Homo sapiens
  Heavy chain CDR3 for antibody 8184 (IGHV3-30)
ARESLWFGEANHFVMDV

SEQ ID NO: 16369 - protein, 9 aa, Homo sapiens
  Light chain CDR3 for antibody 8185 (IGKV1-17)
LHSNNYPWT

SEQ ID NO: 16370 - protein, 13 aa, Homo sapiens
  Heavy chain CDR3 for antibody 8185 (IGHV3-33)
ARDWGYSHGYFDY

SEQ ID NO: 16371 - protein, 10 aa, Homo sapiens
  Light chain CDR3 for antibody 8186 (IGKV1-39)
QQSYSTPMYT

SEQ ID NO: 16372 - protein, 14 aa, Homo sapiens
  Heavy chain CDR3 for antibody 8186 (IGHV3-23)
ANWAYDILTGYLDY

SEQ ID NO: 16373 - protein, 9 aa, Homo sapiens
  Light chain CDR3 for antibody 8187 (IGKV1-6)
LQDYNYPHT

SEQ ID NO: 16374 - protein, 14 aa, Homo sapiens
  Heavy chain CDR3 for antibody 8187 (IGHV4-39)
ARQGGWYLYWYFDL

SEQ ID NO: 16375 - protein, 9 aa, Homo sapiens
  Light chain CDR3 for antibody 8188 (IGKV1-33)
QQYDNLPFT

SEQ ID NO: 16376 - protein, 8 aa, Homo sapiens
  Heavy chain CDR3 for antibody 8188 (IGHV4-39)
ARRGGLDY

SEQ ID NO: 16377 - protein, 9 aa, Homo sapiens
  Light chain CDR3 for antibody 8189 (IGKV3-11)
QQRSSWPPT

SEQ ID NO: 16378 - protein, 11 aa, Homo sapiens
  Heavy chain CDR3 for antibody 8189 (IGHV3-33)
ARDKSSGWSDY

SEQ ID NO: 16379 - protein, 9 aa, Homo sapiens
  Light chain CDR3 for antibody 8190 (IGKV6-21)
HQSSSLPYT

SEQ ID NO: 16380 - protein, 13 aa, Homo sapiens
  Heavy chain CDR3 for antibody 8190 (IGHV4-4)
ARERGIAAAGPDY

SEQ ID NO: 16381 - protein, 9 aa, Homo sapiens
  Light chain CDR3 for antibody 8191 (IGKV1-9)
QQGNTYSRT

SEQ ID NO: 16382 - protein, 19 aa, Homo sapiens
  Heavy chain CDR3 for antibody 8191 (IGHV5-51)
ARHGEKGKRITMVRGSLDV

SEQ ID NO: 16383 - protein, 9 aa, Homo sapiens
  Light chain CDR3 for antibody 8192 (IGKV1-17)
QQLNSYPWT

SEQ ID NO: 16384 - protein, 16 aa, Homo sapiens
  Heavy chain CDR3 for antibody 8192 (IGHV3-23)
AKEGMVLRYFDWLWDY

SEQ ID NO: 16385 - protein, 8 aa, Homo sapiens
  Light chain CDR3 for antibody 8193 (IGKV3-11)
QQRSNWWT

SEQ ID NO: 16386 - protein, 9 aa, Homo sapiens
  Heavy chain CDR3 for antibody 8193 (IGHV3-13)
ARDHWYFDL

SEQ ID NO: 16387 - protein, 8 aa, Homo sapiens
  Light chain CDR3 for antibody 8194 (IGKV6-21)
HQSSSLPT

SEQ ID NO: 16388 - protein, 10 aa, Homo sapiens
  Heavy chain CDR3 for antibody 8194 (IGHV3-23)
AKGDRWRFDP

SEQ ID NO: 16389 - protein, 9 aa, Homo sapiens
  Light chain CDR3 for antibody 8195 (IGKV1D-16)
QQYNSFPLT

SEQ ID NO: 16390 - protein, 16 aa, Homo sapiens
  Heavy chain CDR3 for antibody 8195 (IGHV4-61)
ARGRYFDWLLADVFDL

SEQ ID NO: 16391 - protein, 8 aa, Homo sapiens
  Light chain CDR3 for antibody 8196 (IGKV1D-13)
QQFNNYPT

SEQ ID NO: 16392 - protein, 17 aa, Homo sapiens
  Heavy chain CDR3 for antibody 8196 (IGHV3-33)
ARCGYSSSWYDPYYFDY

SEQ ID NO: 16393 - protein, 9 aa, Homo sapiens
  Light chain CDR3 for antibody 8197 (IGKV3-20)
QQYGSSPYT

SEQ ID NO: 16394 - protein, 13 aa, Homo sapiens
  Heavy chain CDR3 for antibody 8197 (IGHV1-24)
ATLHTYFYGEFAY

SEQ ID NO: 16395 - protein, 9 aa, Homo sapiens
  Light chain CDR3 for antibody 8198 (IGKV3D-7)
QQDYNLPYT

SEQ ID NO: 16396 - protein, 13 aa, Homo sapiens
  Heavy chain CDR3 for antibody 8198 (IGHV3-33)
ASGYSGYDWYFDL

SEQ ID NO: 16397 - protein, 9 aa, Homo sapiens
  Light chain CDR3 for antibody 8199 (IGKV1-17)
QQLNSYPLT

SEQ ID NO: 16398 - protein, 18 aa, Homo sapiens
  Heavy chain CDR3 for antibody 8199 (IGHV4-39)
ARYITMVRGAIITGPFDY

SEQ ID NO: 16399 - protein, 9 aa, Homo sapiens
  Light chain CDR3 for antibody 8200 (IGKV3-20)
QQYGTSPFP

SEQ ID NO: 16400 - protein, 13 aa, Homo sapiens
  Heavy chain CDR3 for antibody 8200 (IGHV3-33)
ARAFTMVRGVIDY

SEQ ID NO: 16401 - protein, 9 aa, Homo sapiens
  Light chain CDR3 for antibody 8201 (IGKV2D-24)
TQATQFPHT

SEQ ID NO: 16402 - protein, 18 aa, Homo sapiens
  Heavy chain CDR3 for antibody 8201 (IGHV3-33)
ARREGIVGATTYYYGMDV

SEQ ID NO: 16403 - protein, 8 aa, Homo sapiens
  Light chain CDR3 for antibody 8202 (IGKV1D-13)
QQFNNYPT

SEQ ID NO: 16404 - protein, 13 aa, Homo sapiens
  Heavy chain CDR3 for antibody 8202 (IGHV3-30)
AAPFMVRGDGMDV

SEQ ID NO: 16405 - protein, 9 aa, Homo sapiens
  Light chain CDR3 for antibody 8203 (IGKV1-9)
LQDFHYPWT

SEQ ID NO: 16406 - protein, 14 aa, Homo sapiens
  Heavy chain CDR3 for antibody 8203 (IGHV3-33)
ARAGSGYDRDWFDP

SEQ ID NO: 16407 - protein, 9 aa, Homo sapiens
  Light chain CDR3 for antibody 8204 (IGKV2D-24)
TQATQFPHT

SEQ ID NO: 16408 - protein, 14 aa, Homo sapiens
  Heavy chain CDR3 for antibody 8204 (IGHV4-39)
ARDSGYDYYYGMDV

SEQ ID NO: 16409 - protein, 9 aa, Homo sapiens
  Light chain CDR3 for antibody 8205 (IGKV2-30)
MQGTHWPLT

SEQ ID NO: 16410 - protein, 13 aa, Homo sapiens
  Heavy chain CDR3 for antibody 8205 (IGHV3-21)
ARDSTLVRGVFPY

SEQ ID NO: 16411 - protein, 9 aa, Homo sapiens
  Light chain CDR3 for antibody 8206 (IGKV3D-15)
QQYNNWPIT

SEQ ID NO: 16412 - protein, 20 aa, Homo sapiens
  Heavy chain CDR3 for antibody 8206 (IGHV3-33)
ARDPGYYGSGSYVPLDAFDI

SEQ ID NO: 16413 - protein, 9 aa, Homo sapiens
  Light chain CDR3 for antibody 8207 (IGKV1D-16)
QQYNSYPYT

SEQ ID NO: 16414 - protein, 14 aa, Homo sapiens
  Heavy chain CDR3 for antibody 8207 (IGHV3-33)
ARDGSGSYPLYFDY

SEQ ID NO: 16415 - protein, 9 aa, Homo sapiens
  Light chain CDR3 for antibody 8208 (IGKV3D-7)
QQDYSFPLT

SEQ ID NO: 16416 - protein, 9 aa, Homo sapiens
  Heavy chain CDR3 for antibody 8208 (IGHV3-13)
ARDRWYFDL

SEQ ID NO: 16417 - protein, 9 aa, Homo sapiens
  Light chain CDR3 for antibody 8209 (IGKV4-1)
QQYYTTPPT

SEQ ID NO: 16418 - protein, 13 aa, Homo sapiens
  Heavy chain CDR3 for antibody 8209 (IGHV3-23)
ASPFNWNDGFFDY

SEQ ID NO: 16419 - protein, 9 aa, Homo sapiens
  Light chain CDR3 for antibody 8210 (IGKV1-9)
QQLNRYPYT

SEQ ID NO: 16420 - protein, 15 aa, Homo sapiens
  Heavy chain CDR3 for antibody 8210 (IGHV3-23)
AKDGSYYDYYYGMDV

SEQ ID NO: 16421 - protein, 8 aa, Homo sapiens
  Light chain CDR3 for antibody 8211 (IGKV1-5)
QQYNSYYT

SEQ ID NO: 16422 - protein, 18 aa, Homo sapiens
  Heavy chain CDR3 for antibody 8211 (IGHV3-33)
VRDRERYGSGSYPDAFDI

SEQ ID NO: 16423 - protein, 9 aa, Homo sapiens
  Light chain CDR3 for antibody 8212 (IGKV3-15)
QQYNNWPYT

SEQ ID NO: 16424 - protein, 17 aa, Homo sapiens
  Heavy chain CDR3 for antibody 8212 (IGHV3-33)
ARDWFGELSDYYYGMDV

SEQ ID NO: 16425 - protein, 9 aa, Homo sapiens
  Light chain CDR3 for antibody 8213 (IGKV1-9)
QQLNSYPNT

SEQ ID NO: 16426 - protein, 14 aa, Homo sapiens
  Heavy chain CDR3 for antibody 8213 (IGHV3-33)
GRDAMGATTAWFDP

SEQ ID NO: 16427 - protein, 9 aa, Homo sapiens
  Light chain CDR3 for antibody 8214 (IGKV3-11)
QQRSNWPPT

SEQ ID NO: 16428 - protein, 18 aa, Homo sapiens
  Heavy chain CDR3 for antibody 8214 (IGHV3-33)
ARDQGIVVLPGAPWYFDP

SEQ ID NO: 16429 - protein, 8 aa, Homo sapiens
  Light chain CDR3 for antibody 8215 (IGKV3-20)
QQYGRSFT

SEQ ID NO: 16430 - protein, 14 aa, Homo sapiens
  Heavy chain CDR3 for antibody 8215 (IGHV3-33)
ARAGSGYDRDWFDP

SEQ ID NO: 16431 - protein, 9 aa, Homo sapiens
  Light chain CDR3 for antibody 8216 (IGKV1-9)
QQLNSYPYT

SEQ ID NO: 16432 - protein, 13 aa, Homo sapiens
  Heavy chain CDR3 for antibody 8216 (IGHV3-33)
AREYCSGGSCYDY

SEQ ID NO: 16433 - protein, 9 aa, Homo sapiens
  Light chain CDR3 for antibody 8217 (IGKV1-39)
QQSYSTPYT

SEQ ID NO: 16434 - protein, 13 aa, Homo sapiens
  Heavy chain CDR3 for antibody 8217 (IGHV1-18)
ARSYYGSGSPFDY

SEQ ID NO: 16435 - protein, 9 aa, Homo sapiens
  Light chain CDR3 for antibody 8218 (IGKV1D-13)
QRFNNYLYT

SEQ ID NO: 16436 - protein, 17 aa, Homo sapiens
  Heavy chain CDR3 for antibody 8218 (IGHV3-33)
ARDQDDILTGYYWYFDL

SEQ ID NO: 16437 - protein, 8 aa, Homo sapiens
  Light chain CDR3 for antibody 8219 (IGKV3-11)
QQRSNWLT

SEQ ID NO: 16438 - protein, 17 aa, Homo sapiens
  Heavy chain CDR3 for antibody 8219 (IGHV1-8)
ARGDYYGSGSPYWYFDL

SEQ ID NO: 16439 - protein, 9 aa, Homo sapiens
  Light chain CDR3 for antibody 8220 (IGKV5-2)
LQHDNFPYT

SEQ ID NO: 16440 - protein, 15 aa, Homo sapiens
  Heavy chain CDR3 for antibody 8220 (IGHV3-33)
ARDRVQLGYYYGMDV

SEQ ID NO: 16441 - protein, 9 aa, Homo sapiens
  Light chain CDR3 for antibody 8221 (IGKV3-15)
QQYNNWPLT

SEQ ID NO: 16442 - protein, 8 aa, Homo sapiens
  Heavy chain CDR3 for antibody 8221 (IGHV4-39)
ARRGGLDY

SEQ ID NO: 16443 - protein, 9 aa, Homo sapiens
  Light chain CDR3 for antibody 8222 (IGKV1-39)
QQSYSTPYT

SEQ ID NO: 16444 - protein, 17 aa, Homo sapiens
  Heavy chain CDR3 for antibody 8222 (IGHV3-33)
ARDPARGNVRSFYGLDV

SEQ ID NO: 16445 - protein, 9 aa, Homo sapiens
  Light chain CDR3 for antibody 8223 (IGKV2-30)
MQGTHWPLT

SEQ ID NO: 16446 - protein, 14 aa, Homo sapiens
  Heavy chain CDR3 for antibody 8223 (IGHV4-39)
ARQGTMIRGGYFDY

SEQ ID NO: 16447 - protein, 9 aa, Homo sapiens
  Light chain CDR3 for antibody 8224 (IGKV3-11)
QQRSNWPRT

SEQ ID NO: 16448 - protein, 14 aa, Homo sapiens
  Heavy chain CDR3 for antibody 8224 (IGHV1-46)
ARKGIVGAFDAFDI

SEQ ID NO: 16449 - protein, 9 aa, Homo sapiens
  Light chain CDR3 for antibody 8225 (IGKV1-17)
LQHNSYPFT

SEQ ID NO: 16450 - protein, 12 aa, Homo sapiens
  Heavy chain CDR3 for antibody 8225 (IGHV3-33)
ARESGGSYSFDY

SEQ ID NO: 16451 - protein, 9 aa, Homo sapiens
  Light chain CDR3 for antibody 8226 (IGKV3-20)
QQYGSSPYT

SEQ ID NO: 16452 - protein, 17 aa, Homo sapiens
  Heavy chain CDR3 for antibody 8226 (IGHV3-33)
ARGDAYYDILTGYHFDY

SEQ ID NO: 16453 - protein, 10 aa, Homo sapiens
  Light chain CDR3 for antibody 8227 (IGKV3-11)
QQHSNWPIFT

SEQ ID NO: 16454 - protein, 12 aa, Homo sapiens
  Heavy chain CDR3 for antibody 8227 (IGHV1-18)
ARVLFDGDYFDY

SEQ ID NO: 16455 - protein, 9 aa, Homo sapiens
  Light chain CDR3 for antibody 8228 (IGKV2-30)
MQGTHWPLT

SEQ ID NO: 16456 - protein, 11 aa, Homo sapiens
  Heavy chain CDR3 for antibody 8228 (IGHV3-23)
AKGLWSYYFDY

SEQ ID NO: 16457 - protein, 9 aa, Homo sapiens
  Light chain CDR3 for antibody 8229 (IGKV1D-13)
QRFNNYLYT

SEQ ID NO: 16458 - protein, 17 aa, Homo sapiens
  Heavy chain CDR3 for antibody 8229 (IGHV3-33)
VREGGLLWVGELSLFDY

SEQ ID NO: 16459 - protein, 9 aa, Homo sapiens
  Light chain CDR3 for antibody 8230 (IGKV1-9)
QQLKSYLYT

SEQ ID NO: 16460 - protein, 9 aa, Homo sapiens
  Heavy chain CDR3 for antibody 8230 (IGHV4-59)
AGGSWDFDY

SEQ ID NO: 16461 - protein, 9 aa, Homo sapiens
  Light chain CDR3 for antibody 8231 (IGKV3D-7)
QQDYNLPFT

SEQ ID NO: 16462 - protein, 14 aa, Homo sapiens
  Heavy chain CDR3 for antibody 8231 (IGHV3-33)
ARDTVAAGFNGMDV

SEQ ID NO: 16463 - protein, 8 aa, Homo sapiens
  Light chain CDR3 for antibody 8232 (IGKV3D-7)
QQDYNLLT

SEQ ID NO: 16464 - protein, 12 aa, Homo sapiens
  Heavy chain CDR3 for antibody 8232 (IGHV3-33)
ARNYDILDYFDY

SEQ ID NO: 16465 - protein, 9 aa, Homo sapiens
  Light chain CDR3 for antibody 8233 (IGKV1-6)
LQDYNYPYT

SEQ ID NO: 16466 - protein, 13 aa, Homo sapiens
  Heavy chain CDR3 for antibody 8233 (IGHV1-18)
ARDEGYDIDGMDV

SEQ ID NO: 16467 - protein, 10 aa, Homo sapiens
  Light chain CDR3 for antibody 8234 (IGKV3-11)
QQRSNWPIFT

SEQ ID NO: 16468 - protein, 20 aa, Homo sapiens
  Heavy chain CDR3 for antibody 8234 (IGHV3-33)
ARDWMVRGVIITDYYYGMDV

SEQ ID NO: 16469 - protein, 9 aa, Homo sapiens
  Light chain CDR3 for antibody 8235 (IGKV1-39)
LQDYNYPYT

SEQ ID NO: 16470 - protein, 12 aa, Homo sapiens
  Heavy chain CDR3 for antibody 8235 (IGHV3-33)
ARVIDWLKPMDV

SEQ ID NO: 16471 - protein, 9 aa, Homo sapiens
  Light chain CDR3 for antibody 8236 (IGKV3-11)
QQRSNWMYT

SEQ ID NO: 16472 - protein, 17 aa, Homo sapiens
  Heavy chain CDR3 for antibody 8236 (IGHV3-30)
AREGVRGLIYYYYGMDV

SEQ ID NO: 16473 - protein, 9 aa, Homo sapiens
  Light chain CDR3 for antibody 8237 (IGKV1D-16)
QQYHSYPYT

SEQ ID NO: 16474 - protein, 13 aa, Homo sapiens
  Heavy chain CDR3 for antibody 8237 (IGHV1-24)
ATGYSINWYEFDY

SEQ ID NO: 16475 - protein, 9 aa, Homo sapiens
  Light chain CDR3 for antibody 8238 (IGKV1D-16)
QQYNSYPFT

SEQ ID NO: 16476 - protein, 12 aa, Homo sapiens
  Heavy chain CDR3 for antibody 8238 (IGHV4-61)
ARVDSSGWYFDY

SEQ ID NO: 16477 - protein, 9 aa, Homo sapiens
  Light chain CDR3 for antibody 8239 (IGKV1-9)
QQLKSYLYT

SEQ ID NO: 16478 - protein, 18 aa, Homo sapiens
  Heavy chain CDR3 for antibody 8239 (IGHV1-18)
ARDLTGRTENYYYYGMDV

SEQ ID NO: 16479 - protein, 9 aa, Homo sapiens
  Light chain CDR3 for antibody 8240 (IGKV6-21)
HQSTSLPFT

SEQ ID NO: 16480 - protein, 18 aa, Homo sapiens
  Heavy chain CDR3 for antibody 8240 (IGHV1-46)
ARDLTGRTENYYYYGMDV

SEQ ID NO: 16481 - protein, 8 aa, Homo sapiens
  Light chain CDR3 for antibody 8241 (IGKV3-20)
QQYGRSFT

SEQ ID NO: 16482 - protein, 11 aa, Homo sapiens
  Heavy chain CDR3 for antibody 8241 (IGHV3-33)
AREAANWGFDY

SEQ ID NO: 16483 - protein, 9 aa, Homo sapiens
  Light chain CDR3 for antibody 8242 (IGKV1D-16)
QQYSSYPYT

SEQ ID NO: 16484 - protein, 14 aa, Homo sapiens
  Heavy chain CDR3 for antibody 8242 (IGHV3-48)
GRDTTHDWSDGGIY

SEQ ID NO: 16485 - protein, 11 aa, Homo sapiens
  Light chain CDR3 for antibody 8243 (IGKV3-11)
QQRSNWPPTWT

SEQ ID NO: 16486 - protein, 10 aa, Homo sapiens
  Heavy chain CDR3 for antibody 8243 (IGHV4-39)
ARQLGNWFDP

SEQ ID NO: 16487 - protein, 9 aa, Homo sapiens
  Light chain CDR3 for antibody 8244 (IGKV3-15)
QQYNNWPYT

SEQ ID NO: 16488 - protein, 17 aa, Homo sapiens
  Heavy chain CDR3 for antibody 8244 (IGHV3-33)
ARCGYSSSWYDPYYFDY

SEQ ID NO: 16489 - protein, 9 aa, Homo sapiens
  Light chain CDR3 for antibody 8245 (IGKV4-1)
QQYYTTPYT

SEQ ID NO: 16490 - protein, 15 aa, Homo sapiens
  Heavy chain CDR3 for antibody 8245 (IGHV3-33)
ARDTGYSSSWNWFDP

SEQ ID NO: 16491 - protein, 8 aa, Homo sapiens
  Light chain CDR3 for antibody 8246 (IGKV3D-7)
QQDYNLLT

SEQ ID NO: 16492 - protein, 18 aa, Homo sapiens
  Heavy chain CDR3 for antibody 8246 (IGHV3-33)
ARDQGIVVLPGAPWYFDP

SEQ ID NO: 16493 - protein, 8 aa, Homo sapiens
  Light chain CDR3 for antibody 8247 (IGKV1D-13)
QQFNNYPT

SEQ ID NO: 16494 - protein, 14 aa, Homo sapiens
  Heavy chain CDR3 for antibody 8247 (IGHV3-33)
AREDYYGPLNWFDP

SEQ ID NO: 16495 - protein, 9 aa, Homo sapiens
  Light chain CDR3 for antibody 8248 (IGKV1D-16)
QQYAGYPPT

SEQ ID NO: 16496 - protein, 18 aa, Homo sapiens
  Heavy chain CDR3 for antibody 8248 (IGHV4-59)
AREGHYYTSGSYYKAFDY

SEQ ID NO: 16497 - protein, 9 aa, Homo sapiens
  Light chain CDR3 for antibody 8249 (IGKV3D-7)
QQDYNLPYT

SEQ ID NO: 16498 - protein, 17 aa, Homo sapiens
  Heavy chain CDR3 for antibody 8249 (IGHV4-59)
ARDFLVRGEGSYYGMDV

SEQ ID NO: 16499 - protein, 9 aa, Homo sapiens
  Light chain CDR3 for antibody 8250 (IGKV3-11)
QQRSNWPLT

SEQ ID NO: 16500 - protein, 18 aa, Homo sapiens
  Heavy chain CDR3 for antibody 8250 (IGHV3-33)
ARRSAAGTGDYYYCGMDV

SEQ ID NO: 16501 - protein, 9 aa, Homo sapiens
  Light chain CDR3 for antibody 8251 (IGKV1D-16)
QQYHSYPYT

SEQ ID NO: 16502 - protein, 15 aa, Homo sapiens
  Heavy chain CDR3 for antibody 8251 (IGHV3-74)
ARGSGSHYFYYGMDV

SEQ ID NO: 16503 - protein, 8 aa, Homo sapiens
  Light chain CDR3 for antibody 8252 (IGKV3-11)
QQRSNWLT

SEQ ID NO: 16504 - protein, 13 aa, Homo sapiens
  Heavy chain CDR3 for antibody 8252 (IGHV4-39)
ARHHYGSGSLRDY

SEQ ID NO: 16505 - protein, 10 aa, Homo sapiens
  Light chain CDR3 for antibody 8253 (IGKV3-15)
QQYNNWPPYT

SEQ ID NO: 16506 - protein, 12 aa, Homo sapiens
  Heavy chain CDR3 for antibody 8253 (IGHV3-33)
AREGDILTGYSL

SEQ ID NO: 16507 - protein, 9 aa, Homo sapiens
  Light chain CDR3 for antibody 8254 (IGKV1-39)
QQSYSTPFT

SEQ ID NO: 16508 - protein, 10 aa, Homo sapiens
  Heavy chain CDR3 for antibody 8254 (IGHV4-59)
ARHGVAGTNY

SEQ ID NO: 16509 - protein, 9 aa, Homo sapiens
  Light chain CDR3 for antibody 8255 (IGKV1D-13)
QQFNNYPHT

SEQ ID NO: 16510 - protein, 17 aa, Homo sapiens
  Heavy chain CDR3 for antibody 8255 (IGHV3-23)
AKEYCSGGSCYVYYFDY

SEQ ID NO: 16511 - protein, 9 aa, Homo sapiens
  Light chain CDR3 for antibody 8256 (IGKV1D-16)
QQYNSFPLT

SEQ ID NO: 16512 - protein, 16 aa, Homo sapiens
  Heavy chain CDR3 for antibody 8256 (IGHV3-23)
AKEGMVLRYFDWLWDY

SEQ ID NO: 16513 - protein, 10 aa, Homo sapiens
  Light chain CDR3 for antibody 8257 (IGKV3-11)
QQRSNWPIFT

SEQ ID NO: 16514 - protein, 21 aa, Homo sapiens
  Heavy chain CDR3 for antibody 8257 (IGHV1-18)
ASGVLIWFGELLSEDYYDMDV

SEQ ID NO: 16515 - protein, 9 aa, Homo sapiens
  Light chain CDR3 for antibody 8258 (IGKV1-16)
QQYNRYPYT

SEQ ID NO: 16516 - protein, 17 aa, Homo sapiens
  Heavy chain CDR3 for antibody 8258 (IGHV4-59)
AREGADSGIYYHWYFDL

SEQ ID NO: 16517 - protein, 9 aa, Homo sapiens
  Light chain CDR3 for antibody 8259 (IGKV1-16)
QHYNDYPFT

SEQ ID NO: 16518 - protein, 15 aa, Homo sapiens
  Heavy chain CDR3 for antibody 8259 (IGHV3-33)
ARDRGWKAPGYGMDV

SEQ ID NO: 16519 - protein, 10 aa, Homo sapiens
  Light chain CDR3 for antibody 8260 (IGKV1-16)
QQSYSTPMYT

SEQ ID NO: 16520 - protein, 13 aa, Homo sapiens
  Heavy chain CDR3 for antibody 8260 (IGHV3-66)
ANTGDSYYYGFYV

SEQ ID NO: 16521 - protein, 9 aa, Homo sapiens
  Light chain CDR3 for antibody 8261 (IGKV1-9)
QQLNSYPLT

SEQ ID NO: 16522 - protein, 15 aa, Homo sapiens
  Heavy chain CDR3 for antibody 8261 (IGHV3-23)
AKDPRGYYYYYGMDV

SEQ ID NO: 16523 - protein, 9 aa, Homo sapiens
  Light chain CDR3 for antibody 8262 (IGKV1-9)
LQDFHYPWT

SEQ ID NO: 16524 - protein, 13 aa, Homo sapiens
  Heavy chain CDR3 for antibody 8262 (IGHV4-28)
ARKGATGYYGMDV

SEQ ID NO: 16525 - protein, 9 aa, Homo sapiens
  Light chain CDR3 for antibody 8263 (IGKV1-17)
LQHNGYPLT

SEQ ID NO: 16526 - protein, 18 aa, Homo sapiens
  Heavy chain CDR3 for antibody 8263 (IGHV4-59)
AREGDYVWGSYRPNWFDP

SEQ ID NO: 16527 - protein, 9 aa, Homo sapiens
  Light chain CDR3 for antibody 8264 (IGKV2-30)
MQGTHWPLT

SEQ ID NO: 16528 - protein, 20 aa, Homo sapiens
  Heavy chain CDR3 for antibody 8264 (IGHV3-33)
ARDWMVRGVIITDYYYGMDV

SEQ ID NO: 16529 - protein, 9 aa, Homo sapiens
  Light chain CDR3 for antibody 8265 (IGKV6-21)
HQSSSLPHT

SEQ ID NO: 16530 - protein, 14 aa, Homo sapiens
  Heavy chain CDR3 for antibody 8265 (IGHV3-33)
ARASSGSSYWYIDL

SEQ ID NO: 16531 - protein, 11 aa, Homo sapiens
  Light chain CDR3 for antibody 8266 (IGKV3-11)
QQRSNWPPMYT

SEQ ID NO: 16532 - protein, 12 aa, Homo sapiens
  Heavy chain CDR3 for antibody 8266 (IGHV3-13)
AREAGIPDAFDI

SEQ ID NO: 16533 - protein, 9 aa, Homo sapiens
  Light chain CDR3 for antibody 8267 (IGKV1-33)
QQYDNLPFT

SEQ ID NO: 16534 - protein, 14 aa, Homo sapiens
  Heavy chain CDR3 for antibody 8267 (IGHV3-33)
VRDAMGATTAWFDP

SEQ ID NO: 16535 - protein, 9 aa, Homo sapiens
  Light chain CDR3 for antibody 8268 (IGKV1-5)
QQYNTYSRT

SEQ ID NO: 16536 - protein, 12 aa, Homo sapiens
  Heavy chain CDR3 for antibody 8268 (IGHV1-46)
ARGLTGDHAVDI

SEQ ID NO: 16537 - protein, 9 aa, Homo sapiens
  Light chain CDR3 for antibody 8269 (IGKV5-2)
LQHDKFPYT

SEQ ID NO: 16538 - protein, 11 aa, Homo sapiens
  Heavy chain CDR3 for antibody 8269 (IGHV3-33)
AREAANWGFDY

SEQ ID NO: 16539 - protein, 9 aa, Homo sapiens
  Light chain CDR3 for antibody 8270 (IGKV3D-20)
HQYGSSPLT

SEQ ID NO: 16540 - protein, 13 aa, Homo sapiens
  Heavy chain CDR3 for antibody 8270 (IGHV4-61)
ASRYSSGWYPFDY

SEQ ID NO: 16541 - protein, 10 aa, Homo sapiens
  Light chain CDR3 for antibody 8271 (IGKV3-11)
QQRSNWPMYT

SEQ ID NO: 16542 - protein, 12 aa, Homo sapiens
  Heavy chain CDR3 for antibody 8271 (IGHV3-23)
AKEGIVGVPFDY

SEQ ID NO: 16543 - protein, 9 aa, Homo sapiens
  Light chain CDR3 for antibody 8272 (IGKV2D-28)
MQALQTPPT

SEQ ID NO: 16544 - protein, 14 aa, Homo sapiens
  Heavy chain CDR3 for antibody 8272 (IGHV3-33)
ARDGYDFLTGPFDY

SEQ ID NO: 16545 - protein, 9 aa, Homo sapiens
  Light chain CDR3 for antibody 8273 (IGKV3-20)
QQFGRSPRT

SEQ ID NO: 16546 - protein, 9 aa, Homo sapiens
  Heavy chain CDR3 for antibody 8273 (IGHV1-18)
ARGKDWFDP

SEQ ID NO: 16547 - protein, 9 aa, Homo sapiens
  Light chain CDR3 for antibody 8274 (IGKV1-39)
QQSYSTPLT

SEQ ID NO: 16548 - protein, 17 aa, Homo sapiens
  Heavy chain CDR3 for antibody 8274 (IGHV3-33)
ARDRDDILTGFYTYFDY

SEQ ID NO: 16549 - protein, 8 aa, Homo sapiens
  Light chain CDR3 for antibody 8275 (IGKV6-21)
HQSSSLPT

SEQ ID NO: 16550 - protein, 17 aa, Homo sapiens
  Heavy chain CDR3 for antibody 8275 (IGHV3-33)
ARSGIVGATDYYYGLDV

SEQ ID NO: 16551 - protein, 10 aa, Homo sapiens
  Light chain CDR3 for antibody 8276 (IGKV3-20)
QQYGRSPPVT

SEQ ID NO: 16552 - protein, 11 aa, Homo sapiens
  Heavy chain CDR3 for antibody 8276 (IGHV3-33)
ARDTWDDYFDY

SEQ ID NO: 16553 - protein, 9 aa, Homo sapiens
  Light chain CDR3 for antibody 8277 (IGKV1-39)
QQSYSTPFT

SEQ ID NO: 16554 - protein, 13 aa, Homo sapiens
  Heavy chain CDR3 for antibody 8277 (IGHV3-11)
ARDEGYRGYVLDA

SEQ ID NO: 16555 - protein, 9 aa, Homo sapiens
  Light chain CDR3 for antibody 8278 (IGKV1-9)
LQDYKSPFT

SEQ ID NO: 16556 - protein, 13 aa, Homo sapiens
  Heavy chain CDR3 for antibody 8278 (IGHV3-33)
ARGDNWNDGGFDY

SEQ ID NO: 16557 - protein, 9 aa, Homo sapiens
  Light chain CDR3 for antibody 8279 (IGKV2D-24)
TQATQFPHT

SEQ ID NO: 16558 - protein, 16 aa, Homo sapiens
  Heavy chain CDR3 for antibody 8279 (IGHV1-18)
ARYFDWLLRDYYGMDV

SEQ ID NO: 16559 - protein, 9 aa, Homo sapiens
  Light chain CDR3 for antibody 8280 (IGKV5-2)
LQHDNFPWT

SEQ ID NO: 16560 - protein, 22 aa, Homo sapiens
  Heavy chain CDR3 for antibody 8280 (IGHV1-18)
ARDRYNNQSKYRNRDYYYGLDV

SEQ ID NO: 16561 - protein, 9 aa, Homo sapiens
  Light chain CDR3 for antibody 8281 (IGKV3-11)
QQRSNWMYT

SEQ ID NO: 16562 - protein, 12 aa, Homo sapiens
  Heavy chain CDR3 for antibody 8281 (IGHV1-46)
ARGLTGDHAFDI

SEQ ID NO: 16563 - protein, 9 aa, Homo sapiens
  Light chain CDR3 for antibody 8282 (IGKV3-15)
QQYNNWPLT

SEQ ID NO: 16564 - protein, 14 aa, Homo sapiens
  Heavy chain CDR3 for antibody 8282 (IGHV3-20)
ARDGGSTCYDWFDP

SEQ ID NO: 16565 - protein, 9 aa, Homo sapiens
  Light chain CDR3 for antibody 8283 (IGKV1-17)
LQHNSYPYT

SEQ ID NO: 16566 - protein, 14 aa, Homo sapiens
  Heavy chain CDR3 for antibody 8283 (IGHV3-33)
AREGILTGYYPFDY

SEQ ID NO: 16567 - protein, 8 aa, Homo sapiens
  Light chain CDR3 for antibody 8284 (IGKV1D-13)
QQFNNYPT

SEQ ID NO: 16568 - protein, 16 aa, Homo sapiens
  Heavy chain CDR3 for antibody 8284 (IGHV3-33)
AREGYSSSWFDRNFDY

SEQ ID NO: 16569 - protein, 9 aa, Homo sapiens
  Light chain CDR3 for antibody 8285 (IGKV3-15)
QQYNNWPIT

SEQ ID NO: 16570 - protein, 13 aa, Homo sapiens
  Heavy chain CDR3 for antibody 8285 (IGHV3-23)
AKDIVVVVAATNY

SEQ ID NO: 16571 - protein, 9 aa, Homo sapiens
  Light chain CDR3 for antibody 8286 (IGKV1-9)
QQLISYPLT

SEQ ID NO: 16572 - protein, 20 aa, Homo sapiens
  Heavy chain CDR3 for antibody 8286 (IGHV3-23)
AKGMGGLRYFDWPHYYGMDV

SEQ ID NO: 16573 - protein, 9 aa, Homo sapiens
  Light chain CDR3 for antibody 8287 (IGKV1-6)
QQEYNYPLT

SEQ ID NO: 16574 - protein, 15 aa, Homo sapiens
  Heavy chain CDR3 for antibody 8287 (IGHV3-30)
ARGAMVRGVDYGMDV

SEQ ID NO: 16575 - protein, 9 aa, Homo sapiens
  Light chain CDR3 for antibody 8288 (IGKV1-6)
QQFNNYPRT

SEQ ID NO: 16576 - protein, 15 aa, Homo sapiens
  Heavy chain CDR3 for antibody 8288 (IGHV3-11)
ARDRAVAGTIHAFDI

SEQ ID NO: 16577 - protein, 9 aa, Homo sapiens
  Light chain CDR3 for antibody 8289 (IGKV3-15)
QQYNNWPYT

SEQ ID NO: 16578 - protein, 10 aa, Homo sapiens
  Heavy chain CDR3 for antibody 8289 (IGHV3-30)
ARDGLESFDY

SEQ ID NO: 16579 - protein, 9 aa, Homo sapiens
  Light chain CDR3 for antibody 8290 (IGKV1-17)
LQLNSFPWT

SEQ ID NO: 16580 - protein, 13 aa, Homo sapiens
  Heavy chain CDR3 for antibody 8290 (IGHV3-33)
ARRYRSGWYPFDY

SEQ ID NO: 16581 - protein, 9 aa, Homo sapiens
  Light chain CDR3 for antibody 8291 (IGKV1D-13)
QRFNNYLYT

SEQ ID NO: 16582 - protein, 17 aa, Homo sapiens
  Heavy chain CDR3 for antibody 8291 (IGHV3-33)
ARGFSGYDGYYYYGMDV

SEQ ID NO: 16583 - protein, 9 aa, Homo sapiens
  Light chain CDR3 for antibody 8292 (IGKV5-2)
LQHDNFPWT

SEQ ID NO: 16584 - protein, 15 aa, Homo sapiens
  Heavy chain CDR3 for antibody 8292 (IGHV3-33)
VRGYYYGSGSYPLNY

SEQ ID NO: 16585 - protein, 9 aa, Homo sapiens
  Light chain CDR3 for antibody 8293 (IGKV2-30)
MQGTHWPLT

SEQ ID NO: 16586 - protein, 17 aa, Homo sapiens
  Heavy chain CDR3 for antibody 8293 (IGHV4-59)
ARDRELLWFGEFGGMDV

SEQ ID NO: 16587 - protein, 9 aa, Homo sapiens
  Light chain CDR3 for antibody 8294 (IGKV5-2)
LQHDNFPYT

SEQ ID NO: 16588 - protein, 15 aa, Homo sapiens
  Heavy chain CDR3 for antibody 8294 (IGHV3-33)
ARGYYYGSGSYPLDY

SEQ ID NO: 16589 - protein, 9 aa, Homo sapiens
  Light chain CDR3 for antibody 8295 (IGKV1D-13)
QRFNNYLYT

SEQ ID NO: 16590 - protein, 16 aa, Homo sapiens
  Heavy chain CDR3 for antibody 8295 (IGHV4-59)
ARDTPYYSGSGRPFDS

SEQ ID NO: 16591 - protein, 8 aa, Homo sapiens
  Light chain CDR3 for antibody 8296 (IGKV1-5)
QQYNSYWT

SEQ ID NO: 16592 - protein, 16 aa, Homo sapiens
  Heavy chain CDR3 for antibody 8296 (IGHV3-33)
ARDQGILTGYYTALDY

SEQ ID NO: 16593 - protein, 9 aa, Homo sapiens
  Light chain CDR3 for antibody 8297 (IGKV3-20)
QQFGRSPRT

SEQ ID NO: 16594 - protein, 15 aa, Homo sapiens
  Heavy chain CDR3 for antibody 8297 (IGHV3-20)
ARDRGSSGWRDWFDP

SEQ ID NO: 16595 - protein, 9 aa, Homo sapiens
  Light chain CDR3 for antibody 8298 (IGKV2D-28)
MQALQTPFT

SEQ ID NO: 16596 - protein, 18 aa, Homo sapiens
  Heavy chain CDR3 for antibody 8298 (IGHV3-33)
ARGLLWFGVSYYYYGMDV

SEQ ID NO: 16597 - protein, 11 aa, Homo sapiens
  Light chain CDR3 for antibody 8299 (IGKV3-11)
QQRSNWPPTWT

SEQ ID NO: 16598 - protein, 15 aa, Homo sapiens
  Heavy chain CDR3 for antibody 8299 (IGHV3-33)
ARDRGWKAPGYGMDV

SEQ ID NO: 16599 - protein, 8 aa, Homo sapiens
  Light chain CDR3 for antibody 8300 (IGKV3-11)
LQRGNWPT

SEQ ID NO: 16600 - protein, 13 aa, Homo sapiens
  Heavy chain CDR3 for antibody 8300 (IGHV3-23)
ASPFNWNDGFFDY

SEQ ID NO: 16601 - protein, 9 aa, Homo sapiens
  Light chain CDR3 for antibody 8301 (IGKV1-6)
LQDYNYPYT

SEQ ID NO: 16602 - protein, 18 aa, Homo sapiens
  Heavy chain CDR3 for antibody 8301 (IGHV3-30)
ARDGYSGYDSYYYYGMDV

SEQ ID NO: 16603 - protein, 10 aa, Homo sapiens
  Light chain CDR3 for antibody 8302 (IGKV3-15)
QQYNNWPPYT

SEQ ID NO: 16604 - protein, 13 aa, Homo sapiens
  Heavy chain CDR3 for antibody 8302 (IGHV4-39)
ARHVLLWFGEFDP

SEQ ID NO: 16605 - protein, 9 aa, Homo sapiens
  Light chain CDR3 for antibody 8303 (IGKV3D-7)
QQDYNLPRT

SEQ ID NO: 16606 - protein, 15 aa, Homo sapiens
  Heavy chain CDR3 for antibody 8303 (IGHV3-33)
ARDALAVTGTGWFDP

SEQ ID NO: 16607 - protein, 9 aa, Homo sapiens
  Light chain CDR3 for antibody 8304 (IGKV3D-7)
QQDYKLPLT

SEQ ID NO: 16608 - protein, 12 aa, Homo sapiens
  Heavy chain CDR3 for antibody 8304 (IGHV3-33)
VRKWFGELYFDY

SEQ ID NO: 16609 - protein, 9 aa, Homo sapiens
  Light chain CDR3 for antibody 8305 (IGKV1-5)
QQYNTYSRT

SEQ ID NO: 16610 - protein, 9 aa, Homo sapiens
  Heavy chain CDR3 for antibody 8305 (IGHV4-59)
ARGGASFDY

SEQ ID NO: 16611 - protein, 9 aa, Homo sapiens
  Light chain CDR3 for antibody 8306 (IGKV1-16)
QKYNSNPLT

SEQ ID NO: 16612 - protein, 13 aa, Homo sapiens
  Heavy chain CDR3 for antibody 8306 (IGHV3-33)
ARIDYYSYYGMDV

SEQ ID NO: 16613 - protein, 9 aa, Homo sapiens
  Light chain CDR3 for antibody 8307 (IGKV1-16)
QHYNDYPFT

SEQ ID NO: 16614 - protein, 14 aa, Homo sapiens
  Heavy chain CDR3 for antibody 8307 (IGHV3-33)
ARTTAAAGPRDFQH

SEQ ID NO: 16615 - protein, 10 aa, Homo sapiens
  Light chain CDR3 for antibody 8308 (IGKV3-11)
QQRSNWPPFT

SEQ ID NO: 16616 - protein, 13 aa, Homo sapiens
  Heavy chain CDR3 for antibody 8308 (IGHV3-11)
ARDEGYSGYNLDN

SEQ ID NO: 16617 - protein, 8 aa, Homo sapiens
  Light chain CDR3 for antibody 8309 (IGKV1D-13)
QQFNNYPT

SEQ ID NO: 16618 - protein, 11 aa, Homo sapiens
  Heavy chain CDR3 for antibody 8309 (IGHV3-33)
ARSLRYSVFDY

SEQ ID NO: 16619 - protein, 8 aa, Homo sapiens
  Light chain CDR3 for antibody 8310 (IGKV1-5)
QQYNSYWT

SEQ ID NO: 16620 - protein, 17 aa, Homo sapiens
  Heavy chain CDR3 for antibody 8310 (IGHV3-33)
ARGDGDILTGYYEWFDP

SEQ ID NO: 16621 - protein, 9 aa, Homo sapiens
  Light chain CDR3 for antibody 8311 (IGKV3-15)
QQYNNWPLT

SEQ ID NO: 16622 - protein, 8 aa, Homo sapiens
  Heavy chain CDR3 for antibody 8311 (IGHV3-20)
APHWIFDY

SEQ ID NO: 16623 - protein, 9 aa, Homo sapiens
  Light chain CDR3 for antibody 8312 (IGKV2-30)
MQGTHWPLT

SEQ ID NO: 16624 - protein, 17 aa, Homo sapiens
  Heavy chain CDR3 for antibody 8312 (IGHV3-66)
ARVQYDILTGYSPYFDN

SEQ ID NO: 16625 - protein, 9 aa, Homo sapiens
  Light chain CDR3 for antibody 8313 (IGKV2-30)
MQGTHWPLT

SEQ ID NO: 16626 - protein, 26 aa, Homo sapiens
  Heavy chain CDR3 for antibody 8313 (IGHV4-39)
ARQGLLWFGDLKAYDSSGYYYGYFHH

SEQ ID NO: 16627 - protein, 9 aa, Homo sapiens
  Light chain CDR3 for antibody 8314 (IGKV1-9)
QQLNSYPRT

SEQ ID NO: 16628 - protein, 18 aa, Homo sapiens
  Heavy chain CDR3 for antibody 8314 (IGHV3-33)
ARDRYHDILTGYYMGFDY

SEQ ID NO: 16629 - protein, 9 aa, Homo sapiens
  Light chain CDR3 for antibody 8315 (IGKV1-39)
QQSYSTPYT

SEQ ID NO: 16630 - protein, 19 aa, Homo sapiens
  Heavy chain CDR3 for antibody 8315 (IGHV1-18)
ARDTTLVRGLMNYYYGMDV

SEQ ID NO: 16631 - protein, 8 aa, Homo sapiens
  Light chain CDR3 for antibody 8316 (IGKV3-20)
QQYGRSWT

SEQ ID NO: 16632 - protein, 13 aa, Homo sapiens
  Heavy chain CDR3 for antibody 8316 (IGHV3-33)
ANTGDSYYYDMDV

SEQ ID NO: 16633 - protein, 9 aa, Homo sapiens
  Light chain CDR3 for antibody 8317 (IGKV1D-16)
QQYNSYPYT

SEQ ID NO: 16634 - protein, 16 aa, Homo sapiens
  Heavy chain CDR3 for antibody 8317 (IGHV1-24)
ATEDSSSYYYYYGMDV

SEQ ID NO: 16635 - protein, 9 aa, Homo sapiens
  Light chain CDR3 for antibody 8318 (IGKV3-11)
QQRSNWMYT

SEQ ID NO: 16636 - protein, 12 aa, Homo sapiens
  Heavy chain CDR3 for antibody 8318 (IGHV3-13)
VREAGIPDAFDI

SEQ ID NO: 16637 - protein, 9 aa, Homo sapiens
  Light chain CDR3 for antibody 8319 (IGKV3-11)
QQRSSWPPT

SEQ ID NO: 16638 - protein, 15 aa, Homo sapiens
  Heavy chain CDR3 for antibody 8319 (IGHV3-33)
ARDALAVTGTGWFDP

SEQ ID NO: 16639 - protein, 9 aa, Homo sapiens
  Light chain CDR3 for antibody 8320 (IGKV1-17)
LQHNSYPRT

SEQ ID NO: 16640 - protein, 17 aa, Homo sapiens
  Heavy chain CDR3 for antibody 8320 (IGHV1-18)
ARERYYGSGNYKYNMDV

SEQ ID NO: 16641 - protein, 9 aa, Homo sapiens
  Light chain CDR3 for antibody 8321 (IGKV1-17)
LQHNSYPWT

SEQ ID NO: 16642 - protein, 20 aa, Homo sapiens
  Heavy chain CDR3 for antibody 8321 (IGHV1-f)
ATDTMVRGVIIEDYYYGMDV

SEQ ID NO: 16643 - protein, 9 aa, Homo sapiens
  Light chain CDR3 for antibody 8322 (IGKV5-2)
LQHDNFPTT

SEQ ID NO: 16644 - protein, 12 aa, Homo sapiens
  Heavy chain CDR3 for antibody 8322 (IGHV3-21)
ARDGGRYGDFDY

SEQ ID NO: 16645 - protein, 9 aa, Homo sapiens
  Light chain CDR3 for antibody 8323 (IGKV3-11)
QQRSNWMYT

SEQ ID NO: 16646 - protein, 12 aa, Homo sapiens
  Heavy chain CDR3 for antibody 8323 (IGHV3-33)
ARVDAAAPYFDY

SEQ ID NO: 16647 - protein, 8 aa, Homo sapiens
  Light chain CDR3 for antibody 8324 (IGKV3D-7)
QQDYNLVT

SEQ ID NO: 16648 - protein, 14 aa, Homo sapiens
  Heavy chain CDR3 for antibody 8324 (IGHV1-24)
ATWLPLYYYYGMDV

SEQ ID NO: 16649 - protein, 9 aa, Homo sapiens
  Light chain CDR3 for antibody 8325 (IGKV1D-16)
QQYNSYPYT

SEQ ID NO: 16650 - protein, 17 aa, Homo sapiens
  Heavy chain CDR3 for antibody 8325 (IGHV1-18)
ARERYYGSGSYYYGMDV

SEQ ID NO: 16651 - protein, 10 aa, Homo sapiens
  Light chain CDR3 for antibody 8326 (IGKV1-13)
QQLDSYPMYT

SEQ ID NO: 16652 - protein, 10 aa, Homo sapiens
  Heavy chain CDR3 for antibody 8326 (IGHV3-23)
AKGDRWRFDP

SEQ ID NO: 16653 - protein, 9 aa, Homo sapiens
  Light chain CDR3 for antibody 8327 (IGKV1-16)
QHYNDYPFT

SEQ ID NO: 16654 - protein, 14 aa, Homo sapiens
  Heavy chain CDR3 for antibody 8327 (IGHV3-33)
AREGYSSNWYDFDY

SEQ ID NO: 16655 - protein, 9 aa, Homo sapiens
  Light chain CDR3 for antibody 8328 (IGKV1-17)
QQFNNYPYT

SEQ ID NO: 16656 - protein, 14 aa, Homo sapiens
  Heavy chain CDR3 for antibody 8328 (IGHV3-33)
AREGYSSGWDYFDH

SEQ ID NO: 16657 - protein, 9 aa, Homo sapiens
  Light chain CDR3 for antibody 8329 (IGKV3D-7)
QQDYKLPLT

SEQ ID NO: 16658 - protein, 17 aa, Homo sapiens
  Heavy chain CDR3 for antibody 8329 (IGHV1-46)
ARERYYGSGIYKYAMDV

SEQ ID NO: 16659 - protein, 9 aa, Homo sapiens
  Light chain CDR3 for antibody 8330 (IGKV5-2)
LQHDNFPWT

SEQ ID NO: 16660 - protein, 15 aa, Homo sapiens
  Heavy chain CDR3 for antibody 8330 (IGHV3-64)
ARDSHHDLLTGHYEY

SEQ ID NO: 16661 - protein, 11 aa, Homo sapiens
  Light chain CDR3 for antibody 8331 (IGKV3-11)
QQRSNWPPTWT

SEQ ID NO: 16662 - protein, 13 aa, Homo sapiens
  Heavy chain CDR3 for antibody 8331 (IGHV4-59)
ANRDYYGYYGMDV

SEQ ID NO: 16663 - protein, 9 aa, Homo sapiens
  Light chain CDR3 for antibody 8332 (IGKV6-21)
QQSSNLPHT

SEQ ID NO: 16664 - protein, 11 aa, Homo sapiens
  Heavy chain CDR3 for antibody 8332 (IGHV3-33)
ARDRSSGPFDY

SEQ ID NO: 16665 - protein, 9 aa, Homo sapiens
  Light chain CDR3 for antibody 8333 (IGKV1-39)
QQGFSTPWT

SEQ ID NO: 16666 - protein, 9 aa, Homo sapiens
  Heavy chain CDR3 for antibody 8333 (IGHV4-59)
AREGGSGSL

SEQ ID NO: 16667 - protein, 9 aa, Homo sapiens
  Light chain CDR3 for antibody 8334 (IGKV1-39)
QQSYRTPLT

SEQ ID NO: 16668 - protein, 16 aa, Homo sapiens
  Heavy chain CDR3 for antibody 8334 (IGHV3-11)
ARDAGYPNYDYYGMDV

SEQ ID NO: 16669 - protein, 9 aa, Homo sapiens
  Light chain CDR3 for antibody 8335 (IGKV3D-7)
QQDYNLPLT

SEQ ID NO: 16670 - protein, 12 aa, Homo sapiens
  Heavy chain CDR3 for antibody 8335 (IGHV4-59)
ARRDGSGTSFDY

SEQ ID NO: 16671 - protein, 9 aa, Homo sapiens
  Light chain CDR3 for antibody 8336 (IGKV1-16)
QHYNDYPFT

SEQ ID NO: 16672 - protein, 9 aa, Homo sapiens
  Heavy chain CDR3 for antibody 8336 (IGHV3-33)
ARATVGVDY

SEQ ID NO: 16673 - protein, 9 aa, Homo sapiens
  Light chain CDR3 for antibody 8337 (IGKV3-20)
QQYGSSPRT

SEQ ID NO: 16674 - protein, 14 aa, Homo sapiens
  Heavy chain CDR3 for antibody 8337 (IGHV3-33)
ARDGIVRATDAFAI

SEQ ID NO: 16675 - protein, 9 aa, Homo sapiens
  Light chain CDR3 for antibody 8338 (IGKV1-39)
QQSYSTPLT

SEQ ID NO: 16676 - protein, 12 aa, Homo sapiens
  Heavy chain CDR3 for antibody 8338 (IGHV3-23)
AKGYTSFWYFDL

SEQ ID NO: 16677 - protein, 9 aa, Homo sapiens
  Light chain CDR3 for antibody 8339 (IGKV1-39)
QQSYSTPLT

SEQ ID NO: 16678 - protein, 17 aa, Homo sapiens
  Heavy chain CDR3 for antibody 8339 (IGHV3-23)
SKERNWNDGYYYFGMDA

SEQ ID NO: 16679 - protein, 9 aa, Homo sapiens
  Light chain CDR3 for antibody 8340 (IGKV5-2)
LQHDNFPWT

SEQ ID NO: 16680 - protein, 13 aa, Homo sapiens
  Heavy chain CDR3 for antibody 8340 (IGHV4-34)
ARDEGYRGYGLDS

SEQ ID NO: 16681 - protein, 9 aa, Homo sapiens
  Light chain CDR3 for antibody 8341 (IGKV1-17)
LQHNSYPYT

SEQ ID NO: 16682 - protein, 15 aa, Homo sapiens
  Heavy chain CDR3 for antibody 8341 (IGHV3-13)
ARDRSYESYYYGMDV

SEQ ID NO: 16683 - protein, 9 aa, Homo sapiens
  Light chain CDR3 for antibody 8342 (IGKV3-20)
QQYGSSPYT

SEQ ID NO: 16684 - protein, 17 aa, Homo sapiens
  Heavy chain CDR3 for antibody 8342 (IGHV3-33)
ARDPWIYSGYGGGWFDP

SEQ ID NO: 16685 - protein, 9 aa, Homo sapiens
  Light chain CDR3 for antibody 8343 (IGKV3D-7)
QQDYNLPYT

SEQ ID NO: 16686 - protein, 10 aa, Homo sapiens
  Heavy chain CDR3 for antibody 8343 (IGHV3-23)
AKENWNDFDY

SEQ ID NO: 16687 - protein, 9 aa, Homo sapiens
  Light chain CDR3 for antibody 8344 (IGKV1D-16)
QQYDSYPWT

SEQ ID NO: 16688 - protein, 14 aa, Homo sapiens
  Heavy chain CDR3 for antibody 8344 (IGHV3-33)
ARTTAAAGPRDFQH

SEQ ID NO: 16689 - protein, 9 aa, Homo sapiens
  Light chain CDR3 for antibody 8345 (IGKV1-17)
LHSNNYPWT

SEQ ID NO: 16690 - protein, 15 aa, Homo sapiens
  Heavy chain CDR3 for antibody 8345 (IGHV3-30)
ARGAMVRGVDYGMDV

SEQ ID NO: 16691 - protein, 9 aa, Homo sapiens
  Light chain CDR3 for antibody 8346 (IGKV1D-13)
QQFNNYPYT

SEQ ID NO: 16692 - protein, 17 aa, Homo sapiens
  Heavy chain CDR3 for antibody 8346 (IGHV3-33)
ARKDYGILSGYYSPFDY

SEQ ID NO: 16693 - protein, 9 aa, Homo sapiens
  Light chain CDR3 for antibody 8347 (IGKV1-17)
LQHNSYPWT

SEQ ID NO: 16694 - protein, 12 aa, Homo sapiens
  Heavy chain CDR3 for antibody 8347 (IGHV6-1)
ARDIMVRGVIDY

SEQ ID NO: 16695 - protein, 9 aa, Homo sapiens
  Light chain CDR3 for antibody 8348 (IGKV1-6)
LQVYSYPWT

SEQ ID NO: 16696 - protein, 20 aa, Homo sapiens
  Heavy chain CDR3 for antibody 8348 (IGHV3-11)
ARGGATLIRGLIDYYYGMDV

SEQ ID NO: 16697 - protein, 9 aa, Homo sapiens
  Light chain CDR3 for antibody 8349 (IGKV3D-7)
QQDYNLPWT

SEQ ID NO: 16698 - protein, 15 aa, Homo sapiens
  Heavy chain CDR3 for antibody 8349 (IGHV4-39)
ARHSGYSSGWYPFDY

SEQ ID NO: 16699 - protein, 9 aa, Homo sapiens
  Light chain CDR3 for antibody 8350 (IGKV1-9)
QQLKSYLYT

SEQ ID NO: 16700 - protein, 15 aa, Homo sapiens
  Heavy chain CDR3 for antibody 8350 (IGHV3-11)
ARDRAVAGTIHAFDI

SEQ ID NO: 16701 - protein, 9 aa, Homo sapiens
  Light chain CDR3 for antibody 8351 (IGKV1-17)
LQYNSYPWT

SEQ ID NO: 16702 - protein, 17 aa, Homo sapiens
  Heavy chain CDR3 for antibody 8351 (IGHV3-33)
ARGEQWLGYYYYCGMDV

SEQ ID NO: 16703 - protein, 9 aa, Homo sapiens
  Light chain CDR3 for antibody 8352 (IGKV1D-16)
QQYNSFPLT

SEQ ID NO: 16704 - protein, 15 aa, Homo sapiens
  Heavy chain CDR3 for antibody 8352 (IGHV4-59)
ARDLGHYYGSVSIDY

SEQ ID NO: 16705 - protein, 9 aa, Homo sapiens
  Light chain CDR3 for antibody 8353 (IGKV1-6)
LQDYNYPFT

SEQ ID NO: 16706 - protein, 14 aa, Homo sapiens
  Heavy chain CDR3 for antibody 8353 (IGHV3-33)
ARDKSYPLSYGMDV

SEQ ID NO: 16707 - protein, 9 aa, Homo sapiens
  Light chain CDR3 for antibody 8354 (IGKV1-39)
QQSYSTPYT

SEQ ID NO: 16708 - protein, 15 aa, Homo sapiens
  Heavy chain CDR3 for antibody 8354 (IGHV1-18)
ARDLGYYGSGSRMDV

SEQ ID NO: 16709 - protein, 9 aa, Homo sapiens
  Light chain CDR3 for antibody 8355 (IGKV1-9)
QQLYTYPYT

SEQ ID NO: 16710 - protein, 11 aa, Homo sapiens
  Heavy chain CDR3 for antibody 8355 (IGHV3-33)
ARDRSSGPFDY

SEQ ID NO: 16711 - protein, 9 aa, Homo sapiens
  Light chain CDR3 for antibody 8356 (IGKV3-11)
QQYGSSPYT

SEQ ID NO: 16712 - protein, 10 aa, Homo sapiens
  Heavy chain CDR3 for antibody 8356 (IGHV3-23)
AKDRYGDYVY

SEQ ID NO: 16713 - protein, 8 aa, Homo sapiens
  Light chain CDR3 for antibody 8357 (IGKV3-11)
LQRGNWPT

SEQ ID NO: 16714 - protein, 14 aa, Homo sapiens
  Heavy chain CDR3 for antibody 8357 (IGHV3-33)
ARDREQQLVRYFDY

SEQ ID NO: 16715 - protein, 9 aa, Homo sapiens
  Light chain CDR3 for antibody 8358 (IGKV1-27)
QKYNSAPYT

SEQ ID NO: 16716 - protein, 11 aa, Homo sapiens
  Heavy chain CDR3 for antibody 8358 (IGHV3-33)
ARDRATAGLDY

SEQ ID NO: 16717 - protein, 9 aa, Homo sapiens
  Light chain CDR3 for antibody 8359 (IGKV3-11)
QQRSNWMYT

SEQ ID NO: 16718 - protein, 12 aa, Homo sapiens
  Heavy chain CDR3 for antibody 8359 (IGHV4-59)
ARDSGSYYYFDY

SEQ ID NO: 16719 - protein, 9 aa, Homo sapiens
  Light chain CDR3 for antibody 8360 (IGKV3-15)
QQYNNWPRT

SEQ ID NO: 16720 - protein, 17 aa, Homo sapiens
  Heavy chain CDR3 for antibody 8360 (IGHV3-33)
ARDQDDILTGYYWYFDL

SEQ ID NO: 16721 - protein, 9 aa, Homo sapiens
  Light chain CDR3 for antibody 8361 (IGKV1-6)
QKYNSAPYT

SEQ ID NO: 16722 - protein, 13 aa, Homo sapiens
  Heavy chain CDR3 for antibody 8361 (IGHV3-33)
ARDYGDYLNWFDP

SEQ ID NO: 16723 - protein, 9 aa, Homo sapiens
  Light chain CDR3 for antibody 8362 (IGKV1D-13)
QQFNNYPST

SEQ ID NO: 16724 - protein, 15 aa, Homo sapiens
  Heavy chain CDR3 for antibody 8362 (IGHV3-20)
AREGPYYYGSGSLDY

SEQ ID NO: 16725 - protein, 9 aa, Homo sapiens
  Light chain CDR3 for antibody 8363 (IGKV1-6)
LQDYNYPWT

SEQ ID NO: 16726 - protein, 19 aa, Homo sapiens
  Heavy chain CDR3 for antibody 8363 (IGHV3-23)
AKDREWAAAGHYYYYGMDV

SEQ ID NO: 16727 - protein, 9 aa, Homo sapiens
  Light chain CDR3 for antibody 8364 (IGKV1-6)
LQDYKSPFT

SEQ ID NO: 16728 - protein, 17 aa, Homo sapiens
  Heavy chain CDR3 for antibody 8364 (IGHV3-33)
ARGEQWLGYYYYYGMDV

SEQ ID NO: 16729 - protein, 9 aa, Homo sapiens
  Light chain CDR3 for antibody 8365 (IGKV2-30)
MQGTHWPLT

SEQ ID NO: 16730 - protein, 14 aa, Homo sapiens
  Heavy chain CDR3 for antibody 8365 (IGHV3-33)
VRDQGSMVRGGGDY

SEQ ID NO: 16731 - protein, 9 aa, Homo sapiens
  Light chain CDR3 for antibody 8366 (IGKV3D-7)
QQDYNLPLT

SEQ ID NO: 16732 - protein, 14 aa, Homo sapiens
  Heavy chain CDR3 for antibody 8366 (IGHV3-20)
ARDGGSTCYDWFDP

SEQ ID NO: 16733 - protein, 10 aa, Homo sapiens
  Light chain CDR3 for antibody 8367 (IGKV3-11)
QQRSNWPTWT

SEQ ID NO: 16734 - protein, 12 aa, Homo sapiens
  Heavy chain CDR3 for antibody 8367 (IGHV3-33)
ARDSSGWSHFDY

SEQ ID NO: 16735 - protein, 10 aa, Homo sapiens
  Light chain CDR3 for antibody 8368 (IGKV1-17)
LQHNSYPMYT

SEQ ID NO: 16736 - protein, 17 aa, Homo sapiens
  Heavy chain CDR3 for antibody 8368 (IGHV3-33)
ARESLKLGIYYYYGMDV

SEQ ID NO: 16737 - protein, 9 aa, Homo sapiens
  Light chain CDR3 for antibody 8369 (IGKV1-27)
QKYNSAPYT

SEQ ID NO: 16738 - protein, 20 aa, Homo sapiens
  Heavy chain CDR3 for antibody 8369 (IGHV1-f)
ATGLITFVRGVILTYRSFDY

SEQ ID NO: 16739 - protein, 9 aa, Homo sapiens
  Light chain CDR3 for antibody 8370 (IGKV1-6)
LQDYNYTWT

SEQ ID NO: 16740 - protein, 9 aa, Homo sapiens
  Heavy chain CDR3 for antibody 8370 (IGHV3-30)
ARPNWGFDY

SEQ ID NO: 16741 - protein, 10 aa, Homo sapiens
  Light chain CDR3 for antibody 8371 (IGKV1-39)
QQSYSTPMYT

SEQ ID NO: 16742 - protein, 11 aa, Homo sapiens
  Heavy chain CDR3 for antibody 8371 (IGHV3-33)
ARGTTVTHFDY

SEQ ID NO: 16743 - protein, 9 aa, Homo sapiens
  Light chain CDR3 for antibody 8372 (IGKV2D-24)
TQATQFPHT

SEQ ID NO: 16744 - protein, 18 aa, Homo sapiens
  Heavy chain CDR3 for antibody 8372 (IGHV1-46)
ARDGDYVWGSYRSDWFDP

SEQ ID NO: 16745 - protein, 10 aa, Homo sapiens
  Light chain CDR3 for antibody 8373 (IGKV3-20)
QQYGSSPPYT

SEQ ID NO: 16746 - protein, 9 aa, Homo sapiens
  Heavy chain CDR3 for antibody 8373 (IGHV3-30)
ARPNWGFDY

SEQ ID NO: 16747 - protein, 10 aa, Homo sapiens
  Light chain CDR3 for antibody 8374 (IGKV1-39)
QQSYSTPMYT

SEQ ID NO: 16748 - protein, 18 aa, Homo sapiens
  Heavy chain CDR3 for antibody 8374 (IGHV3-33)
AREGYFGSGSYYRNWFDP

SEQ ID NO: 16749 - protein, 9 aa, Homo sapiens
  Light chain CDR3 for antibody 8375 (IGKV1-27)
QKYNSAPYT

SEQ ID NO: 16750 - protein, 15 aa, Homo sapiens
  Heavy chain CDR3 for antibody 8375 (IGHV3-23)
AKDLSSGWYAYFFDY

SEQ ID NO: 16751 - protein, 9 aa, Homo sapiens
  Light chain CDR3 for antibody 8376 (IGKV3-15)
QQYNNWPLT

SEQ ID NO: 16752 - protein, 15 aa, Homo sapiens
  Heavy chain CDR3 for antibody 8376 (IGHV1-18)
ARIYYGSGSSYYFDY

SEQ ID NO: 16753 - protein, 9 aa, Homo sapiens
  Light chain CDR3 for antibody 8377 (IGKV1D-13)
QQFNNYPHT

SEQ ID NO: 16754 - protein, 16 aa, Homo sapiens
  Heavy chain CDR3 for antibody 8377 (IGHV4-59)
AGGSGSYRDYYYGMDV

SEQ ID NO: 16755 - protein, 9 aa, Homo sapiens
  Light chain CDR3 for antibody 8378 (IGKV4-1)
QQYYSTPWT

SEQ ID NO: 16756 - protein, 14 aa, Homo sapiens
  Heavy chain CDR3 for antibody 8378 (IGHV3-64)
ARDRIAAASSDFDC

SEQ ID NO: 16757 - protein, 9 aa, Homo sapiens
  Light chain CDR3 for antibody 8379 (IGKV5-2)
LQHDNFPYT

SEQ ID NO: 16758 - protein, 16 aa, Homo sapiens
  Heavy chain CDR3 for antibody 8379 (IGHV3-33)
ARPTYYDILTGYPFDY

SEQ ID NO: 16759 - protein, 9 aa, Homo sapiens
  Light chain CDR3 for antibody 8380 (IGKV1D-16)
QQYDSYPWT

SEQ ID NO: 16760 - protein, 19 aa, Homo sapiens
  Heavy chain CDR3 for antibody 8380 (IGHV3-33)
TRDPHYDILTGYAYYGMDV

SEQ ID NO: 16761 - protein, 10 aa, Homo sapiens
  Light chain CDR3 for antibody 8381 (IGKV1-17)
LQHNSYPMYT

SEQ ID NO: 16762 - protein, 14 aa, Homo sapiens
  Heavy chain CDR3 for antibody 8381 (IGHV4-39)
ARQDYDILTGLFDY

SEQ ID NO: 16763 - protein, 8 aa, Homo sapiens
  Light chain CDR3 for antibody 8382 (IGKV3D-7)
QQDYNLLT

SEQ ID NO: 16764 - protein, 8 aa, Homo sapiens
  Heavy chain CDR3 for antibody 8382 (IGHV3-23)
AETFLFDY

SEQ ID NO: 16765 - protein, 10 aa, Homo sapiens
  Light chain CDR3 for antibody 8383 (IGKV3-11)
QQRSNWPIFT

SEQ ID NO: 16766 - protein, 16 aa, Homo sapiens
  Heavy chain CDR3 for antibody 8383 (IGHV4-59)
ARYSGSYYGDYYGMDV

SEQ ID NO: 16767 - protein, 9 aa, Homo sapiens
  Light chain CDR3 for antibody 8384 (IGKV4-1)
QQYYTTPPT

SEQ ID NO: 16768 - protein, 13 aa, Homo sapiens
  Heavy chain CDR3 for antibody 8384 (IGHV4-34)
ASNFYYYYYGMDV

SEQ ID NO: 16769 - protein, 9 aa, Homo sapiens
  Light chain CDR3 for antibody 8385 (IGKV3D-20)
QQYGRSPRT

SEQ ID NO: 16770 - protein, 16 aa, Homo sapiens
  Heavy chain CDR3 for antibody 8385 (IGHV1-8)
AREGTMVRGVTYALDI

SEQ ID NO: 16771 - protein, 9 aa, Homo sapiens
  Light chain CDR3 for antibody 8386 (IGKV3D-7)
QQDYNLPLT

SEQ ID NO: 16772 - protein, 15 aa, Homo sapiens
  Heavy chain CDR3 for antibody 8386 (IGHV3-33)
ARDGSGSYSLYGMDV

SEQ ID NO: 16773 - protein, 10 aa, Homo sapiens
  Light chain CDR3 for antibody 8387 (IGKV1-9)
QQLDSYPMYT

SEQ ID NO: 16774 - protein, 14 aa, Homo sapiens
  Heavy chain CDR3 for antibody 8387 (IGHV3-33)
ARDWNDVYYYGMDV

SEQ ID NO: 16775 - protein, 9 aa, Homo sapiens
  Light chain CDR3 for antibody 8388 (IGKV1D-16)
QQYITYPYT

SEQ ID NO: 16776 - protein, 17 aa, Homo sapiens
  Heavy chain CDR3 for antibody 8388 (IGHV3-33)
ARGYCSRTSCYLYYFDY

SEQ ID NO: 16777 - protein, 9 aa, Homo sapiens
  Light chain CDR3 for antibody 8389 (IGKV6-21)
HQSSSLPYT

SEQ ID NO: 16778 - protein, 12 aa, Homo sapiens
  Heavy chain CDR3 for antibody 8389 (IGHV4-34)
ARGYSSSWYFDY

SEQ ID NO: 16779 - protein, 10 aa, Homo sapiens
  Light chain CDR3 for antibody 8390 (IGKV3-20)
QQYGRSPPVT

SEQ ID NO: 16780 - protein, 12 aa, Homo sapiens
  Heavy chain CDR3 for antibody 8390 (IGHV1-46)
ARGLTGDHAVDI

SEQ ID NO: 16781 - protein, 9 aa, Homo sapiens
  Light chain CDR3 for antibody 8391 (IGKV3D-7)
QQDYEFPLT

SEQ ID NO: 16782 - protein, 16 aa, Homo sapiens
  Heavy chain CDR3 for antibody 8391 (IGHV4-59)
AGGSGSYRDYYYGMDV

SEQ ID NO: 16783 - protein, 9 aa, Homo sapiens
  Light chain CDR3 for antibody 8392 (IGKV1-27)
QKYNSAPYT

SEQ ID NO: 16784 - protein, 11 aa, Homo sapiens
  Heavy chain CDR3 for antibody 8392 (IGHV1-24)
ATYFGSGSLDY

SEQ ID NO: 16785 - protein, 9 aa, Homo sapiens
  Light chain CDR3 for antibody 8393 (IGKV3D-7)
QQDYNLPWT

SEQ ID NO: 16786 - protein, 14 aa, Homo sapiens
  Heavy chain CDR3 for antibody 8393 (IGHV3-33)
VRDQGSMVRGGGDY

SEQ ID NO: 16787 - protein, 8 aa, Homo sapiens
  Light chain CDR3 for antibody 8394 (IGKV3-11)
QQRRNWLT

SEQ ID NO: 16788 - protein, 9 aa, Homo sapiens
  Heavy chain CDR3 for antibody 8394 (IGHV1-18)
ARGGWGFEY

SEQ ID NO: 16789 - protein, 9 aa, Homo sapiens
  Light chain CDR3 for antibody 8395 (IGKV1-16)
QQYNSYPRT

SEQ ID NO: 16790 - protein, 13 aa, Homo sapiens
  Heavy chain CDR3 for antibody 8395 (IGHV3-33)
ARDRYSGYGAFDY

SEQ ID NO: 16791 - protein, 9 aa, Homo sapiens
  Light chain CDR3 for antibody 8396 (IGKV1-17)
LQHYSYPRT

SEQ ID NO: 16792 - protein, 12 aa, Homo sapiens
  Heavy chain CDR3 for antibody 8396 (IGHV3-33)
AREGIAVAGVDP

SEQ ID NO: 16793 - protein, 9 aa, Homo sapiens
  Light chain CDR3 for antibody 8397 (IGKV1-6)
LQDYNYPRT

SEQ ID NO: 16794 - protein, 12 aa, Homo sapiens
  Heavy chain CDR3 for antibody 8397 (IGHV3-33)
ARESGGSYSFDY

SEQ ID NO: 16795 - protein, 8 aa, Homo sapiens
  Light chain CDR3 for antibody 8398 (IGKV3D-7)
QQDYNLLT

SEQ ID NO: 16796 - protein, 16 aa, Homo sapiens
  Heavy chain CDR3 for antibody 8398 (IGHV3-33)
ARDGSMVRRIHDAFDF

SEQ ID NO: 16797 - protein, 9 aa, Homo sapiens
  Light chain CDR3 for antibody 8399 (IGKV3-11)
QQRSNWQYT

SEQ ID NO: 16798 - protein, 15 aa, Homo sapiens
  Heavy chain CDR3 for antibody 8399 (IGHV3-33)
ARGYYYGSGSFPVDY

SEQ ID NO: 16799 - protein, 9 aa, Homo sapiens
  Light chain CDR3 for antibody 8400 (IGKV1D-13)
QQFNNYPST

SEQ ID NO: 16800 - protein, 10 aa, Homo sapiens
  Heavy chain CDR3 for antibody 8400 (IGHV4-31)
ARHGVAGTNY

SEQ ID NO: 16801 - protein, 9 aa, Homo sapiens
  Light chain CDR3 for antibody 8401 (IGKV1-9)
LQHNSYPRT

SEQ ID NO: 16802 - protein, 16 aa, Homo sapiens
  Heavy chain CDR3 for antibody 8401 (IGHV1-8)
ARGHYYGSGSYYNFDY

SEQ ID NO: 16803 - protein, 10 aa, Homo sapiens
  Light chain CDR3 for antibody 8402 (IGKV1-9)
QQLDSYPMYT

SEQ ID NO: 16804 - protein, 10 aa, Homo sapiens
  Heavy chain CDR3 for antibody 8402 (IGHV3-33)
ARENSTPLDY

SEQ ID NO: 16805 - protein, 9 aa, Homo sapiens
  Light chain CDR3 for antibody 8403 (IGKV3-20)
QQYGSSPRT

SEQ ID NO: 16806 - protein, 16 aa, Homo sapiens
  Heavy chain CDR3 for antibody 8403 (IGHV1-24)
ATEDSSAYYYYYGMDV

SEQ ID NO: 16807 - protein, 8 aa, Homo sapiens
  Light chain CDR3 for antibody 8404 (IGKV3-20)
QQYGSSFT

SEQ ID NO: 16808 - protein, 18 aa, Homo sapiens
  Heavy chain CDR3 for antibody 8404 (IGHV3-23)
AKVGDFFASGNYWDYFDY

SEQ ID NO: 16809 - protein, 8 aa, Homo sapiens
  Light chain CDR3 for antibody 8405 (IGKV3D-7)
QQDYSLLT

SEQ ID NO: 16810 - protein, 15 aa, Homo sapiens
  Heavy chain CDR3 for antibody 8405 (IGHV3-33)
ARDALAVTGTGWFDP

SEQ ID NO: 16811 - protein, 10 aa, Homo sapiens
  Light chain CDR3 for antibody 8406 (IGKV3-11)
QQRSNWPIFT

SEQ ID NO: 16812 - protein, 17 aa, Homo sapiens
  Heavy chain CDR3 for antibody 8406 (IGHV4-34)
ARDGSGSYTHYYYGMDV

SEQ ID NO: 16813 - protein, 9 aa, Homo sapiens
  Light chain CDR3 for antibody 8407 (IGKV1-39)
QQSYSTPYT

SEQ ID NO: 16814 - protein, 14 aa, Homo sapiens
  Heavy chain CDR3 for antibody 8407 (IGHV3-33)
ARDLDIMATSPFAY

SEQ ID NO: 16815 - protein, 9 aa, Homo sapiens
  Light chain CDR3 for antibody 8408 (IGKV1D-16)
QQYDSYPYT

SEQ ID NO: 16816 - protein, 12 aa, Homo sapiens
  Heavy chain CDR3 for antibody 8408 (IGHV3-33)
AREGDILTGYAL

SEQ ID NO: 16817 - protein, 10 aa, Homo sapiens
  Light chain CDR3 for antibody 8409 (IGKV3-15)
QQYNNWPPIT

SEQ ID NO: 16818 - protein, 18 aa, Homo sapiens
  Heavy chain CDR3 for antibody 8409 (IGHV3-23)
AKDGDYFGSGSYWGYFDL

SEQ ID NO: 16819 - protein, 10 aa, Homo sapiens
  Light chain CDR3 for antibody 8410 (IGKV3-15)
QQYNNWPPLT

SEQ ID NO: 16820 - protein, 21 aa, Homo sapiens
  Heavy chain CDR3 for antibody 8410 (IGHV3-23)
AKDIDYYGSGSYPLYYYGMDV

SEQ ID NO: 16821 - protein, 9 aa, Homo sapiens
  Light chain CDR3 for antibody 8411 (IGKV1-37)
QRTSNAPYT

SEQ ID NO: 16822 - protein, 9 aa, Homo sapiens
  Heavy chain CDR3 for antibody 8411 (IGHV3-13)
ARDRWYFDL

SEQ ID NO: 16823 - protein, 10 aa, Homo sapiens
  Light chain CDR3 for antibody 8412 (IGKV1-39)
QQSYSTPMYT

SEQ ID NO: 16824 - protein, 14 aa, Homo sapiens
  Heavy chain CDR3 for antibody 8412 (IGHV3-33)
ARDRRDFYYYGMDV

SEQ ID NO: 16825 - protein, 9 aa, Homo sapiens
  Light chain CDR3 for antibody 8413 (IGKV1D-13)
QRFNNYLYT

SEQ ID NO: 16826 - protein, 13 aa, Homo sapiens
  Heavy chain CDR3 for antibody 8413 (IGHV3-33)
ARGVLWFGELFDY

SEQ ID NO: 16827 - protein, 9 aa, Homo sapiens
  Light chain CDR3 for antibody 8414 (IGKV1D-16)
QQYITYPYT

SEQ ID NO: 16828 - protein, 14 aa, Homo sapiens
  Heavy chain CDR3 for antibody 8414 (IGHV3-33)
ARAISGSSYWYFDL

SEQ ID NO: 16829 - protein, 9 aa, Homo sapiens
  Light chain CDR3 for antibody 8415 (IGKV1-9)
QQLNRYPWT

SEQ ID NO: 16830 - protein, 17 aa, Homo sapiens
  Heavy chain CDR3 for antibody 8415 (IGHV3-23)
AKDGIGELSYYYYGMDV

SEQ ID NO: 16831 - protein, 8 aa, Homo sapiens
  Light chain CDR3 for antibody 8416 (IGKV3-11)
QQRSNWLT

SEQ ID NO: 16832 - protein, 12 aa, Homo sapiens
  Heavy chain CDR3 for antibody 8416 (IGHV1-18)
ARRDGSGTSFDY

SEQ ID NO: 16833 - protein, 9 aa, Homo sapiens
  Light chain CDR3 for antibody 8417 (IGKV6-21)
HQSSSLPYT

SEQ ID NO: 16834 - protein, 13 aa, Homo sapiens
  Heavy chain CDR3 for antibody 8417 (IGHV1-18)
ARGGGVRGAPLDY

SEQ ID NO: 16835 - protein, 10 aa, Homo sapiens
  Light chain CDR3 for antibody 8418 (IGKV1-39)
QQSYSTPMYT

SEQ ID NO: 16836 - protein, 15 aa, Homo sapiens
  Heavy chain CDR3 for antibody 8418 (IGHV3-23)
AKEFTMVRGVITPDY

SEQ ID NO: 16837 - protein, 9 aa, Homo sapiens
  Light chain CDR3 for antibody 8419 (IGKV3-15)
QQYNNWPRT

SEQ ID NO: 16838 - protein, 10 aa, Homo sapiens
  Heavy chain CDR3 for antibody 8419 (IGHV3-23)
AKGDRWRFDP

SEQ ID NO: 16839 - protein, 9 aa, Homo sapiens
  Light chain CDR3 for antibody 8420 (IGKV1D-16)
QQYHSYPFT

SEQ ID NO: 16840 - protein, 14 aa, Homo sapiens
  Heavy chain CDR3 for antibody 8420 (IGHV1-46)
ARKGIVGAFDAFGI

SEQ ID NO: 16841 - protein, 9 aa, Homo sapiens
  Light chain CDR3 for antibody 8421 (IGKV3-15)
QQYNNWPLT

SEQ ID NO: 16842 - protein, 15 aa, Homo sapiens
  Heavy chain CDR3 for antibody 8421 (IGHV4-39)
ARRDYDILTGYLFDY

SEQ ID NO: 16843 - protein, 9 aa, Homo sapiens
  Light chain CDR3 for antibody 8422 (IGKV4-1)
QQYYSTPWT

SEQ ID NO: 16844 - protein, 12 aa, Homo sapiens
  Heavy chain CDR3 for antibody 8422 (IGHV3-33)
AREGTRWVYFDY

SEQ ID NO: 16845 - protein, 10 aa, Homo sapiens
  Light chain CDR3 for antibody 8423 (IGKV3-11)
QQRSNWPIFT

SEQ ID NO: 16846 - protein, 14 aa, Homo sapiens
  Heavy chain CDR3 for antibody 8423 (IGHV3-20)
ARGGSSGWYDWFDP

SEQ ID NO: 16847 - protein, 9 aa, Homo sapiens
  Light chain CDR3 for antibody 8424 (IGKV1-9)
QQLKSYLYT

SEQ ID NO: 16848 - protein, 11 aa, Homo sapiens
  Heavy chain CDR3 for antibody 8424 (IGHV3-33)
ARDRSSGPFDY

SEQ ID NO: 16849 - protein, 9 aa, Homo sapiens
  Light chain CDR3 for antibody 8425 (IGKV1-6)
LQDYNYPFT

SEQ ID NO: 16850 - protein, 18 aa, Homo sapiens
  Heavy chain CDR3 for antibody 8425 (IGHV3-33)
ARRGYSGYDYYYYYGMDV

SEQ ID NO: 16851 - protein, 9 aa, Homo sapiens
  Light chain CDR3 for antibody 8426 (IGKV1-9)
QQLISYPLT

SEQ ID NO: 16852 - protein, 20 aa, Homo sapiens
  Heavy chain CDR3 for antibody 8426 (IGHV3-23)
AKDREMAATSHYYYYYGMDV

SEQ ID NO: 16853 - protein, 10 aa, Homo sapiens
  Light chain CDR3 for antibody 8427 (IGKV1-17)
LQHNSYPMYT

SEQ ID NO: 16854 - protein, 15 aa, Homo sapiens
  Heavy chain CDR3 for antibody 8427 (IGHV4-59)
ARDLGHYYGSVSIDY

SEQ ID NO: 16855 - protein, 10 aa, Homo sapiens
  Light chain CDR3 for antibody 8428 (IGKV3-11)
QQRSNWPIYT

SEQ ID NO: 16856 - protein, 11 aa, Homo sapiens
  Heavy chain CDR3 for antibody 8428 (IGHV3-64)
ARERGSYAFDI

SEQ ID NO: 16857 - protein, 10 aa, Homo sapiens
  Light chain CDR3 for antibody 8429 (IGKV1-17)
LQHNSYPMYT

SEQ ID NO: 16858 - protein, 10 aa, Homo sapiens
  Heavy chain CDR3 for antibody 8429 (IGHV3-33)
AREWFGGFDI

SEQ ID NO: 16859 - protein, 10 aa, Homo sapiens
  Light chain CDR3 for antibody 8430 (IGKV1-16)
QQSYSTPMYT

SEQ ID NO: 16860 - protein, 12 aa, Homo sapiens
  Heavy chain CDR3 for antibody 8430 (IGHV3-23)
AKEYDILTGYFH

SEQ ID NO: 16861 - protein, 9 aa, Homo sapiens
  Light chain CDR3 for antibody 8431 (IGKV1-6)
QQEYNYPLT

SEQ ID NO: 16862 - protein, 14 aa, Homo sapiens
  Heavy chain CDR3 for antibody 8431 (IGHV3-33)
ARDNILTVYYLFDY

SEQ ID NO: 16863 - protein, 9 aa, Homo sapiens
  Light chain CDR3 for antibody 8432 (IGKV1-6)
LQDYNYPYT

SEQ ID NO: 16864 - protein, 17 aa, Homo sapiens
  Heavy chain CDR3 for antibody 8432 (IGHV3-33)
ARDQYSGYDFYYYGMDV

SEQ ID NO: 16865 - protein, 8 aa, Homo sapiens
  Light chain CDR3 for antibody 8433 (IGKV1-5)
QQYNSYWT

SEQ ID NO: 16866 - protein, 15 aa, Homo sapiens
  Heavy chain CDR3 for antibody 8433 (IGHV3-33)
VCVLYDYGDYVGFDY

SEQ ID NO: 16867 - protein, 8 aa, Homo sapiens
  Light chain CDR3 for antibody 8434 (IGKV1-5)
QQYNSYWT

SEQ ID NO: 16868 - protein, 18 aa, Homo sapiens
  Heavy chain CDR3 for antibody 8434 (IGHV3-33)
ARGYYGSGNFYKDSGMDV

SEQ ID NO: 16869 - protein, 9 aa, Homo sapiens
  Light chain CDR3 for antibody 8435 (IGKV1-39)
QQSYSTPYT

SEQ ID NO: 16870 - protein, 12 aa, Homo sapiens
  Heavy chain CDR3 for antibody 8435 (IGHV3-33)
ARDGRAAAYFDN

SEQ ID NO: 16871 - protein, 9 aa, Homo sapiens
  Light chain CDR3 for antibody 8436 (IGKV1-6)
LQDFNYPRT

SEQ ID NO: 16872 - protein, 12 aa, Homo sapiens
  Heavy chain CDR3 for antibody 8436 (IGHV4-39)
ARDSGSYYFFDY

SEQ ID NO: 16873 - protein, 9 aa, Homo sapiens
  Light chain CDR3 for antibody 8437 (IGKV1-17)
LQHNSYPYT

SEQ ID NO: 16874 - protein, 16 aa, Homo sapiens
  Heavy chain CDR3 for antibody 8437 (IGHV4-39)
ARRVPYYDILTGYLDY

SEQ ID NO: 16875 - protein, 9 aa, Homo sapiens
  Light chain CDR3 for antibody 8438 (IGKV1-5)
QQYNTYSRT

SEQ ID NO: 16876 - protein, 17 aa, Homo sapiens
  Heavy chain CDR3 for antibody 8438 (IGHV1-18)
ARDRAFTMVRGVPPFDY

SEQ ID NO: 16877 - protein, 8 aa, Homo sapiens
  Light chain CDR3 for antibody 8439 (IGKV6-21)
HQSSSLPT

SEQ ID NO: 16878 - protein, 18 aa, Homo sapiens
  Heavy chain CDR3 for antibody 8439 (IGHV1-46)
ARDLTGRTENYYYYGMDV

SEQ ID NO: 16879 - protein, 9 aa, Homo sapiens
  Light chain CDR3 for antibody 8440 (IGKV3-20)
QHYGSSPYT

SEQ ID NO: 16880 - protein, 5 aa, Homo sapiens
  Heavy chain CDR3 for antibody 8440 (IGHV3-33)
ARTDY

SEQ ID NO: 16881 - protein, 9 aa, Homo sapiens
  Light chain CDR3 for antibody 8441 (IGKV1-9)
QQLKSYLYT

SEQ ID NO: 16882 - protein, 17 aa, Homo sapiens
  Heavy chain CDR3 for antibody 8441 (IGHV4-34)
AGLRFFDWLFDYYGMDV

SEQ ID NO: 16883 - protein, 9 aa, Homo sapiens
  Light chain CDR3 for antibody 8442 (IGKV1-39)
QQSYRTPLT

SEQ ID NO: 16884 - protein, 16 aa, Homo sapiens
  Heavy chain CDR3 for antibody 8442 (IGHV3-21)
ARDQGILTGYYTALDY

SEQ ID NO: 16885 - protein, 9 aa, Homo sapiens
  Light chain CDR3 for antibody 8443 (IGKV1D-16)
QQYNSFPLT

SEQ ID NO: 16886 - protein, 9 aa, Homo sapiens
  Heavy chain CDR3 for antibody 8443 (IGHV3-30)
ARDYFHFDY

SEQ ID NO: 16887 - protein, 8 aa, Homo sapiens
  Light chain CDR3 for antibody 8444 (IGKV1D-13)
QQFNNYPT

SEQ ID NO: 16888 - protein, 12 aa, Homo sapiens
  Heavy chain CDR3 for antibody 8444 (IGHV3-23)
AKESLYTPTDDY

SEQ ID NO: 16889 - protein, 10 aa, Homo sapiens
  Light chain CDR3 for antibody 8445 (IGKV1-39)
QQSYSTPMYT

SEQ ID NO: 16890 - protein, 14 aa, Homo sapiens
  Heavy chain CDR3 for antibody 8445 (IGHV1-46)
ARRGIVGALDAFDI

SEQ ID NO: 16891 - protein, 9 aa, Homo sapiens
  Light chain CDR3 for antibody 8446 (IGKV1-6)
LQDFHYPWT

SEQ ID NO: 16892 - protein, 18 aa, Homo sapiens
  Heavy chain CDR3 for antibody 8446 (IGHV3-33)
ARDRYYDILTGYYMGFDY

SEQ ID NO: 16893 - protein, 8 aa, Homo sapiens
  Light chain CDR3 for antibody 8447 (IGKV3D-7)
QQDYNLLT

SEQ ID NO: 16894 - protein, 13 aa, Homo sapiens
  Heavy chain CDR3 for antibody 8447 (IGHV3-66)
ANTGDSYYYGFYV

SEQ ID NO: 16895 - protein, 9 aa, Homo sapiens
  Light chain CDR3 for antibody 8448 (IGKV3D-7)
QQDYEFPLT

SEQ ID NO: 16896 - protein, 11 aa, Homo sapiens
  Heavy chain CDR3 for antibody 8448 (IGHV3-33)
ARDKSSGWSDY

SEQ ID NO: 16897 - protein, 9 aa, Homo sapiens
  Light chain CDR3 for antibody 8449 (IGKV1D-13)
QQFNNYPYT

SEQ ID NO: 16898 - protein, 10 aa, Homo sapiens
  Heavy chain CDR3 for antibody 8449 (IGHV3-23)
AKENWNDFDY

SEQ ID NO: 16899 - protein, 9 aa, Homo sapiens
  Light chain CDR3 for antibody 8450 (IGKV2-30)
MQGTHWPLT

SEQ ID NO: 16900 - protein, 13 aa, Homo sapiens
  Heavy chain CDR3 for antibody 8450 (IGHV3-15)
TTDRLLLFGAFDY

SEQ ID NO: 16901 - protein, 9 aa, Homo sapiens
  Light chain CDR3 for antibody 8451 (IGKV6-21)
HQSSSLPYT

SEQ ID NO: 16902 - protein, 14 aa, Homo sapiens
  Heavy chain CDR3 for antibody 8451 (IGHV3-23)
AKDRNIPAAGPFDY

SEQ ID NO: 16903 - protein, 8 aa, Homo sapiens
  Light chain CDR3 for antibody 8452 (IGKV1D-13)
QQFNNYPT

SEQ ID NO: 16904 - protein, 10 aa, Homo sapiens
  Heavy chain CDR3 for antibody 8452 (IGHV3-33)
ARDLGWSFDH

SEQ ID NO: 16905 - protein, 9 aa, Homo sapiens
  Light chain CDR3 for antibody 8453 (IGKV3D-7)
QQDYKLPLT

SEQ ID NO: 16906 - protein, 15 aa, Homo sapiens
  Heavy chain CDR3 for antibody 8453 (IGHV3-33)
ARGGTGYYSYWYFDL

SEQ ID NO: 16907 - protein, 9 aa, Homo sapiens
  Light chain CDR3 for antibody 8454 (IGKV1-39)
QQSYSTPYT

SEQ ID NO: 16908 - protein, 14 aa, Homo sapiens
  Heavy chain CDR3 for antibody 8454 (IGHV1-18)
AREGGSYFYYGVDV

SEQ ID NO: 16909 - protein, 9 aa, Homo sapiens
  Light chain CDR3 for antibody 8455 (IGKV1-6)
LQDYKSPFT

SEQ ID NO: 16910 - protein, 11 aa, Homo sapiens
  Heavy chain CDR3 for antibody 8455 (IGHV3-33)
AREGAVARFDY

SEQ ID NO: 16911 - protein, 9 aa, Homo sapiens
  Light chain CDR3 for antibody 8456 (IGKV6-21)
HQSTSLPFT

SEQ ID NO: 16912 - protein, 13 aa, Homo sapiens
  Heavy chain CDR3 for antibody 8456 (IGHV4-59)
ARKGATGYYGMDV

SEQ ID NO: 16913 - protein, 10 aa, Homo sapiens
  Light chain CDR3 for antibody 8457 (IGKV1-9)
QQLDSYPMYT

SEQ ID NO: 16914 - protein, 18 aa, Homo sapiens
  Heavy chain CDR3 for antibody 8457 (IGHV4-59)
AREGDYVWGSYRPNWFDP

SEQ ID NO: 16915 - protein, 8 aa, Homo sapiens
  Light chain CDR3 for antibody 8458 (IGKV3-11)
QQRSNWLT

SEQ ID NO: 16916 - protein, 14 aa, Homo sapiens
  Heavy chain CDR3 for antibody 8458 (IGHV1-2)
AREGGSGSSPGMDV

SEQ ID NO: 16917 - protein, 9 aa, Homo sapiens
  Light chain CDR3 for antibody 8459 (IGKV1-39)
QQSYSTPLT

SEQ ID NO: 16918 - protein, 15 aa, Homo sapiens
  Heavy chain CDR3 for antibody 8459 (IGHV3-33)
ARDRGMVRGDGYLDY

SEQ ID NO: 16919 - protein, 9 aa, Homo sapiens
  Light chain CDR3 for antibody 8460 (IGKV3-11)
QQRSNWPPT

SEQ ID NO: 16920 - protein, 13 aa, Homo sapiens
  Heavy chain CDR3 for antibody 8460 (IGHV4-39)
ARRDGSYYGYFGY

SEQ ID NO: 16921 - protein, 8 aa, Homo sapiens
  Light chain CDR3 for antibody 8461 (IGKV2D-28)
MQALQTPT

SEQ ID NO: 16922 - protein, 12 aa, Homo sapiens
  Heavy chain CDR3 for antibody 8461 (IGHV3-13)
AREAGIPDAFDI

SEQ ID NO: 16923 - protein, 8 aa, Homo sapiens
  Light chain CDR3 for antibody 8462 (IGKV3-11)
QQRSNWLT

SEQ ID NO: 16924 - protein, 14 aa, Homo sapiens
  Heavy chain CDR3 for antibody 8462 (IGHV3-33)
ARTTAAAGPRDFQH

SEQ ID NO: 16925 - protein, 9 aa, Homo sapiens
  Light chain CDR3 for antibody 8463 (IGKV3-20)
QQYGSSPYT

SEQ ID NO: 16926 - protein, 6 aa, Homo sapiens
  Heavy chain CDR3 for antibody 8463 (IGHV4-59)
AREEDY

SEQ ID NO: 16927 - protein, 9 aa, Homo sapiens
  Light chain CDR3 for antibody 8464 (IGKV3D-7)
QQDYNLPYT

SEQ ID NO: 16928 - protein, 17 aa, Homo sapiens
  Heavy chain CDR3 for antibody 8464 (IGHV3-33)
AREGYYYGSGSYHFFDY

SEQ ID NO: 16929 - protein, 9 aa, Homo sapiens
  Light chain CDR3 for antibody 8465 (IGKV3-15)
QQYNNWPLT

SEQ ID NO: 16930 - protein, 17 aa, Homo sapiens
  Heavy chain CDR3 for antibody 8465 (IGHV3-23)
AKEYCSGGSCYVYYFDY

SEQ ID NO: 16931 - protein, 9 aa, Homo sapiens
  Light chain CDR3 for antibody 8466 (IGKV1-6)
LQDFHYPWT

SEQ ID NO: 16932 - protein, 9 aa, Homo sapiens
  Heavy chain CDR3 for antibody 8466 (IGHV3-30)
ARDNWGFDY

SEQ ID NO: 16933 - protein, 9 aa, Homo sapiens
  Light chain CDR3 for antibody 8467 (IGKV1D-13)
QQFNNYPYT

SEQ ID NO: 16934 - protein, 11 aa, Homo sapiens
  Heavy chain CDR3 for antibody 8467 (IGHV3-23)
AKEGTYFDIPH

SEQ ID NO: 16935 - protein, 9 aa, Homo sapiens
  Light chain CDR3 for antibody 8468 (IGKV1-16)
QHYNDYPFT

SEQ ID NO: 16936 - protein, 15 aa, Homo sapiens
  Heavy chain CDR3 for antibody 8468 (IGHV3-33)
ARDHLTGYYYYGMDV

SEQ ID NO: 16937 - protein, 9 aa, Homo sapiens
  Light chain CDR3 for antibody 8469 (IGKV1-17)
LQHNSYPYT

SEQ ID NO: 16938 - protein, 16 aa, Homo sapiens
  Heavy chain CDR3 for antibody 8469 (IGHV3-23)
ARDLGIAAAGTGWFDP

SEQ ID NO: 16939 - protein, 9 aa, Homo sapiens
  Light chain CDR3 for antibody 8470 (IGKV3D-7)
QQDYNLPYT

SEQ ID NO: 16940 - protein, 16 aa, Homo sapiens
  Heavy chain CDR3 for antibody 8470 (IGHV3-11)
ARDSELRYFDWFGMDV

SEQ ID NO: 16941 - protein, 10 aa, Homo sapiens
  Light chain CDR3 for antibody 8471 (IGKV1-39)
QQSYSTPMYT

SEQ ID NO: 16942 - protein, 12 aa, Homo sapiens
  Heavy chain CDR3 for antibody 8471 (IGHV3-23)
AKDGWFGESLDY

SEQ ID NO: 16943 - protein, 10 aa, Homo sapiens
  Light chain CDR3 for antibody 8472 (IGKV1-39)
QQSYSTPMYT

SEQ ID NO: 16944 - protein, 14 aa, Homo sapiens
  Heavy chain CDR3 for antibody 8472 (IGHV3-33)
VRDQGSMVRGGGDY

SEQ ID NO: 16945 - protein, 9 aa, Homo sapiens
  Light chain CDR3 for antibody 8473 (IGKV3-11)
QQRSNWPPT

SEQ ID NO: 16946 - protein, 12 aa, Homo sapiens
  Heavy chain CDR3 for antibody 8473 (IGHV4-39)
ASQMVREGWFDP

SEQ ID NO: 16947 - protein, 9 aa, Homo sapiens
  Light chain CDR3 for antibody 8474 (IGKV1-9)
QQLNTYPFT

SEQ ID NO: 16948 - protein, 21 aa, Homo sapiens
  Heavy chain CDR3 for antibody 8474 (IGHV3-33)
ARKRLYDILTGYYKAYYGMDV

SEQ ID NO: 16949 - protein, 9 aa, Homo sapiens
  Light chain CDR3 for antibody 8475 (IGKV1-9)
QQVKSYPYT

SEQ ID NO: 16950 - protein, 10 aa, Homo sapiens
  Heavy chain CDR3 for antibody 8475 (IGHV3-30)
AREWYGGMDV

SEQ ID NO: 16951 - protein, 9 aa, Homo sapiens
  Light chain CDR3 for antibody 8476 (IGKV1-6)
LQDYKSPFT

SEQ ID NO: 16952 - protein, 12 aa, Homo sapiens
  Heavy chain CDR3 for antibody 8476 (IGHV3-33)
TRGYSSKSYFDY

SEQ ID NO: 16953 - protein, 8 aa, Homo sapiens
  Light chain CDR3 for antibody 8477 (IGKV3-20)
QQYGSSLT

SEQ ID NO: 16954 - protein, 13 aa, Homo sapiens
  Heavy chain CDR3 for antibody 8477 (IGHV3-33)
ARDQRYSSGWYDY

SEQ ID NO: 16955 - protein, 8 aa, Homo sapiens
  Light chain CDR3 for antibody 8478 (IGKV3D-7)
QQDYSLLT

SEQ ID NO: 16956 - protein, 8 aa, Homo sapiens
  Heavy chain CDR3 for antibody 8478 (IGHV3-33)
ARRGGLDY

SEQ ID NO: 16957 - protein, 10 aa, Homo sapiens
  Light chain CDR3 for antibody 8479 (IGKV1-17)
LQHNSYPMYT

SEQ ID NO: 16958 - protein, 16 aa, Homo sapiens
  Heavy chain CDR3 for antibody 8479 (IGHV4-59)
ARYSGSYYGDYYGMDV

SEQ ID NO: 16959 - protein, 8 aa, Homo sapiens
  Light chain CDR3 for antibody 8480 (IGKV1-5)
QQYNSYYT

SEQ ID NO: 16960 - protein, 16 aa, Homo sapiens
  Heavy chain CDR3 for antibody 8480 (IGHV1-18)
ARYFDWLLRDYYGMDV

SEQ ID NO: 16961 - protein, 10 aa, Homo sapiens
  Light chain CDR3 for antibody 8481 (IGKV3-11)
QQRSNWPTWT

SEQ ID NO: 16962 - protein, 18 aa, Homo sapiens
  Heavy chain CDR3 for antibody 8481 (IGHV3-33)
VRDRERYGSGSYPDAFDI

SEQ ID NO: 16963 - protein, 8 aa, Homo sapiens
  Light chain CDR3 for antibody 8482 (IGKV3D-7)
QQDYNLLT

SEQ ID NO: 16964 - protein, 17 aa, Homo sapiens
  Heavy chain CDR3 for antibody 8482 (IGHV3-33)
TRDSGMVRGIIIYGMDV

SEQ ID NO: 16965 - protein, 9 aa, Homo sapiens
  Light chain CDR3 for antibody 8483 (IGKV3-20)
QQYGSSPYT

SEQ ID NO: 16966 - protein, 10 aa, Homo sapiens
  Heavy chain CDR3 for antibody 8483 (IGHV3-30)
ARGSWYGFDY

SEQ ID NO: 16967 - protein, 9 aa, Homo sapiens
  Light chain CDR3 for antibody 8484 (IGKV2D-28)
MQVLQTPFT

SEQ ID NO: 16968 - protein, 17 aa, Homo sapiens
  Heavy chain CDR3 for antibody 8484 (IGHV4-39)
AGRLTYYFGSGSPSFDY

SEQ ID NO: 16969 - protein, 9 aa, Homo sapiens
  Light chain CDR3 for antibody 8485 (IGKV1-39)
QQSYSTPLT

SEQ ID NO: 16970 - protein, 14 aa, Homo sapiens
  Heavy chain CDR3 for antibody 8485 (IGHV4-39)
ARQGGWYLYWYFDL

SEQ ID NO: 16971 - protein, 9 aa, Homo sapiens
  Light chain CDR3 for antibody 8486 (IGKV2D-28)
MQTVQTPWT

SEQ ID NO: 16972 - protein, 13 aa, Homo sapiens
  Heavy chain CDR3 for antibody 8486 (IGHV4-34)
ASNFYYYYYGMDV

SEQ ID NO: 16973 - protein, 8 aa, Homo sapiens
  Light chain CDR3 for antibody 8487 (IGKV1-5)
QQYNSYWT

SEQ ID NO: 16974 - protein, 9 aa, Homo sapiens
  Heavy chain CDR3 for antibody 8487 (IGHV3-33)
AREYKEFDY

SEQ ID NO: 16975 - protein, 9 aa, Homo sapiens
  Light chain CDR3 for antibody 8488 (IGKV1-33)
QQYDNLPFT

SEQ ID NO: 16976 - protein, 9 aa, Homo sapiens
  Heavy chain CDR3 for antibody 8488 (IGHV3-13)
ARDHWYFDL

SEQ ID NO: 16977 - protein, 9 aa, Homo sapiens
  Light chain CDR3 for antibody 8489 (IGKV6-21)
HQSSSLPYT

SEQ ID NO: 16978 - protein, 14 aa, Homo sapiens
  Heavy chain CDR3 for antibody 8489 (IGHV3-33)
AREMVRGVPNWFDP

SEQ ID NO: 16979 - protein, 9 aa, Homo sapiens
  Light chain CDR3 for antibody 8490 (IGKV1-17)
LQHNTYPWT

SEQ ID NO: 16980 - protein, 11 aa, Homo sapiens
  Heavy chain CDR3 for antibody 8490 (IGHV3-33)
ARAGIAAVFDY

SEQ ID NO: 16981 - protein, 9 aa, Homo sapiens
  Light chain CDR3 for antibody 8491 (IGKV1D-16)
QQYDSYPYT

SEQ ID NO: 16982 - protein, 13 aa, Homo sapiens
  Heavy chain CDR3 for antibody 8491 (IGHV4-34)
ASNVYYYYYGMDV

SEQ ID NO: 16983 - protein, 7 aa, Homo sapiens
  Light chain CDR3 for antibody 8492 (IGKV1-17)
LQHNSYP

SEQ ID NO: 16984 - protein, 13 aa, Homo sapiens
  Heavy chain CDR3 for antibody 8492 (IGHV4-59)
ARDAGYSSSWFDY

SEQ ID NO: 16985 - protein, 8 aa, Homo sapiens
  Light chain CDR3 for antibody 8493 (IGKV1D-13)
QQFNNYHT

SEQ ID NO: 16986 - protein, 21 aa, Homo sapiens
  Heavy chain CDR3 for antibody 8493 (IGHV3-23)
AKDIDYYGSGSYPLYYYGMDV

SEQ ID NO: 16987 - protein, 11 aa, Homo sapiens
  Light chain CDR3 for antibody 8494 (IGKV3-11)
QQRSNWPPTWT

SEQ ID NO: 16988 - protein, 18 aa, Homo sapiens
  Heavy chain CDR3 for antibody 8494 (IGHV3-33)
ARDGYSGYDYYYYYGMDV

SEQ ID NO: 16989 - protein, 10 aa, Homo sapiens
  Light chain CDR3 for antibody 8495 (IGKV1-9)
QQLDSYPMYT

SEQ ID NO: 16990 - protein, 17 aa, Homo sapiens
  Heavy chain CDR3 for antibody 8495 (IGHV1-18)
ARERYYGSGIYKYNMDV

SEQ ID NO: 16991 - protein, 9 aa, Homo sapiens
  Light chain CDR3 for antibody 8496 (IGKV3D-7)
QQDYNLPYT

SEQ ID NO: 16992 - protein, 14 aa, Homo sapiens
  Heavy chain CDR3 for antibody 8496 (IGHV3-64)
ARGGGAVTGTNFDY

SEQ ID NO: 16993 - protein, 9 aa, Homo sapiens
  Light chain CDR3 for antibody 8497 (IGKV1-27)
QKYNSAPYT

SEQ ID NO: 16994 - protein, 14 aa, Homo sapiens
  Heavy chain CDR3 for antibody 8497 (IGHV1-46)
ARDGVGAKEGGSDY

SEQ ID NO: 16995 - protein, 9 aa, Homo sapiens
  Light chain CDR3 for antibody 8498 (IGKV1D-13)
QQFNNYPYT

SEQ ID NO: 16996 - protein, 22 aa, Homo sapiens
  Heavy chain CDR3 for antibody 8498 (IGHV3-23)
AKDDLPYYDILTHSTTTGGMDV

SEQ ID NO: 16997 - protein, 10 aa, Homo sapiens
  Light chain CDR3 for antibody 8499 (IGKV3-11)
QQRSNWPIFT

SEQ ID NO: 16998 - protein, 14 aa, Homo sapiens
  Heavy chain CDR3 for antibody 8499 (IGHV3-23)
AKGGDVLTGYYPDY

SEQ ID NO: 16999 - protein, 9 aa, Homo sapiens
  Light chain CDR3 for antibody 8500 (IGKV3D-7)
QQDYNLPWT

SEQ ID NO: 17000 - protein, 17 aa, Homo sapiens
  Heavy chain CDR3 for antibody 8500 (IGHV3-23)
AKDRPVTTLYYYFGMDV

SEQ ID NO: 17001 - protein, 11 aa, Homo sapiens
  Light chain CDR3 for antibody 8501 (IGKV3-11)
QQRSNWPPTWT

SEQ ID NO: 17002 - protein, 13 aa, Homo sapiens
  Heavy chain CDR3 for antibody 8501 (IGHV3-33)
ARRATLVRGVFDP

SEQ ID NO: 17003 - protein, 9 aa, Homo sapiens
  Light chain CDR3 for antibody 8502 (IGKV1-17)
LQQNSYPWT

SEQ ID NO: 17004 - protein, 12 aa, Homo sapiens
  Heavy chain CDR3 for antibody 8502 (IGHV3-23)
AKEGLGSDYEPY

SEQ ID NO: 17005 - protein, 9 aa, Homo sapiens
  Light chain CDR3 for antibody 8503 (IGKV1-6)
LQDYNYPFT

SEQ ID NO: 17006 - protein, 14 aa, Homo sapiens
  Heavy chain CDR3 for antibody 8503 (IGHV3-33)
ARVTSGSSYWYFDL

SEQ ID NO: 17007 - protein, 9 aa, Homo sapiens
  Light chain CDR3 for antibody 8504 (IGKV1D-13)
QQFNNYPHT

SEQ ID NO: 17008 - protein, 14 aa, Homo sapiens
  Heavy chain CDR3 for antibody 8504 (IGHV3-33)
VSAISGSSYWYFAL

SEQ ID NO: 17009 - protein, 9 aa, Homo sapiens
  Light chain CDR3 for antibody 8505 (IGKV3D-7)
QQDYNLPYT

SEQ ID NO: 17010 - protein, 15 aa, Homo sapiens
  Heavy chain CDR3 for antibody 8505 (IGHV4-59)
ARDLGHYYGSVSIDY

SEQ ID NO: 17011 - protein, 9 aa, Homo sapiens
  Light chain CDR3 for antibody 8506 (IGKV3D-7)
QQDYNLPYT

SEQ ID NO: 17012 - protein, 19 aa, Homo sapiens
  Heavy chain CDR3 for antibody 8506 (IGHV3-30)
ARRFSGYSGYDHYYYGMDV

SEQ ID NO: 17013 - protein, 9 aa, Homo sapiens
  Light chain CDR3 for antibody 8507 (IGKV1-16)
QHYNDYPFT

SEQ ID NO: 17014 - protein, 13 aa, Homo sapiens
  Heavy chain CDR3 for antibody 8507 (IGHV3-33)
ARTDYYSYYGLDV

SEQ ID NO: 17015 - protein, 7 aa, Homo sapiens
  Light chain CDR3 for antibody 8508 (IGKV1-17)
LQHNSYP

SEQ ID NO: 17016 - protein, 16 aa, Homo sapiens
  Heavy chain CDR3 for antibody 8508 (IGHV1-24)
ATEDSSSTYYYYGLDV

SEQ ID NO: 17017 - protein, 9 aa, Homo sapiens
  Light chain CDR3 for antibody 8509 (IGKV1-6)
LQDYNYPYT

SEQ ID NO: 17018 - protein, 13 aa, Homo sapiens
  Heavy chain CDR3 for antibody 8509 (IGHV3-33)
VRRIAVAGTEGDC

SEQ ID NO: 17019 - protein, 11 aa, Homo sapiens
  Light chain CDR3 for antibody 8510 (IGKV3-11)
QQRSNWPPTWT

SEQ ID NO: 17020 - protein, 17 aa, Homo sapiens
  Heavy chain CDR3 for antibody 8510 (IGHV4-39)
ARQGWYYGSGSSLLFDY

SEQ ID NO: 17021 - protein, 9 aa, Homo sapiens
  Light chain CDR3 for antibody 8511 (IGKV1D-13)
QQFNNYPHT

SEQ ID NO: 17022 - protein, 15 aa, Homo sapiens
  Heavy chain CDR3 for antibody 8511 (IGHV3-33)
ARPPIAVAGPEYFQH

SEQ ID NO: 17023 - protein, 8 aa, Homo sapiens
  Light chain CDR3 for antibody 8512 (IGKV1-5)
QQYNSYWT

SEQ ID NO: 17024 - protein, 10 aa, Homo sapiens
  Heavy chain CDR3 for antibody 8512 (IGHV3-33)
AREWFGGFDI

SEQ ID NO: 17025 - protein, 9 aa, Homo sapiens
  Light chain CDR3 for antibody 8513 (IGKV1-16)
QHYNDYPFT

SEQ ID NO: 17026 - protein, 12 aa, Homo sapiens
  Heavy chain CDR3 for antibody 8513 (IGHV3-33)
ARDLVGATPFDY

SEQ ID NO: 17027 - protein, 8 aa, Homo sapiens
  Light chain CDR3 for antibody 8514 (IGKV3-11)
QQRSNWLT

SEQ ID NO: 17028 - protein, 19 aa, Homo sapiens
  Heavy chain CDR3 for antibody 8514 (IGHV1-18)
ARDTTLVRGLMNYYYGMDV

SEQ ID NO: 17029 - protein, 10 aa, Homo sapiens
  Light chain CDR3 for antibody 8515 (IGKV3-15)
QQYNNWPPIT

SEQ ID NO: 17030 - protein, 11 aa, Homo sapiens
  Heavy chain CDR3 for antibody 8515 (IGHV3-33)
ARDRVLTPFDY

SEQ ID NO: 17031 - protein, 9 aa, Homo sapiens
  Light chain CDR3 for antibody 8516 (IGKV3D-7)
QQDYKLPLT

SEQ ID NO: 17032 - protein, 14 aa, Homo sapiens
  Heavy chain CDR3 for antibody 8516 (IGHV4-39)
ARRGVVVPPGGMDV

SEQ ID NO: 17033 - protein, 9 aa, Homo sapiens
  Light chain CDR3 for antibody 8517 (IGKV1-37)
QRTYNAPFT

SEQ ID NO: 17034 - protein, 15 aa, Homo sapiens
  Heavy chain CDR3 for antibody 8517 (IGHV3-33)
ARDRGWKAPGYGMDV

SEQ ID NO: 17035 - protein, 9 aa, Homo sapiens
  Light chain CDR3 for antibody 8518 (IGKV1-9)
QQLNSYPYT

SEQ ID NO: 17036 - protein, 14 aa, Homo sapiens
  Heavy chain CDR3 for antibody 8518 (IGHV3-23)
ANWAYDILTGYLDY

SEQ ID NO: 17037 - protein, 9 aa, Homo sapiens
  Light chain CDR3 for antibody 8519 (IGKV1-39)
QQSYSTPIT

SEQ ID NO: 17038 - protein, 17 aa, Homo sapiens
  Heavy chain CDR3 for antibody 8519 (IGHV1-46)
ARDLTGRTENYYYGMDV

SEQ ID NO: 17039 - protein, 9 aa, Homo sapiens
  Light chain CDR3 for antibody 8520 (IGKV1D-13)
QQFNNYPHT

SEQ ID NO: 17040 - protein, 10 aa, Homo sapiens
  Heavy chain CDR3 for antibody 8520 (IGHV3-13)
ARDRGSYYDY

SEQ ID NO: 17041 - protein, 10 aa, Homo sapiens
  Light chain CDR3 for antibody 8521 (IGKV1-9)
QQLNSFLMYT

SEQ ID NO: 17042 - protein, 13 aa, Homo sapiens
  Heavy chain CDR3 for antibody 8521 (IGHV3-11)
ARDGGAAAGTWDS

SEQ ID NO: 17043 - protein, 10 aa, Homo sapiens
  Light chain CDR3 for antibody 8522 (IGKV1-39)
QQSYSTPMYT

SEQ ID NO: 17044 - protein, 18 aa, Homo sapiens
  Heavy chain CDR3 for antibody 8522 (IGHV3-33)
ARREGITLIFYYYYGMDV

SEQ ID NO: 17045 - protein, 9 aa, Homo sapiens
  Light chain CDR3 for antibody 8523 (IGKV3-20)
QQYGSSPLT

SEQ ID NO: 17046 - protein, 15 aa, Homo sapiens
  Heavy chain CDR3 for antibody 8523 (IGHV4-59)
ARDIGYYGSGSPLDY

SEQ ID NO: 17047 - protein, 9 aa, Homo sapiens
  Light chain CDR3 for antibody 8524 (IGKV1-16)
QQYNSYPLT

SEQ ID NO: 17048 - protein, 11 aa, Homo sapiens
  Heavy chain CDR3 for antibody 8524 (IGHV3-23)
AKDRPYYGSGV

SEQ ID NO: 17049 - protein, 9 aa, Homo sapiens
  Light chain CDR3 for antibody 8525 (IGKV1-9)
QQGNTYSRT

SEQ ID NO: 17050 - protein, 17 aa, Homo sapiens
  Heavy chain CDR3 for antibody 8525 (IGHV4-59)
ARDFLVRGEGSYYGMDV

SEQ ID NO: 17051 - protein, 9 aa, Homo sapiens
  Light chain CDR3 for antibody 8526 (IGKV1-6)
QQEYNYPLT

SEQ ID NO: 17052 - protein, 13 aa, Homo sapiens
  Heavy chain CDR3 for antibody 8526 (IGHV3-11)
ARDGGAAAGTWDS

SEQ ID NO: 17053 - protein, 9 aa, Homo sapiens
  Light chain CDR3 for antibody 8527 (IGKV2D-24)
TQATQFPHT

SEQ ID NO: 17054 - protein, 17 aa, Homo sapiens
  Heavy chain CDR3 for antibody 8527 (IGHV4-59)
ARDFLVRGEGSYYGMDV

SEQ ID NO: 17055 - protein, 9 aa, Homo sapiens
  Light chain CDR3 for antibody 8528 (IGKV1-9)
QQLNGYPFT

SEQ ID NO: 17056 - protein, 18 aa, Homo sapiens
  Heavy chain CDR3 for antibody 8528 (IGHV3-33)
ARGYYGSGNFYKDSGMDV

SEQ ID NO: 17057 - protein, 10 aa, Homo sapiens
  Light chain CDR3 for antibody 8529 (IGKV3-15)
QQYNNWPPYT

SEQ ID NO: 17058 - protein, 12 aa, Homo sapiens
  Heavy chain CDR3 for antibody 8529 (IGHV3-33)
ARDGYSSRNFDY

SEQ ID NO: 17059 - protein, 10 aa, Homo sapiens
  Light chain CDR3 for antibody 8530 (IGKV1-39)
QQSYSTPMYT

SEQ ID NO: 17060 - protein, 17 aa, Homo sapiens
  Heavy chain CDR3 for antibody 8530 (IGHV3-33)
TRDSGMVRGIIIYGMDV

SEQ ID NO: 17061 - protein, 9 aa, Homo sapiens
  Light chain CDR3 for antibody 8531 (IGKV3-11)
QQRSNWPRT

SEQ ID NO: 17062 - protein, 15 aa, Homo sapiens
  Heavy chain CDR3 for antibody 8531 (IGHV1-18)
ARLRWFGELSGWFDP

SEQ ID NO: 17063 - protein, 9 aa, Homo sapiens
  Light chain CDR3 for antibody 8532 (IGKV1-9)
QQGNTYSRT

SEQ ID NO: 17064 - protein, 16 aa, Homo sapiens
  Heavy chain CDR3 for antibody 8532 (IGHV3-13)
ARDRSYESYYYYGMDV

SEQ ID NO: 17065 - protein, 9 aa, Homo sapiens
  Light chain CDR3 for antibody 8533 (IGKV1D-16)
QQYNSYPYT

SEQ ID NO: 17066 - protein, 14 aa, Homo sapiens
  Heavy chain CDR3 for antibody 8533 (IGHV3-64)
ARGRASSGPYYFDY

SEQ ID NO: 17067 - protein, 8 aa, Homo sapiens
  Light chain CDR3 for antibody 8534 (IGKV3D-7)
QQDYNLLT

SEQ ID NO: 17068 - protein, 11 aa, Homo sapiens
  Heavy chain CDR3 for antibody 8534 (IGHV3-11)
ARASRGSYYDY

SEQ ID NO: 17069 - protein, 9 aa, Homo sapiens
  Light chain CDR3 for antibody 8535 (IGKV1-6)
LQDFHYPWT

SEQ ID NO: 17070 - protein, 17 aa, Homo sapiens
  Heavy chain CDR3 for antibody 8535 (IGHV1-18)
ARDRAFTMVRGVPPFDY

SEQ ID NO: 17071 - protein, 9 aa, Homo sapiens
  Light chain CDR3 for antibody 8536 (IGKV1-9)
QQLNSYPWT

SEQ ID NO: 17072 - protein, 9 aa, Homo sapiens
  Heavy chain CDR3 for antibody 8536 (IGHV3-33)
ARATVGVDY

SEQ ID NO: 17073 - protein, 9 aa, Homo sapiens
  Light chain CDR3 for antibody 8537 (IGKV1D-16)
QQYNSYPLT

SEQ ID NO: 17074 - protein, 14 aa, Homo sapiens
  Heavy chain CDR3 for antibody 8537 (IGHV3-23)
AKGGDILTGYYTDY

SEQ ID NO: 17075 - protein, 10 aa, Homo sapiens
  Light chain CDR3 for antibody 8538 (IGKV1-39)
QQSYSTPMYT

SEQ ID NO: 17076 - protein, 10 aa, Homo sapiens
  Heavy chain CDR3 for antibody 8538 (IGHV3-23)
AKGDRWRFDP

SEQ ID NO: 17077 - protein, 9 aa, Homo sapiens
  Light chain CDR3 for antibody 8539 (IGKV1-6)
LQDYKSPFT

SEQ ID NO: 17078 - protein, 12 aa, Homo sapiens
  Heavy chain CDR3 for antibody 8539 (IGHV3-33)
ARDSSGWSHFDY

SEQ ID NO: 17079 - protein, 9 aa, Homo sapiens
  Light chain CDR3 for antibody 8540 (IGKV5-2)
LQHDNFPWT

SEQ ID NO: 17080 - protein, 16 aa, Homo sapiens
  Heavy chain CDR3 for antibody 8540 (IGHV3-30)
ARDSSYYGSGYYGMDV

SEQ ID NO: 17081 - protein, 9 aa, Homo sapiens
  Light chain CDR3 for antibody 8541 (IGKV1-17)
LQHNTYPYT

SEQ ID NO: 17082 - protein, 15 aa, Homo sapiens
  Heavy chain CDR3 for antibody 8541 (IGHV4-39)
ARRDYDILTGYLFDY

SEQ ID NO: 17083 - protein, 10 aa, Homo sapiens
  Light chain CDR3 for antibody 8542 (IGKV3-20)
QQYGRSPPVT

SEQ ID NO: 17084 - protein, 12 aa, Homo sapiens
  Heavy chain CDR3 for antibody 8542 (IGHV3-33)
TRGYSSKSYFDY

SEQ ID NO: 17085 - protein, 10 aa, Homo sapiens
  Light chain CDR3 for antibody 8543 (IGKV1-9)
QQLNSFLMYT

SEQ ID NO: 17086 - protein, 17 aa, Homo sapiens
  Heavy chain CDR3 for antibody 8543 (IGHV4-34)
AGLRFFDWLFDYYGMDV

SEQ ID NO: 17087 - protein, 9 aa, Homo sapiens
  Light chain CDR3 for antibody 8544 (IGKV1-39)
LQDFHYPWT

SEQ ID NO: 17088 - protein, 15 aa, Homo sapiens
  Heavy chain CDR3 for antibody 8544 (IGHV3-74)
ARGSGSHYHYYGMDV

SEQ ID NO: 17089 - protein, 9 aa, Homo sapiens
  Light chain CDR3 for antibody 8545 (IGKV1-27)
QKYNSAPHT

SEQ ID NO: 17090 - protein, 14 aa, Homo sapiens
  Heavy chain CDR3 for antibody 8545 (IGHV3-33)
ARDRIAAASSDFDC

SEQ ID NO: 17091 - protein, 8 aa, Homo sapiens
  Light chain CDR3 for antibody 8546 (IGKV3D-7)
QQDYNLLT

SEQ ID NO: 17092 - protein, 12 aa, Homo sapiens
  Heavy chain CDR3 for antibody 8546 (IGHV3-23)
AKEYDILTGYFH

SEQ ID NO: 17093 - protein, 10 aa, Homo sapiens
  Light chain CDR3 for antibody 8547 (IGKV1-9)
QQLDSYPMYT

SEQ ID NO: 17094 - protein, 14 aa, Homo sapiens
  Heavy chain CDR3 for antibody 8547 (IGHV3-33)
ARASSGSSYWYFDL

SEQ ID NO: 17095 - protein, 9 aa, Homo sapiens
  Light chain CDR3 for antibody 8548 (IGKV5-2)
LQHDNFPWT

SEQ ID NO: 17096 - protein, 18 aa, Homo sapiens
  Heavy chain CDR3 for antibody 8548 (IGHV3-33)
ARGYYGSGNFYKDAGMDV

SEQ ID NO: 17097 - protein, 9 aa, Homo sapiens
  Light chain CDR3 for antibody 8549 (IGKV1D-13)
QHFNNYMYT

SEQ ID NO: 17098 - protein, 13 aa, Homo sapiens
  Heavy chain CDR3 for antibody 8549 (IGHV4-39)
ARHVLLWFGEFDP

SEQ ID NO: 17099 - protein, 9 aa, Homo sapiens
  Light chain CDR3 for antibody 8550 (IGKV1-9)
LQDYNHPFT

SEQ ID NO: 17100 - protein, 15 aa, Homo sapiens
  Heavy chain CDR3 for antibody 8550 (IGHV3-20)
ARDRGSSGWRDWFDP

SEQ ID NO: 17101 - protein, 9 aa, Homo sapiens
  Light chain CDR3 for antibody 8551 (IGKV1-5)
QQYNTYSRT

SEQ ID NO: 17102 - protein, 14 aa, Homo sapiens
  Heavy chain CDR3 for antibody 8551 (IGHV3-74)
ARRGIVGALDAFDI

SEQ ID NO: 17103 - protein, 9 aa, Homo sapiens
  Light chain CDR3 for antibody 8552 (IGKV1-6)
LQDYNYPYT

SEQ ID NO: 17104 - protein, 6 aa, Homo sapiens
  Heavy chain CDR3 for antibody 8552 (IGHV3-23)
AKDIDY

SEQ ID NO: 17105 - protein, 9 aa, Homo sapiens
  Light chain CDR3 for antibody 8553 (IGKV3-11)
QQRINWPWT

SEQ ID NO: 17106 - protein, 11 aa, Homo sapiens
  Heavy chain CDR3 for antibody 8553 (IGHV4-59)
ARDGSWEPFDY

SEQ ID NO: 17107 - protein, 9 aa, Homo sapiens
  Light chain CDR3 for antibody 8554 (IGKV6-21)
LQSSSLLYT

SEQ ID NO: 17108 - protein, 16 aa, Homo sapiens
  Heavy chain CDR3 for antibody 8554 (IGHV3-33)
ARDQGILTGYYAAFDY

SEQ ID NO: 17109 - protein, 10 aa, Homo sapiens
  Light chain CDR3 for antibody 8555 (IGKV3-11)
QQRSNWPIFT

SEQ ID NO: 17110 - protein, 11 aa, Homo sapiens
  Heavy chain CDR3 for antibody 8555 (IGHV4-59)
ARDGSWEPFDY

SEQ ID NO: 17111 - protein, 9 aa, Homo sapiens
  Light chain CDR3 for antibody 8556 (IGKV1-6)
LQDFNYPRT

SEQ ID NO: 17112 - protein, 9 aa, Homo sapiens
  Heavy chain CDR3 for antibody 8556 (IGHV4-59)
AREGGSGSL

SEQ ID NO: 17113 - protein, 9 aa, Homo sapiens
  Light chain CDR3 for antibody 8557 (IGKV1-9)
QQYNSYPLT

SEQ ID NO: 17114 - protein, 15 aa, Homo sapiens
  Heavy chain CDR3 for antibody 8557 (IGHV3-23)
AKAGGRYFDWFPFDY

SEQ ID NO: 17115 - protein, 9 aa, Homo sapiens
  Light chain CDR3 for antibody 8558 (IGKV6-21)
HQSSTLPST

SEQ ID NO: 17116 - protein, 9 aa, Homo sapiens
  Heavy chain CDR3 for antibody 8558 (IGHV4-59)
ARSGSGIYT

SEQ ID NO: 17117 - protein, 9 aa, Homo sapiens
  Light chain CDR3 for antibody 8559 (IGKV1-27)
QKYNSAPYT

SEQ ID NO: 17118 - protein, 18 aa, Homo sapiens
  Heavy chain CDR3 for antibody 8559 (IGHV1-46)
ARDLTGRTENYYFYGMDV

SEQ ID NO: 17119 - protein, 8 aa, Homo sapiens
  Light chain CDR3 for antibody 8560 (IGKV3D-7)
QQDYNLLT

SEQ ID NO: 17120 - protein, 14 aa, Homo sapiens
  Heavy chain CDR3 for antibody 8560 (IGHV3-33)
ARSTLVRGANWFDP

SEQ ID NO: 17121 - protein, 9 aa, Homo sapiens
  Light chain CDR3 for antibody 8561 (IGKV1-9)
QQLISYPLT

SEQ ID NO: 17122 - protein, 17 aa, Homo sapiens
  Heavy chain CDR3 for antibody 8561 (IGHV3-23)
AKDGSFYSSGWYDAFDI

SEQ ID NO: 17123 - protein, 9 aa, Homo sapiens
  Light chain CDR3 for antibody 8562 (IGKV1-27)
QKYNSAPYT

SEQ ID NO: 17124 - protein, 13 aa, Homo sapiens
  Heavy chain CDR3 for antibody 8562 (IGHV3-33)
ARRATLVRGVFDP

SEQ ID NO: 17125 - protein, 9 aa, Homo sapiens
  Light chain CDR3 for antibody 8563 (IGKV3-15)
QQYHNWPLT

SEQ ID NO: 17126 - protein, 18 aa, Homo sapiens
  Heavy chain CDR3 for antibody 8563 (IGHV1-8)
AREGAAAGSYYYYNGMDV

SEQ ID NO: 17127 - protein, 9 aa, Homo sapiens
  Light chain CDR3 for antibody 8564 (IGKV4-1)
QQYYSTPWT

SEQ ID NO: 17128 - protein, 14 aa, Homo sapiens
  Heavy chain CDR3 for antibody 8564 (IGHV3-33)
ARDWNDVYYYGMDV

SEQ ID NO: 17129 - protein, 10 aa, Homo sapiens
  Light chain CDR3 for antibody 8565 (IGKV1-39)
QQSYSTPMYT

SEQ ID NO: 17130 - protein, 18 aa, Homo sapiens
  Heavy chain CDR3 for antibody 8565 (IGHV3-33)
ARERDYYGSGSYPDAFDI

SEQ ID NO: 17131 - protein, 9 aa, Homo sapiens
  Light chain CDR3 for antibody 8566 (IGKV1-17)
LQLNSFPWT

SEQ ID NO: 17132 - protein, 11 aa, Homo sapiens
  Heavy chain CDR3 for antibody 8566 (IGHV3-33)
ARDRSSGPFDY

SEQ ID NO: 17133 - protein, 11 aa, Homo sapiens
  Light chain CDR3 for antibody 8567 (IGKV3-11)
QQRSNWPPTWT

SEQ ID NO: 17134 - protein, 12 aa, Homo sapiens
  Heavy chain CDR3 for antibody 8567 (IGHV4-59)
ARDSGSYYYFDY

SEQ ID NO: 17135 - protein, 9 aa, Homo sapiens
  Light chain CDR3 for antibody 8568 (IGKV2D-28)
MQALQTPPT

SEQ ID NO: 17136 - protein, 17 aa, Homo sapiens
  Heavy chain CDR3 for antibody 8568 (IGHV3-23)
AKDYDILTGYSHNWFDP

SEQ ID NO: 17137 - protein, 9 aa, Homo sapiens
  Light chain CDR3 for antibody 8569 (IGKV1-39)
QQSYRTPLT

SEQ ID NO: 17138 - protein, 14 aa, Homo sapiens
  Heavy chain CDR3 for antibody 8569 (IGHV3-33)
ARDGAAAALDAFDI

SEQ ID NO: 17139 - protein, 9 aa, Homo sapiens
  Light chain CDR3 for antibody 8570 (IGKV1-6)
LQDFNYPRT

SEQ ID NO: 17140 - protein, 14 aa, Homo sapiens
  Heavy chain CDR3 for antibody 8570 (IGHV4-39)
ARQGTMIRGGYSDY

SEQ ID NO: 17141 - protein, 9 aa, Homo sapiens
  Light chain CDR3 for antibody 8571 (IGKV1D-13)
QQFNNYPHT

SEQ ID NO: 17142 - protein, 10 aa, Homo sapiens
  Heavy chain CDR3 for antibody 8571 (IGHV3-23)
AKDHWGDFDY

SEQ ID NO: 17143 - protein, 9 aa, Homo sapiens
  Light chain CDR3 for antibody 8572 (IGKV1-9)
QQYYSYPRT

SEQ ID NO: 17144 - protein, 16 aa, Homo sapiens
  Heavy chain CDR3 for antibody 8572 (IGHV3-33)
ARDGSMVRRIHDAFDF

SEQ ID NO: 17145 - protein, 8 aa, Homo sapiens
  Light chain CDR3 for antibody 8573 (IGKV6-21)
HQSSSLPT

SEQ ID NO: 17146 - protein, 14 aa, Homo sapiens
  Heavy chain CDR3 for antibody 8573 (IGHV3-20)
ARDEGSGGYDVFDI

SEQ ID NO: 17147 - protein, 9 aa, Homo sapiens
  Light chain CDR3 for antibody 8574 (IGKV1-27)
QKYNSAPYT

SEQ ID NO: 17148 - protein, 14 aa, Homo sapiens
  Heavy chain CDR3 for antibody 8574 (IGHV3-33)
ARDGVYISSSWFDP

SEQ ID NO: 17149 - protein, 9 aa, Homo sapiens
  Light chain CDR3 for antibody 8575 (IGKV3D-20)
QQYGSSPRT

SEQ ID NO: 17150 - protein, 18 aa, Homo sapiens
  Heavy chain CDR3 for antibody 8575 (IGHV3-33)
AREIAAAGTKGLYYGMDV

SEQ ID NO: 17151 - protein, 9 aa, Homo sapiens
  Light chain CDR3 for antibody 8576 (IGKV1D-13)
QQFNNYPHT

SEQ ID NO: 17152 - protein, 13 aa, Homo sapiens
  Heavy chain CDR3 for antibody 8576 (IGHV1-18)
ARSITMVRGVIGY

SEQ ID NO: 17153 - protein, 9 aa, Homo sapiens
  Light chain CDR3 for antibody 8577 (IGKV1-9)
QQLNSYPYT

SEQ ID NO: 17154 - protein, 11 aa, Homo sapiens
  Heavy chain CDR3 for antibody 8577 (IGHV3-33)
ARDKGSGWSDY

SEQ ID NO: 17155 - protein, 9 aa, Homo sapiens
  Light chain CDR3 for antibody 8578 (IGKV2-30)
MQGTHWPLT

SEQ ID NO: 17156 - protein, 9 aa, Homo sapiens
  Heavy chain CDR3 for antibody 8578 (IGHV3-33)
ARELAYFDY

SEQ ID NO: 17157 - protein, 9 aa, Homo sapiens
  Light chain CDR3 for antibody 8579 (IGKV1D-13)
QRFNNYLYT

SEQ ID NO: 17158 - protein, 14 aa, Homo sapiens
  Heavy chain CDR3 for antibody 8579 (IGHV3-33)
ARAGSGYDRDWFDP

SEQ ID NO: 17159 - protein, 10 aa, Homo sapiens
  Light chain CDR3 for antibody 8580 (IGKV1-17)
LQHNSYPMYT

SEQ ID NO: 17160 - protein, 19 aa, Homo sapiens
  Heavy chain CDR3 for antibody 8580 (IGHV3-23)
ARGVRLRFFDPYYYYGLDV

SEQ ID NO: 17161 - protein, 10 aa, Homo sapiens
  Light chain CDR3 for antibody 8581 (IGKV1-39)
QQSYSTPMYT

SEQ ID NO: 17162 - protein, 10 aa, Homo sapiens
  Heavy chain CDR3 for antibody 8581 (IGHV3-33)
ARNILTPLDY

SEQ ID NO: 17163 - protein, 9 aa, Homo sapiens
  Light chain CDR3 for antibody 8582 (IGKV1D-13)
QQFNNYPYT

SEQ ID NO: 17164 - protein, 13 aa, Homo sapiens
  Heavy chain CDR3 for antibody 8582 (IGHV3-23)
ARRQVGYYYGMDV

SEQ ID NO: 17165 - protein, 9 aa, Homo sapiens
  Light chain CDR3 for antibody 8583 (IGKV3-20)
QQYGSSPYT

SEQ ID NO: 17166 - protein, 10 aa, Homo sapiens
  Heavy chain CDR3 for antibody 8583 (IGHV3-33)
ARDGLRYFDW

SEQ ID NO: 17167 - protein, 9 aa, Homo sapiens
  Light chain CDR3 for antibody 8584 (IGKV1-39)
QQSYRTPLT

SEQ ID NO: 17168 - protein, 9 aa, Homo sapiens
  Heavy chain CDR3 for antibody 8584 (IGHV3-21)
GSRRPYFDS

SEQ ID NO: 17169 - protein, 9 aa, Homo sapiens
  Light chain CDR3 for antibody 8585 (IGKV3-20)
QQYGSSPYT

SEQ ID NO: 17170 - protein, 10 aa, Homo sapiens
  Heavy chain CDR3 for antibody 8585 (IGHV4-59)
VSSGTSLLAY

SEQ ID NO: 17171 - protein, 9 aa, Homo sapiens
  Light chain CDR3 for antibody 8586 (IGKV3-15)
QQYNNWPLT

SEQ ID NO: 17172 - protein, 17 aa, Homo sapiens
  Heavy chain CDR3 for antibody 8586 (IGHV4-59)
AREGADSGIYYHWYFDL

SEQ ID NO: 17173 - protein, 9 aa, Homo sapiens
  Light chain CDR3 for antibody 8587 (IGKV1-6)
LQDFHYPWT

SEQ ID NO: 17174 - protein, 13 aa, Homo sapiens
  Heavy chain CDR3 for antibody 8587 (IGHV3-66)
ANTGDSYYYGFYV

SEQ ID NO: 17175 - protein, 9 aa, Homo sapiens
  Light chain CDR3 for antibody 8588 (IGKV1D-13)
QQFNNYPYT

SEQ ID NO: 17176 - protein, 19 aa, Homo sapiens
  Heavy chain CDR3 for antibody 8588 (IGHV3-33)
ARGVRLRFFDPYYYYGLDV

SEQ ID NO: 17177 - protein, 9 aa, Homo sapiens
  Light chain CDR3 for antibody 8589 (IGKV2-30)
MQGTHWPLT

SEQ ID NO: 17178 - protein, 12 aa, Homo sapiens
  Heavy chain CDR3 for antibody 8589 (IGHV3-23)
AKEGIVGVPFDY

SEQ ID NO: 17179 - protein, 9 aa, Homo sapiens
  Light chain CDR3 for antibody 8590 (IGKV6-21)
HQSSSLPYT

SEQ ID NO: 17180 - protein, 21 aa, Homo sapiens
  Heavy chain CDR3 for antibody 8590 (IGHV3-33)
ARDGGITMGRGVYYYYYGMDV

SEQ ID NO: 17181 - protein, 9 aa, Homo sapiens
  Light chain CDR3 for antibody 8591 (IGKV1-6)
LQDYNHPFT

SEQ ID NO: 17182 - protein, 13 aa, Homo sapiens
  Heavy chain CDR3 for antibody 8591 (IGHV4-59)
ARDAGYSSSWFDY

SEQ ID NO: 17183 - protein, 9 aa, Homo sapiens
  Light chain CDR3 for antibody 8592 (IGKV1-17)
LQLNSFPWT

SEQ ID NO: 17184 - protein, 15 aa, Homo sapiens
  Heavy chain CDR3 for antibody 8592 (IGHV3-23)
ARRVCSGGSCSLFDY

SEQ ID NO: 17185 - protein, 10 aa, Homo sapiens
  Light chain CDR3 for antibody 8593 (IGKV1-27)
QKYNSAPMYT

SEQ ID NO: 17186 - protein, 13 aa, Homo sapiens
  Heavy chain CDR3 for antibody 8593 (IGHV4-39)
ARREVVGGRGFDY

SEQ ID NO: 17187 - protein, 9 aa, Homo sapiens
  Light chain CDR3 for antibody 8594 (IGKV5-2)
LQHDNFPYT

SEQ ID NO: 17188 - protein, 19 aa, Homo sapiens
  Heavy chain CDR3 for antibody 8594 (IGHV3-33)
ARDKYYDILTGYPWNGMDV

SEQ ID NO: 17189 - protein, 9 aa, Homo sapiens
  Light chain CDR3 for antibody 8595 (IGKV1-27)
QKYNSAPYT

SEQ ID NO: 17190 - protein, 18 aa, Homo sapiens
  Heavy chain CDR3 for antibody 8595 (IGHV3-33)
ARERGYYGSDIYPAAFDI

SEQ ID NO: 17191 - protein, 11 aa, Homo sapiens
  Light chain CDR3 for antibody 8596 (IGKV3-11)
QQRSNWPPTWT

SEQ ID NO: 17192 - protein, 14 aa, Homo sapiens
  Heavy chain CDR3 for antibody 8596 (IGHV4-39)
ARHGYYGSSNWFDP

SEQ ID NO: 17193 - protein, 9 aa, Homo sapiens
  Light chain CDR3 for antibody 8597 (IGKV1-17)
LQHNSFPYT

SEQ ID NO: 17194 - protein, 17 aa, Homo sapiens
  Heavy chain CDR3 for antibody 8597 (IGHV4-39)
AGRLTYYFGSGSPSFDY

SEQ ID NO: 17195 - protein, 9 aa, Homo sapiens
  Light chain CDR3 for antibody 8598 (IGKV3-15)
QQYNNWPYT

SEQ ID NO: 17196 - protein, 12 aa, Homo sapiens
  Heavy chain CDR3 for antibody 8598 (IGHV3-33)
ARKQWLVQAFDI

SEQ ID NO: 17197 - protein, 9 aa, Homo sapiens
  Light chain CDR3 for antibody 8599 (IGKV1-39)
QQGFSTPWT

SEQ ID NO: 17198 - protein, 18 aa, Homo sapiens
  Heavy chain CDR3 for antibody 8599 (IGHV4-59)
AREGHYYTSGSYYKAFDY

SEQ ID NO: 17199 - protein, 10 aa, Homo sapiens
  Light chain CDR3 for antibody 8600 (IGKV1-9)
QQLDSYPMYT

SEQ ID NO: 17200 - protein, 18 aa, Homo sapiens
  Heavy chain CDR3 for antibody 8600 (IGHV1-46)
ARDGDYVWGSYRSDWFDP

SEQ ID NO: 17201 - protein, 9 aa, Homo sapiens
  Light chain CDR3 for antibody 8601 (IGKV1-39)
QQSYSTPFT

SEQ ID NO: 17202 - protein, 11 aa, Homo sapiens
  Heavy chain CDR3 for antibody 8601 (IGHV3-33)
ARGSGSYAFDY

SEQ ID NO: 17203 - protein, 9 aa, Homo sapiens
  Light chain CDR3 for antibody 8602 (IGKV2-30)
MQGTHWPLT

SEQ ID NO: 17204 - protein, 14 aa, Homo sapiens
  Heavy chain CDR3 for antibody 8602 (IGHV3-23)
AKGGDVLTGYYPDY

SEQ ID NO: 17205 - protein, 9 aa, Homo sapiens
  Light chain CDR3 for antibody 8603 (IGKV3D-20)
QQYGRSPRT

SEQ ID NO: 17206 - protein, 13 aa, Homo sapiens
  Heavy chain CDR3 for antibody 8603 (IGHV4-61)
ASRYSSGWYPFDY

SEQ ID NO: 17207 - protein, 9 aa, Homo sapiens
  Light chain CDR3 for antibody 8604 (IGKV2D-28)
MQALQTPFT

SEQ ID NO: 17208 - protein, 12 aa, Homo sapiens
  Heavy chain CDR3 for antibody 8604 (IGHV3-33)
AREGDILTGYSL

SEQ ID NO: 17209 - protein, 9 aa, Homo sapiens
  Light chain CDR3 for antibody 8605 (IGKV1-6)
LQDYKSPFT

SEQ ID NO: 17210 - protein, 14 aa, Homo sapiens
  Heavy chain CDR3 for antibody 8605 (IGHV3-33)
ARRGSPLRPSHLDV

SEQ ID NO: 17211 - protein, 11 aa, Homo sapiens
  Light chain CDR3 for antibody 8606 (IGKV3-11)
QQRSNWPPTWT

SEQ ID NO: 17212 - protein, 21 aa, Homo sapiens
  Heavy chain CDR3 for antibody 8606 (IGHV3-33)
ARKRLYDILTGYYKAYYGMDV

SEQ ID NO: 17213 - protein, 9 aa, Homo sapiens
  Light chain CDR3 for antibody 8607 (IGKV6-21)
HQSSSLPHT

SEQ ID NO: 17214 - protein, 14 aa, Homo sapiens
  Heavy chain CDR3 for antibody 8607 (IGHV3-20)
ARDGGSSCYDYFDY

SEQ ID NO: 17215 - protein, 9 aa, Homo sapiens
  Light chain CDR3 for antibody 8608 (IGKV1-9)
QQLNGYPFT

SEQ ID NO: 17216 - protein, 9 aa, Homo sapiens
  Heavy chain CDR3 for antibody 8608 (IGHV3-30)
ARDYFHYDY

SEQ ID NO: 17217 - protein, 8 aa, Homo sapiens
  Light chain CDR3 for antibody 8609 (IGKV6-21)
HQSSSLYT

SEQ ID NO: 17218 - protein, 13 aa, Homo sapiens
  Heavy chain CDR3 for antibody 8609 (IGHV4-39)
ARHEVMVRGVFDY

SEQ ID NO: 17219 - protein, 9 aa, Homo sapiens
  Light chain CDR3 for antibody 8610 (IGKV4-1)
QQYYSTPWT

SEQ ID NO: 17220 - protein, 13 aa, Homo sapiens
  Heavy chain CDR3 for antibody 8610 (IGHV3-33)
ARKAYGDYFYFDY

SEQ ID NO: 17221 - protein, 9 aa, Homo sapiens
  Light chain CDR3 for antibody 8611 (IGKV1D-16)
QQYDSYPWT

SEQ ID NO: 17222 - protein, 18 aa, Homo sapiens
  Heavy chain CDR3 for antibody 8611 (IGHV3-13)
ARDYYGSGSLYYYYGMDV

SEQ ID NO: 17223 - protein, 10 aa, Homo sapiens
  Light chain CDR3 for antibody 8612 (IGKV1-9)
QQSYSTPMYT

SEQ ID NO: 17224 - protein, 13 aa, Homo sapiens
  Heavy chain CDR3 for antibody 8612 (IGHV4-39)
ARHVLLWFGEFDP

SEQ ID NO: 17225 - protein, 9 aa, Homo sapiens
  Light chain CDR3 for antibody 8613 (IGKV3D-11)
QQRSNWPYT

SEQ ID NO: 17226 - protein, 10 aa, Homo sapiens
  Heavy chain CDR3 for antibody 8613 (IGHV3-30)
AREWYGGMDV

SEQ ID NO: 17227 - protein, 8 aa, Homo sapiens
  Light chain CDR3 for antibody 8614 (IGKV1-5)
QQYNSYWT

SEQ ID NO: 17228 - protein, 12 aa, Homo sapiens
  Heavy chain CDR3 for antibody 8614 (IGHV3-33)
ARDRAYRGSLDY

SEQ ID NO: 17229 - protein, 9 aa, Homo sapiens
  Light chain CDR3 for antibody 8615 (IGKV1-9)
QQLNSYPYT

SEQ ID NO: 17230 - protein, 17 aa, Homo sapiens
  Heavy chain CDR3 for antibody 8615 (IGHV3-33)
ARELRYFDWLLSDAFDI

SEQ ID NO: 17231 - protein, 10 aa, Homo sapiens
  Light chain CDR3 for antibody 8616 (IGKV1-39)
QQSYSTPMYT

SEQ ID NO: 17232 - protein, 11 aa, Homo sapiens
  Heavy chain CDR3 for antibody 8616 (IGHV3-33)
AREAANWGFDY

SEQ ID NO: 17233 - protein, 8 aa, Homo sapiens
  Light chain CDR3 for antibody 8617 (IGKV1-5)
QQYNSYYT

SEQ ID NO: 17234 - protein, 10 aa, Homo sapiens
  Heavy chain CDR3 for antibody 8617 (IGHV3-23)
AKDHWGDFDY

SEQ ID NO: 17235 - protein, 9 aa, Homo sapiens
  Light chain CDR3 for antibody 8618 (IGKV6-21)
QQFNNYPHT

SEQ ID NO: 17236 - protein, 20 aa, Homo sapiens
  Heavy chain CDR3 for antibody 8618 (IGHV4-59)
ARDRGYDILTGYYGYYGMDV

SEQ ID NO: 17237 - protein, 9 aa, Homo sapiens
  Light chain CDR3 for antibody 8619 (IGKV1-16)
QHYNDYPFT

SEQ ID NO: 17238 - protein, 10 aa, Homo sapiens
  Heavy chain CDR3 for antibody 8619 (IGHV3-33)
ARENSTPLDY

SEQ ID NO: 17239 - protein, 9 aa, Homo sapiens
  Light chain CDR3 for antibody 8620 (IGKV1-6)
LQDYKSPFT

SEQ ID NO: 17240 - protein, 12 aa, Homo sapiens
  Heavy chain CDR3 for antibody 8620 (IGHV3-33)
ARKGYDMHAFDI

SEQ ID NO: 17241 - protein, 8 aa, Homo sapiens
  Light chain CDR3 for antibody 8621 (IGKV1D-13)
QQFNNYPT

SEQ ID NO: 17242 - protein, 13 aa, Homo sapiens
  Heavy chain CDR3 for antibody 8621 (IGHV4-39)
ARHPPSRDYGMDV

SEQ ID NO: 17243 - protein, 9 aa, Homo sapiens
  Light chain CDR3 for antibody 8622 (IGKV1-16)
QHYNDYPFT

SEQ ID NO: 17244 - protein, 10 aa, Homo sapiens
  Heavy chain CDR3 for antibody 8622 (IGHV3-23)
AKEQWLVLDY

SEQ ID NO: 17245 - protein, 9 aa, Homo sapiens
  Light chain CDR3 for antibody 8623 (IGKV1-9)
QQLNSYPFT

SEQ ID NO: 17246 - protein, 7 aa, Homo sapiens
  Heavy chain CDR3 for antibody 8623 (IGHV1-46)
AREGGDY

SEQ ID NO: 17247 - protein, 10 aa, Homo sapiens
  Light chain CDR3 for antibody 8624 (IGKV1-39)
QQSYSTPMYT

SEQ ID NO: 17248 - protein, 13 aa, Homo sapiens
  Heavy chain CDR3 for antibody 8624 (IGHV4-39)
ARHEVMIRGVFDY

SEQ ID NO: 17249 - protein, 9 aa, Homo sapiens
  Light chain CDR3 for antibody 8625 (IGKV3-20)
QQYGRSPRT

SEQ ID NO: 17250 - protein, 13 aa, Homo sapiens
  Heavy chain CDR3 for antibody 8625 (IGHV3-33)
ARAFIMVRGVIDY

SEQ ID NO: 17251 - protein, 9 aa, Homo sapiens
  Light chain CDR3 for antibody 8626 (IGKV5-2)
LQHDNFPYT

SEQ ID NO: 17252 - protein, 12 aa, Homo sapiens
  Heavy chain CDR3 for antibody 8626 (IGHV3-33)
ARDIVGTSYFDY

SEQ ID NO: 17253 - protein, 11 aa, Homo sapiens
  Light chain CDR3 for antibody 8627 (IGKV1-39)
QQSYSTPPEYT

SEQ ID NO: 17254 - protein, 18 aa, Homo sapiens
  Heavy chain CDR3 for antibody 8627 (IGHV3-33)
ARDVLRYFDWLSNSYFDY

SEQ ID NO: 17255 - protein, 8 aa, Homo sapiens
  Light chain CDR3 for antibody 8628 (IGKV1D-13)
QQFNNYYT

SEQ ID NO: 17256 - protein, 23 aa, Homo sapiens
  Heavy chain CDR3 for antibody 8628 (IGHV4-59)
ARERTYSDILPGYYEDYYYGMDV

SEQ ID NO: 17257 - protein, 9 aa, Homo sapiens
  Light chain CDR3 for antibody 8629 (IGKV1-6)
LQDYKSPFT

SEQ ID NO: 17258 - protein, 16 aa, Homo sapiens
  Heavy chain CDR3 for antibody 8629 (IGHV3-23)
ARGGRSDWLYYYGMDV

SEQ ID NO: 17259 - protein, 8 aa, Homo sapiens
  Light chain CDR3 for antibody 8630 (IGKV1D-13)
QQFNNYYT

SEQ ID NO: 17260 - protein, 12 aa, Homo sapiens
  Heavy chain CDR3 for antibody 8630 (IGHV1-46)
AREDYDIDGMDV

SEQ ID NO: 17261 - protein, 9 aa, Homo sapiens
  Light chain CDR3 for antibody 8631 (IGKV3-20)
QQYGSSPYT

SEQ ID NO: 17262 - protein, 16 aa, Homo sapiens
  Heavy chain CDR3 for antibody 8631 (IGHV3-33)
ARGEQWLGYYYYGMDV

SEQ ID NO: 17263 - protein, 9 aa, Homo sapiens
  Light chain CDR3 for antibody 8632 (IGKV3-15)
QQYINWPLT

SEQ ID NO: 17264 - protein, 18 aa, Homo sapiens
  Heavy chain CDR3 for antibody 8632 (IGHV3-13)
ARDYYGSGSLYYYYGMDV

SEQ ID NO: 17265 - protein, 9 aa, Homo sapiens
  Light chain CDR3 for antibody 8633 (IGKV1D-13)
QQFNNYPRT

SEQ ID NO: 17266 - protein, 12 aa, Homo sapiens
  Heavy chain CDR3 for antibody 8633 (IGHV3-33)
ARGGIAVDVCDI

SEQ ID NO: 17267 - protein, 9 aa, Homo sapiens
  Light chain CDR3 for antibody 8634 (IGKV1-6)
QQEYNYPLT

SEQ ID NO: 17268 - protein, 13 aa, Homo sapiens
  Heavy chain CDR3 for antibody 8634 (IGHV3-33)
ARAFTMVRGVIDY

SEQ ID NO: 17269 - protein, 8 aa, Homo sapiens
  Light chain CDR3 for antibody 8635 (IGKV1-5)
QQYNSYYT

SEQ ID NO: 17270 - protein, 12 aa, Homo sapiens
  Heavy chain CDR3 for antibody 8635 (IGHV3-13)
AREAGIPDAFDI

SEQ ID NO: 17271 - protein, 9 aa, Homo sapiens
  Light chain CDR3 for antibody 8636 (IGKV1-27)
QKYNSAPYT

SEQ ID NO: 17272 - protein, 20 aa, Homo sapiens
  Heavy chain CDR3 for antibody 8636 (IGHV3-23)
AKDREMAATSHYYYYYGMDV

SEQ ID NO: 17273 - protein, 8 aa, Homo sapiens
  Light chain CDR3 for antibody 8637 (IGKV3-20)
QQYGSSRT

SEQ ID NO: 17274 - protein, 13 aa, Homo sapiens
  Heavy chain CDR3 for antibody 8637 (IGHV4-61)
ASRYSSGWYPFDY

SEQ ID NO: 17275 - protein, 9 aa, Homo sapiens
  Light chain CDR3 for antibody 8638 (IGKV1D-16)
QQYASYPPT

SEQ ID NO: 17276 - protein, 9 aa, Homo sapiens
  Heavy chain CDR3 for antibody 8638 (IGHV4-59)
ARGGASFDY

SEQ ID NO: 17277 - protein, 10 aa, Homo sapiens
  Light chain CDR3 for antibody 8639 (IGKV1-39)
QQSYSTPMYT

SEQ ID NO: 17278 - protein, 14 aa, Homo sapiens
  Heavy chain CDR3 for antibody 8639 (IGHV3-33)
ARTTAAAGPRDFQH

SEQ ID NO: 17279 - protein, 10 aa, Homo sapiens
  Light chain CDR3 for antibody 8640 (IGKV1-9)
QQLDSYPMYT

SEQ ID NO: 17280 - protein, 18 aa, Homo sapiens
  Heavy chain CDR3 for antibody 8640 (IGHV3-33)
ARREGIVGATTYYYGMDV

SEQ ID NO: 17281 - protein, 9 aa, Homo sapiens
  Light chain CDR3 for antibody 8641 (IGKV1D-16)
QQYDSYPWT

SEQ ID NO: 17282 - protein, 16 aa, Homo sapiens
  Heavy chain CDR3 for antibody 8641 (IGHV4-59)
ARDTPYYSGSGRPFDS

SEQ ID NO: 17283 - protein, 9 aa, Homo sapiens
  Light chain CDR3 for antibody 8642 (IGKV3-15)
QQYNNWPLT

SEQ ID NO: 17284 - protein, 12 aa, Homo sapiens
  Heavy chain CDR3 for antibody 8642 (IGHV4-39)
ARHPRYLDAFDI

SEQ ID NO: 17285 - protein, 9 aa, Homo sapiens
  Light chain CDR3 for antibody 8643 (IGKV1-17)
LHSNNYPWT

SEQ ID NO: 17286 - protein, 17 aa, Homo sapiens
  Heavy chain CDR3 for antibody 8643 (IGHV1-18)
ARDEGYDILTGYPHFDY

SEQ ID NO: 17287 - protein, 9 aa, Homo sapiens
  Light chain CDR3 for antibody 8644 (IGKV3D-7)
QQDYKLPLT

SEQ ID NO: 17288 - protein, 15 aa, Homo sapiens
  Heavy chain CDR3 for antibody 8644 (IGHV3-33)
ARAYDLPHYYYGMDV

SEQ ID NO: 17289 - protein, 9 aa, Homo sapiens
  Light chain CDR3 for antibody 8645 (IGKV1-17)
LQHNGYPLT

SEQ ID NO: 17290 - protein, 17 aa, Homo sapiens
  Heavy chain CDR3 for antibody 8645 (IGHV4-39)
ARVLRYFDWLSHDAFDI

SEQ ID NO: 17291 - protein, 10 aa, Homo sapiens
  Light chain CDR3 for antibody 8646 (IGKV1-9)
QQLDSYPMYT

SEQ ID NO: 17292 - protein, 20 aa, Homo sapiens
  Heavy chain CDR3 for antibody 8646 (IGHV3-11)
SRGGATLIRGLIDYYYGMDV

SEQ ID NO: 17293 - protein, 9 aa, Homo sapiens
  Light chain CDR3 for antibody 8647 (IGKV1-6)
LQDYKSPFT

SEQ ID NO: 17294 - protein, 23 aa, Homo sapiens
  Heavy chain CDR3 for antibody 8647 (IGHV3-11)
ARDEGVTMVRGVISYYYYYGMDV

SEQ ID NO: 17295 - protein, 9 aa, Homo sapiens
  Light chain CDR3 for antibody 8648 (IGKV1-27)
QKYNSAPYT

SEQ ID NO: 17296 - protein, 10 aa, Homo sapiens
  Heavy chain CDR3 for antibody 8648 (IGHV4-39)
ARQLGNWFDP

SEQ ID NO: 17297 - protein, 11 aa, Homo sapiens
  Light chain CDR3 for antibody 8649 (IGKV3-11)
QQRSNWPPTWT

SEQ ID NO: 17298 - protein, 9 aa, Homo sapiens
  Heavy chain CDR3 for antibody 8649 (IGHV3-13)
ARDRWYFDL

SEQ ID NO: 17299 - protein, 8 aa, Homo sapiens
  Light chain CDR3 for antibody 8650 (IGKV3D-7)
QQDYNLLT

SEQ ID NO: 17300 - protein, 14 aa, Homo sapiens
  Heavy chain CDR3 for antibody 8650 (IGHV3-33)
VRDAMGATTAWFDP

SEQ ID NO: 17301 - protein, 9 aa, Homo sapiens
  Light chain CDR3 for antibody 8651 (IGKV1-39)
QQSYRTPLT

SEQ ID NO: 17302 - protein, 12 aa, Homo sapiens
  Heavy chain CDR3 for antibody 8651 (IGHV3-33)
ARKGYGLYVLDV

SEQ ID NO: 17303 - protein, 9 aa, Homo sapiens
  Light chain CDR3 for antibody 8652 (IGKV3D-7)
QQDYNLPLT

SEQ ID NO: 17304 - protein, 17 aa, Homo sapiens
  Heavy chain CDR3 for antibody 8652 (IGHV3-23)
AREGYYDILTDYYGMDV

SEQ ID NO: 17305 - protein, 10 aa, Homo sapiens
  Light chain CDR3 for antibody 8653 (IGKV1-39)
QQSYSTPMYT

SEQ ID NO: 17306 - protein, 18 aa, Homo sapiens
  Heavy chain CDR3 for antibody 8653 (IGHV3-33)
ARDRDRYGSGTYPDAIDI

SEQ ID NO: 17307 - protein, 10 aa, Homo sapiens
  Light chain CDR3 for antibody 8654 (IGKV3-15)
QQYNNWPPYT

SEQ ID NO: 17308 - protein, 10 aa, Homo sapiens
  Heavy chain CDR3 for antibody 8654 (IGHV3-23)
AKEQWLVLDY

SEQ ID NO: 17309 - protein, 10 aa, Homo sapiens
  Light chain CDR3 for antibody 8655 (IGKV3-11)
QQRSNWPPYT

SEQ ID NO: 17310 - protein, 18 aa, Homo sapiens
  Heavy chain CDR3 for antibody 8655 (IGHV3-23)
ARREGITLIFYYYYGMDV

SEQ ID NO: 17311 - protein, 9 aa, Homo sapiens
  Light chain CDR3 for antibody 8656 (IGKV1-9)
QQSYSTPIT

SEQ ID NO: 17312 - protein, 9 aa, Homo sapiens
  Heavy chain CDR3 for antibody 8656 (IGHV3-30)
ARGRVSLDV

SEQ ID NO: 17313 - protein, 9 aa, Homo sapiens
  Light chain CDR3 for antibody 8657 (IGKV1-17)
LHSNNYPWT

SEQ ID NO: 17314 - protein, 11 aa, Homo sapiens
  Heavy chain CDR3 for antibody 8657 (IGHV3-33)
ARDRSSGPFDY

SEQ ID NO: 17315 - protein, 10 aa, Homo sapiens
  Light chain CDR3 for antibody 8658 (IGKV3-11)
QQRSNWPIFT

SEQ ID NO: 17316 - protein, 16 aa, Homo sapiens
  Heavy chain CDR3 for antibody 8658 (IGHV3-30)
ARDIAVAGHVYYGMDV

SEQ ID NO: 17317 - protein, 9 aa, Homo sapiens
  Light chain CDR3 for antibody 8659 (IGKV3D-7)
QQDYNLPIT

SEQ ID NO: 17318 - protein, 18 aa, Homo sapiens
  Heavy chain CDR3 for antibody 8659 (IGHV3-33)
VRDRERYGSGSYPDAFDI

SEQ ID NO: 17319 - protein, 9 aa, Homo sapiens
  Light chain CDR3 for antibody 8660 (IGKV2-30)
MQGTHWPLT

SEQ ID NO: 17320 - protein, 16 aa, Homo sapiens
  Heavy chain CDR3 for antibody 8660 (IGHV3-20)
ARDSSSLDYYYYGMDV

SEQ ID NO: 17321 - protein, 9 aa, Homo sapiens
  Light chain CDR3 for antibody 8661 (IGKV1-9)
QQLNSYPLT

SEQ ID NO: 17322 - protein, 15 aa, Homo sapiens
  Heavy chain CDR3 for antibody 8661 (IGHV3-11)
ARDRAVAGTVHAFDI

SEQ ID NO: 17323 - protein, 9 aa, Homo sapiens
  Light chain CDR3 for antibody 8662 (IGKV1D-16)
QQYYSYPRT

SEQ ID NO: 17324 - protein, 15 aa, Homo sapiens
  Heavy chain CDR3 for antibody 8662 (IGHV3-74)
ARGSGSHYHYYGMDV

SEQ ID NO: 17325 - protein, 8 aa, Homo sapiens
  Light chain CDR3 for antibody 8663 (IGKV3-20)
QQYGRSFT

SEQ ID NO: 17326 - protein, 14 aa, Homo sapiens
  Heavy chain CDR3 for antibody 8663 (IGHV4-39)
ARRGVVVPPGGMDV

SEQ ID NO: 17327 - protein, 10 aa, Homo sapiens
  Light chain CDR3 for antibody 8664 (IGKV3-20)
QQYGRSPPVT

SEQ ID NO: 17328 - protein, 13 aa, Homo sapiens
  Heavy chain CDR3 for antibody 8664 (IGHV3-33)
ARRATLVRGVFDP

SEQ ID NO: 17329 - protein, 9 aa, Homo sapiens
  Light chain CDR3 for antibody 8665 (IGKV1-16)
QHYNDYPFT

SEQ ID NO: 17330 - protein, 12 aa, Homo sapiens
  Heavy chain CDR3 for antibody 8665 (IGHV3-66)
ARKGYDMHEFDI

SEQ ID NO: 17331 - protein, 9 aa, Homo sapiens
  Light chain CDR3 for antibody 8666 (IGKV2D-28)
MQALQTPPT

SEQ ID NO: 17332 - protein, 14 aa, Homo sapiens
  Heavy chain CDR3 for antibody 8666 (IGHV3-33)
ARDKTYPLSYGMDV

SEQ ID NO: 17333 - protein, 6 aa, Homo sapiens
  Light chain CDR3 for antibody 8667 (IGKV3-20)
QQYGST

SEQ ID NO: 17334 - protein, 17 aa, Homo sapiens
  Heavy chain CDR3 for antibody 8667 (IGHV3-33)
ARVYYDILTGYSPAFDI

SEQ ID NO: 17335 - protein, 9 aa, Homo sapiens
  Light chain CDR3 for antibody 8668 (IGKV1-33)
QQYDNLPFT

SEQ ID NO: 17336 - protein, 18 aa, Homo sapiens
  Heavy chain CDR3 for antibody 8668 (IGHV3-33)
ARGLLWFGVSYYYYGMDV

SEQ ID NO: 17337 - protein, 9 aa, Homo sapiens
  Light chain CDR3 for antibody 8669 (IGKV1-9)
QQLISYPLT

SEQ ID NO: 17338 - protein, 20 aa, Homo sapiens
  Heavy chain CDR3 for antibody 8669 (IGHV3-66)
ARRMVRGVKKTYYYYYGLDV

SEQ ID NO: 17339 - protein, 9 aa, Homo sapiens
  Light chain CDR3 for antibody 8670 (IGKV1-27)
QKYNSAPYT

SEQ ID NO: 17340 - protein, 13 aa, Homo sapiens
  Heavy chain CDR3 for antibody 8670 (IGHV1-24)
ATGYSINWYEFDY

SEQ ID NO: 17341 - protein, 9 aa, Homo sapiens
  Light chain CDR3 for antibody 8671 (IGKV1D-16)
LQDYNYPFT

SEQ ID NO: 17342 - protein, 12 aa, Homo sapiens
  Heavy chain CDR3 for antibody 8671 (IGHV3-23)
AKEYDILAGYFH

SEQ ID NO: 17343 - protein, 9 aa, Homo sapiens
  Light chain CDR3 for antibody 8672 (IGKV3D-20)
QQYGSSPYT

SEQ ID NO: 17344 - protein, 11 aa, Homo sapiens
  Heavy chain CDR3 for antibody 8672 (IGHV1-24)
ATREYSSSCDY

SEQ ID NO: 17345 - protein, 9 aa, Homo sapiens
  Light chain CDR3 for antibody 8673 (IGKV1-17)
LQHNSYPRT

SEQ ID NO: 17346 - protein, 16 aa, Homo sapiens
  Heavy chain CDR3 for antibody 8673 (IGHV3-33)
ARAYYYGSGSYPHFQH

SEQ ID NO: 17347 - protein, 9 aa, Homo sapiens
  Light chain CDR3 for antibody 8674 (IGKV1D-17)
LQHNSYPYT

SEQ ID NO: 17348 - protein, 13 aa, Homo sapiens
  Heavy chain CDR3 for antibody 8674 (IGHV3-33)
ARGELLWFGEFAC

SEQ ID NO: 17349 - protein, 9 aa, Homo sapiens
  Light chain CDR3 for antibody 8675 (IGKV3-20)
QQYGSSPYT

SEQ ID NO: 17350 - protein, 12 aa, Homo sapiens
  Heavy chain CDR3 for antibody 8675 (IGHV1-46)
ARGLIGDHAVDI

SEQ ID NO: 17351 - protein, 11 aa, Homo sapiens
  Light chain CDR3 for antibody 8676 (IGKV3-11)
QQRSNWPPTWT

SEQ ID NO: 17352 - protein, 12 aa, Homo sapiens
  Heavy chain CDR3 for antibody 8676 (IGHV1-18)
AGVLFDGDYSDY

SEQ ID NO: 17353 - protein, 9 aa, Homo sapiens
  Light chain CDR3 for antibody 8677 (IGKV3D-7)
QQDYNLPWT

SEQ ID NO: 17354 - protein, 11 aa, Homo sapiens
  Heavy chain CDR3 for antibody 8677 (IGHV4-59)
VRERGYYGMDV

SEQ ID NO: 17355 - protein, 9 aa, Homo sapiens
  Light chain CDR3 for antibody 8678 (IGKV2-30)
MQGTHWPLT

SEQ ID NO: 17356 - protein, 16 aa, Homo sapiens
  Heavy chain CDR3 for antibody 8678 (IGHV3-33)
ARGDDILTHQYYGVDV

SEQ ID NO: 17357 - protein, 9 aa, Homo sapiens
  Light chain CDR3 for antibody 8679 (IGKV3-20)
QQYGSSPYT

SEQ ID NO: 17358 - protein, 20 aa, Homo sapiens
  Heavy chain CDR3 for antibody 8679 (IGHV3-33)
AKGMGGLRYFDWPHYYGMDV

SEQ ID NO: 17359 - protein, 9 aa, Homo sapiens
  Light chain CDR3 for antibody 8680 (IGKV1-33)
QQYDNLPFT

SEQ ID NO: 17360 - protein, 17 aa, Homo sapiens
  Heavy chain CDR3 for antibody 8680 (IGHV3-33)
ARESLKLGIYYYYGMDV

SEQ ID NO: 17361 - protein, 9 aa, Homo sapiens
  Light chain CDR3 for antibody 8681 (IGKV3D-7)
QQDYEFPLT

SEQ ID NO: 17362 - protein, 12 aa, Homo sapiens
  Heavy chain CDR3 for antibody 8681 (IGHV1-46)
ARGLTGDHAVDI

SEQ ID NO: 17363 - protein, 9 aa, Homo sapiens
  Light chain CDR3 for antibody 8682 (IGKV1-33)
QQYDNLPFT

SEQ ID NO: 17364 - protein, 15 aa, Homo sapiens
  Heavy chain CDR3 for antibody 8682 (IGHV3-33)
VCVLYDYGDYVGFDY

SEQ ID NO: 17365 - protein, 10 aa, Homo sapiens
  Light chain CDR3 for antibody 8683 (IGKV1-16)
QQSYSTPMYT

SEQ ID NO: 17366 - protein, 10 aa, Homo sapiens
  Heavy chain CDR3 for antibody 8683 (IGHV3-23)
AKDHYGDYPY

SEQ ID NO: 17367 - protein, 9 aa, Homo sapiens
  Light chain CDR3 for antibody 8684 (IGKV1-9)
QQLISYPLT

SEQ ID NO: 17368 - protein, 18 aa, Homo sapiens
  Heavy chain CDR3 for antibody 8684 (IGHV3-23)
AKPDYYGSGSYYNVPFDY

SEQ ID NO: 17369 - protein, 8 aa, Homo sapiens
  Light chain CDR3 for antibody 8685 (IGKV3D-7)
QQDYNLLT

SEQ ID NO: 17370 - protein, 17 aa, Homo sapiens
  Heavy chain CDR3 for antibody 8685 (IGHV4-59)
ARDRELLWFGEFGGMDV

SEQ ID NO: 17371 - protein, 9 aa, Homo sapiens
  Light chain CDR3 for antibody 8686 (IGKV1-27)
QKYNSAPYT

SEQ ID NO: 17372 - protein, 17 aa, Homo sapiens
  Heavy chain CDR3 for antibody 8686 (IGHV3-23)
AKGGSFYSSGWYDAFDI

SEQ ID NO: 17373 - protein, 8 aa, Homo sapiens
  Light chain CDR3 for antibody 8687 (IGKV1-5)
QQYNSYWT

SEQ ID NO: 17374 - protein, 16 aa, Homo sapiens
  Heavy chain CDR3 for antibody 8687 (IGHV4-59)
ARYSGSYYGDYYGMDV

SEQ ID NO: 17375 - protein, 10 aa, Homo sapiens
  Light chain CDR3 for antibody 8688 (IGKV1-6)
LQDYNYPMYT

SEQ ID NO: 17376 - protein, 15 aa, Homo sapiens
  Heavy chain CDR3 for antibody 8688 (IGHV3-30)
ARGAMVRGVDYGMDV

SEQ ID NO: 17377 - protein, 9 aa, Homo sapiens
  Light chain CDR3 for antibody 8689 (IGKV1D-16)
QQYHSYPYT

SEQ ID NO: 17378 - protein, 9 aa, Homo sapiens
  Heavy chain CDR3 for antibody 8689 (IGHV3-33)
ARGSGWSDY

SEQ ID NO: 17379 - protein, 8 aa, Homo sapiens
  Light chain CDR3 for antibody 8690 (IGKV1-5)
QQYNSYYT

SEQ ID NO: 17380 - protein, 17 aa, Homo sapiens
  Heavy chain CDR3 for antibody 8690 (IGHV4-39)
ARQGWYYGSGSSLLFDY

SEQ ID NO: 17381 - protein, 9 aa, Homo sapiens
  Light chain CDR3 for antibody 8691 (IGKV1-27)
QKYNSAPYT

SEQ ID NO: 17382 - protein, 19 aa, Homo sapiens
  Heavy chain CDR3 for antibody 8691 (IGHV5-51)
ARHGEKGKRITMVRGSLDV

SEQ ID NO: 17383 - protein, 9 aa, Homo sapiens
  Light chain CDR3 for antibody 8692 (IGKV3D-20)
QQYGSSPYT

SEQ ID NO: 17384 - protein, 14 aa, Homo sapiens
  Heavy chain CDR3 for antibody 8692 (IGHV3-23)
AKGGDVLTGYYPDY

SEQ ID NO: 17385 - protein, 9 aa, Homo sapiens
  Light chain CDR3 for antibody 8693 (IGKV1-17)
LHSNNYPWT

SEQ ID NO: 17386 - protein, 18 aa, Homo sapiens
  Heavy chain CDR3 for antibody 8693 (IGHV4-59)
AREGDYVWGSYRPNWFDP

SEQ ID NO: 17387 - protein, 8 aa, Homo sapiens
  Light chain CDR3 for antibody 8694 (IGKV3D-7)
QQDYNLLT

SEQ ID NO: 17388 - protein, 12 aa, Homo sapiens
  Heavy chain CDR3 for antibody 8694 (IGHV3-h)
AREDYYYYGMDV

SEQ ID NO: 17389 - protein, 9 aa, Homo sapiens
  Light chain CDR3 for antibody 8695 (IGKV1-9)
QHYNDYPFT

SEQ ID NO: 17390 - protein, 12 aa, Homo sapiens
  Heavy chain CDR3 for antibody 8695 (IGHV4-39)
ARHGSGSSYFDY

SEQ ID NO: 17391 - protein, 9 aa, Homo sapiens
  Light chain CDR3 for antibody 8696 (IGKV1-9)
QQVKSYPYT

SEQ ID NO: 17392 - protein, 11 aa, Homo sapiens
  Heavy chain CDR3 for antibody 8696 (IGHV4-4)
AREAYYYGLDV

SEQ ID NO: 17393 - protein, 9 aa, Homo sapiens
  Light chain CDR3 for antibody 8697 (IGKV3-20)
QLYGSSPYT

SEQ ID NO: 17394 - protein, 17 aa, Homo sapiens
  Heavy chain CDR3 for antibody 8697 (IGHV1-18)
ARERYYGSGNYKYNMDV

SEQ ID NO: 17395 - protein, 9 aa, Homo sapiens
  Light chain CDR3 for antibody 8698 (IGKV6-21)
HQSSSLPYT

SEQ ID NO: 17396 - protein, 16 aa, Homo sapiens
  Heavy chain CDR3 for antibody 8698 (IGHV1-18)
TRGTFYYGSGSSFFDY

SEQ ID NO: 17397 - protein, 10 aa, Homo sapiens
  Light chain CDR3 for antibody 8699 (IGKV3-15)
QQYNNWPPIT

SEQ ID NO: 17398 - protein, 17 aa, Homo sapiens
  Heavy chain CDR3 for antibody 8699 (IGHV3-33)
VREGGLLWVGELSLFDY

SEQ ID NO: 17399 - protein, 8 aa, Homo sapiens
  Light chain CDR3 for antibody 8700 (IGKV3D-7)
QQDYNLLT

SEQ ID NO: 17400 - protein, 12 aa, Homo sapiens
  Heavy chain CDR3 for antibody 8700 (IGHV3-23)
AKEGLGSDYESY

SEQ ID NO: 17401 - protein, 9 aa, Homo sapiens
  Light chain CDR3 for antibody 8701 (IGKV3-11)
QQRINWPWT

SEQ ID NO: 17402 - protein, 13 aa, Homo sapiens
  Heavy chain CDR3 for antibody 8701 (IGHV4-28)
ARKGATGYYGMDV

SEQ ID NO: 17403 - protein, 9 aa, Homo sapiens
  Light chain CDR3 for antibody 8702 (IGKV3-15)
QQYNNWPLT

SEQ ID NO: 17404 - protein, 14 aa, Homo sapiens
  Heavy chain CDR3 for antibody 8702 (IGHV1-24)
ATWLPLYYYYGMDV

SEQ ID NO: 17405 - protein, 9 aa, Homo sapiens
  Light chain CDR3 for antibody 8703 (IGKV3D-20)
LQHNGYPLT

SEQ ID NO: 17406 - protein, 17 aa, Homo sapiens
  Heavy chain CDR3 for antibody 8703 (IGHV3-33)
ARGYCSRTSCYLYYFDY

SEQ ID NO: 17407 - protein, 8 aa, Homo sapiens
  Light chain CDR3 for antibody 8704 (IGKV3-15)
QQYNNWPT

SEQ ID NO: 17408 - protein, 17 aa, Homo sapiens
  Heavy chain CDR3 for antibody 8704 (IGHV3-33)
ARERYYGSGSYYNWFDP

SEQ ID NO: 17409 - protein, 11 aa, Homo sapiens
  Light chain CDR3 for antibody 8705 (IGKV3-11)
QQRSNWPPTWT

SEQ ID NO: 17410 - protein, 17 aa, Homo sapiens
  Heavy chain CDR3 for antibody 8705 (IGHV3-33)
ARGEQWLGYYYYYGMDV

SEQ ID NO: 17411 - protein, 10 aa, Homo sapiens
  Light chain CDR3 for antibody 8706 (IGKV3-11)
QQRSNWPIFT

SEQ ID NO: 17412 - protein, 19 aa, Homo sapiens
  Heavy chain CDR3 for antibody 8706 (IGHV4-39)
ARQGDVLRYFDWLLGAFDI

SEQ ID NO: 17413 - protein, 11 aa, Homo sapiens
  Light chain CDR3 for antibody 8707 (IGKV3-11)
QQRSNWPPTWT

SEQ ID NO: 17414 - protein, 12 aa, Homo sapiens
  Heavy chain CDR3 for antibody 8707 (IGHV3-33)
ARGYFGSGYAHF

SEQ ID NO: 17415 - protein, 9 aa, Homo sapiens
  Light chain CDR3 for antibody 8708 (IGKV1-17)
LQHNSYPYT

SEQ ID NO: 17416 - protein, 16 aa, Homo sapiens
  Heavy chain CDR3 for antibody 8708 (IGHV3-48)
TRRRQWLAGFDWYFDL

SEQ ID NO: 17417 - protein, 11 aa, Homo sapiens
  Light chain CDR3 for antibody 8709 (IGKV3-11)
QQRSNWPPTWT

SEQ ID NO: 17418 - protein, 15 aa, Homo sapiens
  Heavy chain CDR3 for antibody 8709 (IGHV3-33)
VCVLYDYGDYVGFDY

SEQ ID NO: 17419 - protein, 8 aa, Homo sapiens
  Light chain CDR3 for antibody 8710 (IGKV1-5)
QQYNSYST

SEQ ID NO: 17420 - protein, 11 aa, Homo sapiens
  Heavy chain CDR3 for antibody 8710 (IGHV4-59)
TRDRGLGSFDY

SEQ ID NO: 17421 - protein, 8 aa, Homo sapiens
  Light chain CDR3 for antibody 8711 (IGKV3-15)
QQYNNWPT

SEQ ID NO: 17422 - protein, 17 aa, Homo sapiens
  Heavy chain CDR3 for antibody 8711 (IGHV1-18)
ARDEGYDILTGYPHFDY

SEQ ID NO: 17423 - protein, 9 aa, Homo sapiens
  Light chain CDR3 for antibody 8712 (IGKV1-9)
QQLISYPLT

SEQ ID NO: 17424 - protein, 15 aa, Homo sapiens
  Heavy chain CDR3 for antibody 8712 (IGHV3-33)
ARRICSGGSCSLFDY

SEQ ID NO: 17425 - protein, 9 aa, Homo sapiens
  Light chain CDR3 for antibody 8713 (IGKV2D-28)
MQALQTPPT

SEQ ID NO: 17426 - protein, 16 aa, Homo sapiens
  Heavy chain CDR3 for antibody 8713 (IGHV3-33)
ARDGSMVRRIHDAFDF

SEQ ID NO: 17427 - protein, 9 aa, Homo sapiens
  Light chain CDR3 for antibody 8714 (IGKV6-21)
HQSTSLPFT

SEQ ID NO: 17428 - protein, 17 aa, Homo sapiens
  Heavy chain CDR3 for antibody 8714 (IGHV1-8)
ARGDYYGSGSPYWYFDL

SEQ ID NO: 17429 - protein, 9 aa, Homo sapiens
  Light chain CDR3 for antibody 8715 (IGKV1-6)
LQDFHYPWT

SEQ ID NO: 17430 - protein, 15 aa, Homo sapiens
  Heavy chain CDR3 for antibody 8715 (IGHV3-33)
ARDRGWKAPGYGMDV

SEQ ID NO: 17431 - protein, 9 aa, Homo sapiens
  Light chain CDR3 for antibody 8716 (IGKV1-17)
LQHNSYPYT

SEQ ID NO: 17432 - protein, 17 aa, Homo sapiens
  Heavy chain CDR3 for antibody 8716 (IGHV3-23)
AKERNWNDGYYYYGMDV

SEQ ID NO: 17433 - protein, 9 aa, Homo sapiens
  Light chain CDR3 for antibody 8717 (IGKV6-21)
HQSYSLPHT

SEQ ID NO: 17434 - protein, 14 aa, Homo sapiens
  Heavy chain CDR3 for antibody 8717 (IGHV3-33)
ARASSGSSYWYFDL

SEQ ID NO: 17435 - protein, 9 aa, Homo sapiens
  Light chain CDR3 for antibody 8718 (IGKV1-6)
LQDYKSPFT

SEQ ID NO: 17436 - protein, 20 aa, Homo sapiens
  Heavy chain CDR3 for antibody 8718 (IGHV3-23)
AKGMGGLRYFDWPHYYGMDV

SEQ ID NO: 17437 - protein, 9 aa, Homo sapiens
  Light chain CDR3 for antibody 8719 (IGKV1D-16)
LQHNSYPYT

SEQ ID NO: 17438 - protein, 14 aa, Homo sapiens
  Heavy chain CDR3 for antibody 8719 (IGHV1-18)
ARDQPTVPSGYFDY

SEQ ID NO: 17439 - protein, 9 aa, Homo sapiens
  Light chain CDR3 for antibody 8720 (IGKV1-6)
LQDYKSPFT

SEQ ID NO: 17440 - protein, 18 aa, Homo sapiens
  Heavy chain CDR3 for antibody 8720 (IGHV4-39)
ARQYYFGSGNYYRGWFDP

SEQ ID NO: 17441 - protein, 9 aa, Homo sapiens
  Light chain CDR3 for antibody 8721 (IGKV5-2)
LQHDNFPYT

SEQ ID NO: 17442 - protein, 13 aa, Homo sapiens
  Heavy chain CDR3 for antibody 8721 (IGHV1-24)
ATLHTYFYGEFAY

SEQ ID NO: 17443 - protein, 8 aa, Homo sapiens
  Light chain CDR3 for antibody 8722 (IGKV2D-28)
MQALQTPT

SEQ ID NO: 17444 - protein, 14 aa, Homo sapiens
  Heavy chain CDR3 for antibody 8722 (IGHV3-23)
AKSRIVGALYYFDY

SEQ ID NO: 17445 - protein, 11 aa, Homo sapiens
  Light chain CDR3 for antibody 8723 (IGKV3-11)
QQRSNWPPTWT

SEQ ID NO: 17446 - protein, 12 aa, Homo sapiens
  Heavy chain CDR3 for antibody 8723 (IGHV3-33)
ARDLVGATPFDY

SEQ ID NO: 17447 - protein, 9 aa, Homo sapiens
  Light chain CDR3 for antibody 8724 (IGKV3-15)
QQYNNWPLT

SEQ ID NO: 17448 - protein, 23 aa, Homo sapiens
  Heavy chain CDR3 for antibody 8724 (IGHV4-34)
ARERTYSDILPGYYEDYYYGMDV

SEQ ID NO: 17449 - protein, 9 aa, Homo sapiens
  Light chain CDR3 for antibody 8725 (IGKV1-27)
QKYNSAPLT

SEQ ID NO: 17450 - protein, 9 aa, Homo sapiens
  Heavy chain CDR3 for antibody 8725 (IGHV3-33)
ARDGLGIDY

SEQ ID NO: 17451 - protein, 9 aa, Homo sapiens
  Light chain CDR3 for antibody 8726 (IGKV1-9)
QQFNSYPWT

SEQ ID NO: 17452 - protein, 11 aa, Homo sapiens
  Heavy chain CDR3 for antibody 8726 (IGHV3-20)
AREGAVAGIDY

SEQ ID NO: 17453 - protein, 10 aa, Homo sapiens
  Light chain CDR3 for antibody 8727 (IGKV3-20)
QQYGRSPPVT

SEQ ID NO: 17454 - protein, 13 aa, Homo sapiens
  Heavy chain CDR3 for antibody 8727 (IGHV4-34)
ASNFYYYYYGMDV

SEQ ID NO: 17455 - protein, 9 aa, Homo sapiens
  Light chain CDR3 for antibody 8728 (IGKV3-11)
QQRINWPWT

SEQ ID NO: 17456 - protein, 10 aa, Homo sapiens
  Heavy chain CDR3 for antibody 8728 (IGHV3-30)
ARDGLESFDY

SEQ ID NO: 17457 - protein, 10 aa, Homo sapiens
  Light chain CDR3 for antibody 8729 (IGKV1-17)
LQHNSYPMYT

SEQ ID NO: 17458 - protein, 14 aa, Homo sapiens
  Heavy chain CDR3 for antibody 8729 (IGHV3-33)
VRDQGSMVRGGGDY

SEQ ID NO: 17459 - protein, 9 aa, Homo sapiens
  Light chain CDR3 for antibody 8730 (IGKV1D-13)
QQFNNYPYT

SEQ ID NO: 17460 - protein, 13 aa, Homo sapiens
  Heavy chain CDR3 for antibody 8730 (IGHV3-33)
ARDYGDYLNWFDP

SEQ ID NO: 17461 - protein, 9 aa, Homo sapiens
  Light chain CDR3 for antibody 8731 (IGKV1-6)
LQDYKSPFT

SEQ ID NO: 17462 - protein, 12 aa, Homo sapiens
  Heavy chain CDR3 for antibody 8731 (IGHV3-33)
AREGDILTGYSL

SEQ ID NO: 17463 - protein, 9 aa, Homo sapiens
  Light chain CDR3 for antibody 8732 (IGKV1D-16)
QQYNSYPYT

SEQ ID NO: 17464 - protein, 13 aa, Homo sapiens
  Heavy chain CDR3 for antibody 8732 (IGHV3-23)
ARAFFMVRGVMAY

SEQ ID NO: 17465 - protein, 9 aa, Homo sapiens
  Light chain CDR3 for antibody 8733 (IGKV3-20)
QQYGSSPYT

SEQ ID NO: 17466 - protein, 20 aa, Homo sapiens
  Heavy chain CDR3 for antibody 8733 (IGHV4-59)
ARDRGYDILTGYYGYYGMDV

SEQ ID NO: 17467 - protein, 9 aa, Homo sapiens
  Light chain CDR3 for antibody 8734 (IGKV1-6)
LQDYKSPFT

SEQ ID NO: 17468 - protein, 12 aa, Homo sapiens
  Heavy chain CDR3 for antibody 8734 (IGHV3-h)
AREDYYYYGMDV

SEQ ID NO: 17469 - protein, 10 aa, Homo sapiens
  Light chain CDR3 for antibody 8735 (IGKV3-20)
QQYGSSPPYT

SEQ ID NO: 17470 - protein, 13 aa, Homo sapiens
  Heavy chain CDR3 for antibody 8735 (IGHV3-23)
AKDRGYSSTSTAY

SEQ ID NO: 17471 - protein, 9 aa, Homo sapiens
  Light chain CDR3 for antibody 8736 (IGKV2-30)
MQGTHWPLT

SEQ ID NO: 17472 - protein, 11 aa, Homo sapiens
  Heavy chain CDR3 for antibody 8736 (IGHV3-33)
ARGTTVTHFDY

SEQ ID NO: 17473 - protein, 9 aa, Homo sapiens
  Light chain CDR3 for antibody 8737 (IGKV5-2)
LQHDNFPWT

SEQ ID NO: 17474 - protein, 15 aa, Homo sapiens
  Heavy chain CDR3 for antibody 8737 (IGHV4-59)
ARDGHGNWGSGTFDY

SEQ ID NO: 17475 - protein, 9 aa, Homo sapiens
  Light chain CDR3 for antibody 8738 (IGKV1-39)
QQSYRTPLT

SEQ ID NO: 17476 - protein, 12 aa, Homo sapiens
  Heavy chain CDR3 for antibody 8738 (IGHV4-61)
ARVDSSGWYFDY

SEQ ID NO: 17477 - protein, 9 aa, Homo sapiens
  Light chain CDR3 for antibody 8739 (IGKV1-9)
QQLISYPLT

SEQ ID NO: 17478 - protein, 13 aa, Homo sapiens
  Heavy chain CDR3 for antibody 8739 (IGHV3-21)
ARDSTLVRGVFPY

SEQ ID NO: 17479 - protein, 9 aa, Homo sapiens
  Light chain CDR3 for antibody 8740 (IGKV3-20)
QQYGSSPRT

SEQ ID NO: 17480 - protein, 13 aa, Homo sapiens
  Heavy chain CDR3 for antibody 8740 (IGHV1-18)
ARDYGDYLNWFDP

SEQ ID NO: 17481 - protein, 8 aa, Homo sapiens
  Light chain CDR3 for antibody 8741 (IGKV3-20)
QQYGSSLT

SEQ ID NO: 17482 - protein, 13 aa, Homo sapiens
  Heavy chain CDR3 for antibody 8741 (IGHV3-33)
ARKAYGDYFYFDY

SEQ ID NO: 17483 - protein, 9 aa, Homo sapiens
  Light chain CDR3 for antibody 8742 (IGKV1-6)
LQDFHYPWT

SEQ ID NO: 17484 - protein, 9 aa, Homo sapiens
  Heavy chain CDR3 for antibody 8742 (IGHV4-59)
AREGGSGSL

SEQ ID NO: 17485 - protein, 9 aa, Homo sapiens
  Light chain CDR3 for antibody 8743 (IGKV1-9)
QQLNTYPWT

SEQ ID NO: 17486 - protein, 19 aa, Homo sapiens
  Heavy chain CDR3 for antibody 8743 (IGHV3-64)
ARRFSGYSGYDHYYYGMDV

SEQ ID NO: 17487 - protein, 9 aa, Homo sapiens
  Light chain CDR3 for antibody 8744 (IGKV1-9)
QQLISYPLT

SEQ ID NO: 17488 - protein, 16 aa, Homo sapiens
  Heavy chain CDR3 for antibody 8744 (IGHV1-18)
ARYFDWLLRDYYGMDV

SEQ ID NO: 17489 - protein, 9 aa, Homo sapiens
  Light chain CDR3 for antibody 8745 (IGKV6-21)
HQSSSLPIT

SEQ ID NO: 17490 - protein, 13 aa, Homo sapiens
  Heavy chain CDR3 for antibody 8745 (IGHV3-11)
ARGGDVLTGYYDY

SEQ ID NO: 17491 - protein, 10 aa, Homo sapiens
  Light chain CDR3 for antibody 8746 (IGKV3-20)
QQYGRSPPVT

SEQ ID NO: 17492 - protein, 18 aa, Homo sapiens
  Heavy chain CDR3 for antibody 8746 (IGHV1-18)
ARDRYYYDSGSYYYGMDV

SEQ ID NO: 17493 - protein, 9 aa, Homo sapiens
  Light chain CDR3 for antibody 8747 (IGKV6-21)
HQSSSLPYT

SEQ ID NO: 17494 - protein, 16 aa, Homo sapiens
  Heavy chain CDR3 for antibody 8747 (IGHV3-23)
AKEGRVLRYFDWFWDY

SEQ ID NO: 17495 - protein, 8 aa, Homo sapiens
  Light chain CDR3 for antibody 8748 (IGKV1-5)
QQYNSYYT

SEQ ID NO: 17496 - protein, 13 aa, Homo sapiens
  Heavy chain CDR3 for antibody 8748 (IGHV4-61)
ASRYSSGWYPFDY

SEQ ID NO: 17497 - protein, 9 aa, Homo sapiens
  Light chain CDR3 for antibody 8749 (IGKV1-16)
QQYNSYPYT

SEQ ID NO: 17498 - protein, 20 aa, Homo sapiens
  Heavy chain CDR3 for antibody 8749 (IGHV1-69)
AREGVAAVGRVYYFYYGMDV

SEQ ID NO: 17499 - protein, 10 aa, Homo sapiens
  Light chain CDR3 for antibody 8750 (IGKV3-20)
QQYGRSPPVT

SEQ ID NO: 17500 - protein, 18 aa, Homo sapiens
  Heavy chain CDR3 for antibody 8750 (IGHV3-33)
ARREGIVGATTYYYGMDV

SEQ ID NO: 17501 - protein, 9 aa, Homo sapiens
  Light chain CDR3 for antibody 8751 (IGKV1-33)
QQYDNLPFT

SEQ ID NO: 17502 - protein, 10 aa, Homo sapiens
  Heavy chain CDR3 for antibody 8751 (IGHV3-23)
AKEQWLVLDY

SEQ ID NO: 17503 - protein, 9 aa, Homo sapiens
  Light chain CDR3 for antibody 8752 (IGKV2-30)
MQGTHWPLT

SEQ ID NO: 17504 - protein, 16 aa, Homo sapiens
  Heavy chain CDR3 for antibody 8752 (IGHV4-59)
ARFYFGSGSYYWYFDL

SEQ ID NO: 17505 - protein, 9 aa, Homo sapiens
  Light chain CDR3 for antibody 8753 (IGKV2-30)
MQGTHWPLT

SEQ ID NO: 17506 - protein, 15 aa, Homo sapiens
  Heavy chain CDR3 for antibody 8753 (IGHV4-39)
ARRSKYSSAWYPFDY

SEQ ID NO: 17507 - protein, 9 aa, Homo sapiens
  Light chain CDR3 for antibody 8754 (IGKV1-39)
QQSYRTPLT

SEQ ID NO: 17508 - protein, 15 aa, Homo sapiens
  Heavy chain CDR3 for antibody 8754 (IGHV3-33)
AKDRNSGYDWGGFDY

SEQ ID NO: 17509 - protein, 9 aa, Homo sapiens
  Light chain CDR3 for antibody 8755 (IGKV1-17)
LHHHSYPYT

SEQ ID NO: 17510 - protein, 18 aa, Homo sapiens
  Heavy chain CDR3 for antibody 8755 (IGHV4-59)
AREGDYVWGSYRPNWFDP

SEQ ID NO: 17511 - protein, 9 aa, Homo sapiens
  Light chain CDR3 for antibody 8756 (IGKV1-17)
LQHNSYPYT

SEQ ID NO: 17512 - protein, 14 aa, Homo sapiens
  Heavy chain CDR3 for antibody 8756 (IGHV1-18)
ARGLRYFDWLSQDY

SEQ ID NO: 17513 - protein, 10 aa, Homo sapiens
  Light chain CDR3 for antibody 8757 (IGKV3-15)
QQYNNWPPYT

SEQ ID NO: 17514 - protein, 17 aa, Homo sapiens
  Heavy chain CDR3 for antibody 8757 (IGHV3-66)
ARVQYDILTGYSPYFDN

SEQ ID NO: 17515 - protein, 9 aa, Homo sapiens
  Light chain CDR3 for antibody 8758 (IGKV3D-20)
QQHGNSPLT

SEQ ID NO: 17516 - protein, 13 aa, Homo sapiens
  Heavy chain CDR3 for antibody 8758 (IGHV4-59)
ARDAGYSSSWFDY

SEQ ID NO: 17517 - protein, 9 aa, Homo sapiens
  Light chain CDR3 for antibody 8759 (IGKV1-9)
QQLKSYLYT

SEQ ID NO: 17518 - protein, 14 aa, Homo sapiens
  Heavy chain CDR3 for antibody 8759 (IGHV4-39)
ARRGVVVPPGGMDV

SEQ ID NO: 17519 - protein, 9 aa, Homo sapiens
  Light chain CDR3 for antibody 8760 (IGKV3D-7)
QQDYNLPYT

SEQ ID NO: 17520 - protein, 9 aa, Homo sapiens
  Heavy chain CDR3 for antibody 8760 (IGHV4-39)
AKEQLLFDY

SEQ ID NO: 17521 - protein, 6 aa, Homo sapiens
  Light chain CDR3 for antibody 8761 (IGKV3-20)
QQYGST

SEQ ID NO: 17522 - protein, 17 aa, Homo sapiens
  Heavy chain CDR3 for antibody 8761 (IGHV3-33)
ARGYCSRTSCYLYYFDY

SEQ ID NO: 17523 - protein, 9 aa, Homo sapiens
  Light chain CDR3 for antibody 8762 (IGKV4-1)
QQYYSTPWT

SEQ ID NO: 17524 - protein, 13 aa, Homo sapiens
  Heavy chain CDR3 for antibody 8762 (IGHV3-33)
ARDWGYSHGYFDY

SEQ ID NO: 17525 - protein, 9 aa, Homo sapiens
  Light chain CDR3 for antibody 8763 (IGKV1D-13)
QRFNNYLYT

SEQ ID NO: 17526 - protein, 15 aa, Homo sapiens
  Heavy chain CDR3 for antibody 8763 (IGHV3-33)
ARAYDLPHYYYGMDV

SEQ ID NO: 17527 - protein, 9 aa, Homo sapiens
  Light chain CDR3 for antibody 8764 (IGKV1-6)
LQDYNYPYT

SEQ ID NO: 17528 - protein, 14 aa, Homo sapiens
  Heavy chain CDR3 for antibody 8764 (IGHV3-33)
ARDYYDSGSYYFDY

SEQ ID NO: 17529 - protein, 9 aa, Homo sapiens
  Light chain CDR3 for antibody 8765 (IGKV1-9)
QQLKSYLYT

SEQ ID NO: 17530 - protein, 12 aa, Homo sapiens
  Heavy chain CDR3 for antibody 8765 (IGHV4-39)
ARHGSGSSYFDY

SEQ ID NO: 17531 - protein, 9 aa, Homo sapiens
  Light chain CDR3 for antibody 8766 (IGKV1-17)
LQHNGYPLT

SEQ ID NO: 17532 - protein, 11 aa, Homo sapiens
  Heavy chain CDR3 for antibody 8766 (IGHV3-33)
ARDQGGSSFDY

SEQ ID NO: 17533 - protein, 9 aa, Homo sapiens
  Light chain CDR3 for antibody 8767 (IGKV3D-7)
QQDYNLPLT

SEQ ID NO: 17534 - protein, 11 aa, Homo sapiens
  Heavy chain CDR3 for antibody 8767 (IGHV1-24)
ATYFGSGSLDY

SEQ ID NO: 17535 - protein, 10 aa, Homo sapiens
  Light chain CDR3 for antibody 8768 (IGKV1-9)
QQLDSYPMYT

SEQ ID NO: 17536 - protein, 12 aa, Homo sapiens
  Heavy chain CDR3 for antibody 8768 (IGHV3-33)
ARDRAYRGSLDY

SEQ ID NO: 17537 - protein, 9 aa, Homo sapiens
  Light chain CDR3 for antibody 8769 (IGKV6-21)
HQSSSLPYT

SEQ ID NO: 17538 - protein, 13 aa, Homo sapiens
  Heavy chain CDR3 for antibody 8769 (IGHV3-33)
ARDGYSYGPYFDY

SEQ ID NO: 17539 - protein, 9 aa, Homo sapiens
  Light chain CDR3 for antibody 8770 (IGKV1-6)
LQDYNYPWT

SEQ ID NO: 17540 - protein, 16 aa, Homo sapiens
  Heavy chain CDR3 for antibody 8770 (IGHV3-48)
TRRRQWLAGFDWYFDL

SEQ ID NO: 17541 - protein, 9 aa, Homo sapiens
  Light chain CDR3 for antibody 8771 (IGKV1-6)
LQDYNYPFT

SEQ ID NO: 17542 - protein, 13 aa, Homo sapiens
  Heavy chain CDR3 for antibody 8771 (IGHV3-33)
ARAFTMVRGVIDY

SEQ ID NO: 17543 - protein, 9 aa, Homo sapiens
  Light chain CDR3 for antibody 8772 (IGKV1-9)
QQGNTYSRT

SEQ ID NO: 17544 - protein, 12 aa, Homo sapiens
  Heavy chain CDR3 for antibody 8772 (IGHV1-18)
ARILFYGDYFDY

SEQ ID NO: 17545 - protein, 9 aa, Homo sapiens
  Light chain CDR3 for antibody 8773 (IGKV2D-28)
MQALQTPPT

SEQ ID NO: 17546 - protein, 14 aa, Homo sapiens
  Heavy chain CDR3 for antibody 8773 (IGHV3-20)
ARDGGSTSFDWFDP

SEQ ID NO: 17547 - protein, 9 aa, Homo sapiens
  Light chain CDR3 for antibody 8774 (IGKV3-20)
QQYGRSPRT

SEQ ID NO: 17548 - protein, 4 aa, Homo sapiens
  Heavy chain CDR3 for antibody 8774 (IGHV1-f)
ALDV

SEQ ID NO: 17549 - protein, 9 aa, Homo sapiens
  Light chain CDR3 for antibody 8775 (IGKV1-17)
LQHSTYPWT

SEQ ID NO: 17550 - protein, 20 aa, Homo sapiens
  Heavy chain CDR3 for antibody 8775 (IGHV3-21)
ARDRGYNDILTGYSWRYFDL

SEQ ID NO: 17551 - protein, 9 aa, Homo sapiens
  Light chain CDR3 for antibody 8776 (IGKV1-39)
QQSYRTPLT

SEQ ID NO: 17552 - protein, 12 aa, Homo sapiens
  Heavy chain CDR3 for antibody 8776 (IGHV1-18)
ARRDGSGTSFDY

SEQ ID NO: 17553 - protein, 9 aa, Homo sapiens
  Light chain CDR3 for antibody 8777 (IGKV1D-13)
QQFNNYPHT

SEQ ID NO: 17554 - protein, 12 aa, Homo sapiens
  Heavy chain CDR3 for antibody 8777 (IGHV3-33)
AREGIAVAGVDP

SEQ ID NO: 17555 - protein, 9 aa, Homo sapiens
  Light chain CDR3 for antibody 8778 (IGKV5-2)
LQHDNFPYT

SEQ ID NO: 17556 - protein, 13 aa, Homo sapiens
  Heavy chain CDR3 for antibody 8778 (IGHV3-33)
ARRGSGSPDGFDI

SEQ ID NO: 17557 - protein, 9 aa, Homo sapiens
  Light chain CDR3 for antibody 8779 (IGKV1-16)
QHYNDYPFT

SEQ ID NO: 17558 - protein, 13 aa, Homo sapiens
  Heavy chain CDR3 for antibody 8779 (IGHV3-66)
ANTGDSYYYGFYV

SEQ ID NO: 17559 - protein, 10 aa, Homo sapiens
  Light chain CDR3 for antibody 8780 (IGKV3-11)
QQRSNWPALT

SEQ ID NO: 17560 - protein, 20 aa, Homo sapiens
  Heavy chain CDR3 for antibody 8780 (IGHV3-23)
AKDREMAATSHYYYYYGMDV

SEQ ID NO: 17561 - protein, 9 aa, Homo sapiens
  Light chain CDR3 for antibody 8781 (IGKV1-6)
LQDYNYPYT

SEQ ID NO: 17562 - protein, 15 aa, Homo sapiens
  Heavy chain CDR3 for antibody 8781 (IGHV3-20)
ARDSSSLDYYYGMDV

SEQ ID NO: 17563 - protein, 9 aa, Homo sapiens
  Light chain CDR3 for antibody 8782 (IGKV5-2)
LQHDNFPYT

SEQ ID NO: 17564 - protein, 12 aa, Homo sapiens
  Heavy chain CDR3 for antibody 8782 (IGHV3-33)
ARKKWEEGAFDI

SEQ ID NO: 17565 - protein, 8 aa, Homo sapiens
  Light chain CDR3 for antibody 8783 (IGKV3D-7)
QQDYNLLT

SEQ ID NO: 17566 - protein, 14 aa, Homo sapiens
  Heavy chain CDR3 for antibody 8783 (IGHV3-33)
VRDQGSMVRGGGDY

SEQ ID NO: 17567 - protein, 9 aa, Homo sapiens
  Light chain CDR3 for antibody 8784 (IGKV5-2)
LQHDNFPWT

SEQ ID NO: 17568 - protein, 18 aa, Homo sapiens
  Heavy chain CDR3 for antibody 8784 (IGHV4-59)
ARVTIVRGVTIGRGWFDP

SEQ ID NO: 17569 - protein, 8 aa, Homo sapiens
  Light chain CDR3 for antibody 8785 (IGKV3-11)
QQRSNWLT

SEQ ID NO: 17570 - protein, 14 aa, Homo sapiens
  Heavy chain CDR3 for antibody 8785 (IGHV3-33)
ARDWNDVYYYGMDV

SEQ ID NO: 17571 - protein, 9 aa, Homo sapiens
  Light chain CDR3 for antibody 8786 (IGKV3-15)
QQYNNWPIT

SEQ ID NO: 17572 - protein, 16 aa, Homo sapiens
  Heavy chain CDR3 for antibody 8786 (IGHV3-23)
AKDLRYFDWSLYAFDI

SEQ ID NO: 17573 - protein, 9 aa, Homo sapiens
  Light chain CDR3 for antibody 8787 (IGKV2D-28)
MQALQTPPT

SEQ ID NO: 17574 - protein, 14 aa, Homo sapiens
  Heavy chain CDR3 for antibody 8787 (IGHV3-33)
ARDWNDVYYYGMDV

SEQ ID NO: 17575 - protein, 8 aa, Homo sapiens
  Light chain CDR3 for antibody 8788 (IGKV3-15)
QQYNNWPT

SEQ ID NO: 17576 - protein, 20 aa, Homo sapiens
  Heavy chain CDR3 for antibody 8788 (IGHV3-20)
ARDLCSSTSCYGYYYYGMDV

SEQ ID NO: 17577 - protein, 9 aa, Homo sapiens
  Light chain CDR3 for antibody 8789 (IGKV1-9)
QQLISYPLT

SEQ ID NO: 17578 - protein, 17 aa, Homo sapiens
  Heavy chain CDR3 for antibody 8789 (IGHV4-39)
ARVLRYFDWLSHDAFDI

SEQ ID NO: 17579 - protein, 9 aa, Homo sapiens
  Light chain CDR3 for antibody 8790 (IGKV1-16)
QQYNSYPLT

SEQ ID NO: 17580 - protein, 15 aa, Homo sapiens
  Heavy chain CDR3 for antibody 8790 (IGHV3-33)
ASDRGWKAPGYGMDV

SEQ ID NO: 17581 - protein, 9 aa, Homo sapiens
  Light chain CDR3 for antibody 8791 (IGKV3D-7)
QQDYTLPLT

SEQ ID NO: 17582 - protein, 11 aa, Homo sapiens
  Heavy chain CDR3 for antibody 8791 (IGHV4-59)
AREDYGVPFDY

SEQ ID NO: 17583 - protein, 8 aa, Homo sapiens
  Light chain CDR3 for antibody 8792 (IGKV1D-13)
QQFNNYPT

SEQ ID NO: 17584 - protein, 21 aa, Homo sapiens
  Heavy chain CDR3 for antibody 8792 (IGHV3-33)
ARKRLYDILTGYYKAYYGMDV

SEQ ID NO: 17585 - protein, 9 aa, Homo sapiens
  Light chain CDR3 for antibody 8793 (IGKV1-6)
QQLNSYPLT

SEQ ID NO: 17586 - protein, 12 aa, Homo sapiens
  Heavy chain CDR3 for antibody 8793 (IGHV3-13)
ARDRGYSGYFDY

SEQ ID NO: 17587 - protein, 6 aa, Homo sapiens
  Light chain CDR3 for antibody 8794 (IGKV3-20)
QQYGST

SEQ ID NO: 17588 - protein, 24 aa, Homo sapiens
  Heavy chain CDR3 for antibody 8794 (IGHV3-20)
ARGRITMVRGVIINPLDYYNGMDV

SEQ ID NO: 17589 - protein, 9 aa, Homo sapiens
  Light chain CDR3 for antibody 8795 (IGKV1-17)
LQHNSYPRT

SEQ ID NO: 17590 - protein, 12 aa, Homo sapiens
  Heavy chain CDR3 for antibody 8795 (IGHV3-33)
ARKAYALYVLDV

SEQ ID NO: 17591 - protein, 9 aa, Homo sapiens
  Light chain CDR3 for antibody 8796 (IGKV3-11)
QQRINWPWT

SEQ ID NO: 17592 - protein, 16 aa, Homo sapiens
  Heavy chain CDR3 for antibody 8796 (IGHV4-59)
ARGRYFEWLLGDVLDI

SEQ ID NO: 17593 - protein, 10 aa, Homo sapiens
  Light chain CDR3 for antibody 8797 (IGKV1-39)
QQSYSTPMYT

SEQ ID NO: 17594 - protein, 15 aa, Homo sapiens
  Heavy chain CDR3 for antibody 8797 (IGHV3-33)
ARGYYYGSGSFPVDY

SEQ ID NO: 17595 - protein, 10 aa, Homo sapiens
  Light chain CDR3 for antibody 8798 (IGKV1-39)
QQSYSTPMYT

SEQ ID NO: 17596 - protein, 13 aa, Homo sapiens
  Heavy chain CDR3 for antibody 8798 (IGHV3-21)
ARDSTLVRGVFPY

SEQ ID NO: 17597 - protein, 8 aa, Homo sapiens
  Light chain CDR3 for antibody 8799 (IGKV1D-13)
QQFNNYPT

SEQ ID NO: 17598 - protein, 20 aa, Homo sapiens
  Heavy chain CDR3 for antibody 8799 (IGHV3-23)
AKDREMAATSHYYYYYGMDV

SEQ ID NO: 17599 - protein, 9 aa, Homo sapiens
  Light chain CDR3 for antibody 8800 (IGKV1-17)
LQHNGYPLT

SEQ ID NO: 17600 - protein, 16 aa, Homo sapiens
  Heavy chain CDR3 for antibody 8800 (IGHV3-33)
ARGYDMLTGDYHGMDV

SEQ ID NO: 17601 - protein, 9 aa, Homo sapiens
  Light chain CDR3 for antibody 8801 (IGKV2D-28)
MQALQTPPT

SEQ ID NO: 17602 - protein, 13 aa, Homo sapiens
  Heavy chain CDR3 for antibody 8801 (IGHV3-33)
ARRYRSGWYPFDY

SEQ ID NO: 17603 - protein, 9 aa, Homo sapiens
  Light chain CDR3 for antibody 8802 (IGKV5-2)
LQHDNFPYT

SEQ ID NO: 17604 - protein, 12 aa, Homo sapiens
  Heavy chain CDR3 for antibody 8802 (IGHV3-33)
ARDGPVAGLFDY

SEQ ID NO: 17605 - protein, 9 aa, Homo sapiens
  Light chain CDR3 for antibody 8803 (IGKV1-39)
QQSYRTPLT

SEQ ID NO: 17606 - protein, 17 aa, Homo sapiens
  Heavy chain CDR3 for antibody 8803 (IGHV3-33)
AREDYDILTGYPFYFDY

SEQ ID NO: 17607 - protein, 8 aa, Homo sapiens
  Light chain CDR3 for antibody 8804 (IGKV3D-7)
QQDYNLLT

SEQ ID NO: 17608 - protein, 12 aa, Homo sapiens
  Heavy chain CDR3 for antibody 8804 (IGHV3-23)
AKESLYTPTDDY

SEQ ID NO: 17609 - protein, 8 aa, Homo sapiens
  Light chain CDR3 for antibody 8805 (IGKV1-5)
QQYNSYWT

SEQ ID NO: 17610 - protein, 14 aa, Homo sapiens
  Heavy chain CDR3 for antibody 8805 (IGHV3-33)
VRDAMGATTAWFDP

SEQ ID NO: 17611 - protein, 10 aa, Homo sapiens
  Light chain CDR3 for antibody 8806 (IGKV3-15)
QQYNNWPPYT

SEQ ID NO: 17612 - protein, 23 aa, Homo sapiens
  Heavy chain CDR3 for antibody 8806 (IGHV4-59)
ARERTYSDILPGYYEDYYYGMDV

SEQ ID NO: 17613 - protein, 9 aa, Homo sapiens
  Light chain CDR3 for antibody 8807 (IGKV3D-7)
QQDYNLPHT

SEQ ID NO: 17614 - protein, 12 aa, Homo sapiens
  Heavy chain CDR3 for antibody 8807 (IGHV3-33)
ARAGMGAPYFDY

SEQ ID NO: 17615 - protein, 10 aa, Homo sapiens
  Light chain CDR3 for antibody 8808 (IGKV1-9)
QQLDSYPMYT

SEQ ID NO: 17616 - protein, 14 aa, Homo sapiens
  Heavy chain CDR3 for antibody 8808 (IGHV3-13)
VRDQGSMVRGGGDY

SEQ ID NO: 17617 - protein, 8 aa, Homo sapiens
  Light chain CDR3 for antibody 8809 (IGKV1D-13)
QQFNNYPT

SEQ ID NO: 17618 - protein, 18 aa, Homo sapiens
  Heavy chain CDR3 for antibody 8809 (IGHV1-46)
ARDLTGRTENYYYYGMDV

SEQ ID NO: 17619 - protein, 8 aa, Homo sapiens
  Light chain CDR3 for antibody 8810 (IGKV1-5)
QQYNSYWT

SEQ ID NO: 17620 - protein, 17 aa, Homo sapiens
  Heavy chain CDR3 for antibody 8810 (IGHV3-33)
ARGGGYENDHYYYGMDV

SEQ ID NO: 17621 - protein, 9 aa, Homo sapiens
  Light chain CDR3 for antibody 8811 (IGKV1-5)
QQGNTYSRT

SEQ ID NO: 17622 - protein, 14 aa, Homo sapiens
  Heavy chain CDR3 for antibody 8811 (IGHV3-74)
ARAISGSSYWYFDL

SEQ ID NO: 17623 - protein, 9 aa, Homo sapiens
  Light chain CDR3 for antibody 8812 (IGKV3-20)
QQYGSSIFT

SEQ ID NO: 17624 - protein, 11 aa, Homo sapiens
  Heavy chain CDR3 for antibody 8812 (IGHV3-23)
ARDRSSGPFDY

SEQ ID NO: 17625 - protein, 9 aa, Homo sapiens
  Light chain CDR3 for antibody 8813 (IGKV1-39)
QQSYRTPLT

SEQ ID NO: 17626 - protein, 13 aa, Homo sapiens
  Heavy chain CDR3 for antibody 8813 (IGHV4-34)
ASNFYYYYYGMDV

SEQ ID NO: 17627 - protein, 8 aa, Homo sapiens
  Light chain CDR3 for antibody 8814 (IGKV3-20)
QQYGRSFT

SEQ ID NO: 17628 - protein, 14 aa, Homo sapiens
  Heavy chain CDR3 for antibody 8814 (IGHV1-46)
ARRGIVGALDAFDI

SEQ ID NO: 17629 - protein, 8 aa, Homo sapiens
  Light chain CDR3 for antibody 8815 (IGKV1-5)
QQYNSYWT

SEQ ID NO: 17630 - protein, 13 aa, Homo sapiens
  Heavy chain CDR3 for antibody 8815 (IGHV1-18)
ARSITMVRGVIGY

SEQ ID NO: 17631 - protein, 9 aa, Homo sapiens
  Light chain CDR3 for antibody 8816 (IGKV3-11)
QQRSNWMYT

SEQ ID NO: 17632 - protein, 13 aa, Homo sapiens
  Heavy chain CDR3 for antibody 8816 (IGHV3-23)
AKDRGGSYSYFDF

SEQ ID NO: 17633 - protein, 9 aa, Homo sapiens
  Light chain CDR3 for antibody 8817 (IGKV2-30)
MQGTHWPLT

SEQ ID NO: 17634 - protein, 14 aa, Homo sapiens
  Heavy chain CDR3 for antibody 8817 (IGHV3-33)
ARDGYDFLTGPFDY

SEQ ID NO: 17635 - protein, 9 aa, Homo sapiens
  Light chain CDR3 for antibody 8818 (IGKV3-15)
QQYNNWPLT

SEQ ID NO: 17636 - protein, 18 aa, Homo sapiens
  Heavy chain CDR3 for antibody 8818 (IGHV3-33)
ARERGYYGSDIYPAAFDI

SEQ ID NO: 17637 - protein, 9 aa, Homo sapiens
  Light chain CDR3 for antibody 8819 (IGKV1-27)
QKYNSAPYT

SEQ ID NO: 17638 - protein, 17 aa, Homo sapiens
  Heavy chain CDR3 for antibody 8819 (IGHV3-15)
TTERYPRRYYYYFGMDV

SEQ ID NO: 17639 - protein, 9 aa, Homo sapiens
  Light chain CDR3 for antibody 8820 (IGKV1-9)
QQLNSYPWT

SEQ ID NO: 17640 - protein, 10 aa, Homo sapiens
  Heavy chain CDR3 for antibody 8820 (IGHV3-33)
ARDGSGSYPI

SEQ ID NO: 17641 - protein, 11 aa, Homo sapiens
  Light chain CDR3 for antibody 8821 (IGKV3-11)
QQRSNWPPMYT

SEQ ID NO: 17642 - protein, 11 aa, Homo sapiens
  Heavy chain CDR3 for antibody 8821 (IGHV4-59)
AREMGHDTFDI

SEQ ID NO: 17643 - protein, 9 aa, Homo sapiens
  Light chain CDR3 for antibody 8822 (IGKV2D-28)
MQALQTPPT

SEQ ID NO: 17644 - protein, 11 aa, Homo sapiens
  Heavy chain CDR3 for antibody 8822 (IGHV3-33)
ARARYTTGLDY

SEQ ID NO: 17645 - protein, 10 aa, Homo sapiens
  Light chain CDR3 for antibody 8823 (IGKV3-11)
QQRSNWPTWT

SEQ ID NO: 17646 - protein, 17 aa, Homo sapiens
  Heavy chain CDR3 for antibody 8823 (IGHV3-33)
ARQGVLLWFGELYYFDY

SEQ ID NO: 17647 - protein, 8 aa, Homo sapiens
  Light chain CDR3 for antibody 8824 (IGKV1D-13)
QQFNNYPT

SEQ ID NO: 17648 - protein, 12 aa, Homo sapiens
  Heavy chain CDR3 for antibody 8824 (IGHV3-33)
AREGDILTGYSL

SEQ ID NO: 17649 - protein, 9 aa, Homo sapiens
  Light chain CDR3 for antibody 8825 (IGKV1-6)
LQDFNYPRT

SEQ ID NO: 17650 - protein, 18 aa, Homo sapiens
  Heavy chain CDR3 for antibody 8825 (IGHV1-46)
ARDLTGRTENYYFYGMDV

SEQ ID NO: 17651 - protein, 9 aa, Homo sapiens
  Light chain CDR3 for antibody 8826 (IGKV1-37)
QRTSNAPYT

SEQ ID NO: 17652 - protein, 13 aa, Homo sapiens
  Heavy chain CDR3 for antibody 8826 (IGHV3-33)
ARDQRYSSGWYDY

SEQ ID NO: 17653 - protein, 9 aa, Homo sapiens
  Light chain CDR3 for antibody 8827 (IGKV2D-24)
TQATQFPHT

SEQ ID NO: 17654 - protein, 14 aa, Homo sapiens
  Heavy chain CDR3 for antibody 8827 (IGHV1-18)
ARRGIVGALDAFDI

SEQ ID NO: 17655 - protein, 9 aa, Homo sapiens
  Light chain CDR3 for antibody 8828 (IGKV1-6)
LQDYNFPFT

SEQ ID NO: 17656 - protein, 20 aa, Homo sapiens
  Heavy chain CDR3 for antibody 8828 (IGHV3-33)
ARDRCSSTSCYGYYYYGMDV

SEQ ID NO: 17657 - protein, 10 aa, Homo sapiens
  Light chain CDR3 for antibody 8829 (IGKV1-27)
QKYNSAPMYT

SEQ ID NO: 17658 - protein, 16 aa, Homo sapiens
  Heavy chain CDR3 for antibody 8829 (IGHV4-59)
ARGRYFEWLLGDVFDI

SEQ ID NO: 17659 - protein, 9 aa, Homo sapiens
  Light chain CDR3 for antibody 8830 (IGKV1-6)
LQDFHYPWT

SEQ ID NO: 17660 - protein, 15 aa, Homo sapiens
  Heavy chain CDR3 for antibody 8830 (IGHV3-33)
ARRGYNDYDPYGMDV

SEQ ID NO: 17661 - protein, 9 aa, Homo sapiens
  Light chain CDR3 for antibody 8831 (IGKV5-2)
LQHDNFPWT

SEQ ID NO: 17662 - protein, 18 aa, Homo sapiens
  Heavy chain CDR3 for antibody 8831 (IGHV1-18)
ARDPTFYYVSGSYYKFDY

SEQ ID NO: 17663 - protein, 9 aa, Homo sapiens
  Light chain CDR3 for antibody 8832 (IGKV1D-16)
LQHNSYPRT

SEQ ID NO: 17664 - protein, 13 aa, Homo sapiens
  Heavy chain CDR3 for antibody 8832 (IGHV3-11)
AREGIAVAGDFDF

SEQ ID NO: 17665 - protein, 9 aa, Homo sapiens
  Light chain CDR3 for antibody 8833 (IGKV1-17)
LQHNSYPPT

SEQ ID NO: 17666 - protein, 9 aa, Homo sapiens
  Heavy chain CDR3 for antibody 8833 (IGHV3-20)
ATWGSAFDV

SEQ ID NO: 17667 - protein, 9 aa, Homo sapiens
  Light chain CDR3 for antibody 8834 (IGKV3-15)
QQYNNWPRT

SEQ ID NO: 17668 - protein, 13 aa, Homo sapiens
  Heavy chain CDR3 for antibody 8834 (IGHV3-23)
AKDRGYSSTSTAY

SEQ ID NO: 17669 - protein, 9 aa, Homo sapiens
  Light chain CDR3 for antibody 8835 (IGKV1-9)
QQLISYPLT

SEQ ID NO: 17670 - protein, 12 aa, Homo sapiens
  Heavy chain CDR3 for antibody 8835 (IGHV3-23)
AKEYDILTGYFH

SEQ ID NO: 17671 - protein, 8 aa, Homo sapiens
  Light chain CDR3 for antibody 8836 (IGKV3-20)
QQYGSSLT

SEQ ID NO: 17672 - protein, 8 aa, Homo sapiens
  Heavy chain CDR3 for antibody 8836 (IGHV3-33)
EKSAGEDV

SEQ ID NO: 17673 - protein, 9 aa, Homo sapiens
  Light chain CDR3 for antibody 8837 (IGKV3-20)
QQYGTSPFP

SEQ ID NO: 17674 - protein, 12 aa, Homo sapiens
  Heavy chain CDR3 for antibody 8837 (IGHV1-18)
ARILFYGDYFDY

SEQ ID NO: 17675 - protein, 8 aa, Homo sapiens
  Light chain CDR3 for antibody 8838 (IGKV3-11)
QQRRNWLT

SEQ ID NO: 17676 - protein, 12 aa, Homo sapiens
  Heavy chain CDR3 for antibody 8838 (IGHV1-8)
ARHGSGSSYFDY

SEQ ID NO: 17677 - protein, 10 aa, Homo sapiens
  Light chain CDR3 for antibody 8839 (IGKV3-11)
QQRSNWPMYT

SEQ ID NO: 17678 - protein, 9 aa, Homo sapiens
  Heavy chain CDR3 for antibody 8839 (IGHV3-30)
ARPNWGFDY

SEQ ID NO: 17679 - protein, 9 aa, Homo sapiens
  Light chain CDR3 for antibody 8840 (IGKV1D-13)
QRFNNYLYT

SEQ ID NO: 17680 - protein, 11 aa, Homo sapiens
  Heavy chain CDR3 for antibody 8840 (IGHV3-33)
ARARYTTGLDY

SEQ ID NO: 17681 - protein, 9 aa, Homo sapiens
  Light chain CDR3 for antibody 8841 (IGKV1-17)
LQHNSFPLT

SEQ ID NO: 17682 - protein, 17 aa, Homo sapiens
  Heavy chain CDR3 for antibody 8841 (IGHV1-18)
ARERYYGSGNYKYNMDV

SEQ ID NO: 17683 - protein, 9 aa, Homo sapiens
  Light chain CDR3 for antibody 8842 (IGKV2D-28)
MQALQTPPT

SEQ ID NO: 17684 - protein, 10 aa, Homo sapiens
  Heavy chain CDR3 for antibody 8842 (IGHV3-23)
AKEQWLVLDY

SEQ ID NO: 17685 - protein, 9 aa, Homo sapiens
  Light chain CDR3 for antibody 8843 (IGKV1-6)
LQDYKSPFT

SEQ ID NO: 17686 - protein, 14 aa, Homo sapiens
  Heavy chain CDR3 for antibody 8843 (IGHV3-33)
ARTTAAAGPRDFQH

SEQ ID NO: 17687 - protein, 8 aa, Homo sapiens
  Light chain CDR3 for antibody 8844 (IGKV6-21)
HQSSSLPT

SEQ ID NO: 17688 - protein, 10 aa, Homo sapiens
  Heavy chain CDR3 for antibody 8844 (IGHV3-30)
ARDGLESFDY

SEQ ID NO: 17689 - protein, 9 aa, Homo sapiens
  Light chain CDR3 for antibody 8845 (IGKV1-39)
QQSYSTPYT

SEQ ID NO: 17690 - protein, 12 aa, Homo sapiens
  Heavy chain CDR3 for antibody 8845 (IGHV3-33)
ARVDTAAPYFDY

SEQ ID NO: 17691 - protein, 9 aa, Homo sapiens
  Light chain CDR3 for antibody 8846 (IGKV1-6)
QQEYNYPLT

SEQ ID NO: 17692 - protein, 17 aa, Homo sapiens
  Heavy chain CDR3 for antibody 8846 (IGHV3-33)
ARGEQWLGYYYYYGMDV

SEQ ID NO: 17693 - protein, 9 aa, Homo sapiens
  Light chain CDR3 for antibody 8847 (IGKV5-2)
LQHDNFPYT

SEQ ID NO: 17694 - protein, 13 aa, Homo sapiens
  Heavy chain CDR3 for antibody 8847 (IGHV3-33)
ARDYGDYLNWFDP

SEQ ID NO: 17695 - protein, 9 aa, Homo sapiens
  Light chain CDR3 for antibody 8848 (IGKV3-11)
QQRSNWPPT

SEQ ID NO: 17696 - protein, 16 aa, Homo sapiens
  Heavy chain CDR3 for antibody 8848 (IGHV3-33)
AKDAFYYGSGSHLFDY

SEQ ID NO: 17697 - protein, 9 aa, Homo sapiens
  Light chain CDR3 for antibody 8849 (IGKV1-9)
QQLHIYPWT

SEQ ID NO: 17698 - protein, 13 aa, Homo sapiens
  Heavy chain CDR3 for antibody 8849 (IGHV3-53)
ARSGSYWGYYFDY

SEQ ID NO: 17699 - protein, 9 aa, Homo sapiens
  Light chain CDR3 for antibody 8850 (IGKV1-39)
QQSYSTPLT

SEQ ID NO: 17700 - protein, 10 aa, Homo sapiens
  Heavy chain CDR3 for antibody 8850 (IGHV3-21)
AREGLRYFDH

SEQ ID NO: 17701 - protein, 9 aa, Homo sapiens
  Light chain CDR3 for antibody 8851 (IGKV3-20)
QQYGSSIFT

SEQ ID NO: 17702 - protein, 13 aa, Homo sapiens
  Heavy chain CDR3 for antibody 8851 (IGHV3-53)
ARSGSYWGYYFDY

SEQ ID NO: 17703 - protein, 9 aa, Homo sapiens
  Light chain CDR3 for antibody 8852 (IGKV1D-16)
QQYDSYPWT

SEQ ID NO: 17704 - protein, 12 aa, Homo sapiens
  Heavy chain CDR3 for antibody 8852 (IGHV1-46)
ARGLTGDHASDI

SEQ ID NO: 17705 - protein, 10 aa, Homo sapiens
  Light chain CDR3 for antibody 8853 (IGKV3-15)
QQYNNWPPYT

SEQ ID NO: 17706 - protein, 14 aa, Homo sapiens
  Heavy chain CDR3 for antibody 8853 (IGHV3-33)
ARQYSYGYPYYFDY

SEQ ID NO: 17707 - protein, 9 aa, Homo sapiens
  Light chain CDR3 for antibody 8854 (IGKV6-21)
HQSTSLPFT

SEQ ID NO: 17708 - protein, 13 aa, Homo sapiens
  Heavy chain CDR3 for antibody 8854 (IGHV3-33)
ARAFTMVRGVIDY

SEQ ID NO: 17709 - protein, 9 aa, Homo sapiens
  Light chain CDR3 for antibody 8855 (IGKV3-11)
QQRSNWPPT

SEQ ID NO: 17710 - protein, 19 aa, Homo sapiens
  Heavy chain CDR3 for antibody 8855 (IGHV3-64)
ARRFSGYSGYDHYYYGMDV

SEQ ID NO: 17711 - protein, 9 aa, Homo sapiens
  Light chain CDR3 for antibody 8856 (IGKV1-39)
QQSYRTPLT

SEQ ID NO: 17712 - protein, 17 aa, Homo sapiens
  Heavy chain CDR3 for antibody 8856 (IGHV3-33)
ARENDILTGSYYYGMDV

SEQ ID NO: 17713 - protein, 9 aa, Homo sapiens
  Light chain CDR3 for antibody 8857 (IGKV6-21)
HQSSSLPYT

SEQ ID NO: 17714 - protein, 9 aa, Homo sapiens
  Heavy chain CDR3 for antibody 8857 (IGHV3-33)
AREYKGFDY

SEQ ID NO: 17715 - protein, 9 aa, Homo sapiens
  Light chain CDR3 for antibody 8858 (IGKV1-27)
QKYNSAPYT

SEQ ID NO: 17716 - protein, 12 aa, Homo sapiens
  Heavy chain CDR3 for antibody 8858 (IGHV3-23)
AKEGIVGVPFDY

SEQ ID NO: 17717 - protein, 9 aa, Homo sapiens
  Light chain CDR3 for antibody 8859 (IGKV3D-7)
QQDYSFPLT

SEQ ID NO: 17718 - protein, 9 aa, Homo sapiens
  Heavy chain CDR3 for antibody 8859 (IGHV3-30)
ARDYFHYDY

SEQ ID NO: 17719 - protein, 9 aa, Homo sapiens
  Light chain CDR3 for antibody 8860 (IGKV1-27)
QKYNSAPYT

SEQ ID NO: 17720 - protein, 17 aa, Homo sapiens
  Heavy chain CDR3 for antibody 8860 (IGHV3-23)
AKGNYGSGSYYNGDFQH

SEQ ID NO: 17721 - protein, 9 aa, Homo sapiens
  Light chain CDR3 for antibody 8861 (IGKV1-6)
LQDYKSPFT

SEQ ID NO: 17722 - protein, 12 aa, Homo sapiens
  Heavy chain CDR3 for antibody 8861 (IGHV1-18)
ARILFYGDYFDY

SEQ ID NO: 17723 - protein, 8 aa, Homo sapiens
  Light chain CDR3 for antibody 8862 (IGKV3-15)
QQYNNWPT

SEQ ID NO: 17724 - protein, 18 aa, Homo sapiens
  Heavy chain CDR3 for antibody 8862 (IGHV3-33)
ARDEYYGSGIYYNYGMDV

SEQ ID NO: 17725 - protein, 9 aa, Homo sapiens
  Light chain CDR3 for antibody 8863 (IGKV1-9)
QQVKSYPYT

SEQ ID NO: 17726 - protein, 17 aa, Homo sapiens
  Heavy chain CDR3 for antibody 8863 (IGHV1-46)
AREDYVWGSYRSNWFDP

SEQ ID NO: 17727 - protein, 9 aa, Homo sapiens
  Light chain CDR3 for antibody 8864 (IGKV1D-16)
QQYHSYPYT

SEQ ID NO: 17728 - protein, 18 aa, Homo sapiens
  Heavy chain CDR3 for antibody 8864 (IGHV3-23)
AKDGRSGSYDYYYYGMDV

SEQ ID NO: 17729 - protein, 9 aa, Homo sapiens
  Light chain CDR3 for antibody 8865 (IGKV1D-13)
QQFNNYPHT

SEQ ID NO: 17730 - protein, 12 aa, Homo sapiens
  Heavy chain CDR3 for antibody 8865 (IGHV3-23)
AKGAVVTAIFDY

SEQ ID NO: 17731 - protein, 10 aa, Homo sapiens
  Light chain CDR3 for antibody 8866 (IGKV1-16)
QQLNSFLMYT

SEQ ID NO: 17732 - protein, 13 aa, Homo sapiens
  Heavy chain CDR3 for antibody 8866 (IGHV4-34)
ASNFYYYYYGMDV

SEQ ID NO: 17733 - protein, 9 aa, Homo sapiens
  Light chain CDR3 for antibody 8867 (IGKV6-21)
HQSSSLPLT

SEQ ID NO: 17734 - protein, 15 aa, Homo sapiens
  Heavy chain CDR3 for antibody 8867 (IGHV4-39)
ARRSKYSSAWYPFDY

SEQ ID NO: 17735 - protein, 9 aa, Homo sapiens
  Light chain CDR3 for antibody 8868 (IGKV6-21)
HQSSSLPLT

SEQ ID NO: 17736 - protein, 18 aa, Homo sapiens
  Heavy chain CDR3 for antibody 8868 (IGHV3-33)
AREGSYYGSGSFPNWFDP

SEQ ID NO: 17737 - protein, 9 aa, Homo sapiens
  Light chain CDR3 for antibody 8869 (IGKV1-9)
QQLNSYPWT

SEQ ID NO: 17738 - protein, 18 aa, Homo sapiens
  Heavy chain CDR3 for antibody 8869 (IGHV1-46)
ARDGDYVWGSYRYDWFDP

SEQ ID NO: 17739 - protein, 9 aa, Homo sapiens
  Light chain CDR3 for antibody 8870 (IGKV1-6)
LQDYNYPYT

SEQ ID NO: 17740 - protein, 12 aa, Homo sapiens
  Heavy chain CDR3 for antibody 8870 (IGHV3-33)
ARKQWLVQAFDI

SEQ ID NO: 17741 - protein, 10 aa, Homo sapiens
  Light chain CDR3 for antibody 8871 (IGKV3-11)
QQRSNWPIFT

SEQ ID NO: 17742 - protein, 14 aa, Homo sapiens
  Heavy chain CDR3 for antibody 8871 (IGHV3-33)
AREDYYGPLNWFDP

SEQ ID NO: 17743 - protein, 9 aa, Homo sapiens
  Light chain CDR3 for antibody 8872 (IGKV1-6)
QQEYNYPLT

SEQ ID NO: 17744 - protein, 16 aa, Homo sapiens
  Heavy chain CDR3 for antibody 8872 (IGHV3-33)
ARGDDILTHQYYGVDV

SEQ ID NO: 17745 - protein, 9 aa, Homo sapiens
  Light chain CDR3 for antibody 8873 (IGKV5-2)
LQHDNFPWT

SEQ ID NO: 17746 - protein, 12 aa, Homo sapiens
  Heavy chain CDR3 for antibody 8873 (IGHV3-33)
ARGGIAVDVCDI

SEQ ID NO: 17747 - protein, 10 aa, Homo sapiens
  Light chain CDR3 for antibody 8874 (IGKV3-11)
QQRSNWLMYT

SEQ ID NO: 17748 - protein, 9 aa, Homo sapiens
  Heavy chain CDR3 for antibody 8874 (IGHV1-18)
ARGKDWFDP

SEQ ID NO: 17749 - protein, 9 aa, Homo sapiens
  Light chain CDR3 for antibody 8875 (IGKV1-6)
LQDYNYPWT

SEQ ID NO: 17750 - protein, 13 aa, Homo sapiens
  Heavy chain CDR3 for antibody 8875 (IGHV3-11)
ARDGGYRGYVLDN

SEQ ID NO: 17751 - protein, 8 aa, Homo sapiens
  Light chain CDR3 for antibody 8876 (IGKV1D-13)
QQFNNYPT

SEQ ID NO: 17752 - protein, 12 aa, Homo sapiens
  Heavy chain CDR3 for antibody 8876 (IGHV3-33)
ARGGIAVDVCDI

SEQ ID NO: 17753 - protein, 8 aa, Homo sapiens
  Light chain CDR3 for antibody 8877 (IGKV6-21)
HQSSSLPT

SEQ ID NO: 17754 - protein, 13 aa, Homo sapiens
  Heavy chain CDR3 for antibody 8877 (IGHV4-59)
ARTMVRGVAPFDY

SEQ ID NO: 17755 - protein, 9 aa, Homo sapiens
  Light chain CDR3 for antibody 8878 (IGKV1-9)
QQLNRYPYT

SEQ ID NO: 17756 - protein, 16 aa, Homo sapiens
  Heavy chain CDR3 for antibody 8878 (IGHV3-33)
AKEGEVLRYFDWLFNY

SEQ ID NO: 17757 - protein, 9 aa, Homo sapiens
  Light chain CDR3 for antibody 8879 (IGKV1-12)
QQANSFPFT

SEQ ID NO: 17758 - protein, 11 aa, Homo sapiens
  Heavy chain CDR3 for antibody 8879 (IGHV3-33)
ARDRSSGPFDY

SEQ ID NO: 17759 - protein, 9 aa, Homo sapiens
  Light chain CDR3 for antibody 8880 (IGKV1-6)
LQDYKSPFT

SEQ ID NO: 17760 - protein, 16 aa, Homo sapiens
  Heavy chain CDR3 for antibody 8880 (IGHV1-24)
ATDWNDRGYYYYGMDV

SEQ ID NO: 17761 - protein, 9 aa, Homo sapiens
  Light chain CDR3 for antibody 8881 (IGKV1-9)
QQLKSYLYT

SEQ ID NO: 17762 - protein, 17 aa, Homo sapiens
  Heavy chain CDR3 for antibody 8881 (IGHV1-24)
ATHYGSGSHYKGYGMDV

SEQ ID NO: 17763 - protein, 8 aa, Homo sapiens
  Light chain CDR3 for antibody 8882 (IGKV1-5)
QQYNSYYT

SEQ ID NO: 17764 - protein, 12 aa, Homo sapiens
  Heavy chain CDR3 for antibody 8882 (IGHV3-h)
AREDYYYYGMDV

SEQ ID NO: 17765 - protein, 9 aa, Homo sapiens
  Light chain CDR3 for antibody 8883 (IGKV1D-16)
QQYDSYPWT

SEQ ID NO: 17766 - protein, 17 aa, Homo sapiens
  Heavy chain CDR3 for antibody 8883 (IGHV3-33)
ARDSYDILTGYYKPFDY

SEQ ID NO: 17767 - protein, 9 aa, Homo sapiens
  Light chain CDR3 for antibody 8884 (IGKV3-11)
QQRSNWPYT

SEQ ID NO: 17768 - protein, 14 aa, Homo sapiens
  Heavy chain CDR3 for antibody 8884 (IGHV1-24)
ATWLPLYYYYGMDV

SEQ ID NO: 17769 - protein, 9 aa, Homo sapiens
  Light chain CDR3 for antibody 8885 (IGKV1-9)
QQLISYPLT

SEQ ID NO: 17770 - protein, 16 aa, Homo sapiens
  Heavy chain CDR3 for antibody 8885 (IGHV1-46)
ATEDSSSTYYYYGLDV

SEQ ID NO: 17771 - protein, 9 aa, Homo sapiens
  Light chain CDR3 for antibody 8886 (IGKV3D-7)
QQDYNLPYT

SEQ ID NO: 17772 - protein, 14 aa, Homo sapiens
  Heavy chain CDR3 for antibody 8886 (IGHV3-33)
ARDGAAAALDAFDI

SEQ ID NO: 17773 - protein, 9 aa, Homo sapiens
  Light chain CDR3 for antibody 8887 (IGKV2-30)
MQGTHWPLT

SEQ ID NO: 17774 - protein, 12 aa, Homo sapiens
  Heavy chain CDR3 for antibody 8887 (IGHV3-23)
AKEGLGSDYESY

SEQ ID NO: 17775 - protein, 8 aa, Homo sapiens
  Light chain CDR3 for antibody 8888 (IGKV1-5)
QQYNSYYT

SEQ ID NO: 17776 - protein, 19 aa, Homo sapiens
  Heavy chain CDR3 for antibody 8888 (IGHV5-51)
ARHGEKGKRITMVRGSLDV

SEQ ID NO: 17777 - protein, 8 aa, Homo sapiens
  Light chain CDR3 for antibody 8889 (IGKV1-5)
QQYNSYYT

SEQ ID NO: 17778 - protein, 18 aa, Homo sapiens
  Heavy chain CDR3 for antibody 8889 (IGHV3-23)
AKEGNYYGSGSYWGYFDP

SEQ ID NO: 17779 - protein, 9 aa, Homo sapiens
  Light chain CDR3 for antibody 8890 (IGKV3D-7)
QQDYNLPLT

SEQ ID NO: 17780 - protein, 11 aa, Homo sapiens
  Heavy chain CDR3 for antibody 8890 (IGHV3-33)
AREGAVARFDY

SEQ ID NO: 17781 - protein, 9 aa, Homo sapiens
  Light chain CDR3 for antibody 8891 (IGKV3D-7)
QQDYEFPIT

SEQ ID NO: 17782 - protein, 13 aa, Homo sapiens
  Heavy chain CDR3 for antibody 8891 (IGHV4-39)
ARHEVMVRGVFDY

SEQ ID NO: 17783 - protein, 8 aa, Homo sapiens
  Light chain CDR3 for antibody 8892 (IGKV1D-13)
QQFNNYLT

SEQ ID NO: 17784 - protein, 8 aa, Homo sapiens
  Heavy chain CDR3 for antibody 8892 (IGHV3-23)
AETFLFDY

SEQ ID NO: 17785 - protein, 8 aa, Homo sapiens
  Light chain CDR3 for antibody 8893 (IGKV1D-13)
QQFNNYPT

SEQ ID NO: 17786 - protein, 13 aa, Homo sapiens
  Heavy chain CDR3 for antibody 8893 (IGHV3-33)
ARGDNWNDGGFDY

SEQ ID NO: 17787 - protein, 10 aa, Homo sapiens
  Light chain CDR3 for antibody 8894 (IGKV1-17)
LQHNSYPMYT

SEQ ID NO: 17788 - protein, 19 aa, Homo sapiens
  Heavy chain CDR3 for antibody 8894 (IGHV3-23)
AKDGRSGSYDYYYYYGMDV

SEQ ID NO: 17789 - protein, 9 aa, Homo sapiens
  Light chain CDR3 for antibody 8895 (IGKV1-6)
QQYNSYPYT

SEQ ID NO: 17790 - protein, 14 aa, Homo sapiens
  Heavy chain CDR3 for antibody 8895 (IGHV3-20)
ARDRGSSGHDGFDI

SEQ ID NO: 17791 - protein, 9 aa, Homo sapiens
  Light chain CDR3 for antibody 8896 (IGKV2-30)
MQGTHWPLT

SEQ ID NO: 17792 - protein, 12 aa, Homo sapiens
  Heavy chain CDR3 for antibody 8896 (IGHV4-59)
ARDSGSYYYFDY

SEQ ID NO: 17793 - protein, 9 aa, Homo sapiens
  Light chain CDR3 for antibody 8897 (IGKV1D-16)
QQYNSYPFT

SEQ ID NO: 17794 - protein, 16 aa, Homo sapiens
  Heavy chain CDR3 for antibody 8897 (IGHV4-59)
ARDTPYYSGSGRPFDS

SEQ ID NO: 17795 - protein, 8 aa, Homo sapiens
  Light chain CDR3 for antibody 8898 (IGKV1-6)
QQFNNYYT

SEQ ID NO: 17796 - protein, 13 aa, Homo sapiens
  Heavy chain CDR3 for antibody 8898 (IGHV1-46)
ARRQVGYYYGMDV

SEQ ID NO: 17797 - protein, 9 aa, Homo sapiens
  Light chain CDR3 for antibody 8899 (IGKV1-33)
QQYDNLPFT

SEQ ID NO: 17798 - protein, 16 aa, Homo sapiens
  Heavy chain CDR3 for antibody 8899 (IGHV3-30)
ARDIAVAGHVYYGMDV

SEQ ID NO: 17799 - protein, 8 aa, Homo sapiens
  Light chain CDR3 for antibody 8900 (IGKV3-20)
QQYGSSLT

SEQ ID NO: 17800 - protein, 13 aa, Homo sapiens
  Heavy chain CDR3 for antibody 8900 (IGHV4-39)
ARRDGSYYGYFGY

SEQ ID NO: 17801 - protein, 9 aa, Homo sapiens
  Light chain CDR3 for antibody 8901 (IGKV3-20)
QQYGSLPLT

SEQ ID NO: 17802 - protein, 15 aa, Homo sapiens
  Heavy chain CDR3 for antibody 8901 (IGHV2-5)
AHRPNYYDKAGAFDI

SEQ ID NO: 17803 - protein, 8 aa, Homo sapiens
  Light chain CDR3 for antibody 8902 (IGKV6-21)
HQSSSLPT

SEQ ID NO: 17804 - protein, 11 aa, Homo sapiens
  Heavy chain CDR3 for antibody 8902 (IGHV4-59)
AREMGHDTFDI

SEQ ID NO: 17805 - protein, 9 aa, Homo sapiens
  Light chain CDR3 for antibody 8903 (IGKV3-15)
QQYNNWPYT

SEQ ID NO: 17806 - protein, 9 aa, Homo sapiens
  Heavy chain CDR3 for antibody 8903 (IGHV3-23)
AKEQQLFDY

SEQ ID NO: 17807 - protein, 9 aa, Homo sapiens
  Light chain CDR3 for antibody 8904 (IGKV3-20)
QQYGSSPLT

SEQ ID NO: 17808 - protein, 12 aa, Homo sapiens
  Heavy chain CDR3 for antibody 8904 (IGHV3-11)
VRVLLWFGESDY

SEQ ID NO: 17809 - protein, 9 aa, Homo sapiens
  Light chain CDR3 for antibody 8905 (IGKV1D-16)
QQYNSYPYT

SEQ ID NO: 17810 - protein, 14 aa, Homo sapiens
  Heavy chain CDR3 for antibody 8905 (IGHV3-33)
VRDARGATTAWFDP

SEQ ID NO: 17811 - protein, 7 aa, Homo sapiens
  Light chain CDR3 for antibody 8906 (IGKV1-17)
LQHNSYP

SEQ ID NO: 17812 - protein, 9 aa, Homo sapiens
  Heavy chain CDR3 for antibody 8906 (IGHV1-18)
ARGKDWFDP

SEQ ID NO: 17813 - protein, 10 aa, Homo sapiens
  Light chain CDR3 for antibody 8907 (IGKV3-15)
QQYNNWPPYT

SEQ ID NO: 17814 - protein, 15 aa, Homo sapiens
  Heavy chain CDR3 for antibody 8907 (IGHV3-33)
ARAYDLPHYYYGMDV

SEQ ID NO: 17815 - protein, 9 aa, Homo sapiens
  Light chain CDR3 for antibody 8908 (IGKV1-33)
QQYDNLPFT

SEQ ID NO: 17816 - protein, 18 aa, Homo sapiens
  Heavy chain CDR3 for antibody 8908 (IGHV1-18)
ARDRYYYDSGSYYYGMDV

SEQ ID NO: 17817 - protein, 8 aa, Homo sapiens
  Light chain CDR3 for antibody 8909 (IGKV3D-7)
QQDYNLLT

SEQ ID NO: 17818 - protein, 9 aa, Homo sapiens
  Heavy chain CDR3 for antibody 8909 (IGHV4-59)
ARGGVHFDS

SEQ ID NO: 17819 - protein, 9 aa, Homo sapiens
  Light chain CDR3 for antibody 8910 (IGKV1-27)
QKYNSAPYT

SEQ ID NO: 17820 - protein, 16 aa, Homo sapiens
  Heavy chain CDR3 for antibody 8910 (IGHV3-23)
AKEGEVLRYFDWLFNY

SEQ ID NO: 17821 - protein, 9 aa, Homo sapiens
  Light chain CDR3 for antibody 8911 (IGKV1-6)
LQVYSYPWT

SEQ ID NO: 17822 - protein, 14 aa, Homo sapiens
  Heavy chain CDR3 for antibody 8911 (IGHV3-23)
AKSRIVGALYYFDY

SEQ ID NO: 17823 - protein, 9 aa, Homo sapiens
  Light chain CDR3 for antibody 8912 (IGKV1-33)
QQYDNLPFT

SEQ ID NO: 17824 - protein, 21 aa, Homo sapiens
  Heavy chain CDR3 for antibody 8912 (IGHV3-30)
ARDRHHDILTGYYKAYYGMDV

SEQ ID NO: 17825 - protein, 8 aa, Homo sapiens
  Light chain CDR3 for antibody 8913 (IGKV1D-13)
QQFNNYPT

SEQ ID NO: 17826 - protein, 13 aa, Homo sapiens
  Heavy chain CDR3 for antibody 8913 (IGHV3-33)
ARRYRSGWYPFDY

SEQ ID NO: 17827 - protein, 9 aa, Homo sapiens
  Light chain CDR3 for antibody 8914 (IGKV1-9)
QQLKSYLYT

SEQ ID NO: 17828 - protein, 13 aa, Homo sapiens
  Heavy chain CDR3 for antibody 8914 (IGHV1-24)
ATGYSINWYEFDY

SEQ ID NO: 17829 - protein, 9 aa, Homo sapiens
  Light chain CDR3 for antibody 8915 (IGKV3-15)
QQYNNWPRT

SEQ ID NO: 17830 - protein, 15 aa, Homo sapiens
  Heavy chain CDR3 for antibody 8915 (IGHV3-33)
ARDRVVRGVMGYFDY

SEQ ID NO: 17831 - protein, 10 aa, Homo sapiens
  Light chain CDR3 for antibody 8916 (IGKV3-15)
QQYNNWPPYT

SEQ ID NO: 17832 - protein, 9 aa, Homo sapiens
  Heavy chain CDR3 for antibody 8916 (IGHV4-59)
AREGGSGSL

SEQ ID NO: 17833 - protein, 10 aa, Homo sapiens
  Light chain CDR3 for antibody 8917 (IGKV1-27)
QKYNSAPMYT

SEQ ID NO: 17834 - protein, 14 aa, Homo sapiens
  Heavy chain CDR3 for antibody 8917 (IGHV4-39)
ARQDYDILTGLFDY

SEQ ID NO: 17835 - protein, 9 aa, Homo sapiens
  Light chain CDR3 for antibody 8918 (IGKV6-21)
HQSYSLPHT

SEQ ID NO: 17836 - protein, 14 aa, Homo sapiens
  Heavy chain CDR3 for antibody 8918 (IGHV3-33)
ARDKSYPLSYGMDV

SEQ ID NO: 17837 - protein, 9 aa, Homo sapiens
  Light chain CDR3 for antibody 8919 (IGKV3D-7)
QQDYNFPLT

SEQ ID NO: 17838 - protein, 15 aa, Homo sapiens
  Heavy chain CDR3 for antibody 8919 (IGHV3-33)
ARDSRPEIIGPPFDY

SEQ ID NO: 17839 - protein, 10 aa, Homo sapiens
  Light chain CDR3 for antibody 8920 (IGKV1-17)
LQHNSYPMYT

SEQ ID NO: 17840 - protein, 22 aa, Homo sapiens
  Heavy chain CDR3 for antibody 8920 (IGHV4-59)
AREINYGSGSYYNEDYYYGMDV

SEQ ID NO: 17841 - protein, 9 aa, Homo sapiens
  Light chain CDR3 for antibody 8921 (IGKV6-21)
HQSSSLPYT

SEQ ID NO: 17842 - protein, 19 aa, Homo sapiens
  Heavy chain CDR3 for antibody 8921 (IGHV3-33)
ARGRGSYYYGPGSHNGMDV

SEQ ID NO: 17843 - protein, 9 aa, Homo sapiens
  Light chain CDR3 for antibody 8922 (IGKV1D-16)
QQYNSFPLT

SEQ ID NO: 17844 - protein, 9 aa, Homo sapiens
  Heavy chain CDR3 for antibody 8922 (IGHV4-59)
ARDLYYFDY

SEQ ID NO: 17845 - protein, 9 aa, Homo sapiens
  Light chain CDR3 for antibody 8923 (IGKV1D-16)
QQYSSYPYT

SEQ ID NO: 17846 - protein, 15 aa, Homo sapiens
  Heavy chain CDR3 for antibody 8923 (IGHV3-33)
ARDHLTGYYYYGMDV

SEQ ID NO: 17847 - protein, 9 aa, Homo sapiens
  Light chain CDR3 for antibody 8924 (IGKV1-17)
LRHNCYPYT

SEQ ID NO: 17848 - protein, 16 aa, Homo sapiens
  Heavy chain CDR3 for antibody 8924 (IGHV3-23)
AKEGMVLRYFDWLWDY

SEQ ID NO: 17849 - protein, 9 aa, Homo sapiens
  Light chain CDR3 for antibody 8925 (IGKV1-27)
QKYNSAPYT

SEQ ID NO: 17850 - protein, 14 aa, Homo sapiens
  Heavy chain CDR3 for antibody 8925 (IGHV3-66)
ARDLDIMATSPFAY

SEQ ID NO: 17851 - protein, 10 aa, Homo sapiens
  Light chain CDR3 for antibody 8926 (IGKV1-17)
LQHNSYPMYT

SEQ ID NO: 17852 - protein, 20 aa, Homo sapiens
  Heavy chain CDR3 for antibody 8926 (IGHV3-33)
ARDNDSSGYYDYYYYYGMDV

SEQ ID NO: 17853 - protein, 9 aa, Homo sapiens
  Light chain CDR3 for antibody 8927 (IGKV1-17)
LQQNSYPWT

SEQ ID NO: 17854 - protein, 17 aa, Homo sapiens
  Heavy chain CDR3 for antibody 8927 (IGHV1-18)
ARERYYGSGNYKYNMDV

SEQ ID NO: 17855 - protein, 9 aa, Homo sapiens
  Light chain CDR3 for antibody 8928 (IGKV3-11)
QQRSNWMYT

SEQ ID NO: 17856 - protein, 18 aa, Homo sapiens
  Heavy chain CDR3 for antibody 8928 (IGHV3-33)
ARKGGYYSGSGSYRHFDF

SEQ ID NO: 17857 - protein, 8 aa, Homo sapiens
  Light chain CDR3 for antibody 8929 (IGKV3D-7)
QQDYNLLT

SEQ ID NO: 17858 - protein, 8 aa, Homo sapiens
  Heavy chain CDR3 for antibody 8929 (IGHV3-33)
ARDRGFDY

SEQ ID NO: 17859 - protein, 9 aa, Homo sapiens
  Light chain CDR3 for antibody 8930 (IGKV1D-13)
QQFNNYPYT

SEQ ID NO: 17860 - protein, 14 aa, Homo sapiens
  Heavy chain CDR3 for antibody 8930 (IGHV3-33)
ARDAMGTSTAWFDP

SEQ ID NO: 17861 - protein, 10 aa, Homo sapiens
  Light chain CDR3 for antibody 8931 (IGKV1-39)
QQSYSTPMYT

SEQ ID NO: 17862 - protein, 14 aa, Homo sapiens
  Heavy chain CDR3 for antibody 8931 (IGHV3-33)
ARRGYSGYDWYFDY

SEQ ID NO: 17863 - protein, 10 aa, Homo sapiens
  Light chain CDR3 for antibody 8932 (IGKV1-39)
QQSYSTPMYT

SEQ ID NO: 17864 - protein, 9 aa, Homo sapiens
  Heavy chain CDR3 for antibody 8932 (IGHV4-59)
AREGGSGSL

SEQ ID NO: 17865 - protein, 9 aa, Homo sapiens
  Light chain CDR3 for antibody 8933 (IGKV1-6)
LQDYKSPFT

SEQ ID NO: 17866 - protein, 17 aa, Homo sapiens
  Heavy chain CDR3 for antibody 8933 (IGHV4-59)
ARRITMVREIIITAFDY

SEQ ID NO: 17867 - protein, 9 aa, Homo sapiens
  Light chain CDR3 for antibody 8934 (IGKV3-20)
QQLISYPLT

SEQ ID NO: 17868 - protein, 21 aa, Homo sapiens
  Heavy chain CDR3 for antibody 8934 (IGHV1-18)
ASGVLIWFGELLSEDYYDMDV

SEQ ID NO: 17869 - protein, 9 aa, Homo sapiens
  Light chain CDR3 for antibody 8935 (IGKV1-6)
LQDYNYPRT

SEQ ID NO: 17870 - protein, 9 aa, Homo sapiens
  Heavy chain CDR3 for antibody 8935 (IGHV3-30)
ARPNWGFDY

SEQ ID NO: 17871 - protein, 9 aa, Homo sapiens
  Light chain CDR3 for antibody 8936 (IGKV4-1)
QQYYSTPPT

SEQ ID NO: 17872 - protein, 18 aa, Homo sapiens
  Heavy chain CDR3 for antibody 8936 (IGHV3-23)
AKPDYYGSGSYYNVPFDY

SEQ ID NO: 17873 - protein, 9 aa, Homo sapiens
  Light chain CDR3 for antibody 8937 (IGKV5-2)
LQHDNFPYT

SEQ ID NO: 17874 - protein, 13 aa, Homo sapiens
  Heavy chain CDR3 for antibody 8937 (IGHV3-21)
ATGAWASSWWGDY

SEQ ID NO: 17875 - protein, 9 aa, Homo sapiens
  Light chain CDR3 for antibody 8938 (IGKV3-20)
QQYGSSPLT

SEQ ID NO: 17876 - protein, 18 aa, Homo sapiens
  Heavy chain CDR3 for antibody 8938 (IGHV3-33)
ARRTAAGTGDYYYYGMDV

SEQ ID NO: 17877 - protein, 9 aa, Homo sapiens
  Light chain CDR3 for antibody 8939 (IGKV2-30)
MQGTHWPLT

SEQ ID NO: 17878 - protein, 16 aa, Homo sapiens
  Heavy chain CDR3 for antibody 8939 (IGHV3-23)
ARNDILTASGYYGMDV

SEQ ID NO: 17879 - protein, 9 aa, Homo sapiens
  Light chain CDR3 for antibody 8940 (IGKV2-30)
MQGTHWPLT

SEQ ID NO: 17880 - protein, 13 aa, Homo sapiens
  Heavy chain CDR3 for antibody 8940 (IGHV3-33)
AREYCSGGSCYDY

SEQ ID NO: 17881 - protein, 9 aa, Homo sapiens
  Light chain CDR3 for antibody 8941 (IGKV1-9)
QQLNSYPYT

SEQ ID NO: 17882 - protein, 14 aa, Homo sapiens
  Heavy chain CDR3 for antibody 8941 (IGHV3-33)
ARDTVSAGFNGMDV

SEQ ID NO: 17883 - protein, 8 aa, Homo sapiens
  Light chain CDR3 for antibody 8942 (IGKV3-11)
LQRGNWPT

SEQ ID NO: 17884 - protein, 12 aa, Homo sapiens
  Heavy chain CDR3 for antibody 8942 (IGHV3-33)
ARESGGSYSFDY

SEQ ID NO: 17885 - protein, 8 aa, Homo sapiens
  Light chain CDR3 for antibody 8943 (IGKV6-21)
HQSSSLPT

SEQ ID NO: 17886 - protein, 8 aa, Homo sapiens
  Heavy chain CDR3 for antibody 8943 (IGHV3-33)
ARDRGFDY

SEQ ID NO: 17887 - protein, 9 aa, Homo sapiens
  Light chain CDR3 for antibody 8944 (IGKV3-20)
QQYGSSPLT

SEQ ID NO: 17888 - protein, 14 aa, Homo sapiens
  Heavy chain CDR3 for antibody 8944 (IGHV1-18)
ARERGVRGVMYFDY

SEQ ID NO: 17889 - protein, 9 aa, Homo sapiens
  Light chain CDR3 for antibody 8945 (IGKV2-30)
MQGTHWPLT

SEQ ID NO: 17890 - protein, 13 aa, Homo sapiens
  Heavy chain CDR3 for antibody 8945 (IGHV4-39)
ARHPPSRDYGMDV

SEQ ID NO: 17891 - protein, 8 aa, Homo sapiens
  Light chain CDR3 for antibody 8946 (IGKV2D-28)
MQALQTPT

SEQ ID NO: 17892 - protein, 11 aa, Homo sapiens
  Heavy chain CDR3 for antibody 8946 (IGHV4-59)
AREMGHDTFDI

SEQ ID NO: 17893 - protein, 10 aa, Homo sapiens
  Light chain CDR3 for antibody 8947 (IGKV3-11)
QQRSNWLMYT

SEQ ID NO: 17894 - protein, 13 aa, Homo sapiens
  Heavy chain CDR3 for antibody 8947 (IGHV3-33)
ARDYCGGDCYLDY

SEQ ID NO: 17895 - protein, 9 aa, Homo sapiens
  Light chain CDR3 for antibody 8948 (IGKV3D-7)
QQDYEFPLT

SEQ ID NO: 17896 - protein, 15 aa, Homo sapiens
  Heavy chain CDR3 for antibody 8948 (IGHV4-61)
ARHSKYSSGWYPFDY

SEQ ID NO: 17897 - protein, 9 aa, Homo sapiens
  Light chain CDR3 for antibody 8949 (IGKV1-39)
QQSYRTPLT

SEQ ID NO: 17898 - protein, 20 aa, Homo sapiens
  Heavy chain CDR3 for antibody 8949 (IGHV1-f)
ATHYDILTGSPYYYYCALDV

SEQ ID NO: 17899 - protein, 9 aa, Homo sapiens
  Light chain CDR3 for antibody 8950 (IGKV3D-7)
QQDYNLPYT

SEQ ID NO: 17900 - protein, 15 aa, Homo sapiens
  Heavy chain CDR3 for antibody 8950 (IGHV3-33)
AKDRNSGYDWGGFDY

SEQ ID NO: 17901 - protein, 6 aa, Homo sapiens
  Light chain CDR3 for antibody 8951 (IGKV3-20)
QQYGST

SEQ ID NO: 17902 - protein, 13 aa, Homo sapiens
  Heavy chain CDR3 for antibody 8951 (IGHV4-39)
ARHVLLWFGEFDP

SEQ ID NO: 17903 - protein, 9 aa, Homo sapiens
  Light chain CDR3 for antibody 8952 (IGKV1-6)
LQDYNYPRT

SEQ ID NO: 17904 - protein, 9 aa, Homo sapiens
  Heavy chain CDR3 for antibody 8952 (IGHV4-34)
ARDLYYFDY

SEQ ID NO: 17905 - protein, 9 aa, Homo sapiens
  Light chain CDR3 for antibody 8953 (IGKV3D-20)
QQYGNSPRT

SEQ ID NO: 17906 - protein, 18 aa, Homo sapiens
  Heavy chain CDR3 for antibody 8953 (IGHV3-33)
ARERGYYGSDIYPAAFDI

SEQ ID NO: 17907 - protein, 9 aa, Homo sapiens
  Light chain CDR3 for antibody 8954 (IGKV5-2)
LQHDNFPWT

SEQ ID NO: 17908 - protein, 17 aa, Homo sapiens
  Heavy chain CDR3 for antibody 8954 (IGHV6-1)
ARDQYSYGPYYYYGMDV

SEQ ID NO: 17909 - protein, 8 aa, Homo sapiens
  Light chain CDR3 for antibody 8955 (IGKV3D-7)
QQDYNLLT

SEQ ID NO: 17910 - protein, 13 aa, Homo sapiens
  Heavy chain CDR3 for antibody 8955 (IGHV3-33)
ARDYTMVRGVMNY

SEQ ID NO: 17911 - protein, 9 aa, Homo sapiens
  Light chain CDR3 for antibody 8956 (IGKV3-15)
QQYNNWPRT

SEQ ID NO: 17912 - protein, 10 aa, Homo sapiens
  Heavy chain CDR3 for antibody 8956 (IGHV3-33)
ARENSSPLDY

SEQ ID NO: 17913 - protein, 9 aa, Homo sapiens
  Light chain CDR3 for antibody 8957 (IGKV1-37)
QRTYNAPFT

SEQ ID NO: 17914 - protein, 11 aa, Homo sapiens
  Heavy chain CDR3 for antibody 8957 (IGHV4-59)
AREMGHDTFDI

SEQ ID NO: 17915 - protein, 10 aa, Homo sapiens
  Light chain CDR3 for antibody 8958 (IGKV1-39)
QQSYSTPMYT

SEQ ID NO: 17916 - protein, 13 aa, Homo sapiens
  Heavy chain CDR3 for antibody 8958 (IGHV3-33)
AREYCSGGSCYDY

SEQ ID NO: 17917 - protein, 8 aa, Homo sapiens
  Light chain CDR3 for antibody 8959 (IGKV3D-7)
QQDYNLVT

SEQ ID NO: 17918 - protein, 11 aa, Homo sapiens
  Heavy chain CDR3 for antibody 8959 (IGHV4-59)
ARDGVRGVFDI

SEQ ID NO: 17919 - protein, 9 aa, Homo sapiens
  Light chain CDR3 for antibody 8960 (IGKV3-20)
QQYGSSPRT

SEQ ID NO: 17920 - protein, 16 aa, Homo sapiens
  Heavy chain CDR3 for antibody 8960 (IGHV1-24)
ATEDSSSYYYYDGMDV

SEQ ID NO: 17921 - protein, 9 aa, Homo sapiens
  Light chain CDR3 for antibody 8961 (IGKV3D-20)
QQHGNSPLT

SEQ ID NO: 17922 - protein, 13 aa, Homo sapiens
  Heavy chain CDR3 for antibody 8961 (IGHV4-34)
ASNFYYYYYGMDV

SEQ ID NO: 17923 - protein, 9 aa, Homo sapiens
  Light chain CDR3 for antibody 8962 (IGKV1-9)
QQLKSYLYT

SEQ ID NO: 17924 - protein, 18 aa, Homo sapiens
  Heavy chain CDR3 for antibody 8962 (IGHV1-18)
ARDPNYYGSGSYYNYFDY

SEQ ID NO: 17925 - protein, 10 aa, Homo sapiens
  Light chain CDR3 for antibody 8963 (IGKV1-39)
QQSYSTPMYT

SEQ ID NO: 17926 - protein, 16 aa, Homo sapiens
  Heavy chain CDR3 for antibody 8963 (IGHV3-64)
ARGRYFDWLLGDWFDP

SEQ ID NO: 17927 - protein, 9 aa, Homo sapiens
  Light chain CDR3 for antibody 8964 (IGKV1-6)
LQDFHYPWT

SEQ ID NO: 17928 - protein, 15 aa, Homo sapiens
  Heavy chain CDR3 for antibody 8964 (IGHV3-33)
ARDHLTGYYYYGMDV

SEQ ID NO: 17929 - protein, 9 aa, Homo sapiens
  Light chain CDR3 for antibody 8965 (IGKV1-37)
QRTSNAPYT

SEQ ID NO: 17930 - protein, 12 aa, Homo sapiens
  Heavy chain CDR3 for antibody 8965 (IGHV3-33)
ARDLVGATPFDY

SEQ ID NO: 17931 - protein, 9 aa, Homo sapiens
  Light chain CDR3 for antibody 8966 (IGKV1-27)
QKYNSAPYT

SEQ ID NO: 17932 - protein, 13 aa, Homo sapiens
  Heavy chain CDR3 for antibody 8966 (IGHV3-23)
AKDRGGSYSYFDF

SEQ ID NO: 17933 - protein, 9 aa, Homo sapiens
  Light chain CDR3 for antibody 8967 (IGKV3-11)
QQRSNWPLT

SEQ ID NO: 17934 - protein, 15 aa, Homo sapiens
  Heavy chain CDR3 for antibody 8967 (IGHV3-33)
AREGLRYFHYYGMDV

SEQ ID NO: 17935 - protein, 9 aa, Homo sapiens
  Light chain CDR3 for antibody 8968 (IGKV1-6)
LQDYKSPFT

SEQ ID NO: 17936 - protein, 15 aa, Homo sapiens
  Heavy chain CDR3 for antibody 8968 (IGHV3-33)
ARDHLTGYYYYGMDV

SEQ ID NO: 17937 - protein, 9 aa, Homo sapiens
  Light chain CDR3 for antibody 8969 (IGKV1-6)
LQDYNYPYT

SEQ ID NO: 17938 - protein, 17 aa, Homo sapiens
  Heavy chain CDR3 for antibody 8969 (IGHV6-1)
ARDQYSYGPYYYYGMDV

SEQ ID NO: 17939 - protein, 9 aa, Homo sapiens
  Light chain CDR3 for antibody 8970 (IGKV1D-16)
QQYDSYPWT

SEQ ID NO: 17940 - protein, 26 aa, Homo sapiens
  Heavy chain CDR3 for antibody 8970 (IGHV4-39)
ARQGLLWFGDLKAYDSSGYYYGYFHH

SEQ ID NO: 17941 - protein, 9 aa, Homo sapiens
  Light chain CDR3 for antibody 8971 (IGKV3-20)
QQYGSSPYT

SEQ ID NO: 17942 - protein, 14 aa, Homo sapiens
  Heavy chain CDR3 for antibody 8971 (IGHV3-20)
ARDEGSTWSDIFDI

SEQ ID NO: 17943 - protein, 9 aa, Homo sapiens
  Light chain CDR3 for antibody 8972 (IGKV3-11)
QQRINWPWT

SEQ ID NO: 17944 - protein, 21 aa, Homo sapiens
  Heavy chain CDR3 for antibody 8972 (IGHV4-59)
AAGVLLWFGEPNYYYYYGMDV

SEQ ID NO: 17945 - protein, 8 aa, Homo sapiens
  Light chain CDR3 for antibody 8973 (IGKV3-20)
QQYGSSFT

SEQ ID NO: 17946 - protein, 12 aa, Homo sapiens
  Heavy chain CDR3 for antibody 8973 (IGHV4-59)
ARVDSSGWFFDY

SEQ ID NO: 17947 - protein, 9 aa, Homo sapiens
  Light chain CDR3 for antibody 8974 (IGKV1-6)
LQDYNYPRT

SEQ ID NO: 17948 - protein, 15 aa, Homo sapiens
  Heavy chain CDR3 for antibody 8974 (IGHV4-59)
ARDIGYYGSGSPLDY

SEQ ID NO: 17949 - protein, 9 aa, Homo sapiens
  Light chain CDR3 for antibody 8975 (IGKV1-27)
QKYNSAPYT

SEQ ID NO: 17950 - protein, 13 aa, Homo sapiens
  Heavy chain CDR3 for antibody 8975 (IGHV4-59)
ANRDYYGYYGMDV

SEQ ID NO: 17951 - protein, 9 aa, Homo sapiens
  Light chain CDR3 for antibody 8976 (IGKV1-17)
QQLNSYPWT

SEQ ID NO: 17952 - protein, 13 aa, Homo sapiens
  Heavy chain CDR3 for antibody 8976 (IGHV3-66)
ARAFFMVRGVIDF

SEQ ID NO: 17953 - protein, 8 aa, Homo sapiens
  Light chain CDR3 for antibody 8977 (IGKV6-21)
HQSSSLPT

SEQ ID NO: 17954 - protein, 10 aa, Homo sapiens
  Heavy chain CDR3 for antibody 8977 (IGHV3-33)
ARDVVVYFDY

SEQ ID NO: 17955 - protein, 9 aa, Homo sapiens
  Light chain CDR3 for antibody 8978 (IGKV1-39)
QQGFSTPWT

SEQ ID NO: 17956 - protein, 14 aa, Homo sapiens
  Heavy chain CDR3 for antibody 8978 (IGHV4-39)
ARDSGYDYYYGMDV

SEQ ID NO: 17957 - protein, 9 aa, Homo sapiens
  Light chain CDR3 for antibody 8979 (IGKV1-39)
QQSYRTPLT

SEQ ID NO: 17958 - protein, 10 aa, Homo sapiens
  Heavy chain CDR3 for antibody 8979 (IGHV3-33)
ARDLGWSFDH

SEQ ID NO: 17959 - protein, 9 aa, Homo sapiens
  Light chain CDR3 for antibody 8980 (IGKV3D-7)
QQYNNWPYT

SEQ ID NO: 17960 - protein, 14 aa, Homo sapiens
  Heavy chain CDR3 for antibody 8980 (IGHV3-33)
ARDRRDFYYYGMDV

SEQ ID NO: 17961 - protein, 9 aa, Homo sapiens
  Light chain CDR3 for antibody 8981 (IGKV2D-28)
MQALQTPPT

SEQ ID NO: 17962 - protein, 14 aa, Homo sapiens
  Heavy chain CDR3 for antibody 8981 (IGHV3-33)
ARDNILTVYYLFDY

SEQ ID NO: 17963 - protein, 9 aa, Homo sapiens
  Light chain CDR3 for antibody 8982 (IGKV1-33)
QQYDNLPFT

SEQ ID NO: 17964 - protein, 19 aa, Homo sapiens
  Heavy chain CDR3 for antibody 8982 (IGHV3-64)
ARDRYYDILTGYSSYYFDY

SEQ ID NO: 17965 - protein, 9 aa, Homo sapiens
  Light chain CDR3 for antibody 8983 (IGKV2-30)
MQGTHWPLT

SEQ ID NO: 17966 - protein, 12 aa, Homo sapiens
  Heavy chain CDR3 for antibody 8983 (IGHV3-33)
ARDYISTYGMDV

SEQ ID NO: 17967 - protein, 10 aa, Homo sapiens
  Light chain CDR3 for antibody 8984 (IGKV3-11)
QQRSNWPIFT

SEQ ID NO: 17968 - protein, 15 aa, Homo sapiens
  Heavy chain CDR3 for antibody 8984 (IGHV3-11)
AREYSSGWYGDAFDI

SEQ ID NO: 17969 - protein, 10 aa, Homo sapiens
  Light chain CDR3 for antibody 8985 (IGKV1-39)
QQSYSTPMYT

SEQ ID NO: 17970 - protein, 18 aa, Homo sapiens
  Heavy chain CDR3 for antibody 8985 (IGHV3-33)
ARDRGDILTGYYKGWFDP

SEQ ID NO: 17971 - protein, 9 aa, Homo sapiens
  Light chain CDR3 for antibody 8986 (IGKV4-1)
QQYYTTPYT

SEQ ID NO: 17972 - protein, 20 aa, Homo sapiens
  Heavy chain CDR3 for antibody 8986 (IGHV1-f)
ATHYDILTGSPYYYYCALDV

SEQ ID NO: 17973 - protein, 8 aa, Homo sapiens
  Light chain CDR3 for antibody 8987 (IGKV1D-13)
QQFNNYLT

SEQ ID NO: 17974 - protein, 18 aa, Homo sapiens
  Heavy chain CDR3 for antibody 8987 (IGHV3-33)
ARREGITLIFYYYYGMDV

SEQ ID NO: 17975 - protein, 9 aa, Homo sapiens
  Light chain CDR3 for antibody 8988 (IGKV1-27)
QKYNSAPYT

SEQ ID NO: 17976 - protein, 17 aa, Homo sapiens
  Heavy chain CDR3 for antibody 8988 (IGHV3-23)
AKDYDILTGYSHNWFDP

SEQ ID NO: 17977 - protein, 10 aa, Homo sapiens
  Light chain CDR3 for antibody 8989 (IGKV1-9)
QQLDSYPMYT

SEQ ID NO: 17978 - protein, 17 aa, Homo sapiens
  Heavy chain CDR3 for antibody 8989 (IGHV3-23)
AKDGSFYSSGWYDAFDI

SEQ ID NO: 17979 - protein, 8 aa, Homo sapiens
  Light chain CDR3 for antibody 8990 (IGKV6-21)
HQSSSLPT

SEQ ID NO: 17980 - protein, 18 aa, Homo sapiens
  Heavy chain CDR3 for antibody 8990 (IGHV3-23)
ARYHLYFGSGFGSDGMDV

SEQ ID NO: 17981 - protein, 9 aa, Homo sapiens
  Light chain CDR3 for antibody 8991 (IGKV1D-16)
QQYNSYPLT

SEQ ID NO: 17982 - protein, 12 aa, Homo sapiens
  Heavy chain CDR3 for antibody 8991 (IGHV3-30)
ARGAMVRGVFDP

SEQ ID NO: 17983 - protein, 9 aa, Homo sapiens
  Light chain CDR3 for antibody 8992 (IGKV3-15)
QQYNNWPYT

SEQ ID NO: 17984 - protein, 14 aa, Homo sapiens
  Heavy chain CDR3 for antibody 8992 (IGHV3-23)
AKDRYRGYEGLFDY

SEQ ID NO: 17985 - protein, 9 aa, Homo sapiens
  Light chain CDR3 for antibody 8993 (IGKV1-17)
QHYGSSPYT

SEQ ID NO: 17986 - protein, 18 aa, Homo sapiens
  Heavy chain CDR3 for antibody 8993 (IGHV3-23)
AKEGNYYGSGSYWGYFDP

SEQ ID NO: 17987 - protein, 9 aa, Homo sapiens
  Light chain CDR3 for antibody 8994 (IGKV3-11)
QQRSNWPYT

SEQ ID NO: 17988 - protein, 16 aa, Homo sapiens
  Heavy chain CDR3 for antibody 8994 (IGHV1-18)
ARYFDWLLRDYYGMDV

SEQ ID NO: 17989 - protein, 9 aa, Homo sapiens
  Light chain CDR3 for antibody 8995 (IGKV3-11)
QQYINWPLT

SEQ ID NO: 17990 - protein, 15 aa, Homo sapiens
  Heavy chain CDR3 for antibody 8995 (IGHV3-23)
AKAGGRYFDWFPFDY

SEQ ID NO: 17991 - protein, 9 aa, Homo sapiens
  Light chain CDR3 for antibody 8996 (IGKV4-1)
QQYYTTPYT

SEQ ID NO: 17992 - protein, 13 aa, Homo sapiens
  Heavy chain CDR3 for antibody 8996 (IGHV3-33)
ARAFIMVRGVIDY

SEQ ID NO: 17993 - protein, 9 aa, Homo sapiens
  Light chain CDR3 for antibody 8997 (IGKV2-30)
MQGTHWPLT

SEQ ID NO: 17994 - protein, 18 aa, Homo sapiens
  Heavy chain CDR3 for antibody 8997 (IGHV3-33)
ARDQGIVVLPGAPWYFDP

SEQ ID NO: 17995 - protein, 9 aa, Homo sapiens
  Light chain CDR3 for antibody 8998 (IGKV3-20)
QQYGSSPWT

SEQ ID NO: 17996 - protein, 14 aa, Homo sapiens
  Heavy chain CDR3 for antibody 8998 (IGHV3-33)
ARKPDYYGSGYFDY

SEQ ID NO: 17997 - protein, 9 aa, Homo sapiens
  Light chain CDR3 for antibody 8999 (IGKV1-6)
LQDYNYPYT

SEQ ID NO: 17998 - protein, 9 aa, Homo sapiens
  Heavy chain CDR3 for antibody 8999 (IGHV3-23)
AIGRYYFDY

SEQ ID NO: 17999 - protein, 9 aa, Homo sapiens
  Light chain CDR3 for antibody 9000 (IGKV1-39)
QQSYRTPLT

SEQ ID NO: 18000 - protein, 12 aa, Homo sapiens
  Heavy chain CDR3 for antibody 9000 (IGHV3-11)
ARVLLWFGETDY

SEQ ID NO: 18001 - protein, 10 aa, Homo sapiens
  Light chain CDR3 for antibody 9001 (IGKV3-15)
QQYNNWPPYT

SEQ ID NO: 18002 - protein, 13 aa, Homo sapiens
  Heavy chain CDR3 for antibody 9001 (IGHV3-23)
ARAFFMVRGVIDF

SEQ ID NO: 18003 - protein, 8 aa, Homo sapiens
  Light chain CDR3 for antibody 9002 (IGKV6-21)
HQSSSLPT

SEQ ID NO: 18004 - protein, 12 aa, Homo sapiens
  Heavy chain CDR3 for antibody 9002 (IGHV3-33)
AREGTRWVYFDY

SEQ ID NO: 18005 - protein, 10 aa, Homo sapiens
  Light chain CDR3 for antibody 9003 (IGKV1-27)
QKYNSAPMYT

SEQ ID NO: 18006 - protein, 14 aa, Homo sapiens
  Heavy chain CDR3 for antibody 9003 (IGHV4-39)
ARDSGYDYYYGMDV

SEQ ID NO: 18007 - protein, 8 aa, Homo sapiens
  Light chain CDR3 for antibody 9004 (IGKV2D-28)
MQALQTPT

SEQ ID NO: 18008 - protein, 9 aa, Homo sapiens
  Heavy chain CDR3 for antibody 9004 (IGHV3-33)
ARATVGVDY

SEQ ID NO: 18009 - protein, 9 aa, Homo sapiens
  Light chain CDR3 for antibody 9005 (IGKV1-9)
QQLISYPRT

SEQ ID NO: 18010 - protein, 14 aa, Homo sapiens
  Heavy chain CDR3 for antibody 9005 (IGHV3-33)
AKSRIVGALYYFDY

SEQ ID NO: 18011 - protein, 9 aa, Homo sapiens
  Light chain CDR3 for antibody 9006 (IGKV2D-28)
MQALQTPPT

SEQ ID NO: 18012 - protein, 14 aa, Homo sapiens
  Heavy chain CDR3 for antibody 9006 (IGHV3-33)
VRDQGSMVRGGGDY

SEQ ID NO: 18013 - protein, 10 aa, Homo sapiens
  Light chain CDR3 for antibody 9007 (IGKV3-15)
QQYNNWPPYT

SEQ ID NO: 18014 - protein, 16 aa, Homo sapiens
  Heavy chain CDR3 for antibody 9007 (IGHV4-59)
ARGRYFDWLLGDVFDI

SEQ ID NO: 18015 - protein, 9 aa, Homo sapiens
  Light chain CDR3 for antibody 9008 (IGKV1-6)
QQLNGYPFT

SEQ ID NO: 18016 - protein, 17 aa, Homo sapiens
  Heavy chain CDR3 for antibody 9008 (IGHV1-18)
ARDEGYDILTGYPHFDY

SEQ ID NO: 18017 - protein, 8 aa, Homo sapiens
  Light chain CDR3 for antibody 9009 (IGKV1D-13)
QQFNNYPT

SEQ ID NO: 18018 - protein, 14 aa, Homo sapiens
  Heavy chain CDR3 for antibody 9009 (IGHV3-33)
ARGGYSGYRYYFDY

SEQ ID NO: 18019 - protein, 10 aa, Homo sapiens
  Light chain CDR3 for antibody 9010 (IGKV1-17)
LQHNSYPMYT

SEQ ID NO: 18020 - protein, 12 aa, Homo sapiens
  Heavy chain CDR3 for antibody 9010 (IGHV3-33)
VRKWFGELYFDY

SEQ ID NO: 18021 - protein, 11 aa, Homo sapiens
  Light chain CDR3 for antibody 9011 (IGKV3-11)
QQRSNWPPTWT

SEQ ID NO: 18022 - protein, 15 aa, Homo sapiens
  Heavy chain CDR3 for antibody 9011 (IGHV4-39)
ARRSKYSSAWYPFDY

SEQ ID NO: 18023 - protein, 8 aa, Homo sapiens
  Light chain CDR3 for antibody 9012 (IGKV1-5)
QQYHSYYT

SEQ ID NO: 18024 - protein, 10 aa, Homo sapiens
  Heavy chain CDR3 for antibody 9012 (IGHV1-18)
AREQRLGFDY

SEQ ID NO: 18025 - protein, 10 aa, Homo sapiens
  Light chain CDR3 for antibody 9013 (IGKV3-15)
QQYNNWPPYT

SEQ ID NO: 18026 - protein, 9 aa, Homo sapiens
  Heavy chain CDR3 for antibody 9013 (IGHV3-13)
ARDRWYFDL

SEQ ID NO: 18027 - protein, 9 aa, Homo sapiens
  Light chain CDR3 for antibody 9014 (IGKV1-9)
QQLKSYLYT

SEQ ID NO: 18028 - protein, 13 aa, Homo sapiens
  Heavy chain CDR3 for antibody 9014 (IGHV4-28)
ARKGATGYYGMDV

SEQ ID NO: 18029 - protein, 9 aa, Homo sapiens
  Light chain CDR3 for antibody 9015 (IGKV1-16)
QQFNNYPYT

SEQ ID NO: 18030 - protein, 15 aa, Homo sapiens
  Heavy chain CDR3 for antibody 9015 (IGHV3-23)
AKAGGRYFDWFPFDY

SEQ ID NO: 18031 - protein, 8 aa, Homo sapiens
  Light chain CDR3 for antibody 9016 (IGKV1-5)
QQYNSYWT

SEQ ID NO: 18032 - protein, 9 aa, Homo sapiens
  Heavy chain CDR3 for antibody 9016 (IGHV3-30)
ARDYFHYDY

SEQ ID NO: 18033 - protein, 9 aa, Homo sapiens
  Light chain CDR3 for antibody 9017 (IGKV1-16)
QKYNSNPLT

SEQ ID NO: 18034 - protein, 11 aa, Homo sapiens
  Heavy chain CDR3 for antibody 9017 (IGHV3-33)
ARDTWDDYFDY

SEQ ID NO: 18035 - protein, 9 aa, Homo sapiens
  Light chain CDR3 for antibody 9018 (IGKV1-6)
LQDYNYPRT

SEQ ID NO: 18036 - protein, 15 aa, Homo sapiens
  Heavy chain CDR3 for antibody 9018 (IGHV1-18)
ARDRAFTMVRGVIDY

SEQ ID NO: 18037 - protein, 8 aa, Homo sapiens
  Light chain CDR3 for antibody 9019 (IGKV2D-28)
MQALQTPT

SEQ ID NO: 18038 - protein, 13 aa, Homo sapiens
  Heavy chain CDR3 for antibody 9019 (IGHV3-23)
ARAFFMVRGVIDF

SEQ ID NO: 18039 - protein, 10 aa, Homo sapiens
  Light chain CDR3 for antibody 9020 (IGKV1-17)
LQHNSYPMYT

SEQ ID NO: 18040 - protein, 13 aa, Homo sapiens
  Heavy chain CDR3 for antibody 9020 (IGHV3-53)
ARSGSYWGYYFDY

SEQ ID NO: 18041 - protein, 9 aa, Homo sapiens
  Light chain CDR3 for antibody 9021 (IGKV1-17)
QQLKSYLYT

SEQ ID NO: 18042 - protein, 15 aa, Homo sapiens
  Heavy chain CDR3 for antibody 9021 (IGHV3-33)
ARDRGWKAPGYGMDV

SEQ ID NO: 18043 - protein, 9 aa, Homo sapiens
  Light chain CDR3 for antibody 9022 (IGKV1-17)
LHSNNYPWT

SEQ ID NO: 18044 - protein, 13 aa, Homo sapiens
  Heavy chain CDR3 for antibody 9022 (IGHV4-59)
ARDAGYSSSWFDY

SEQ ID NO: 18045 - protein, 6 aa, Homo sapiens
  Light chain CDR3 for antibody 9023 (IGKV3-20)
QQYGST

SEQ ID NO: 18046 - protein, 12 aa, Homo sapiens
  Heavy chain CDR3 for antibody 9023 (IGHV3-23)
AKDGWFGESLDY

SEQ ID NO: 18047 - protein, 9 aa, Homo sapiens
  Light chain CDR3 for antibody 9024 (IGKV3-15)
QQYNNWPYT

SEQ ID NO: 18048 - protein, 12 aa, Homo sapiens
  Heavy chain CDR3 for antibody 9024 (IGHV3-33)
ARGGYSHGYFDY

SEQ ID NO: 18049 - protein, 9 aa, Homo sapiens
  Light chain CDR3 for antibody 9025 (IGKV3-20)
QHYGSSPYT

SEQ ID NO: 18050 - protein, 12 aa, Homo sapiens
  Heavy chain CDR3 for antibody 9025 (IGHV3-64)
ARVNSGSPYFDY

SEQ ID NO: 18051 - protein, 9 aa, Homo sapiens
  Light chain CDR3 for antibody 9026 (IGKV1-37)
QRTSNAPYT

SEQ ID NO: 18052 - protein, 15 aa, Homo sapiens
  Heavy chain CDR3 for antibody 9026 (IGHV3-30)
ARGAMVRGVDYGMDV

SEQ ID NO: 18053 - protein, 9 aa, Homo sapiens
  Light chain CDR3 for antibody 9027 (IGKV1D-16)
QQYNSYPYT

SEQ ID NO: 18054 - protein, 10 aa, Homo sapiens
  Heavy chain CDR3 for antibody 9027 (IGHV3-21)
ARRWERYFDY

SEQ ID NO: 18055 - protein, 10 aa, Homo sapiens
  Light chain CDR3 for antibody 9028 (IGKV1-39)
QQSYSTPMYT

SEQ ID NO: 18056 - protein, 13 aa, Homo sapiens
  Heavy chain CDR3 for antibody 9028 (IGHV3-33)
ARDYTMVRGVMNY

SEQ ID NO: 18057 - protein, 11 aa, Homo sapiens
  Light chain CDR3 for antibody 9029 (IGKV3-11)
QQRSNWPPTWT

SEQ ID NO: 18058 - protein, 17 aa, Homo sapiens
  Heavy chain CDR3 for antibody 9029 (IGHV3-23)
AKDGIGELSYYYYGMDV

SEQ ID NO: 18059 - protein, 8 aa, Homo sapiens
  Light chain CDR3 for antibody 9030 (IGKV1-5)
QQYNSYWT

SEQ ID NO: 18060 - protein, 12 aa, Homo sapiens
  Heavy chain CDR3 for antibody 9030 (IGHV3-33)
VRKWFGELYFDY

SEQ ID NO: 18061 - protein, 9 aa, Homo sapiens
  Light chain CDR3 for antibody 9031 (IGKV5-2)
LQHDNFPWT

SEQ ID NO: 18062 - protein, 14 aa, Homo sapiens
  Heavy chain CDR3 for antibody 9031 (IGHV3-33)
ARGLEWGGDNWFDP

SEQ ID NO: 18063 - protein, 9 aa, Homo sapiens
  Light chain CDR3 for antibody 9032 (IGKV3-15)
QQYNNWPRT

SEQ ID NO: 18064 - protein, 17 aa, Homo sapiens
  Heavy chain CDR3 for antibody 9032 (IGHV4-34)
ARDGSGSYTHYYYGMDV

SEQ ID NO: 18065 - protein, 10 aa, Homo sapiens
  Light chain CDR3 for antibody 9033 (IGKV3-11)
QQRSNWPIFT

SEQ ID NO: 18066 - protein, 13 aa, Homo sapiens
  Heavy chain CDR3 for antibody 9033 (IGHV3-30)
AAPFMVRGDGMDV

SEQ ID NO: 18067 - protein, 10 aa, Homo sapiens
  Light chain CDR3 for antibody 9034 (IGKV3-20)
QQYGRSPPVT

SEQ ID NO: 18068 - protein, 16 aa, Homo sapiens
  Heavy chain CDR3 for antibody 9034 (IGHV3-33)
ARGGRSDWLYYYGMDV

SEQ ID NO: 18069 - protein, 9 aa, Homo sapiens
  Light chain CDR3 for antibody 9035 (IGKV6-21)
HQSSSLPHT

SEQ ID NO: 18070 - protein, 14 aa, Homo sapiens
  Heavy chain CDR3 for antibody 9035 (IGHV3-23)
VRDRIAAASSDFDN

SEQ ID NO: 18071 - protein, 9 aa, Homo sapiens
  Light chain CDR3 for antibody 9036 (IGKV4-1)
QQYYSTPLT

SEQ ID NO: 18072 - protein, 11 aa, Homo sapiens
  Heavy chain CDR3 for antibody 9036 (IGHV4-59)
AREMGHDPFDI

SEQ ID NO: 18073 - protein, 10 aa, Homo sapiens
  Light chain CDR3 for antibody 9037 (IGKV3-15)
QQYNNWPPIT

SEQ ID NO: 18074 - protein, 17 aa, Homo sapiens
  Heavy chain CDR3 for antibody 9037 (IGHV3-33)
ARGEQWLGYYYYYGMDV

SEQ ID NO: 18075 - protein, 9 aa, Homo sapiens
  Light chain CDR3 for antibody 9038 (IGKV1-6)
LQDYKSPFT

SEQ ID NO: 18076 - protein, 11 aa, Homo sapiens
  Heavy chain CDR3 for antibody 9038 (IGHV3-33)
AREAANWGFDY

SEQ ID NO: 18077 - protein, 9 aa, Homo sapiens
  Light chain CDR3 for antibody 9039 (IGKV1D-13)
QRFNNYLYT

SEQ ID NO: 18078 - protein, 14 aa, Homo sapiens
  Heavy chain CDR3 for antibody 9039 (IGHV3-33)
ARDGVYISSSWFDP

SEQ ID NO: 18079 - protein, 8 aa, Homo sapiens
  Light chain CDR3 for antibody 9040 (IGKV3D-7)
QQDYSLLT

SEQ ID NO: 18080 - protein, 13 aa, Homo sapiens
  Heavy chain CDR3 for antibody 9040 (IGHV3-33)
VSTGDSYYYVMDV

SEQ ID NO: 18081 - protein, 8 aa, Homo sapiens
  Light chain CDR3 for antibody 9041 (IGKV1D-13)
QQFNNYPT

SEQ ID NO: 18082 - protein, 19 aa, Homo sapiens
  Heavy chain CDR3 for antibody 9041 (IGHV3-33)
ARDRYYDILTGYSSYYFDY

SEQ ID NO: 18083 - protein, 9 aa, Homo sapiens
  Light chain CDR3 for antibody 9042 (IGKV1-6)
LQDYNHPFT

SEQ ID NO: 18084 - protein, 13 aa, Homo sapiens
  Heavy chain CDR3 for antibody 9042 (IGHV3-33)
ARDYCGGDCYLDY

SEQ ID NO: 18085 - protein, 10 aa, Homo sapiens
  Light chain CDR3 for antibody 9043 (IGKV1-17)
LQHNSYPMYT

SEQ ID NO: 18086 - protein, 17 aa, Homo sapiens
  Heavy chain CDR3 for antibody 9043 (IGHV3-33)
ARVYYDILTGYSPAFDI

SEQ ID NO: 18087 - protein, 10 aa, Homo sapiens
  Light chain CDR3 for antibody 9044 (IGKV1-17)
LQHNSYPMYT

SEQ ID NO: 18088 - protein, 17 aa, Homo sapiens
  Heavy chain CDR3 for antibody 9044 (IGHV3-33)
ARGFSGYDGYYYYGMDV

SEQ ID NO: 18089 - protein, 10 aa, Homo sapiens
  Light chain CDR3 for antibody 9045 (IGKV1-39)
QQSYSTPMYT

SEQ ID NO: 18090 - protein, 9 aa, Homo sapiens
  Heavy chain CDR3 for antibody 9045 (IGHV1-18)
ARGKDWFDP

SEQ ID NO: 18091 - protein, 10 aa, Homo sapiens
  Light chain CDR3 for antibody 9046 (IGKV1-27)
QKYNSAPMYT

SEQ ID NO: 18092 - protein, 13 aa, Homo sapiens
  Heavy chain CDR3 for antibody 9046 (IGHV3-33)
ARDYCGGDCYLDY

SEQ ID NO: 18093 - protein, 9 aa, Homo sapiens
  Light chain CDR3 for antibody 9047 (IGKV3-15)
QQYNDWPLT

SEQ ID NO: 18094 - protein, 9 aa, Homo sapiens
  Heavy chain CDR3 for antibody 9047 (IGHV3-13)
ARDRWYFDL

SEQ ID NO: 18095 - protein, 9 aa, Homo sapiens
  Light chain CDR3 for antibody 9048 (IGKV1-6)
LQDYNYPYT

SEQ ID NO: 18096 - protein, 18 aa, Homo sapiens
  Heavy chain CDR3 for antibody 9048 (IGHV3-33)
ARDHCSGGSCYYYYGMDV

SEQ ID NO: 18097 - protein, 10 aa, Homo sapiens
  Light chain CDR3 for antibody 9049 (IGKV1-17)
LQHNSYPMYT

SEQ ID NO: 18098 - protein, 18 aa, Homo sapiens
  Heavy chain CDR3 for antibody 9049 (IGHV3-33)
ARREGITLIFYYYYGMDV

SEQ ID NO: 18099 - protein, 9 aa, Homo sapiens
  Light chain CDR3 for antibody 9050 (IGKV2-30)
MQGTHWPLT

SEQ ID NO: 18100 - protein, 9 aa, Homo sapiens
  Heavy chain CDR3 for antibody 9050 (IGHV3-33)
AANSYGLDY

SEQ ID NO: 18101 - protein, 8 aa, Homo sapiens
  Light chain CDR3 for antibody 9051 (IGKV3D-7)
QQDYNLLT

SEQ ID NO: 18102 - protein, 11 aa, Homo sapiens
  Heavy chain CDR3 for antibody 9051 (IGHV3-23)
AKGLWSYYFDY

SEQ ID NO: 18103 - protein, 8 aa, Homo sapiens
  Light chain CDR3 for antibody 9052 (IGKV3D-7)
QQDYNLLT

SEQ ID NO: 18104 - protein, 13 aa, Homo sapiens
  Heavy chain CDR3 for antibody 9052 (IGHV1-46)
ARRQVGYYYGMDV

SEQ ID NO: 18105 - protein, 9 aa, Homo sapiens
  Light chain CDR3 for antibody 9053 (IGKV1D-13)
QRFNNYLYT

SEQ ID NO: 18106 - protein, 16 aa, Homo sapiens
  Heavy chain CDR3 for antibody 9053 (IGHV3-33)
ARGGRSDWLYYYGMDV

SEQ ID NO: 18107 - protein, 11 aa, Homo sapiens
  Light chain CDR3 for antibody 9054 (IGKV3-11)
QQRSNWPPTWT

SEQ ID NO: 18108 - protein, 7 aa, Homo sapiens
  Heavy chain CDR3 for antibody 9054 (IGHV3-33)
ARELVDY

SEQ ID NO: 18109 - protein, 9 aa, Homo sapiens
  Light chain CDR3 for antibody 9055 (IGKV1-16)
QQYYSYPRT

SEQ ID NO: 18110 - protein, 18 aa, Homo sapiens
  Heavy chain CDR3 for antibody 9055 (IGHV3-33)
ARERYYYGSGSYPDAFDI

SEQ ID NO: 18111 - protein, 10 aa, Homo sapiens
  Light chain CDR3 for antibody 9056 (IGKV3-20)
QQYGRSPPVT

SEQ ID NO: 18112 - protein, 21 aa, Homo sapiens
  Heavy chain CDR3 for antibody 9056 (IGHV3-23)
AKDIDYYGSGSYPLYYYGMDV

SEQ ID NO: 18113 - protein, 9 aa, Homo sapiens
  Light chain CDR3 for antibody 9057 (IGKV3-15)
QQYNNWPRT

SEQ ID NO: 18114 - protein, 14 aa, Homo sapiens
  Heavy chain CDR3 for antibody 9057 (IGHV3-23)
AKCDYDILTGILDY

SEQ ID NO: 18115 - protein, 11 aa, Homo sapiens
  Light chain CDR3 for antibody 9058 (IGKV3-11)
QQRSNWPPTWT

SEQ ID NO: 18116 - protein, 15 aa, Homo sapiens
  Heavy chain CDR3 for antibody 9058 (IGHV3-30)
ARGAMVRGVDYGMDV

SEQ ID NO: 18117 - protein, 9 aa, Homo sapiens
  Light chain CDR3 for antibody 9059 (IGKV6-21)
HQSSSLPYT

SEQ ID NO: 18118 - protein, 14 aa, Homo sapiens
  Heavy chain CDR3 for antibody 9059 (IGHV3-33)
ARDAMGTSTAWFDP

SEQ ID NO: 18119 - protein, 10 aa, Homo sapiens
  Light chain CDR3 for antibody 9060 (IGKV1-17)
LQHNSYPMYT

SEQ ID NO: 18120 - protein, 12 aa, Homo sapiens
  Heavy chain CDR3 for antibody 9060 (IGHV3-33)
ARDPGYYYGLDV

SEQ ID NO: 18121 - protein, 9 aa, Homo sapiens
  Light chain CDR3 for antibody 9061 (IGKV1-16)
QQYNSYPPT

SEQ ID NO: 18122 - protein, 14 aa, Homo sapiens
  Heavy chain CDR3 for antibody 9061 (IGHV3-33)
ARDAMGTPTAWFDP

SEQ ID NO: 18123 - protein, 9 aa, Homo sapiens
  Light chain CDR3 for antibody 9062 (IGKV1-39)
QQSYRTPLT

SEQ ID NO: 18124 - protein, 15 aa, Homo sapiens
  Heavy chain CDR3 for antibody 9062 (IGHV3-20)
AREGSSSWYLYYFDY

SEQ ID NO: 18125 - protein, 8 aa, Homo sapiens
  Light chain CDR3 for antibody 9063 (IGKV1-5)
QQYNSYWT

SEQ ID NO: 18126 - protein, 16 aa, Homo sapiens
  Heavy chain CDR3 for antibody 9063 (IGHV3-23)
AKDLRYFDWSLYAFDI

SEQ ID NO: 18127 - protein, 8 aa, Homo sapiens
  Light chain CDR3 for antibody 9064 (IGKV3-11)
QQRGNWPS

SEQ ID NO: 18128 - protein, 15 aa, Homo sapiens
  Heavy chain CDR3 for antibody 9064 (IGHV4-59)
ARDLGHYYGSVSIDY

SEQ ID NO: 18129 - protein, 10 aa, Homo sapiens
  Light chain CDR3 for antibody 9065 (IGKV3-15)
QQYNNWPPYT

SEQ ID NO: 18130 - protein, 17 aa, Homo sapiens
  Heavy chain CDR3 for antibody 9065 (IGHV1-24)
ATEGYDILPGYYNVLDY

SEQ ID NO: 18131 - protein, 9 aa, Homo sapiens
  Light chain CDR3 for antibody 9066 (IGKV1-17)
LQYNSYPWT

SEQ ID NO: 18132 - protein, 14 aa, Homo sapiens
  Heavy chain CDR3 for antibody 9066 (IGHV3-23)
AKSRIVGALYYFGY

SEQ ID NO: 18133 - protein, 9 aa, Homo sapiens
  Light chain CDR3 for antibody 9067 (IGKV1-6)
LQDFHYPWT

SEQ ID NO: 18134 - protein, 13 aa, Homo sapiens
  Heavy chain CDR3 for antibody 9067 (IGHV1-2)
ARDGVRGSFGMDV

SEQ ID NO: 18135 - protein, 9 aa, Homo sapiens
  Light chain CDR3 for antibody 9068 (IGKV3-20)
QQYGSSPRT

SEQ ID NO: 18136 - protein, 15 aa, Homo sapiens
  Heavy chain CDR3 for antibody 9068 (IGHV1-24)
ATEDSSSYYYYGLDV

SEQ ID NO: 18137 - protein, 9 aa, Homo sapiens
  Light chain CDR3 for antibody 9069 (IGKV1-17)
LQHNSYPWT

SEQ ID NO: 18138 - protein, 22 aa, Homo sapiens
  Heavy chain CDR3 for antibody 9069 (IGHV3-33)
ARMYYDILTGYYKDYYYYGMDV

SEQ ID NO: 18139 - protein, 8 aa, Homo sapiens
  Light chain CDR3 for antibody 9070 (IGKV1-5)
QQYNSYWT

SEQ ID NO: 18140 - protein, 12 aa, Homo sapiens
  Heavy chain CDR3 for antibody 9070 (IGHV3-33)
AREGTRWVYFDY

SEQ ID NO: 18141 - protein, 9 aa, Homo sapiens
  Light chain CDR3 for antibody 9071 (IGKV1-27)
QKYNSAPYT

SEQ ID NO: 18142 - protein, 15 aa, Homo sapiens
  Heavy chain CDR3 for antibody 9071 (IGHV3-64)
ARDSRPEITGPPFDY

SEQ ID NO: 18143 - protein, 8 aa, Homo sapiens
  Light chain CDR3 for antibody 9072 (IGKV6-21)
HQSSSLPT

SEQ ID NO: 18144 - protein, 18 aa, Homo sapiens
  Heavy chain CDR3 for antibody 9072 (IGHV4-59)
AREGHYYTSGSYYKAFDY

SEQ ID NO: 18145 - protein, 8 aa, Homo sapiens
  Light chain CDR3 for antibody 9073 (IGKV1-5)
QQYNSYYT

SEQ ID NO: 18146 - protein, 9 aa, Homo sapiens
  Heavy chain CDR3 for antibody 9073 (IGHV3-13)
ARDRWYFDL

SEQ ID NO: 18147 - protein, 9 aa, Homo sapiens
  Light chain CDR3 for antibody 9074 (IGKV1-16)
QQYDNLPFT

SEQ ID NO: 18148 - protein, 14 aa, Homo sapiens
  Heavy chain CDR3 for antibody 9074 (IGHV3-33)
ARDRIAAASSDFDC

SEQ ID NO: 18149 - protein, 9 aa, Homo sapiens
  Light chain CDR3 for antibody 9075 (IGKV3-15)
QQYNNWPYT

SEQ ID NO: 18150 - protein, 13 aa, Homo sapiens
  Heavy chain CDR3 for antibody 9075 (IGHV3-30)
AAPFMVRGDGMDV

SEQ ID NO: 18151 - protein, 9 aa, Homo sapiens
  Light chain CDR3 for antibody 9076 (IGKV1-6)
LQDYKSPFT

SEQ ID NO: 18152 - protein, 12 aa, Homo sapiens
  Heavy chain CDR3 for antibody 9076 (IGHV3-23)
AKDGWFGESLDY

SEQ ID NO: 18153 - protein, 8 aa, Homo sapiens
  Light chain CDR3 for antibody 9077 (IGKV1D-13)
QQFNNYPT

SEQ ID NO: 18154 - protein, 18 aa, Homo sapiens
  Heavy chain CDR3 for antibody 9077 (IGHV3-33)
ARGGYSSGWDYYYYGMDV

SEQ ID NO: 18155 - protein, 9 aa, Homo sapiens
  Light chain CDR3 for antibody 9078 (IGKV1-17)
LQHNSYPYT

SEQ ID NO: 18156 - protein, 12 aa, Homo sapiens
  Heavy chain CDR3 for antibody 9078 (IGHV3-64)
ARVNSGSPYFDY

SEQ ID NO: 18157 - protein, 9 aa, Homo sapiens
  Light chain CDR3 for antibody 9079 (IGKV3-20)
QQYGSSPYT

SEQ ID NO: 18158 - protein, 16 aa, Homo sapiens
  Heavy chain CDR3 for antibody 9079 (IGHV3-33)
AREMAGSYYYYYGMDV

SEQ ID NO: 18159 - protein, 9 aa, Homo sapiens
  Light chain CDR3 for antibody 9080 (IGKV1-27)
QKYNSAPYT

SEQ ID NO: 18160 - protein, 11 aa, Homo sapiens
  Heavy chain CDR3 for antibody 9080 (IGHV4-39)
ARLLVGATTDY

SEQ ID NO: 18161 - protein, 9 aa, Homo sapiens
  Light chain CDR3 for antibody 9081 (IGKV2D-28)
MQVLQTPFT

SEQ ID NO: 18162 - protein, 13 aa, Homo sapiens
  Heavy chain CDR3 for antibody 9081 (IGHV4-28)
ARKGATGYYGMDV

SEQ ID NO: 18163 - protein, 9 aa, Homo sapiens
  Light chain CDR3 for antibody 9082 (IGKV1-16)
QHYNDYPFT

SEQ ID NO: 18164 - protein, 13 aa, Homo sapiens
  Heavy chain CDR3 for antibody 9082 (IGHV3-33)
AKEDGDYHHYFDY

SEQ ID NO: 18165 - protein, 9 aa, Homo sapiens
  Light chain CDR3 for antibody 9083 (IGKV3-15)
QQYNNWPRT

SEQ ID NO: 18166 - protein, 18 aa, Homo sapiens
  Heavy chain CDR3 for antibody 9083 (IGHV3-33)
VRDRERYGSGSYPDAFDI

SEQ ID NO: 18167 - protein, 8 aa, Homo sapiens
  Light chain CDR3 for antibody 9084 (IGKV1D-16)
QQYNSYYT

SEQ ID NO: 18168 - protein, 17 aa, Homo sapiens
  Heavy chain CDR3 for antibody 9084 (IGHV3-33)
ARQGVLLWFGELYYFDY

SEQ ID NO: 18169 - protein, 9 aa, Homo sapiens
  Light chain CDR3 for antibody 9085 (IGKV1-16)
QQYNSYPLT

SEQ ID NO: 18170 - protein, 10 aa, Homo sapiens
  Heavy chain CDR3 for antibody 9085 (IGHV3-33)
ARDYGDYFDY

SEQ ID NO: 18171 - protein, 9 aa, Homo sapiens
  Light chain CDR3 for antibody 9086 (IGKV1-6)
QQEYNYPLT

SEQ ID NO: 18172 - protein, 16 aa, Homo sapiens
  Heavy chain CDR3 for antibody 9086 (IGHV1-46)
ARGYDMLTGDYHGMDV

SEQ ID NO: 18173 - protein, 10 aa, Homo sapiens
  Light chain CDR3 for antibody 9087 (IGKV1-39)
QQSYSTPMYT

SEQ ID NO: 18174 - protein, 18 aa, Homo sapiens
  Heavy chain CDR3 for antibody 9087 (IGHV1-46)
ARDLTGRTENYYFYGMDV

SEQ ID NO: 18175 - protein, 8 aa, Homo sapiens
  Light chain CDR3 for antibody 9088 (IGKV6-21)
HQSSSLPT

SEQ ID NO: 18176 - protein, 14 aa, Homo sapiens
  Heavy chain CDR3 for antibody 9088 (IGHV3-33)
ARDGYDFLTGPFDY

SEQ ID NO: 18177 - protein, 9 aa, Homo sapiens
  Light chain CDR3 for antibody 9089 (IGKV2D-28)
MQALQTPPT

SEQ ID NO: 18178 - protein, 17 aa, Homo sapiens
  Heavy chain CDR3 for antibody 9089 (IGHV1-18)
ARDEGYDILTGYPHFDY

SEQ ID NO: 18179 - protein, 9 aa, Homo sapiens
  Light chain CDR3 for antibody 9090 (IGKV1-27)
QKYNSAPYT

SEQ ID NO: 18180 - protein, 14 aa, Homo sapiens
  Heavy chain CDR3 for antibody 9090 (IGHV3-23)
AKCDYDILTGILDY

SEQ ID NO: 18181 - protein, 9 aa, Homo sapiens
  Light chain CDR3 for antibody 9091 (IGKV1-6)
LQDYKSPFT

SEQ ID NO: 18182 - protein, 15 aa, Homo sapiens
  Heavy chain CDR3 for antibody 9091 (IGHV1-18)
ARGYCSSTSCYYFDY

SEQ ID NO: 18183 - protein, 9 aa, Homo sapiens
  Light chain CDR3 for antibody 9092 (IGKV1-39)
QQSYSTPYT

SEQ ID NO: 18184 - protein, 13 aa, Homo sapiens
  Heavy chain CDR3 for antibody 9092 (IGHV3-33)
ARDWGYSNGYFDY

SEQ ID NO: 18185 - protein, 6 aa, Homo sapiens
  Light chain CDR3 for antibody 9093 (IGKV3-20)
QQYGST

SEQ ID NO: 18186 - protein, 17 aa, Homo sapiens
  Heavy chain CDR3 for antibody 9093 (IGHV3-33)
ARESLKLGIYYYYGMDV

SEQ ID NO: 18187 - protein, 10 aa, Homo sapiens
  Light chain CDR3 for antibody 9094 (IGKV1-17)
LQHNSYPMYT

SEQ ID NO: 18188 - protein, 9 aa, Homo sapiens
  Heavy chain CDR3 for antibody 9094 (IGHV3-23)
AREYKEFDY

SEQ ID NO: 18189 - protein, 9 aa, Homo sapiens
  Light chain CDR3 for antibody 9095 (IGKV3D-20)
QQYGSSPYT

SEQ ID NO: 18190 - protein, 16 aa, Homo sapiens
  Heavy chain CDR3 for antibody 9095 (IGHV4-59)
AGGSGSYRDYYYGMDV

SEQ ID NO: 18191 - protein, 9 aa, Homo sapiens
  Light chain CDR3 for antibody 9096 (IGKV2-30)
MQGTHWPLT

SEQ ID NO: 18192 - protein, 13 aa, Homo sapiens
  Heavy chain CDR3 for antibody 9096 (IGHV4-39)
ARHHYGSGSLRDY

SEQ ID NO: 18193 - protein, 10 aa, Homo sapiens
  Light chain CDR3 for antibody 9097 (IGKV3-11)
QQRSNWLMYT

SEQ ID NO: 18194 - protein, 13 aa, Homo sapiens
  Heavy chain CDR3 for antibody 9097 (IGHV3-33)
ARTDYYFYYGLDV

SEQ ID NO: 18195 - protein, 8 aa, Homo sapiens
  Light chain CDR3 for antibody 9098 (IGKV3-20)
QQYGSSFT

SEQ ID NO: 18196 - protein, 20 aa, Homo sapiens
  Heavy chain CDR3 for antibody 9098 (IGHV3-23)
AKDREMAATSHYYYYYGMDV

SEQ ID NO: 18197 - protein, 9 aa, Homo sapiens
  Light chain CDR3 for antibody 9099 (IGKV2D-28)
MQALQTPPT

SEQ ID NO: 18198 - protein, 11 aa, Homo sapiens
  Heavy chain CDR3 for antibody 9099 (IGHV3-74)
ARDRGNWGFDY

SEQ ID NO: 18199 - protein, 8 aa, Homo sapiens
  Light chain CDR3 for antibody 9100 (IGKV3D-7)
QQDYNLLT

SEQ ID NO: 18200 - protein, 14 aa, Homo sapiens
  Heavy chain CDR3 for antibody 9100 (IGHV3-23)
AKCDYDILTGILDY

SEQ ID NO: 18201 - protein, 9 aa, Homo sapiens
  Light chain CDR3 for antibody 9101 (IGKV1-9)
QQLNSYPYT

SEQ ID NO: 18202 - protein, 19 aa, Homo sapiens
  Heavy chain CDR3 for antibody 9101 (IGHV3-33)
ARGRGSYYYGPGSHYGMDV

SEQ ID NO: 18203 - protein, 8 aa, Homo sapiens
  Light chain CDR3 for antibody 9102 (IGKV1-5)
QQYNSYWT

SEQ ID NO: 18204 - protein, 17 aa, Homo sapiens
  Heavy chain CDR3 for antibody 9102 (IGHV3-33)
ARVRGVIEGYYYYGMDV

SEQ ID NO: 18205 - protein, 9 aa, Homo sapiens
  Light chain CDR3 for antibody 9103 (IGKV1-6)
LQDFHYPWT

SEQ ID NO: 18206 - protein, 14 aa, Homo sapiens
  Heavy chain CDR3 for antibody 9103 (IGHV3-33)
VRDAMGATTAWFDP

SEQ ID NO: 18207 - protein, 10 aa, Homo sapiens
  Light chain CDR3 for antibody 9104 (IGKV1-39)
QQSYSTPMYT

SEQ ID NO: 18208 - protein, 12 aa, Homo sapiens
  Heavy chain CDR3 for antibody 9104 (IGHV3-33)
AREGDILTGYSL

SEQ ID NO: 18209 - protein, 10 aa, Homo sapiens
  Light chain CDR3 for antibody 9105 (IGKV1-39)
QQSYSTPMYT

SEQ ID NO: 18210 - protein, 15 aa, Homo sapiens
  Heavy chain CDR3 for antibody 9105 (IGHV3-74)
ARGSGSHYHYYGMDV

SEQ ID NO: 18211 - protein, 9 aa, Homo sapiens
  Light chain CDR3 for antibody 9106 (IGKV2D-24)
TQATQFPHT

SEQ ID NO: 18212 - protein, 19 aa, Homo sapiens
  Heavy chain CDR3 for antibody 9106 (IGHV1-18)
ARDDILTGYSLYYYYGMDV

SEQ ID NO: 18213 - protein, 9 aa, Homo sapiens
  Light chain CDR3 for antibody 9107 (IGKV3D-20)
QQYGYSPRT

SEQ ID NO: 18214 - protein, 14 aa, Homo sapiens
  Heavy chain CDR3 for antibody 9107 (IGHV3-33)
ARWELPFYYSGMDV

SEQ ID NO: 18215 - protein, 9 aa, Homo sapiens
  Light chain CDR3 for antibody 9108 (IGKV3D-7)
QQDYNLPWT

SEQ ID NO: 18216 - protein, 20 aa, Homo sapiens
  Heavy chain CDR3 for antibody 9108 (IGHV3-23)
AKGMGGLRYFDWPHYYGMDV

SEQ ID NO: 18217 - protein, 9 aa, Homo sapiens
  Light chain CDR3 for antibody 9109 (IGKV1-9)
QQYNSYPRT

SEQ ID NO: 18218 - protein, 17 aa, Homo sapiens
  Heavy chain CDR3 for antibody 9109 (IGHV3-23)
ANGGFGESHYNYYGMDV

SEQ ID NO: 18219 - protein, 9 aa, Homo sapiens
  Light chain CDR3 for antibody 9110 (IGKV1-17)
LQHNSYPYT

SEQ ID NO: 18220 - protein, 14 aa, Homo sapiens
  Heavy chain CDR3 for antibody 9110 (IGHV3-23)
AKGGGVGAYNWFDP

SEQ ID NO: 18221 - protein, 9 aa, Homo sapiens
  Light chain CDR3 for antibody 9111 (IGKV3D-7)
QQDYEFPLT

SEQ ID NO: 18222 - protein, 10 aa, Homo sapiens
  Heavy chain CDR3 for antibody 9111 (IGHV4-39)
ARQLGNWFDP

SEQ ID NO: 18223 - protein, 9 aa, Homo sapiens
  Light chain CDR3 for antibody 9112 (IGKV1-9)
QQLNSYPYT

SEQ ID NO: 18224 - protein, 13 aa, Homo sapiens
  Heavy chain CDR3 for antibody 9112 (IGHV3-23)
AKERLRYFDWLAY

SEQ ID NO: 18225 - protein, 9 aa, Homo sapiens
  Light chain CDR3 for antibody 9113 (IGKV1-9)
QQLNTYPWT

SEQ ID NO: 18226 - protein, 12 aa, Homo sapiens
  Heavy chain CDR3 for antibody 9113 (IGHV1-46)
ARGLTGDHAIDI

SEQ ID NO: 18227 - protein, 9 aa, Homo sapiens
  Light chain CDR3 for antibody 9114 (IGKV3-11)
QQRSNWMYT

SEQ ID NO: 18228 - protein, 17 aa, Homo sapiens
  Heavy chain CDR3 for antibody 9114 (IGHV3-33)
ARCGYSSSWYDPYYFDY

SEQ ID NO: 18229 - protein, 9 aa, Homo sapiens
  Light chain CDR3 for antibody 9115 (IGKV1D-13)
QRLNNYLYT

SEQ ID NO: 18230 - protein, 9 aa, Homo sapiens
  Heavy chain CDR3 for antibody 9115 (IGHV3-30)
ARDYFHFDY

SEQ ID NO: 18231 - protein, 9 aa, Homo sapiens
  Light chain CDR3 for antibody 9116 (IGKV1-17)
LHSNNYPWT

SEQ ID NO: 18232 - protein, 17 aa, Homo sapiens
  Heavy chain CDR3 for antibody 9116 (IGHV3-33)
ARSPYDILTGYSYYFDY

SEQ ID NO: 18233 - protein, 10 aa, Homo sapiens
  Light chain CDR3 for antibody 9117 (IGKV1-17)
LQHNSYPMYT

SEQ ID NO: 18234 - protein, 16 aa, Homo sapiens
  Heavy chain CDR3 for antibody 9117 (IGHV3-33)
AREGGLIAAAGTGFDY

SEQ ID NO: 18235 - protein, 6 aa, Homo sapiens
  Light chain CDR3 for antibody 9118 (IGKV3-20)
QQYGST

SEQ ID NO: 18236 - protein, 14 aa, Homo sapiens
  Heavy chain CDR3 for antibody 9118 (IGHV3-33)
ARDREQQLVRYFDY

SEQ ID NO: 18237 - protein, 9 aa, Homo sapiens
  Light chain CDR3 for antibody 9119 (IGKV1-9)
QQLNGYPFT

SEQ ID NO: 18238 - protein, 17 aa, Homo sapiens
  Heavy chain CDR3 for antibody 9119 (IGHV3-33)
VREGGLLWVGELSLFDY

SEQ ID NO: 18239 - protein, 9 aa, Homo sapiens
  Light chain CDR3 for antibody 9120 (IGKV1-17)
LHSNNYPWT

SEQ ID NO: 18240 - protein, 13 aa, Homo sapiens
  Heavy chain CDR3 for antibody 9120 (IGHV3-33)
ARDYCGGDCYLDY

SEQ ID NO: 18241 - protein, 9 aa, Homo sapiens
  Light chain CDR3 for antibody 9121 (IGKV1D-13)
QQFNNYPHT

SEQ ID NO: 18242 - protein, 11 aa, Homo sapiens
  Heavy chain CDR3 for antibody 9121 (IGHV4-59)
AREDYGVPFDY

SEQ ID NO: 18243 - protein, 11 aa, Homo sapiens
  Light chain CDR3 for antibody 9122 (IGKV3-11)
QQRSNWPPTWT

SEQ ID NO: 18244 - protein, 16 aa, Homo sapiens
  Heavy chain CDR3 for antibody 9122 (IGHV4-59)
ARFYFGSGSYYWYFDL

SEQ ID NO: 18245 - protein, 9 aa, Homo sapiens
  Light chain CDR3 for antibody 9123 (IGKV1D-16)
QQYNSYPYT

SEQ ID NO: 18246 - protein, 16 aa, Homo sapiens
  Heavy chain CDR3 for antibody 9123 (IGHV3-48)
TRRRQWLAGFDWYFDL

SEQ ID NO: 18247 - protein, 9 aa, Homo sapiens
  Light chain CDR3 for antibody 9124 (IGKV1-16)
QQYNSYPYT

SEQ ID NO: 18248 - protein, 13 aa, Homo sapiens
  Heavy chain CDR3 for antibody 9124 (IGHV4-59)
AREGDYDIDGMDV

SEQ ID NO: 18249 - protein, 9 aa, Homo sapiens
  Light chain CDR3 for antibody 9125 (IGKV1-9)
QQLISYPLT

SEQ ID NO: 18250 - protein, 16 aa, Homo sapiens
  Heavy chain CDR3 for antibody 9125 (IGHV3-33)
ARDNFGSGSYYSHFHY

SEQ ID NO: 18251 - protein, 8 aa, Homo sapiens
  Light chain CDR3 for antibody 9126 (IGKV3-20)
QQYGSSRT

SEQ ID NO: 18252 - protein, 12 aa, Homo sapiens
  Heavy chain CDR3 for antibody 9126 (IGHV3-33)
ASRDILTGYLGY

SEQ ID NO: 18253 - protein, 9 aa, Homo sapiens
  Light chain CDR3 for antibody 9127 (IGKV1-9)
QQLISYPLT

SEQ ID NO: 18254 - protein, 13 aa, Homo sapiens
  Heavy chain CDR3 for antibody 9127 (IGHV3-11)
ARDEGYSGYNLDN

SEQ ID NO: 18255 - protein, 9 aa, Homo sapiens
  Light chain CDR3 for antibody 9128 (IGKV6-21)
HQSSSLPYT

SEQ ID NO: 18256 - protein, 20 aa, Homo sapiens
  Heavy chain CDR3 for antibody 9128 (IGHV3-33)
ARRMVRGVKKTYYYYYGLDV

SEQ ID NO: 18257 - protein, 9 aa, Homo sapiens
  Light chain CDR3 for antibody 9129 (IGKV1-9)
QQLISYPLT

SEQ ID NO: 18258 - protein, 16 aa, Homo sapiens
  Heavy chain CDR3 for antibody 9129 (IGHV3-33)
ARDTPYYSGSGRPFDH

SEQ ID NO: 18259 - protein, 8 aa, Homo sapiens
  Light chain CDR3 for antibody 9130 (IGKV6-21)
HQSSSLPT

SEQ ID NO: 18260 - protein, 11 aa, Homo sapiens
  Heavy chain CDR3 for antibody 9130 (IGHV3-33)
ARGTTVTHFDY

SEQ ID NO: 18261 - protein, 8 aa, Homo sapiens
  Light chain CDR3 for antibody 9131 (IGKV1D-13)
QQFNNYPT

SEQ ID NO: 18262 - protein, 14 aa, Homo sapiens
  Heavy chain CDR3 for antibody 9131 (IGHV3-33)
ARDRYYDILNGGGY

SEQ ID NO: 18263 - protein, 8 aa, Homo sapiens
  Light chain CDR3 for antibody 9132 (IGKV3-11)
QQRSNWLT

SEQ ID NO: 18264 - protein, 14 aa, Homo sapiens
  Heavy chain CDR3 for antibody 9132 (IGHV3-33)
ARAGSGYDRDWFDP

SEQ ID NO: 18265 - protein, 8 aa, Homo sapiens
  Light chain CDR3 for antibody 9133 (IGKV1D-13)
QQFNNYLT

SEQ ID NO: 18266 - protein, 10 aa, Homo sapiens
  Heavy chain CDR3 for antibody 9133 (IGHV3-23)
AKDHYGDYPY

SEQ ID NO: 18267 - protein, 9 aa, Homo sapiens
  Light chain CDR3 for antibody 9134 (IGKV1-9)
QQLNGYPFT

SEQ ID NO: 18268 - protein, 14 aa, Homo sapiens
  Heavy chain CDR3 for antibody 9134 (IGHV4-39)
ARDSGYDYYYAMDV

SEQ ID NO: 18269 - protein, 9 aa, Homo sapiens
  Light chain CDR3 for antibody 9135 (IGKV1-39)
QQSYRTPLT

SEQ ID NO: 18270 - protein, 19 aa, Homo sapiens
  Heavy chain CDR3 for antibody 9135 (IGHV3-21)
AREDYYGSGSYYNEDWFDP

SEQ ID NO: 18271 - protein, 8 aa, Homo sapiens
  Light chain CDR3 for antibody 9136 (IGKV1-5)
QQYNSYYT

SEQ ID NO: 18272 - protein, 16 aa, Homo sapiens
  Heavy chain CDR3 for antibody 9136 (IGHV3-20)
ARDSSSLDYYYYGMDV

SEQ ID NO: 18273 - protein, 8 aa, Homo sapiens
  Light chain CDR3 for antibody 9137 (IGKV3D-7)
QQDYNLLT

SEQ ID NO: 18274 - protein, 18 aa, Homo sapiens
  Heavy chain CDR3 for antibody 9137 (IGHV3-30)
ARDRHHDILTGYSDAFEI

SEQ ID NO: 18275 - protein, 9 aa, Homo sapiens
  Light chain CDR3 for antibody 9138 (IGKV1-16)
QHYNDYPFT

SEQ ID NO: 18276 - protein, 14 aa, Homo sapiens
  Heavy chain CDR3 for antibody 9138 (IGHV3-33)
ARDRIAAASSDFDC

SEQ ID NO: 18277 - protein, 7 aa, Homo sapiens
  Light chain CDR3 for antibody 9139 (IGKV1-17)
LQHNSYP

SEQ ID NO: 18278 - protein, 20 aa, Homo sapiens
  Heavy chain CDR3 for antibody 9139 (IGHV1-18)
AREVGIAVAGTLYYYYGMDV

SEQ ID NO: 18279 - protein, 9 aa, Homo sapiens
  Light chain CDR3 for antibody 9140 (IGKV3-20)
QQYGRSPRT

SEQ ID NO: 18280 - protein, 19 aa, Homo sapiens
  Heavy chain CDR3 for antibody 9140 (IGHV1-24)
ATHYDILTGSPYYYCALDV

SEQ ID NO: 18281 - protein, 9 aa, Homo sapiens
  Light chain CDR3 for antibody 9141 (IGKV2D-24)
TQATQFPHT

SEQ ID NO: 18282 - protein, 18 aa, Homo sapiens
  Heavy chain CDR3 for antibody 9141 (IGHV1-18)
ARDRYYYDSGSYYYGMDV

SEQ ID NO: 18283 - protein, 10 aa, Homo sapiens
  Light chain CDR3 for antibody 9142 (IGKV3-15)
QQYNNWPPIT

SEQ ID NO: 18284 - protein, 9 aa, Homo sapiens
  Heavy chain CDR3 for antibody 9142 (IGHV4-59)
ARGGASFDY

SEQ ID NO: 18285 - protein, 9 aa, Homo sapiens
  Light chain CDR3 for antibody 9143 (IGKV3-11)
QQRSNWMYT

SEQ ID NO: 18286 - protein, 10 aa, Homo sapiens
  Heavy chain CDR3 for antibody 9143 (IGHV3-33)
ARDGSGSQPI

SEQ ID NO: 18287 - protein, 9 aa, Homo sapiens
  Light chain CDR3 for antibody 9144 (IGKV1D-16)
QQYITYPYT

SEQ ID NO: 18288 - protein, 14 aa, Homo sapiens
  Heavy chain CDR3 for antibody 9144 (IGHV3-33)
ARDWNDVYYYGMDV

SEQ ID NO: 18289 - protein, 10 aa, Homo sapiens
  Light chain CDR3 for antibody 9145 (IGKV3-11)
QQRSNWPPFT

SEQ ID NO: 18290 - protein, 17 aa, Homo sapiens
  Heavy chain CDR3 for antibody 9145 (IGHV4-59)
ARRITMVREIIITAFDY

SEQ ID NO: 18291 - protein, 9 aa, Homo sapiens
  Light chain CDR3 for antibody 9146 (IGKV3D-20)
QQFGSLPLT

SEQ ID NO: 18292 - protein, 11 aa, Homo sapiens
  Heavy chain CDR3 for antibody 9146 (IGHV4-59)
AREMGHDTFDI

SEQ ID NO: 18293 - protein, 9 aa, Homo sapiens
  Light chain CDR3 for antibody 9147 (IGKV2D-24)
TQATQFPHT

SEQ ID NO: 18294 - protein, 12 aa, Homo sapiens
  Heavy chain CDR3 for antibody 9147 (IGHV1-46)
AREDYDIDGMDV

SEQ ID NO: 18295 - protein, 8 aa, Homo sapiens
  Light chain CDR3 for antibody 9148 (IGKV3D-7)
QQDYNLLT

SEQ ID NO: 18296 - protein, 17 aa, Homo sapiens
  Heavy chain CDR3 for antibody 9148 (IGHV1-24)
ATHYGSGSHYKGYGMDV

SEQ ID NO: 18297 - protein, 9 aa, Homo sapiens
  Light chain CDR3 for antibody 9149 (IGKV3-11)
QQRSNWPYT

SEQ ID NO: 18298 - protein, 19 aa, Homo sapiens
  Heavy chain CDR3 for antibody 9149 (IGHV3-33)
AREDYYGSGSYYNEDWFDP

SEQ ID NO: 18299 - protein, 9 aa, Homo sapiens
  Light chain CDR3 for antibody 9150 (IGKV1-17)
LQHNSFPLT

SEQ ID NO: 18300 - protein, 11 aa, Homo sapiens
  Heavy chain CDR3 for antibody 9150 (IGHV3-33)
ARGSGSYAFDS

SEQ ID NO: 18301 - protein, 8 aa, Homo sapiens
  Light chain CDR3 for antibody 9151 (IGKV3-11)
QQRSNWWT

SEQ ID NO: 18302 - protein, 20 aa, Homo sapiens
  Heavy chain CDR3 for antibody 9151 (IGHV3-33)
ARDRCSSTSCYGYYYYGMDV

SEQ ID NO: 18303 - protein, 9 aa, Homo sapiens
  Light chain CDR3 for antibody 9152 (IGKV3D-7)
QQDYNLPYT

SEQ ID NO: 18304 - protein, 19 aa, Homo sapiens
  Heavy chain CDR3 for antibody 9152 (IGHV1-24)
ATAGLQWFGEKIGYYGMDV

SEQ ID NO: 18305 - protein, 8 aa, Homo sapiens
  Light chain CDR3 for antibody 9153 (IGKV3D-7)
QQDYNLLT

SEQ ID NO: 18306 - protein, 15 aa, Homo sapiens
  Heavy chain CDR3 for antibody 9153 (IGHV3-33)
AKDRNSGYDWGGFDY

SEQ ID NO: 18307 - protein, 9 aa, Homo sapiens
  Light chain CDR3 for antibody 9154 (IGKV1-16)
QHYNDYPFT

SEQ ID NO: 18308 - protein, 18 aa, Homo sapiens
  Heavy chain CDR3 for antibody 9154 (IGHV3-33)
ARGYYGSGNFYKDSGMDV

SEQ ID NO: 18309 - protein, 9 aa, Homo sapiens
  Light chain CDR3 for antibody 9155 (IGKV6-21)
HQSYSLPHT

SEQ ID NO: 18310 - protein, 9 aa, Homo sapiens
  Heavy chain CDR3 for antibody 9155 (IGHV3-30)
VRDNWGFDY

SEQ ID NO: 18311 - protein, 9 aa, Homo sapiens
  Light chain CDR3 for antibody 9156 (IGKV1D-13)
QRFNNYLYT

SEQ ID NO: 18312 - protein, 18 aa, Homo sapiens
  Heavy chain CDR3 for antibody 9156 (IGHV3-23)
AKDRITGTTYGYYSGLDV

SEQ ID NO: 18313 - protein, 8 aa, Homo sapiens
  Light chain CDR3 for antibody 9157 (IGKV1-39)
QQSYTTPT

SEQ ID NO: 18314 - protein, 18 aa, Homo sapiens
  Heavy chain CDR3 for antibody 9157 (IGHV4-59)
AREGDYVWGSYRPNWFDP

SEQ ID NO: 18315 - protein, 9 aa, Homo sapiens
  Light chain CDR3 for antibody 9158 (IGKV3-20)
QQYGSSPYT

SEQ ID NO: 18316 - protein, 12 aa, Homo sapiens
  Heavy chain CDR3 for antibody 9158 (IGHV1-18)
ARAPYNWNDPDY

SEQ ID NO: 18317 - protein, 9 aa, Homo sapiens
  Light chain CDR3 for antibody 9159 (IGKV1-37)
QRTSNAPYT

SEQ ID NO: 18318 - protein, 11 aa, Homo sapiens
  Heavy chain CDR3 for antibody 9159 (IGHV3-33)
ARDTWDDYFDY

SEQ ID NO: 18319 - protein, 7 aa, Homo sapiens
  Light chain CDR3 for antibody 9160 (IGKV1-17)
LQHNSYP

SEQ ID NO: 18320 - protein, 17 aa, Homo sapiens
  Heavy chain CDR3 for antibody 9160 (IGHV1-18)
ARDRAFTMVRGVPPFDY

SEQ ID NO: 18321 - protein, 9 aa, Homo sapiens
  Light chain CDR3 for antibody 9161 (IGKV1-39)
QQSYSTPIT

SEQ ID NO: 18322 - protein, 16 aa, Homo sapiens
  Heavy chain CDR3 for antibody 9161 (IGHV3-23)
ARNWNDVGDYYYGMDV

SEQ ID NO: 18323 - protein, 9 aa, Homo sapiens
  Light chain CDR3 for antibody 9162 (IGKV1-9)
QQLISYPLT

SEQ ID NO: 18324 - protein, 13 aa, Homo sapiens
  Heavy chain CDR3 for antibody 9162 (IGHV3-33)
ARDYTMVRGVMNY

SEQ ID NO: 18325 - protein, 9 aa, Homo sapiens
  Light chain CDR3 for antibody 9163 (IGKV1-39)
QQGFSTPWT

SEQ ID NO: 18326 - protein, 13 aa, Homo sapiens
  Heavy chain CDR3 for antibody 9163 (IGHV3-33)
ARRYRSGWYPFDY

SEQ ID NO: 18327 - protein, 10 aa, Homo sapiens
  Light chain CDR3 for antibody 9164 (IGKV3-15)
QQYNNWPPYT

SEQ ID NO: 18328 - protein, 13 aa, Homo sapiens
  Heavy chain CDR3 for antibody 9164 (IGHV3-33)
ARDQRYSSGWYDY

SEQ ID NO: 18329 - protein, 9 aa, Homo sapiens
  Light chain CDR3 for antibody 9165 (IGKV3D-7)
QQDYEFPIT

SEQ ID NO: 18330 - protein, 14 aa, Homo sapiens
  Heavy chain CDR3 for antibody 9165 (IGHV3-33)
ARASSGSSYWYFDL

SEQ ID NO: 18331 - protein, 9 aa, Homo sapiens
  Light chain CDR3 for antibody 9166 (IGKV1-27)
QKYNSAPLT

SEQ ID NO: 18332 - protein, 16 aa, Homo sapiens
  Heavy chain CDR3 for antibody 9166 (IGHV3-33)
ARDAKYYDILTGYPDY

SEQ ID NO: 18333 - protein, 8 aa, Homo sapiens
  Light chain CDR3 for antibody 9167 (IGKV3D-7)
QQDYNLLT

SEQ ID NO: 18334 - protein, 12 aa, Homo sapiens
  Heavy chain CDR3 for antibody 9167 (IGHV3-33)
ARKQWLVQAFDI

SEQ ID NO: 18335 - protein, 9 aa, Homo sapiens
  Light chain CDR3 for antibody 9168 (IGKV3D-7)
QQDYNLPLT

SEQ ID NO: 18336 - protein, 10 aa, Homo sapiens
  Heavy chain CDR3 for antibody 9168 (IGHV3-33)
ARNILTPLDY

SEQ ID NO: 18337 - protein, 9 aa, Homo sapiens
  Light chain CDR3 for antibody 9169 (IGKV5-2)
LQHDNFPWT

SEQ ID NO: 18338 - protein, 16 aa, Homo sapiens
  Heavy chain CDR3 for antibody 9169 (IGHV3-33)
AKDAFYYGSGSHLFDY

SEQ ID NO: 18339 - protein, 9 aa, Homo sapiens
  Light chain CDR3 for antibody 9170 (IGKV1-6)
LQDYKSPFT

SEQ ID NO: 18340 - protein, 15 aa, Homo sapiens
  Heavy chain CDR3 for antibody 9170 (IGHV3-33)
ARDRVVRGVMGYFDY

SEQ ID NO: 18341 - protein, 9 aa, Homo sapiens
  Light chain CDR3 for antibody 9171 (IGKV1D-16)
QQYDSYPYT

SEQ ID NO: 18342 - protein, 13 aa, Homo sapiens
  Heavy chain CDR3 for antibody 9171 (IGHV3-33)
ARDYCGGDCYLDY

SEQ ID NO: 18343 - protein, 10 aa, Homo sapiens
  Light chain CDR3 for antibody 9172 (IGKV3-11)
QQRSNWLMYT

SEQ ID NO: 18344 - protein, 13 aa, Homo sapiens
  Heavy chain CDR3 for antibody 9172 (IGHV1-46)
ARAFFMVRGVIDF

SEQ ID NO: 18345 - protein, 9 aa, Homo sapiens
  Light chain CDR3 for antibody 9173 (IGKV1D-16)
QQYNSFPLT

SEQ ID NO: 18346 - protein, 17 aa, Homo sapiens
  Heavy chain CDR3 for antibody 9173 (IGHV4-59)
ARGRYFDWLFDYYGMDV

SEQ ID NO: 18347 - protein, 6 aa, Homo sapiens
  Light chain CDR3 for antibody 9174 (IGKV3-20)
QQYGST

SEQ ID NO: 18348 - protein, 16 aa, Homo sapiens
  Heavy chain CDR3 for antibody 9174 (IGHV3-23)
AKEGMVLRYFDWLWDY

SEQ ID NO: 18349 - protein, 9 aa, Homo sapiens
  Light chain CDR3 for antibody 9175 (IGKV6-21)
HQSSSLPHT

SEQ ID NO: 18350 - protein, 19 aa, Homo sapiens
  Heavy chain CDR3 for antibody 9175 (IGHV4-39)
ARQDYHGSGTYYKDWFFDL

SEQ ID NO: 18351 - protein, 9 aa, Homo sapiens
  Light chain CDR3 for antibody 9176 (IGKV1-17)
LQHNSYPRT

SEQ ID NO: 18352 - protein, 9 aa, Homo sapiens
  Heavy chain CDR3 for antibody 9176 (IGHV1-18)
ARGNTWFDY

SEQ ID NO: 18353 - protein, 9 aa, Homo sapiens
  Light chain CDR3 for antibody 9177 (IGKV1D-16)
QQYNSFPLT

SEQ ID NO: 18354 - protein, 14 aa, Homo sapiens
  Heavy chain CDR3 for antibody 9177 (IGHV4-39)
ARQGGSGSYYNLDY

SEQ ID NO: 18355 - protein, 9 aa, Homo sapiens
  Light chain CDR3 for antibody 9178 (IGKV1-5)
QQYNTYSRT

SEQ ID NO: 18356 - protein, 9 aa, Homo sapiens
  Heavy chain CDR3 for antibody 9178 (IGHV1-8)
ARGRLDFDY

SEQ ID NO: 18357 - protein, 9 aa, Homo sapiens
  Light chain CDR3 for antibody 9179 (IGKV1-9)
QQVKSYPYT

SEQ ID NO: 18358 - protein, 26 aa, Homo sapiens
  Heavy chain CDR3 for antibody 9179 (IGHV4-39)
ARQGLLWFGDLKAYDSSGYYYGYFHH

SEQ ID NO: 18359 - protein, 9 aa, Homo sapiens
  Light chain CDR3 for antibody 9180 (IGKV3D-20)
QQYGYSPYT

SEQ ID NO: 18360 - protein, 12 aa, Homo sapiens
  Heavy chain CDR3 for antibody 9180 (IGHV3-33)
ARGPTGDHALDI

SEQ ID NO: 18361 - protein, 8 aa, Homo sapiens
  Light chain CDR3 for antibody 9181 (IGKV6-21)
HQSSSLPT

SEQ ID NO: 18362 - protein, 9 aa, Homo sapiens
  Heavy chain CDR3 for antibody 9181 (IGHV4-59)
ARGGASFDY

SEQ ID NO: 18363 - protein, 10 aa, Homo sapiens
  Light chain CDR3 for antibody 9182 (IGKV1-9)
QQLDSYPMYT

SEQ ID NO: 18364 - protein, 9 aa, Homo sapiens
  Heavy chain CDR3 for antibody 9182 (IGHV1-18)
ARGKDWFDP

SEQ ID NO: 18365 - protein, 10 aa, Homo sapiens
  Light chain CDR3 for antibody 9183 (IGKV1-39)
QQSYSTPMYT

SEQ ID NO: 18366 - protein, 15 aa, Homo sapiens
  Heavy chain CDR3 for antibody 9183 (IGHV1-46)
ARGAVDDYYYYGMDV

SEQ ID NO: 18367 - protein, 9 aa, Homo sapiens
  Light chain CDR3 for antibody 9184 (IGKV3-15)
QQYNNWPLT

SEQ ID NO: 18368 - protein, 10 aa, Homo sapiens
  Heavy chain CDR3 for antibody 9184 (IGHV4-39)
ARQLGNWFDP

SEQ ID NO: 18369 - protein, 9 aa, Homo sapiens
  Light chain CDR3 for antibody 9185 (IGKV1-27)
QKYNSAPYT

SEQ ID NO: 18370 - protein, 15 aa, Homo sapiens
  Heavy chain CDR3 for antibody 9185 (IGHV3-66)
ARDRDYYYYYYGMDV

SEQ ID NO: 18371 - protein, 9 aa, Homo sapiens
  Light chain CDR3 for antibody 9186 (IGKV3D-7)
QQDYNLPLT

SEQ ID NO: 18372 - protein, 16 aa, Homo sapiens
  Heavy chain CDR3 for antibody 9186 (IGHV3-33)
ARDKNTDYDILTGFDY

SEQ ID NO: 18373 - protein, 9 aa, Homo sapiens
  Light chain CDR3 for antibody 9187 (IGKV5-2)
LQHDNFPWT

SEQ ID NO: 18374 - protein, 18 aa, Homo sapiens
  Heavy chain CDR3 for antibody 9187 (IGHV1-24)
ATGLRYFDWPIISNLFDY

SEQ ID NO: 18375 - protein, 9 aa, Homo sapiens
  Light chain CDR3 for antibody 9188 (IGKV2-30)
MQGTHWPLT

SEQ ID NO: 18376 - protein, 11 aa, Homo sapiens
  Heavy chain CDR3 for antibody 9188 (IGHV3-23)
ARDPGSITGDY

SEQ ID NO: 18377 - protein, 8 aa, Homo sapiens
  Light chain CDR3 for antibody 9189 (IGKV1D-13)
QQFNNYYT

SEQ ID NO: 18378 - protein, 6 aa, Homo sapiens
  Heavy chain CDR3 for antibody 9189 (IGHV1-8)
AREGTY

SEQ ID NO: 18379 - protein, 9 aa, Homo sapiens
  Light chain CDR3 for antibody 9190 (IGKV3D-7)
QQLKSYLYT

SEQ ID NO: 18380 - protein, 11 aa, Homo sapiens
  Heavy chain CDR3 for antibody 9190 (IGHV3-33)
ARDKSSGWSDY

SEQ ID NO: 18381 - protein, 10 aa, Homo sapiens
  Light chain CDR3 for antibody 9191 (IGKV3-11)
QQRSNWLMYT

SEQ ID NO: 18382 - protein, 14 aa, Homo sapiens
  Heavy chain CDR3 for antibody 9191 (IGHV3-23)
AKSRIVGALYYFDY

SEQ ID NO: 18383 - protein, 9 aa, Homo sapiens
  Light chain CDR3 for antibody 9192 (IGKV5-2)
LQHDNFPWT

SEQ ID NO: 18384 - protein, 10 aa, Homo sapiens
  Heavy chain CDR3 for antibody 9192 (IGHV3-33)
ARDYGDYFDY

SEQ ID NO: 18385 - protein, 9 aa, Homo sapiens
  Light chain CDR3 for antibody 9193 (IGKV1-17)
LQHNSYPLT

SEQ ID NO: 18386 - protein, 12 aa, Homo sapiens
  Heavy chain CDR3 for antibody 9193 (IGHV1-18)
ARVGPLTGAFDY

SEQ ID NO: 18387 - protein, 8 aa, Homo sapiens
  Light chain CDR3 for antibody 9194 (IGKV1-5)
QQYNSYYT

SEQ ID NO: 18388 - protein, 15 aa, Homo sapiens
  Heavy chain CDR3 for antibody 9194 (IGHV3-23)
AKEALRYFDWSGMDV

SEQ ID NO: 18389 - protein, 9 aa, Homo sapiens
  Light chain CDR3 for antibody 9195 (IGKV1-6)
LQDFHYPWT

SEQ ID NO: 18390 - protein, 12 aa, Homo sapiens
  Heavy chain CDR3 for antibody 9195 (IGHV3-23)
AKDGWFGESLDY

SEQ ID NO: 18391 - protein, 9 aa, Homo sapiens
  Light chain CDR3 for antibody 9196 (IGKV3-15)
QQYNNWPRT

SEQ ID NO: 18392 - protein, 11 aa, Homo sapiens
  Heavy chain CDR3 for antibody 9196 (IGHV3-33)
ARDKSSGWSDY

SEQ ID NO: 18393 - protein, 9 aa, Homo sapiens
  Light chain CDR3 for antibody 9197 (IGKV3D-7)
QQDYNLPRT

SEQ ID NO: 18394 - protein, 9 aa, Homo sapiens
  Heavy chain CDR3 for antibody 9197 (IGHV3-33)
ARDYFHYDY

SEQ ID NO: 18395 - protein, 9 aa, Homo sapiens
  Light chain CDR3 for antibody 9198 (IGKV1-39)
QQSYRTPLT

SEQ ID NO: 18396 - protein, 10 aa, Homo sapiens
  Heavy chain CDR3 for antibody 9198 (IGHV3-72)
CRDREGFGDV

SEQ ID NO: 18397 - protein, 9 aa, Homo sapiens
  Light chain CDR3 for antibody 9199 (IGKV1-6)
QQYNSYPIT

SEQ ID NO: 18398 - protein, 13 aa, Homo sapiens
  Heavy chain CDR3 for antibody 9199 (IGHV3-23)
ASTGDSSYYGMDV

SEQ ID NO: 18399 - protein, 9 aa, Homo sapiens
  Light chain CDR3 for antibody 9200 (IGKV2D-28)
MQVLQTPYT

SEQ ID NO: 18400 - protein, 11 aa, Homo sapiens
  Heavy chain CDR3 for antibody 9200 (IGHV3-33)
AREAANWGFDY

SEQ ID NO: 18401 - protein, 10 aa, Homo sapiens
  Light chain CDR3 for antibody 9201 (IGKV3-11)
QQRSNWPIFT

SEQ ID NO: 18402 - protein, 17 aa, Homo sapiens
  Heavy chain CDR3 for antibody 9201 (IGHV3-30)
ARDGVGATSYYYYGMDV

SEQ ID NO: 18403 - protein, 9 aa, Homo sapiens
  Light chain CDR3 for antibody 9202 (IGKV2-30)
MQGTHWPLT

SEQ ID NO: 18404 - protein, 17 aa, Homo sapiens
  Heavy chain CDR3 for antibody 9202 (IGHV3-21)
AKGNYGSGSYYNGDFQH

SEQ ID NO: 18405 - protein, 10 aa, Homo sapiens
  Light chain CDR3 for antibody 9203 (IGKV1-17)
QQYNNWPPYT

SEQ ID NO: 18406 - protein, 17 aa, Homo sapiens
  Heavy chain CDR3 for antibody 9203 (IGHV1-24)
AGLRFFDWLFDYYGMDV

SEQ ID NO: 18407 - protein, 9 aa, Homo sapiens
  Light chain CDR3 for antibody 9204 (IGKV1-16)
QQYKSYPYT

SEQ ID NO: 18408 - protein, 13 aa, Homo sapiens
  Heavy chain CDR3 for antibody 9204 (IGHV1-46)
ARDAEYSSSWFDY

SEQ ID NO: 18409 - protein, 9 aa, Homo sapiens
  Light chain CDR3 for antibody 9205 (IGKV1-6)
LQDYKSPFT

SEQ ID NO: 18410 - protein, 14 aa, Homo sapiens
  Heavy chain CDR3 for antibody 9205 (IGHV3-23)
AKDRYRGYEGLFDY

SEQ ID NO: 18411 - protein, 9 aa, Homo sapiens
  Light chain CDR3 for antibody 9206 (IGKV3-15)
QQYNNWPLT

SEQ ID NO: 18412 - protein, 14 aa, Homo sapiens
  Heavy chain CDR3 for antibody 9206 (IGHV4-39)
ARQGGWYLYWYFDL

SEQ ID NO: 18413 - protein, 9 aa, Homo sapiens
  Light chain CDR3 for antibody 9207 (IGKV1D-16)
QQYNSFPLT

SEQ ID NO: 18414 - protein, 12 aa, Homo sapiens
  Heavy chain CDR3 for antibody 9207 (IGHV4-39)
ARQGAYSRFFDY

SEQ ID NO: 18415 - protein, 9 aa, Homo sapiens
  Light chain CDR3 for antibody 9208 (IGKV1-39)
QQSYSTPFT

SEQ ID NO: 18416 - protein, 19 aa, Homo sapiens
  Heavy chain CDR3 for antibody 9208 (IGHV4-59)
ARDRVVGATTYYYYYGMDV

SEQ ID NO: 18417 - protein, 9 aa, Homo sapiens
  Light chain CDR3 for antibody 9209 (IGKV1-9)
QQLKSYLYT

SEQ ID NO: 18418 - protein, 9 aa, Homo sapiens
  Heavy chain CDR3 for antibody 9209 (IGHV3-30)
ARDYFHYDY

SEQ ID NO: 18419 - protein, 10 aa, Homo sapiens
  Light chain CDR3 for antibody 9210 (IGKV1-39)
QQSYSTPMYT

SEQ ID NO: 18420 - protein, 14 aa, Homo sapiens
  Heavy chain CDR3 for antibody 9210 (IGHV3-33)
ARGGYSGYRYYFDY

SEQ ID NO: 18421 - protein, 9 aa, Homo sapiens
  Light chain CDR3 for antibody 9211 (IGKV1-27)
QKYNSAPYT

SEQ ID NO: 18422 - protein, 22 aa, Homo sapiens
  Heavy chain CDR3 for antibody 9211 (IGHV4-59)
AREINYGSGSYYNEDYYYGMDV

SEQ ID NO: 18423 - protein, 9 aa, Homo sapiens
  Light chain CDR3 for antibody 9212 (IGKV3-11)
QQRSNWPPT

SEQ ID NO: 18424 - protein, 17 aa, Homo sapiens
  Heavy chain CDR3 for antibody 9212 (IGHV3-11)
ARSPYDILTGYSYYFDY

SEQ ID NO: 18425 - protein, 9 aa, Homo sapiens
  Light chain CDR3 for antibody 9213 (IGKV1-39)
QQGFSTPWT

SEQ ID NO: 18426 - protein, 15 aa, Homo sapiens
  Heavy chain CDR3 for antibody 9213 (IGHV4-59)
ARDLGHYYGSVSIDY

SEQ ID NO: 18427 - protein, 9 aa, Homo sapiens
  Light chain CDR3 for antibody 9214 (IGKV1-27)
QKYNSAPYT

SEQ ID NO: 18428 - protein, 13 aa, Homo sapiens
  Heavy chain CDR3 for antibody 9214 (IGHV3-23)
AKDRGYSSTSTAY

SEQ ID NO: 18429 - protein, 9 aa, Homo sapiens
  Light chain CDR3 for antibody 9215 (IGKV1-9)
QQVKSYPYT

SEQ ID NO: 18430 - protein, 12 aa, Homo sapiens
  Heavy chain CDR3 for antibody 9215 (IGHV1-46)
ARGLTGDHASDI

SEQ ID NO: 18431 - protein, 9 aa, Homo sapiens
  Light chain CDR3 for antibody 9216 (IGKV1-6)
QQEYNYPLT

SEQ ID NO: 18432 - protein, 20 aa, Homo sapiens
  Heavy chain CDR3 for antibody 9216 (IGHV3-33)
AREDYYGSGSYYPAYNWFDP

SEQ ID NO: 18433 - protein, 8 aa, Homo sapiens
  Light chain CDR3 for antibody 9217 (IGKV3D-7)
QQDYSLLT

SEQ ID NO: 18434 - protein, 18 aa, Homo sapiens
  Heavy chain CDR3 for antibody 9217 (IGHV4-59)
AREGDYVWGSYRSNWFDP

SEQ ID NO: 18435 - protein, 9 aa, Homo sapiens
  Light chain CDR3 for antibody 9218 (IGKV3-15)
QQYNNWPLT

SEQ ID NO: 18436 - protein, 18 aa, Homo sapiens
  Heavy chain CDR3 for antibody 9218 (IGHV3-33)
ARDQGIVVLPGAPWYFDL

SEQ ID NO: 18437 - protein, 9 aa, Homo sapiens
  Light chain CDR3 for antibody 9219 (IGKV1-39)
QQSYSTPFT

SEQ ID NO: 18438 - protein, 16 aa, Homo sapiens
  Heavy chain CDR3 for antibody 9219 (IGHV3-33)
AREMAGSYYYYYGMDV

SEQ ID NO: 18439 - protein, 9 aa, Homo sapiens
  Light chain CDR3 for antibody 9220 (IGKV1-16)
QHYNDYPFT

SEQ ID NO: 18440 - protein, 12 aa, Homo sapiens
  Heavy chain CDR3 for antibody 9220 (IGHV3-33)
ARDPGYYYGLDV

SEQ ID NO: 18441 - protein, 9 aa, Homo sapiens
  Light chain CDR3 for antibody 9221 (IGKV1D-13)
QHFNNYMYT

SEQ ID NO: 18442 - protein, 14 aa, Homo sapiens
  Heavy chain CDR3 for antibody 9221 (IGHV3-33)
ARDKTYPLSYGMDV

SEQ ID NO: 18443 - protein, 10 aa, Homo sapiens
  Light chain CDR3 for antibody 9222 (IGKV1-39)
QQSYSTPMYT

SEQ ID NO: 18444 - protein, 8 aa, Homo sapiens
  Heavy chain CDR3 for antibody 9222 (IGHV3-23)
AKETGNNY

SEQ ID NO: 18445 - protein, 11 aa, Homo sapiens
  Light chain CDR3 for antibody 9223 (IGKV3-11)
QQRSNWPPTWT

SEQ ID NO: 18446 - protein, 17 aa, Homo sapiens
  Heavy chain CDR3 for antibody 9223 (IGHV3-33)
ARAYYDILTGYSYYFDY

SEQ ID NO: 18447 - protein, 9 aa, Homo sapiens
  Light chain CDR3 for antibody 9224 (IGKV1-27)
QKYNSAPYT

SEQ ID NO: 18448 - protein, 14 aa, Homo sapiens
  Heavy chain CDR3 for antibody 9224 (IGHV1-46)
ARSYYDILTGAFDI

SEQ ID NO: 18449 - protein, 10 aa, Homo sapiens
  Light chain CDR3 for antibody 9225 (IGKV3-20)
QQYGSSPPYT

SEQ ID NO: 18450 - protein, 7 aa, Homo sapiens
  Heavy chain CDR3 for antibody 9225 (IGHV3-33)
ARELVDY

SEQ ID NO: 18451 - protein, 8 aa, Homo sapiens
  Light chain CDR3 for antibody 9226 (IGKV3D-7)
QQDYNLLT

SEQ ID NO: 18452 - protein, 19 aa, Homo sapiens
  Heavy chain CDR3 for antibody 9226 (IGHV3-33)
AREDYYGSGSYYNEDWFDP

SEQ ID NO: 18453 - protein, 9 aa, Homo sapiens
  Light chain CDR3 for antibody 9227 (IGKV1-5)
QQYNSYSYT

SEQ ID NO: 18454 - protein, 13 aa, Homo sapiens
  Heavy chain CDR3 for antibody 9227 (IGHV4-39)
ARRDGSYYGYFDY

SEQ ID NO: 18455 - protein, 9 aa, Homo sapiens
  Light chain CDR3 for antibody 9228 (IGKV2D-28)
MQALQTPPT

SEQ ID NO: 18456 - protein, 18 aa, Homo sapiens
  Heavy chain CDR3 for antibody 9228 (IGHV3-33)
ARGYYGSGNFYKDSGMDV

SEQ ID NO: 18457 - protein, 8 aa, Homo sapiens
  Light chain CDR3 for antibody 9229 (IGKV1D-13)
QQFNNYPT

SEQ ID NO: 18458 - protein, 15 aa, Homo sapiens
  Heavy chain CDR3 for antibody 9229 (IGHV3-74)
ARGSGSHYHYYGMDV

SEQ ID NO: 18459 - protein, 10 aa, Homo sapiens
  Light chain CDR3 for antibody 9230 (IGKV3-20)
QQYGSSPPYT

SEQ ID NO: 18460 - protein, 12 aa, Homo sapiens
  Heavy chain CDR3 for antibody 9230 (IGHV1-24)
ASDWAYYYGMDV

SEQ ID NO: 18461 - protein, 9 aa, Homo sapiens
  Light chain CDR3 for antibody 9231 (IGKV1-16)
QQYNSYPRT

SEQ ID NO: 18462 - protein, 13 aa, Homo sapiens
  Heavy chain CDR3 for antibody 9231 (IGHV4-59)
ARDAGYSSSWLDY

SEQ ID NO: 18463 - protein, 9 aa, Homo sapiens
  Light chain CDR3 for antibody 9232 (IGKV3-11)
QQRSNWMYT

SEQ ID NO: 18464 - protein, 14 aa, Homo sapiens
  Heavy chain CDR3 for antibody 9232 (IGHV3-33)
ARASSESSYWYFDL

SEQ ID NO: 18465 - protein, 8 aa, Homo sapiens
  Light chain CDR3 for antibody 9233 (IGKV3-20)
QQYGSSLT

SEQ ID NO: 18466 - protein, 18 aa, Homo sapiens
  Heavy chain CDR3 for antibody 9233 (IGHV3-33)
ARERGYYGSDIYPAAFDI

SEQ ID NO: 18467 - protein, 10 aa, Homo sapiens
  Light chain CDR3 for antibody 9234 (IGKV1-27)
QKYNSAPMYT

SEQ ID NO: 18468 - protein, 11 aa, Homo sapiens
  Heavy chain CDR3 for antibody 9234 (IGHV3-33)
ARDRVLTPFDY

SEQ ID NO: 18469 - protein, 9 aa, Homo sapiens
  Light chain CDR3 for antibody 9235 (IGKV1D-13)
QQFNNYPST

SEQ ID NO: 18470 - protein, 17 aa, Homo sapiens
  Heavy chain CDR3 for antibody 9235 (IGHV4-59)
ARDRELLWFGEFGGMDV

SEQ ID NO: 18471 - protein, 9 aa, Homo sapiens
  Light chain CDR3 for antibody 9236 (IGKV1-5)
QQYNTYSRT

SEQ ID NO: 18472 - protein, 16 aa, Homo sapiens
  Heavy chain CDR3 for antibody 9236 (IGHV3-33)
ARAVYYGSGSSLIMDV

SEQ ID NO: 18473 - protein, 9 aa, Homo sapiens
  Light chain CDR3 for antibody 9237 (IGKV6-21)
HQSTSLPFT

SEQ ID NO: 18474 - protein, 12 aa, Homo sapiens
  Heavy chain CDR3 for antibody 9237 (IGHV3-33)
ARKGYDMHAFDI

SEQ ID NO: 18475 - protein, 9 aa, Homo sapiens
  Light chain CDR3 for antibody 9238 (IGKV3D-7)
QQDYEFPLT

SEQ ID NO: 18476 - protein, 15 aa, Homo sapiens
  Heavy chain CDR3 for antibody 9238 (IGHV3-30)
ARGAMVRGVDYGMDV

SEQ ID NO: 18477 - protein, 10 aa, Homo sapiens
  Light chain CDR3 for antibody 9239 (IGKV3-11)
QQRSNWPALT

SEQ ID NO: 18478 - protein, 18 aa, Homo sapiens
  Heavy chain CDR3 for antibody 9239 (IGHV3-30)
ARDRHHDILTGYSDAFEI

SEQ ID NO: 18479 - protein, 9 aa, Homo sapiens
  Light chain CDR3 for antibody 9240 (IGKV1-6)
LQDFHYPWT

SEQ ID NO: 18480 - protein, 16 aa, Homo sapiens
  Heavy chain CDR3 for antibody 9240 (IGHV3-33)
ARGDDILTHQYYGVDV

SEQ ID NO: 18481 - protein, 9 aa, Homo sapiens
  Light chain CDR3 for antibody 9241 (IGKV3D-7)
QQDYEFPLT

SEQ ID NO: 18482 - protein, 18 aa, Homo sapiens
  Heavy chain CDR3 for antibody 9241 (IGHV4-59)
ARDGYSGYDYYYYYGMDV

SEQ ID NO: 18483 - protein, 9 aa, Homo sapiens
  Light chain CDR3 for antibody 9242 (IGKV1D-13)
QQFNNYPHT

SEQ ID NO: 18484 - protein, 15 aa, Homo sapiens
  Heavy chain CDR3 for antibody 9242 (IGHV3-64)
ARDGLRYFDWLFPWY

SEQ ID NO: 18485 - protein, 9 aa, Homo sapiens
  Light chain CDR3 for antibody 9243 (IGKV3D-7)
QQDYNLPWT

SEQ ID NO: 18486 - protein, 15 aa, Homo sapiens
  Heavy chain CDR3 for antibody 9243 (IGHV1-18)
ARGYCSSTSCYYLDY

SEQ ID NO: 18487 - protein, 9 aa, Homo sapiens
  Light chain CDR3 for antibody 9244 (IGKV3-20)
QQYSSSIFT

SEQ ID NO: 18488 - protein, 13 aa, Homo sapiens
  Heavy chain CDR3 for antibody 9244 (IGHV4-61)
ASRYSSGWYPFDY

SEQ ID NO: 18489 - protein, 9 aa, Homo sapiens
  Light chain CDR3 for antibody 9245 (IGKV1-17)
LQHNSYPYT

SEQ ID NO: 18490 - protein, 17 aa, Homo sapiens
  Heavy chain CDR3 for antibody 9245 (IGHV3-23)
AKDRDWNDGQYYYGMDV

SEQ ID NO: 18491 - protein, 9 aa, Homo sapiens
  Light chain CDR3 for antibody 9246 (IGKV2D-28)
MQALQTPPT

SEQ ID NO: 18492 - protein, 18 aa, Homo sapiens
  Heavy chain CDR3 for antibody 9246 (IGHV3-33)
ARDRDRYGSGTYPDAIDI

SEQ ID NO: 18493 - protein, 9 aa, Homo sapiens
  Light chain CDR3 for antibody 9247 (IGKV1-37)
QRTYNAPFT

SEQ ID NO: 18494 - protein, 9 aa, Homo sapiens
  Heavy chain CDR3 for antibody 9247 (IGHV3-30)
ARPNWGFDY

SEQ ID NO: 18495 - protein, 9 aa, Homo sapiens
  Light chain CDR3 for antibody 9248 (IGKV1D-16)
QQYGSYPLT

SEQ ID NO: 18496 - protein, 14 aa, Homo sapiens
  Heavy chain CDR3 for antibody 9248 (IGHV3-33)
ARGGYNWNDDWFDP

SEQ ID NO: 18497 - protein, 9 aa, Homo sapiens
  Light chain CDR3 for antibody 9249 (IGKV1-6)
LQDFNYPRT

SEQ ID NO: 18498 - protein, 12 aa, Homo sapiens
  Heavy chain CDR3 for antibody 9249 (IGHV1-18)
ARILFYGDYFDY

SEQ ID NO: 18499 - protein, 10 aa, Homo sapiens
  Light chain CDR3 for antibody 9250 (IGKV3-11)
QQRSNWPPLT

SEQ ID NO: 18500 - protein, 19 aa, Homo sapiens
  Heavy chain CDR3 for antibody 9250 (IGHV1-24)
ATERYKVGATYYYYYGMDV

SEQ ID NO: 18501 - protein, 9 aa, Homo sapiens
  Light chain CDR3 for antibody 9251 (IGKV1-39)
QQSYSTPLT

SEQ ID NO: 18502 - protein, 9 aa, Homo sapiens
  Heavy chain CDR3 for antibody 9251 (IGHV1-8)
ARGPRIMDV

SEQ ID NO: 18503 - protein, 10 aa, Homo sapiens
  Light chain CDR3 for antibody 9252 (IGKV1-39)
QQSYSTPMYT

SEQ ID NO: 18504 - protein, 12 aa, Homo sapiens
  Heavy chain CDR3 for antibody 9252 (IGHV3-33)
ASRDILTGYLGY

SEQ ID NO: 18505 - protein, 9 aa, Homo sapiens
  Light chain CDR3 for antibody 9253 (IGKV3D-7)
QQDYNLPFT

SEQ ID NO: 18506 - protein, 17 aa, Homo sapiens
  Heavy chain CDR3 for antibody 9253 (IGHV3-23)
ARGYCSRTSCYLYYFDY

SEQ ID NO: 18507 - protein, 10 aa, Homo sapiens
  Light chain CDR3 for antibody 9254 (IGKV3-11)
QQRSNWPALA

SEQ ID NO: 18508 - protein, 20 aa, Homo sapiens
  Heavy chain CDR3 for antibody 9254 (IGHV3-33)
AREDYYGSGSYYPAYNWFAP

SEQ ID NO: 18509 - protein, 9 aa, Homo sapiens
  Light chain CDR3 for antibody 9255 (IGKV1-9)
QQYYTYPYT

SEQ ID NO: 18510 - protein, 18 aa, Homo sapiens
  Heavy chain CDR3 for antibody 9255 (IGHV4-59)
AREGHYYTSGGYYKAFDY

SEQ ID NO: 18511 - protein, 10 aa, Homo sapiens
  Light chain CDR3 for antibody 9256 (IGKV1-17)
LQHNSYPMYT

SEQ ID NO: 18512 - protein, 17 aa, Homo sapiens
  Heavy chain CDR3 for antibody 9256 (IGHV3-33)
ARVRGVIEGYYYYGMDV

SEQ ID NO: 18513 - protein, 9 aa, Homo sapiens
  Light chain CDR3 for antibody 9257 (IGKV1-17)
LQHTSYPIT

SEQ ID NO: 18514 - protein, 18 aa, Homo sapiens
  Heavy chain CDR3 for antibody 9257 (IGHV1-18)
ARDPNYYGSGSYYNYFDY

SEQ ID NO: 18515 - protein, 10 aa, Homo sapiens
  Light chain CDR3 for antibody 9258 (IGKV3-11)
QQRSNWPIFT

SEQ ID NO: 18516 - protein, 10 aa, Homo sapiens
  Heavy chain CDR3 for antibody 9258 (IGHV3-23)
VRDVVVYCDY

SEQ ID NO: 18517 - protein, 9 aa, Homo sapiens
  Light chain CDR3 for antibody 9259 (IGKV1-6)
LQDYNYPYT

SEQ ID NO: 18518 - protein, 16 aa, Homo sapiens
  Heavy chain CDR3 for antibody 9259 (IGHV3-30)
AREIEVAGHVYYGMDV

SEQ ID NO: 18519 - protein, 9 aa, Homo sapiens
  Light chain CDR3 for antibody 9260 (IGKV3D-7)
QQDYTLPLT

SEQ ID NO: 18520 - protein, 17 aa, Homo sapiens
  Heavy chain CDR3 for antibody 9260 (IGHV3-33)
ARAYYDILTGYYIHCDY

SEQ ID NO: 18521 - protein, 9 aa, Homo sapiens
  Light chain CDR3 for antibody 9261 (IGKV1D-13)
QQFNNYPHT

SEQ ID NO: 18522 - protein, 16 aa, Homo sapiens
  Heavy chain CDR3 for antibody 9261 (IGHV3-53)
AREPLRYFDWPDAFDI

SEQ ID NO: 18523 - protein, 9 aa, Homo sapiens
  Light chain CDR3 for antibody 9262 (IGKV1-27)
QKYNSAPYT

SEQ ID NO: 18524 - protein, 15 aa, Homo sapiens
  Heavy chain CDR3 for antibody 9262 (IGHV1-46)
ARGAVDDYYYYGMDV

SEQ ID NO: 18525 - protein, 8 aa, Homo sapiens
  Light chain CDR3 for antibody 9263 (IGKV3-20)
QQYGSSLT

SEQ ID NO: 18526 - protein, 16 aa, Homo sapiens
  Heavy chain CDR3 for antibody 9263 (IGHV3-33)
ARNWNDVGDYYYGMDV

SEQ ID NO: 18527 - protein, 9 aa, Homo sapiens
  Light chain CDR3 for antibody 9264 (IGKV2D-28)
MQALQTPPT

SEQ ID NO: 18528 - protein, 15 aa, Homo sapiens
  Heavy chain CDR3 for antibody 9264 (IGHV3-23)
AKDRDYDFLSGPFDY

SEQ ID NO: 18529 - protein, 8 aa, Homo sapiens
  Light chain CDR3 for antibody 9265 (IGKV3-11)
LQRGNWPT

SEQ ID NO: 18530 - protein, 15 aa, Homo sapiens
  Heavy chain CDR3 for antibody 9265 (IGHV3-33)
ARGGTGYYSYWYFDL

SEQ ID NO: 18531 - protein, 10 aa, Homo sapiens
  Light chain CDR3 for antibody 9266 (IGKV3-15)
QQYNNLPPLT

SEQ ID NO: 18532 - protein, 12 aa, Homo sapiens
  Heavy chain CDR3 for antibody 9266 (IGHV3-33)
AREGTGGNWFDP

SEQ ID NO: 18533 - protein, 9 aa, Homo sapiens
  Light chain CDR3 for antibody 9267 (IGKV3D-7)
QQDYNLPYT

SEQ ID NO: 18534 - protein, 10 aa, Homo sapiens
  Heavy chain CDR3 for antibody 9267 (IGHV3-33)
ARVVDTAMAY

SEQ ID NO: 18535 - protein, 9 aa, Homo sapiens
  Light chain CDR3 for antibody 9268 (IGKV5-2)
LQHDNFPWT

SEQ ID NO: 18536 - protein, 17 aa, Homo sapiens
  Heavy chain CDR3 for antibody 9268 (IGHV4-34)
AREDYDILTGYPSYFDY

SEQ ID NO: 18537 - protein, 9 aa, Homo sapiens
  Light chain CDR3 for antibody 9269 (IGKV1-6)
LQDYNYPYT

SEQ ID NO: 18538 - protein, 15 aa, Homo sapiens
  Heavy chain CDR3 for antibody 9269 (IGHV3-33)
ARRVCSGGSCSLLDY

SEQ ID NO: 18539 - protein, 9 aa, Homo sapiens
  Light chain CDR3 for antibody 9270 (IGKV1-16)
QHYNDYPFT

SEQ ID NO: 18540 - protein, 13 aa, Homo sapiens
  Heavy chain CDR3 for antibody 9270 (IGHV3-23)
AREYCSGGSCYDY

SEQ ID NO: 18541 - protein, 9 aa, Homo sapiens
  Light chain CDR3 for antibody 9271 (IGKV1-9)
QQLHIYPWT

SEQ ID NO: 18542 - protein, 11 aa, Homo sapiens
  Heavy chain CDR3 for antibody 9271 (IGHV3-33)
ARDKSSGWSDY

SEQ ID NO: 18543 - protein, 8 aa, Homo sapiens
  Light chain CDR3 for antibody 9272 (IGKV3-11)
LQRGNWPT

SEQ ID NO: 18544 - protein, 13 aa, Homo sapiens
  Heavy chain CDR3 for antibody 9272 (IGHV4-59)
ARTMVRGVAPFDY

SEQ ID NO: 18545 - protein, 10 aa, Homo sapiens
  Light chain CDR3 for antibody 9273 (IGKV3-11)
QQRSNWPMYT

SEQ ID NO: 18546 - protein, 13 aa, Homo sapiens
  Heavy chain CDR3 for antibody 9273 (IGHV4-39)
ARRDGSYYGYFDY

SEQ ID NO: 18547 - protein, 9 aa, Homo sapiens
  Light chain CDR3 for antibody 9274 (IGKV1-27)
QQYNSAPYT

SEQ ID NO: 18548 - protein, 12 aa, Homo sapiens
  Heavy chain CDR3 for antibody 9274 (IGHV1-18)
ARKGIEVGGFDY

SEQ ID NO: 18549 - protein, 9 aa, Homo sapiens
  Light chain CDR3 for antibody 9275 (IGKV4-1)
QQYYTTPYT

SEQ ID NO: 18550 - protein, 13 aa, Homo sapiens
  Heavy chain CDR3 for antibody 9275 (IGHV3-11)
ARDEGYRGYVLDT

SEQ ID NO: 18551 - protein, 8 aa, Homo sapiens
  Light chain CDR3 for antibody 9276 (IGKV6-21)
HQSSSLPT

SEQ ID NO: 18552 - protein, 13 aa, Homo sapiens
  Heavy chain CDR3 for antibody 9276 (IGHV3-33)
ARDQRYSSGWYDY

SEQ ID NO: 18553 - protein, 9 aa, Homo sapiens
  Light chain CDR3 for antibody 9277 (IGKV1D-16)
QQYITYPYT

SEQ ID NO: 18554 - protein, 14 aa, Homo sapiens
  Heavy chain CDR3 for antibody 9277 (IGHV3-33)
ARGAAAGNFYGLDV

SEQ ID NO: 18555 - protein, 9 aa, Homo sapiens
  Light chain CDR3 for antibody 9278 (IGKV1-9)
QQLNSYPYT

SEQ ID NO: 18556 - protein, 16 aa, Homo sapiens
  Heavy chain CDR3 for antibody 9278 (IGHV3-33)
ARELAGSYYYYYGMDV

SEQ ID NO: 18557 - protein, 10 aa, Homo sapiens
  Light chain CDR3 for antibody 9279 (IGKV3-11)
QQRSNWPALT

SEQ ID NO: 18558 - protein, 15 aa, Homo sapiens
  Heavy chain CDR3 for antibody 9279 (IGHV3-74)
ARGSGSHYHYYGMDV

SEQ ID NO: 18559 - protein, 9 aa, Homo sapiens
  Light chain CDR3 for antibody 9280 (IGKV1-33)
QQYYNLPFT

SEQ ID NO: 18560 - protein, 15 aa, Homo sapiens
  Heavy chain CDR3 for antibody 9280 (IGHV3-33)
ARGYYYGSGSFPVDY

SEQ ID NO: 18561 - protein, 8 aa, Homo sapiens
  Light chain CDR3 for antibody 9281 (IGKV3-15)
QQYNNWPT

SEQ ID NO: 18562 - protein, 8 aa, Homo sapiens
  Heavy chain CDR3 for antibody 9281 (IGHV3-23)
AKETGNNY

SEQ ID NO: 18563 - protein, 9 aa, Homo sapiens
  Light chain CDR3 for antibody 9282 (IGKV4-1)
QQYYSTPPT

SEQ ID NO: 18564 - protein, 13 aa, Homo sapiens
  Heavy chain CDR3 for antibody 9282 (IGHV3-33)
AKEDGDYHHYFDY

SEQ ID NO: 18565 - protein, 9 aa, Homo sapiens
  Light chain CDR3 for antibody 9283 (IGKV6-21)
HQTSSLPYT

SEQ ID NO: 18566 - protein, 16 aa, Homo sapiens
  Heavy chain CDR3 for antibody 9283 (IGHV4-59)
ARFYFGSGSYYWYFDL

SEQ ID NO: 18567 - protein, 9 aa, Homo sapiens
  Light chain CDR3 for antibody 9284 (IGKV3D-7)
HQDYNLPWT

SEQ ID NO: 18568 - protein, 18 aa, Homo sapiens
  Heavy chain CDR3 for antibody 9284 (IGHV1-46)
ARDGDYVWGSYRSDWFDP

SEQ ID NO: 18569 - protein, 9 aa, Homo sapiens
  Light chain CDR3 for antibody 9285 (IGKV1-6)
LQDYSYPFT

SEQ ID NO: 18570 - protein, 13 aa, Homo sapiens
  Heavy chain CDR3 for antibody 9285 (IGHV3-23)
ARAFTMGRGVIDY

SEQ ID NO: 18571 - protein, 10 aa, Homo sapiens
  Light chain CDR3 for antibody 9286 (IGKV3-15)
QQYNNWPPYT

SEQ ID NO: 18572 - protein, 12 aa, Homo sapiens
  Heavy chain CDR3 for antibody 9286 (IGHV1-46)
AREDYDIDGMDV

SEQ ID NO: 18573 - protein, 9 aa, Homo sapiens
  Light chain CDR3 for antibody 9287 (IGKV3-20)
QQYGSSPYT

SEQ ID NO: 18574 - protein, 17 aa, Homo sapiens
  Heavy chain CDR3 for antibody 9287 (IGHV3-23)
AKEGSYYGSGSYNWFDP

SEQ ID NO: 18575 - protein, 9 aa, Homo sapiens
  Light chain CDR3 for antibody 9288 (IGKV1-37)
QRTSNAPYT

SEQ ID NO: 18576 - protein, 14 aa, Homo sapiens
  Heavy chain CDR3 for antibody 9288 (IGHV3-33)
ARDRIAAASSDFDC

SEQ ID NO: 18577 - protein, 8 aa, Homo sapiens
  Light chain CDR3 for antibody 9289 (IGKV3-15)
QQYNNWPT

SEQ ID NO: 18578 - protein, 17 aa, Homo sapiens
  Heavy chain CDR3 for antibody 9289 (IGHV3-33)
ARDLIGPLSSSWYPFDY

SEQ ID NO: 18579 - protein, 10 aa, Homo sapiens
  Light chain CDR3 for antibody 9290 (IGKV1-17)
LQHNSYPMYT

SEQ ID NO: 18580 - protein, 12 aa, Homo sapiens
  Heavy chain CDR3 for antibody 9290 (IGHV3-23)
AKDGWFGESLDY

SEQ ID NO: 18581 - protein, 9 aa, Homo sapiens
  Light chain CDR3 for antibody 9291 (IGKV3-20)
QQYGSSPLT

SEQ ID NO: 18582 - protein, 12 aa, Homo sapiens
  Heavy chain CDR3 for antibody 9291 (IGHV1-18)
ARVLFDGAYFAY

SEQ ID NO: 18583 - protein, 10 aa, Homo sapiens
  Light chain CDR3 for antibody 9292 (IGKV3-20)
QQYGRSPPVT

SEQ ID NO: 18584 - protein, 15 aa, Homo sapiens
  Heavy chain CDR3 for antibody 9292 (IGHV3-33)
AREGLRYFHYYGMDV

SEQ ID NO: 18585 - protein, 9 aa, Homo sapiens
  Light chain CDR3 for antibody 9293 (IGKV1D-13)
QQFNNYPHT

SEQ ID NO: 18586 - protein, 18 aa, Homo sapiens
  Heavy chain CDR3 for antibody 9293 (IGHV4-59)
ARDNHYYSSGTYSNWFDP

SEQ ID NO: 18587 - protein, 9 aa, Homo sapiens
  Light chain CDR3 for antibody 9294 (IGKV1-6)
LQDFHYPWT

SEQ ID NO: 18588 - protein, 12 aa, Homo sapiens
  Heavy chain CDR3 for antibody 9294 (IGHV4-59)
ARDRSGWAYFDY

SEQ ID NO: 18589 - protein, 9 aa, Homo sapiens
  Light chain CDR3 for antibody 9295 (IGKV1-9)
QQLHIYPWT

SEQ ID NO: 18590 - protein, 13 aa, Homo sapiens
  Heavy chain CDR3 for antibody 9295 (IGHV4-59)
ARDAGYSSSWFDY

SEQ ID NO: 18591 - protein, 9 aa, Homo sapiens
  Light chain CDR3 for antibody 9296 (IGKV3-20)
QQYGSSPRT

SEQ ID NO: 18592 - protein, 16 aa, Homo sapiens
  Heavy chain CDR3 for antibody 9296 (IGHV1-24)
ATEDSSSYCYYYDMDV

SEQ ID NO: 18593 - protein, 9 aa, Homo sapiens
  Light chain CDR3 for antibody 9297 (IGKV1-6)
LQVYSYPWT

SEQ ID NO: 18594 - protein, 11 aa, Homo sapiens
  Heavy chain CDR3 for antibody 9297 (IGHV4-59)
AREMGHDTFDI

SEQ ID NO: 18595 - protein, 8 aa, Homo sapiens
  Light chain CDR3 for antibody 9298 (IGKV3-15)
QQYNNYPT

SEQ ID NO: 18596 - protein, 13 aa, Homo sapiens
  Heavy chain CDR3 for antibody 9298 (IGHV3-33)
ARDSTLVRGVFPY

SEQ ID NO: 18597 - protein, 10 aa, Homo sapiens
  Light chain CDR3 for antibody 9299 (IGKV1-17)
LQHNSYPMYT

SEQ ID NO: 18598 - protein, 12 aa, Homo sapiens
  Heavy chain CDR3 for antibody 9299 (IGHV3-33)
ARVDAAAPYFDY

SEQ ID NO: 18599 - protein, 11 aa, Homo sapiens
  Light chain CDR3 for antibody 9300 (IGKV3-11)
QQRSNWPPMYT

SEQ ID NO: 18600 - protein, 13 aa, Homo sapiens
  Heavy chain CDR3 for antibody 9300 (IGHV3-33)
ARDWGYSHGYFDY

SEQ ID NO: 18601 - protein, 9 aa, Homo sapiens
  Light chain CDR3 for antibody 9301 (IGKV3D-11)
QQRSNWQYT

SEQ ID NO: 18602 - protein, 15 aa, Homo sapiens
  Heavy chain CDR3 for antibody 9301 (IGHV3-33)
ARDALAVTGTGWFDP

SEQ ID NO: 18603 - protein, 9 aa, Homo sapiens
  Light chain CDR3 for antibody 9302 (IGKV1D-13)
QQFNNYPHT

SEQ ID NO: 18604 - protein, 17 aa, Homo sapiens
  Heavy chain CDR3 for antibody 9302 (IGHV3-23)
AKGDYYGSGSYSTFFDY

SEQ ID NO: 18605 - protein, 9 aa, Homo sapiens
  Light chain CDR3 for antibody 9303 (IGKV3D-7)
QQDYELPLT

SEQ ID NO: 18606 - protein, 12 aa, Homo sapiens
  Heavy chain CDR3 for antibody 9303 (IGHV1-18)
ARVLFDGDYFDY

SEQ ID NO: 18607 - protein, 8 aa, Homo sapiens
  Light chain CDR3 for antibody 9304 (IGKV6-21)
HQSSSLPT

SEQ ID NO: 18608 - protein, 13 aa, Homo sapiens
  Heavy chain CDR3 for antibody 9304 (IGHV3-33)
ARRATLVRGVFDP

SEQ ID NO: 18609 - protein, 9 aa, Homo sapiens
  Light chain CDR3 for antibody 9305 (IGKV1-17)
LQHNTYPLT

SEQ ID NO: 18610 - protein, 10 aa, Homo sapiens
  Heavy chain CDR3 for antibody 9305 (IGHV3-33)
VRDVVVYFDY

SEQ ID NO: 18611 - protein, 8 aa, Homo sapiens
  Light chain CDR3 for antibody 9306 (IGKV3-11)
QQRSNWLT

SEQ ID NO: 18612 - protein, 14 aa, Homo sapiens
  Heavy chain CDR3 for antibody 9306 (IGHV1-46)
ARDGVGAKEGGFDY

SEQ ID NO: 18613 - protein, 9 aa, Homo sapiens
  Light chain CDR3 for antibody 9307 (IGKV1-6)
LQDYNHPFT

SEQ ID NO: 18614 - protein, 16 aa, Homo sapiens
  Heavy chain CDR3 for antibody 9307 (IGHV4-61)
ARGRYFEWLLGDVLDI

SEQ ID NO: 18615 - protein, 9 aa, Homo sapiens
  Light chain CDR3 for antibody 9308 (IGKV1-9)
QQLNSYPWT

SEQ ID NO: 18616 - protein, 18 aa, Homo sapiens
  Heavy chain CDR3 for antibody 9308 (IGHV4-59)
AREGDYVWGSYRPNWFDH

SEQ ID NO: 18617 - protein, 9 aa, Homo sapiens
  Light chain CDR3 for antibody 9309 (IGKV1-9)
QQYITYPYT

SEQ ID NO: 18618 - protein, 11 aa, Homo sapiens
  Heavy chain CDR3 for antibody 9309 (IGHV3-33)
ATERDMVRGDY

SEQ ID NO: 18619 - protein, 6 aa, Homo sapiens
  Light chain CDR3 for antibody 9310 (IGKV3-20)
QQYGST

SEQ ID NO: 18620 - protein, 20 aa, Homo sapiens
  Heavy chain CDR3 for antibody 9310 (IGHV3-33)
AREDYYGSGSYYPAYNWFDP

SEQ ID NO: 18621 - protein, 9 aa, Homo sapiens
  Light chain CDR3 for antibody 9311 (IGKV1-6)
LQDFHYPRT

SEQ ID NO: 18622 - protein, 15 aa, Homo sapiens
  Heavy chain CDR3 for antibody 9311 (IGHV3-23)
AKEALRYFDWSGMDV

SEQ ID NO: 18623 - protein, 10 aa, Homo sapiens
  Light chain CDR3 for antibody 9312 (IGKV3-11)
QQRSNWPPYT

SEQ ID NO: 18624 - protein, 12 aa, Homo sapiens
  Heavy chain CDR3 for antibody 9312 (IGHV3-23)
AKESLYTPTDDY

SEQ ID NO: 18625 - protein, 9 aa, Homo sapiens
  Light chain CDR3 for antibody 9313 (IGKV1-17)
LQHNSYPPT

SEQ ID NO: 18626 - protein, 15 aa, Homo sapiens
  Heavy chain CDR3 for antibody 9313 (IGHV3-33)
ARDSRPEIIGTPFDY

SEQ ID NO: 18627 - protein, 9 aa, Homo sapiens
  Light chain CDR3 for antibody 9314 (IGKV1-39)
QQSYRTPLT

SEQ ID NO: 18628 - protein, 18 aa, Homo sapiens
  Heavy chain CDR3 for antibody 9314 (IGHV3-33)
AREGSYYGSGSVPNWFDP

SEQ ID NO: 18629 - protein, 10 aa, Homo sapiens
  Light chain CDR3 for antibody 9315 (IGKV3-11)
QQRSNWPIWT

SEQ ID NO: 18630 - protein, 14 aa, Homo sapiens
  Heavy chain CDR3 for antibody 9315 (IGHV1-46)
ARKGIVGGFDAFDV

SEQ ID NO: 18631 - protein, 9 aa, Homo sapiens
  Light chain CDR3 for antibody 9316 (IGKV3-11)
QQRINWPWT

SEQ ID NO: 18632 - protein, 14 aa, Homo sapiens
  Heavy chain CDR3 for antibody 9316 (IGHV4-39)
ARHGYYGSSNWLDP

SEQ ID NO: 18633 - protein, 9 aa, Homo sapiens
  Light chain CDR3 for antibody 9317 (IGKV1-17)
LHSNNYPWT

SEQ ID NO: 18634 - protein, 15 aa, Homo sapiens
  Heavy chain CDR3 for antibody 9317 (IGHV3-33)
ARRICSGGSCSLFDY

SEQ ID NO: 18635 - protein, 9 aa, Homo sapiens
  Light chain CDR3 for antibody 9318 (IGKV1-9)
QQLISYQLT

SEQ ID NO: 18636 - protein, 14 aa, Homo sapiens
  Heavy chain CDR3 for antibody 9318 (IGHV3-23)
ASWAYDILTGYLDY

SEQ ID NO: 18637 - protein, 9 aa, Homo sapiens
  Light chain CDR3 for antibody 9319 (IGKV1-9)
QQLHSYPYT

SEQ ID NO: 18638 - protein, 19 aa, Homo sapiens
  Heavy chain CDR3 for antibody 9319 (IGHV3-30)
ARRFSGYSGYDHYYYGMDV

SEQ ID NO: 18639 - protein, 10 aa, Homo sapiens
  Light chain CDR3 for antibody 9320 (IGKV3-20)
QQYGSSPPYT

SEQ ID NO: 18640 - protein, 18 aa, Homo sapiens
  Heavy chain CDR3 for antibody 9320 (IGHV3-23)
ARYHLYFGSGFGSDGMDV

SEQ ID NO: 18641 - protein, 9 aa, Homo sapiens
  Light chain CDR3 for antibody 9321 (IGKV6-21)
HQSSSLPYT

SEQ ID NO: 18642 - protein, 14 aa, Homo sapiens
  Heavy chain CDR3 for antibody 9321 (IGHV3-23)
AKSYDILTGEAFDI

SEQ ID NO: 18643 - protein, 8 aa, Homo sapiens
  Light chain CDR3 for antibody 9322 (IGKV3-20)
QQYGSSRT

SEQ ID NO: 18644 - protein, 11 aa, Homo sapiens
  Heavy chain CDR3 for antibody 9322 (IGHV1-24)
ATELGLYYFDY

SEQ ID NO: 18645 - protein, 9 aa, Homo sapiens
  Light chain CDR3 for antibody 9323 (IGKV1-6)
QQLISYPLT

SEQ ID NO: 18646 - protein, 11 aa, Homo sapiens
  Heavy chain CDR3 for antibody 9323 (IGHV3-33)
ARDILTGFLDH

SEQ ID NO: 18647 - protein, 9 aa, Homo sapiens
  Light chain CDR3 for antibody 9324 (IGKV1-6)
LQDYNHPFT

SEQ ID NO: 18648 - protein, 18 aa, Homo sapiens
  Heavy chain CDR3 for antibody 9324 (IGHV4-59)
AREGDYGWGSYRPNWFDP

SEQ ID NO: 18649 - protein, 9 aa, Homo sapiens
  Light chain CDR3 for antibody 9325 (IGKV1-6)
LQDYNSPYT

SEQ ID NO: 18650 - protein, 14 aa, Homo sapiens
  Heavy chain CDR3 for antibody 9325 (IGHV3-23)
AKEALRYFDWLLDY

SEQ ID NO: 18651 - protein, 10 aa, Homo sapiens
  Light chain CDR3 for antibody 9326 (IGKV3-11)
QQRSNWPIWT

SEQ ID NO: 18652 - protein, 19 aa, Homo sapiens
  Heavy chain CDR3 for antibody 9326 (IGHV3-33)
ARDSGYSGYDYYYYYGMDV

SEQ ID NO: 18653 - protein, 9 aa, Homo sapiens
  Light chain CDR3 for antibody 9327 (IGKV1D-16)
QQYYSYPRT

SEQ ID NO: 18654 - protein, 17 aa, Homo sapiens
  Heavy chain CDR3 for antibody 9327 (IGHV3-23)
AKDYDILTGYSHNWFDP

SEQ ID NO: 18655 - protein, 8 aa, Homo sapiens
  Light chain CDR3 for antibody 9328 (IGKV3-11)
LQRGNWPT

SEQ ID NO: 18656 - protein, 13 aa, Homo sapiens
  Heavy chain CDR3 for antibody 9328 (IGHV4-39)
ARHVLLWFGEFDP

SEQ ID NO: 18657 - protein, 9 aa, Homo sapiens
  Light chain CDR3 for antibody 9329 (IGKV5-2)
LQHDNFPLT

SEQ ID NO: 18658 - protein, 10 aa, Homo sapiens
  Heavy chain CDR3 for antibody 9329 (IGHV4-34)
ARGPTSDVDY

SEQ ID NO: 18659 - protein, 9 aa, Homo sapiens
  Light chain CDR3 for antibody 9330 (IGKV1-27)
QKYNSAPYT

SEQ ID NO: 18660 - protein, 14 aa, Homo sapiens
  Heavy chain CDR3 for antibody 9330 (IGHV1-46)
ARKGIVGAFDAFDI

SEQ ID NO: 18661 - protein, 8 aa, Homo sapiens
  Light chain CDR3 for antibody 9331 (IGKV3D-7)
QQDYNLVT

SEQ ID NO: 18662 - protein, 13 aa, Homo sapiens
  Heavy chain CDR3 for antibody 9331 (IGHV4-39)
ASRYSSGWYPFDY

SEQ ID NO: 18663 - protein, 9 aa, Homo sapiens
  Light chain CDR3 for antibody 9332 (IGKV6-21)
HQSSSLPRT

SEQ ID NO: 18664 - protein, 11 aa, Homo sapiens
  Heavy chain CDR3 for antibody 9332 (IGHV3-33)
ARDILTGYFDY

SEQ ID NO: 18665 - protein, 9 aa, Homo sapiens
  Light chain CDR3 for antibody 9333 (IGKV6-21)
HQSSSLPYT

SEQ ID NO: 18666 - protein, 19 aa, Homo sapiens
  Heavy chain CDR3 for antibody 9333 (IGHV1-18)
ARGGHIGVVTAFHGYGMDV

SEQ ID NO: 18667 - protein, 9 aa, Homo sapiens
  Light chain CDR3 for antibody 9334 (IGKV1-5)
QQYNSYSYT

SEQ ID NO: 18668 - protein, 12 aa, Homo sapiens
  Heavy chain CDR3 for antibody 9334 (IGHV3-33)
ASRDILTGYLGY

SEQ ID NO: 18669 - protein, 9 aa, Homo sapiens
  Light chain CDR3 for antibody 9335 (IGKV1D-16)
QQRSSWPPT

SEQ ID NO: 18670 - protein, 13 aa, Homo sapiens
  Heavy chain CDR3 for antibody 9335 (IGHV3-33)
ARDWGYSHGYFDY

SEQ ID NO: 18671 - protein, 9 aa, Homo sapiens
  Light chain CDR3 for antibody 9336 (IGKV1-17)
LQHNSYPPT

SEQ ID NO: 18672 - protein, 16 aa, Homo sapiens
  Heavy chain CDR3 for antibody 9336 (IGHV4-59)
ARGRYFDWLLGDVFDI

SEQ ID NO: 18673 - protein, 8 aa, Homo sapiens
  Light chain CDR3 for antibody 9337 (IGKV1D-13)
QQFNNYPT

SEQ ID NO: 18674 - protein, 15 aa, Homo sapiens
  Heavy chain CDR3 for antibody 9337 (IGHV3-33)
ARDRYYDILTGYLDY

SEQ ID NO: 18675 - protein, 9 aa, Homo sapiens
  Light chain CDR3 for antibody 9338 (IGKV3D-7)
QQDYTLPRT

SEQ ID NO: 18676 - protein, 11 aa, Homo sapiens
  Heavy chain CDR3 for antibody 9338 (IGHV4-39)
TRDRGLGSFDY

SEQ ID NO: 18677 - protein, 11 aa, Homo sapiens
  Light chain CDR3 for antibody 9339 (IGKV3-11)
QQRSNWPPTWT

SEQ ID NO: 18678 - protein, 8 aa, Homo sapiens
  Heavy chain CDR3 for antibody 9339 (IGHV3-23)
EKSAGEDV

SEQ ID NO: 18679 - protein, 9 aa, Homo sapiens
  Light chain CDR3 for antibody 9340 (IGKV1-16)
QHYNDYPFT

SEQ ID NO: 18680 - protein, 12 aa, Homo sapiens
  Heavy chain CDR3 for antibody 9340 (IGHV4-59)
ARDRSGWAYFDY

SEQ ID NO: 18681 - protein, 8 aa, Homo sapiens
  Light chain CDR3 for antibody 9341 (IGKV3-15)
QQYNNYPT

SEQ ID NO: 18682 - protein, 8 aa, Homo sapiens
  Heavy chain CDR3 for antibody 9341 (IGHV3-23)
AKESLLDY

SEQ ID NO: 18683 - protein, 9 aa, Homo sapiens
  Light chain CDR3 for antibody 9342 (IGKV1-6)
LQDYSYPWT

SEQ ID NO: 18684 - protein, 10 aa, Homo sapiens
  Heavy chain CDR3 for antibody 9342 (IGHV3-33)
ATMTNVTFDY

SEQ ID NO: 18685 - protein, 10 aa, Homo sapiens
  Light chain CDR3 for antibody 9343 (IGKV1-17)
LQHNSYPMYT

SEQ ID NO: 18686 - protein, 17 aa, Homo sapiens
  Heavy chain CDR3 for antibody 9343 (IGHV3-23)
AKEYCSGGSCYVYYFDY

SEQ ID NO: 18687 - protein, 9 aa, Homo sapiens
  Light chain CDR3 for antibody 9344 (IGKV5-2)
LQHDKFPYT

SEQ ID NO: 18688 - protein, 9 aa, Homo sapiens
  Heavy chain CDR3 for antibody 9344 (IGHV3-33)
ASHSSGEDY

SEQ ID NO: 18689 - protein, 8 aa, Homo sapiens
  Light chain CDR3 for antibody 9345 (IGKV3-11)
QQRSNWLT

SEQ ID NO: 18690 - protein, 16 aa, Homo sapiens
  Heavy chain CDR3 for antibody 9345 (IGHV1-24)
ATDWNDRGYYYYGMDV

SEQ ID NO: 18691 - protein, 10 aa, Homo sapiens
  Light chain CDR3 for antibody 9346 (IGKV3-15)
QQYNNWPPLT

SEQ ID NO: 18692 - protein, 12 aa, Homo sapiens
  Heavy chain CDR3 for antibody 9346 (IGHV3-33)
TRGYSSKSYFDY

SEQ ID NO: 18693 - protein, 9 aa, Homo sapiens
  Light chain CDR3 for antibody 9347 (IGKV5-2)
LQHDKFPYT

SEQ ID NO: 18694 - protein, 13 aa, Homo sapiens
  Heavy chain CDR3 for antibody 9347 (IGHV3-23)
AKCIVAAIGGFDY

SEQ ID NO: 18695 - protein, 9 aa, Homo sapiens
  Light chain CDR3 for antibody 9348 (IGKV3D-20)
QQYGYSPLT

SEQ ID NO: 18696 - protein, 13 aa, Homo sapiens
  Heavy chain CDR3 for antibody 9348 (IGHV3-33)
ARGRGYNYGYGDY

SEQ ID NO: 18697 - protein, 9 aa, Homo sapiens
  Light chain CDR3 for antibody 9349 (IGKV3-20)
QQYGSSPYT

SEQ ID NO: 18698 - protein, 15 aa, Homo sapiens
  Heavy chain CDR3 for antibody 9349 (IGHV3-33)
ARDRGSSGYDRYFDY

SEQ ID NO: 18699 - protein, 9 aa, Homo sapiens
  Light chain CDR3 for antibody 9350 (IGKV3D-20)
QQYGSSPIT

SEQ ID NO: 18700 - protein, 18 aa, Homo sapiens
  Heavy chain CDR3 for antibody 9350 (IGHV1-46)
ARDGDYVWGSYRSNCFDP

SEQ ID NO: 18701 - protein, 9 aa, Homo sapiens
  Light chain CDR3 for antibody 9351 (IGKV1-6)
LQDYSYPWT

SEQ ID NO: 18702 - protein, 18 aa, Homo sapiens
  Heavy chain CDR3 for antibody 9351 (IGHV3-33)
ARDGYSGYDYYYYYGMDV

SEQ ID NO: 18703 - protein, 9 aa, Homo sapiens
  Light chain CDR3 for antibody 9352 (IGKV1D-16)
QQYYSYPRT

SEQ ID NO: 18704 - protein, 18 aa, Homo sapiens
  Heavy chain CDR3 for antibody 9352 (IGHV4-39)
ARQYYFGSGNYYRGWFDP

SEQ ID NO: 18705 - protein, 6 aa, Homo sapiens
  Light chain CDR3 for antibody 9353 (IGKV3-20)
QQYGST

SEQ ID NO: 18706 - protein, 13 aa, Homo sapiens
  Heavy chain CDR3 for antibody 9353 (IGHV3-33)
ARQSSGWFDAFDI

SEQ ID NO: 18707 - protein, 9 aa, Homo sapiens
  Light chain CDR3 for antibody 9354 (IGKV1-6)
LQDYNYPRT

SEQ ID NO: 18708 - protein, 18 aa, Homo sapiens
  Heavy chain CDR3 for antibody 9354 (IGHV3-33)
ARGSYSSGWNDYHYGMDV

SEQ ID NO: 18709 - protein, 9 aa, Homo sapiens
  Light chain CDR3 for antibody 9355 (IGKV5-2)
LQHDKFPYT

SEQ ID NO: 18710 - protein, 13 aa, Homo sapiens
  Heavy chain CDR3 for antibody 9355 (IGHV3-33)
TRTDYYFYYGMDV

SEQ ID NO: 18711 - protein, 10 aa, Homo sapiens
  Light chain CDR3 for antibody 9356 (IGKV3-11)
QQRSNWPIFT

SEQ ID NO: 18712 - protein, 17 aa, Homo sapiens
  Heavy chain CDR3 for antibody 9356 (IGHV1-8)
ARGDYYGSGSPYWYFDL

SEQ ID NO: 18713 - protein, 9 aa, Homo sapiens
  Light chain CDR3 for antibody 9357 (IGKV1-6)
LQDYNHPFT

SEQ ID NO: 18714 - protein, 16 aa, Homo sapiens
  Heavy chain CDR3 for antibody 9357 (IGHV3-33)
ARVYYDILTGYPHFDY

SEQ ID NO: 18715 - protein, 9 aa, Homo sapiens
  Light chain CDR3 for antibody 9358 (IGKV1D-13)
QHFNNYMYT

SEQ ID NO: 18716 - protein, 17 aa, Homo sapiens
  Heavy chain CDR3 for antibody 9358 (IGHV3-33)
ARDWFGELSDYYYGMDV

SEQ ID NO: 18717 - protein, 9 aa, Homo sapiens
  Light chain CDR3 for antibody 9359 (IGKV6-21)
HQSTSLPFT

SEQ ID NO: 18718 - protein, 12 aa, Homo sapiens
  Heavy chain CDR3 for antibody 9359 (IGHV4-39)
ARDSGSYYYFAY

SEQ ID NO: 18719 - protein, 9 aa, Homo sapiens
  Light chain CDR3 for antibody 9360 (IGKV6-21)
HQSSSLPLA

SEQ ID NO: 18720 - protein, 9 aa, Homo sapiens
  Heavy chain CDR3 for antibody 9360 (IGHV3-33)
AREYKEFDY

SEQ ID NO: 18721 - protein, 9 aa, Homo sapiens
  Light chain CDR3 for antibody 9361 (IGKV4-1)
QQYYSTPWT

SEQ ID NO: 18722 - protein, 14 aa, Homo sapiens
  Heavy chain CDR3 for antibody 9361 (IGHV3-33)
ARGGYSGYRYYFDY

SEQ ID NO: 18723 - protein, 9 aa, Homo sapiens
  Light chain CDR3 for antibody 9362 (IGKV1D-16)
QQYAGYPPT

SEQ ID NO: 18724 - protein, 13 aa, Homo sapiens
  Heavy chain CDR3 for antibody 9362 (IGHV4-39)
ARREVVGGRGFDY

SEQ ID NO: 18725 - protein, 9 aa, Homo sapiens
  Light chain CDR3 for antibody 9363 (IGKV1-17)
LHSNNYPWT

SEQ ID NO: 18726 - protein, 13 aa, Homo sapiens
  Heavy chain CDR3 for antibody 9363 (IGHV3-23)
ARAFTMVRGVIDY

SEQ ID NO: 18727 - protein, 9 aa, Homo sapiens
  Light chain CDR3 for antibody 9364 (IGKV5-2)
LQHDNFPYT

SEQ ID NO: 18728 - protein, 15 aa, Homo sapiens
  Heavy chain CDR3 for antibody 9364 (IGHV3-33)
ARDRGSSGYDRYFDY

SEQ ID NO: 18729 - protein, 9 aa, Homo sapiens
  Light chain CDR3 for antibody 9365 (IGKV6-21)
QQSSSLPQT

SEQ ID NO: 18730 - protein, 17 aa, Homo sapiens
  Heavy chain CDR3 for antibody 9365 (IGHV3-33)
ARGYSGYVGYYYYGMDV

SEQ ID NO: 18731 - protein, 7 aa, Homo sapiens
  Light chain CDR3 for antibody 9366 (IGKV1-17)
LQHNSYP

SEQ ID NO: 18732 - protein, 17 aa, Homo sapiens
  Heavy chain CDR3 for antibody 9366 (IGHV1-18)
ARERYYGSGSYKYNMDV

SEQ ID NO: 18733 - protein, 8 aa, Homo sapiens
  Light chain CDR3 for antibody 9367 (IGKV6-21)
HQSSSLPT

SEQ ID NO: 18734 - protein, 20 aa, Homo sapiens
  Heavy chain CDR3 for antibody 9367 (IGHV3-11)
ARGGATLIRGLIDYYYGMDV

SEQ ID NO: 18735 - protein, 9 aa, Homo sapiens
  Light chain CDR3 for antibody 9368 (IGKV1-9)
QQLNSYPWP

SEQ ID NO: 18736 - protein, 15 aa, Homo sapiens
  Heavy chain CDR3 for antibody 9368 (IGHV3-20)
ARDRGSSGWRDWFDP

SEQ ID NO: 18737 - protein, 8 aa, Homo sapiens
  Light chain CDR3 for antibody 9369 (IGKV3-11)
QQRGNWPS

SEQ ID NO: 18738 - protein, 10 aa, Homo sapiens
  Heavy chain CDR3 for antibody 9369 (IGHV3-23)
ATIVGPFLDV

SEQ ID NO: 18739 - protein, 10 aa, Homo sapiens
  Light chain CDR3 for antibody 9370 (IGKV3-20)
QQYGSSPPYT

SEQ ID NO: 18740 - protein, 13 aa, Homo sapiens
  Heavy chain CDR3 for antibody 9370 (IGHV4-59)
ARTMVRGVAPFDY

SEQ ID NO: 18741 - protein, 9 aa, Homo sapiens
  Light chain CDR3 for antibody 9371 (IGKV1-6)
LQDFNYPPT

SEQ ID NO: 18742 - protein, 14 aa, Homo sapiens
  Heavy chain CDR3 for antibody 9371 (IGHV3-33)
ARDGYDILTGPFDY

SEQ ID NO: 18743 - protein, 8 aa, Homo sapiens
  Light chain CDR3 for antibody 9372 (IGKV1-5)
QQYHSYYT

SEQ ID NO: 18744 - protein, 14 aa, Homo sapiens
  Heavy chain CDR3 for antibody 9372 (IGHV1-18)
ARRGIVGALDAFDI

SEQ ID NO: 18745 - protein, 9 aa, Homo sapiens
  Light chain CDR3 for antibody 9373 (IGKV1-6)
LQDYNYPLT

SEQ ID NO: 18746 - protein, 17 aa, Homo sapiens
  Heavy chain CDR3 for antibody 9373 (IGHV3-33)
ARDRGDILTGYSYYFDY

SEQ ID NO: 18747 - protein, 9 aa, Homo sapiens
  Light chain CDR3 for antibody 9374 (IGKV3D-20)
QQYGSSPYT

SEQ ID NO: 18748 - protein, 12 aa, Homo sapiens
  Heavy chain CDR3 for antibody 9374 (IGHV3-66)
VRDRAAAPYFDL

SEQ ID NO: 18749 - protein, 9 aa, Homo sapiens
  Light chain CDR3 for antibody 9375 (IGKV1-6)
LQDYNYPRT

SEQ ID NO: 18750 - protein, 14 aa, Homo sapiens
  Heavy chain CDR3 for antibody 9375 (IGHV4-34)
ARREEDYYYYGLDV

SEQ ID NO: 18751 - protein, 10 aa, Homo sapiens
  Light chain CDR3 for antibody 9376 (IGKV3-11)
QQRSNWPALT

SEQ ID NO: 18752 - protein, 14 aa, Homo sapiens
  Heavy chain CDR3 for antibody 9376 (IGHV3-33)
ARAISGSSYWYFDL

SEQ ID NO: 18753 - protein, 9 aa, Homo sapiens
  Light chain CDR3 for antibody 9377 (IGKV3-15)
QQYNNWPYT

SEQ ID NO: 18754 - protein, 13 aa, Homo sapiens
  Heavy chain CDR3 for antibody 9377 (IGHV4-39)
ARHPPSRDYGMDV

SEQ ID NO: 18755 - protein, 9 aa, Homo sapiens
  Light chain CDR3 for antibody 9378 (IGKV1-6)
LQDYKSPFT

SEQ ID NO: 18756 - protein, 19 aa, Homo sapiens
  Heavy chain CDR3 for antibody 9378 (IGHV3-33)
TRDPHYDILTGYAYYGMDV

SEQ ID NO: 18757 - protein, 8 aa, Homo sapiens
  Light chain CDR3 for antibody 9379 (IGKV3-11)
QQRSNWLT

SEQ ID NO: 18758 - protein, 13 aa, Homo sapiens
  Heavy chain CDR3 for antibody 9379 (IGHV1-8)
ARSITMVRGVIGY

SEQ ID NO: 18759 - protein, 10 aa, Homo sapiens
  Light chain CDR3 for antibody 9380 (IGKV3-15)
QQYNNWPPYT

SEQ ID NO: 18760 - protein, 11 aa, Homo sapiens
  Heavy chain CDR3 for antibody 9380 (IGHV3-74)
ARDRGNWGFDY

SEQ ID NO: 18761 - protein, 9 aa, Homo sapiens
  Light chain CDR3 for antibody 9381 (IGKV1-9)
QQLNSYPRT

SEQ ID NO: 18762 - protein, 15 aa, Homo sapiens
  Heavy chain CDR3 for antibody 9381 (IGHV3-23)
AKEALRYFDWAGMDV

SEQ ID NO: 18763 - protein, 9 aa, Homo sapiens
  Light chain CDR3 for antibody 9382 (IGKV1-17)
LQYNNYPWT

SEQ ID NO: 18764 - protein, 14 aa, Homo sapiens
  Heavy chain CDR3 for antibody 9382 (IGHV3-33)
ARDRIAAASSDFDC

SEQ ID NO: 18765 - protein, 8 aa, Homo sapiens
  Light chain CDR3 for antibody 9383 (IGKV3-11)
LQRGNWPT

SEQ ID NO: 18766 - protein, 16 aa, Homo sapiens
  Heavy chain CDR3 for antibody 9383 (IGHV4-39)
ARDTPYYSGSGRPFDY

SEQ ID NO: 18767 - protein, 9 aa, Homo sapiens
  Light chain CDR3 for antibody 9384 (IGKV1-9)
QQYNTYSRT

SEQ ID NO: 18768 - protein, 9 aa, Homo sapiens
  Heavy chain CDR3 for antibody 9384 (IGHV3-13)
ARDRWYFDL

SEQ ID NO: 18769 - protein, 9 aa, Homo sapiens
  Light chain CDR3 for antibody 9385 (IGKV1D-13)
QQFNNYPST

SEQ ID NO: 18770 - protein, 11 aa, Homo sapiens
  Heavy chain CDR3 for antibody 9385 (IGHV3-23)
ARDPGSIPGDY

SEQ ID NO: 18771 - protein, 9 aa, Homo sapiens
  Light chain CDR3 for antibody 9386 (IGKV1D-16)
QQYHSYPYT

SEQ ID NO: 18772 - protein, 17 aa, Homo sapiens
  Heavy chain CDR3 for antibody 9386 (IGHV3-33)
ARVYYDMLTGYSPALDI

SEQ ID NO: 18773 - protein, 11 aa, Homo sapiens
  Light chain CDR3 for antibody 9387 (IGKV3-11)
QQRSNWPPMYT

SEQ ID NO: 18774 - protein, 16 aa, Homo sapiens
  Heavy chain CDR3 for antibody 9387 (IGHV4-59)
ARDIPYYSGSGRPFDH

SEQ ID NO: 18775 - protein, 9 aa, Homo sapiens
  Light chain CDR3 for antibody 9388 (IGKV1-6)
LQDYKSPFT

SEQ ID NO: 18776 - protein, 11 aa, Homo sapiens
  Heavy chain CDR3 for antibody 9388 (IGHV4-4)
AREAYYYGLDV

SEQ ID NO: 18777 - protein, 8 aa, Homo sapiens
  Light chain CDR3 for antibody 9389 (IGKV3-11)
LQRGNWPT

SEQ ID NO: 18778 - protein, 19 aa, Homo sapiens
  Heavy chain CDR3 for antibody 9389 (IGHV3-33)
ARRRDDILTGWDYYFGMDV

SEQ ID NO: 18779 - protein, 9 aa, Homo sapiens
  Light chain CDR3 for antibody 9390 (IGKV1-6)
QQEYNYPLT

SEQ ID NO: 18780 - protein, 18 aa, Homo sapiens
  Heavy chain CDR3 for antibody 9390 (IGHV1-18)
ARDRYYYDSGSYYYGMDV

SEQ ID NO: 18781 - protein, 9 aa, Homo sapiens
  Light chain CDR3 for antibody 9391 (IGKV1-9)
QQYNTYSRT

SEQ ID NO: 18782 - protein, 18 aa, Homo sapiens
  Heavy chain CDR3 for antibody 9391 (IGHV3-33)
ARDGYSGYDYYYYYGMDV

SEQ ID NO: 18783 - protein, 11 aa, Homo sapiens
  Light chain CDR3 for antibody 9392 (IGKV3-11)
QQRSNWPPMYT

SEQ ID NO: 18784 - protein, 13 aa, Homo sapiens
  Heavy chain CDR3 for antibody 9392 (IGHV4-39)
ARERGIAAAGPDY

SEQ ID NO: 18785 - protein, 8 aa, Homo sapiens
  Light chain CDR3 for antibody 9393 (IGKV3D-7)
QQDYNLLT

SEQ ID NO: 18786 - protein, 8 aa, Homo sapiens
  Heavy chain CDR3 for antibody 9393 (IGHV3-20)
APHWIFDY

SEQ ID NO: 18787 - protein, 9 aa, Homo sapiens
  Light chain CDR3 for antibody 9394 (IGKV3-15)
QQYNDWPLT

SEQ ID NO: 18788 - protein, 20 aa, Homo sapiens
  Heavy chain CDR3 for antibody 9394 (IGHV1-f)
ATHYDILTGSPYYYYCALDV

SEQ ID NO: 18789 - protein, 9 aa, Homo sapiens
  Light chain CDR3 for antibody 9395 (IGKV1-6)
LQDYKSPFT

SEQ ID NO: 18790 - protein, 17 aa, Homo sapiens
  Heavy chain CDR3 for antibody 9395 (IGHV3-33)
VREGGLLWVGELSLFDY

SEQ ID NO: 18791 - protein, 10 aa, Homo sapiens
  Light chain CDR3 for antibody 9396 (IGKV3-11)
QQRSNWPIFT

SEQ ID NO: 18792 - protein, 17 aa, Homo sapiens
  Heavy chain CDR3 for antibody 9396 (IGHV3-23)
AKEGSSSSWYGGHYFDY

SEQ ID NO: 18793 - protein, 10 aa, Homo sapiens
  Light chain CDR3 for antibody 9397 (IGKV1-39)
QQSYSSPMYT

SEQ ID NO: 18794 - protein, 19 aa, Homo sapiens
  Heavy chain CDR3 for antibody 9397 (IGHV5-51)
ARHGEKGKRITMVRGSLDV

SEQ ID NO: 18795 - protein, 9 aa, Homo sapiens
  Light chain CDR3 for antibody 9398 (IGKV1-6)
LQVYSYPWT

SEQ ID NO: 18796 - protein, 12 aa, Homo sapiens
  Heavy chain CDR3 for antibody 9398 (IGHV1-46)
ARGLTGDHALDI

SEQ ID NO: 18797 - protein, 8 aa, Homo sapiens
  Light chain CDR3 for antibody 9399 (IGKV1-13)
QQYSNWLT

SEQ ID NO: 18798 - protein, 18 aa, Homo sapiens
  Heavy chain CDR3 for antibody 9399 (IGHV1-18)
ARDRYYYDSGSYYYGMDV

SEQ ID NO: 18799 - protein, 9 aa, Homo sapiens
  Light chain CDR3 for antibody 9400 (IGKV1-6)
LQDYNYPYT

SEQ ID NO: 18800 - protein, 18 aa, Homo sapiens
  Heavy chain CDR3 for antibody 9400 (IGHV3-33)
ARERYYYGSGSYYNWFDP

SEQ ID NO: 18801 - protein, 9 aa, Homo sapiens
  Light chain CDR3 for antibody 9401 (IGKV1-6)
LQDFHYPWT

SEQ ID NO: 18802 - protein, 12 aa, Homo sapiens
  Heavy chain CDR3 for antibody 9401 (IGHV3-23)
AKESLYTPTDDY

SEQ ID NO: 18803 - protein, 9 aa, Homo sapiens
  Light chain CDR3 for antibody 9402 (IGKV3-11)
QQRINWPWT

SEQ ID NO: 18804 - protein, 14 aa, Homo sapiens
  Heavy chain CDR3 for antibody 9402 (IGHV4-59)
AKGGSGSYYNWFDP

SEQ ID NO: 18805 - protein, 9 aa, Homo sapiens
  Light chain CDR3 for antibody 9403 (IGKV6-21)
HQSSSLPYT

SEQ ID NO: 18806 - protein, 13 aa, Homo sapiens
  Heavy chain CDR3 for antibody 9403 (IGHV3-33)
ARGELLWFGEFAC

SEQ ID NO: 18807 - protein, 9 aa, Homo sapiens
  Light chain CDR3 for antibody 9404 (IGKV1D-13)
QQFNNYPYT

SEQ ID NO: 18808 - protein, 13 aa, Homo sapiens
  Heavy chain CDR3 for antibody 9404 (IGHV3-33)
ARDPLYSGSYFDY

SEQ ID NO: 18809 - protein, 9 aa, Homo sapiens
  Light chain CDR3 for antibody 9405 (IGKV5-2)
LQHDKFPYT

SEQ ID NO: 18810 - protein, 11 aa, Homo sapiens
  Heavy chain CDR3 for antibody 9405 (IGHV4-59)
AREMGHDIFDI

SEQ ID NO: 18811 - protein, 10 aa, Homo sapiens
  Light chain CDR3 for antibody 9406 (IGKV1-16)
LQDYNYPMYT

SEQ ID NO: 18812 - protein, 10 aa, Homo sapiens
  Heavy chain CDR3 for antibody 9406 (IGHV3-23)
AKGDRWRFDP

SEQ ID NO: 18813 - protein, 11 aa, Homo sapiens
  Light chain CDR3 for antibody 9407 (IGKV3-11)
QQRSNWPPTWT

SEQ ID NO: 18814 - protein, 11 aa, Homo sapiens
  Heavy chain CDR3 for antibody 9407 (IGHV3-33)
ARDKSSGWSDY

SEQ ID NO: 18815 - protein, 9 aa, Homo sapiens
  Light chain CDR3 for antibody 9408 (IGKV3-15)
QQYHNWPRT

SEQ ID NO: 18816 - protein, 13 aa, Homo sapiens
  Heavy chain CDR3 for antibody 9408 (IGHV3-33)
ARDYTMVRGVMNY

SEQ ID NO: 18817 - protein, 9 aa, Homo sapiens
  Light chain CDR3 for antibody 9409 (IGKV1-9)
QQLNSYPYT

SEQ ID NO: 18818 - protein, 12 aa, Homo sapiens
  Heavy chain CDR3 for antibody 9409 (IGHV3-33)
ARGRGYSYGYDY

SEQ ID NO: 18819 - protein, 8 aa, Homo sapiens
  Light chain CDR3 for antibody 9410 (IGKV6-21)
HQSSSLPT

SEQ ID NO: 18820 - protein, 15 aa, Homo sapiens
  Heavy chain CDR3 for antibody 9410 (IGHV3-23)
AKDGSYYDYYYGMDV

SEQ ID NO: 18821 - protein, 8 aa, Homo sapiens
  Light chain CDR3 for antibody 9411 (IGKV3-20)
QQYGSSLT

SEQ ID NO: 18822 - protein, 14 aa, Homo sapiens
  Heavy chain CDR3 for antibody 9411 (IGHV1-24)
ATWLPLYYYYGMDV

SEQ ID NO: 18823 - protein, 9 aa, Homo sapiens
  Light chain CDR3 for antibody 9412 (IGKV1-9)
QQLNSYPYT

SEQ ID NO: 18824 - protein, 15 aa, Homo sapiens
  Heavy chain CDR3 for antibody 9412 (IGHV3-33)
ARHYDILTGYGGFDP

SEQ ID NO: 18825 - protein, 9 aa, Homo sapiens
  Light chain CDR3 for antibody 9413 (IGKV6-21)
HQSSTLPST

SEQ ID NO: 18826 - protein, 15 aa, Homo sapiens
  Heavy chain CDR3 for antibody 9413 (IGHV3-21)
ARDSRPEITGPPFDY

SEQ ID NO: 18827 - protein, 9 aa, Homo sapiens
  Light chain CDR3 for antibody 9414 (IGKV5-2)
LQHDKFPYT

SEQ ID NO: 18828 - protein, 12 aa, Homo sapiens
  Heavy chain CDR3 for antibody 9414 (IGHV4-59)
ARDRSGWAYFDY

SEQ ID NO: 18829 - protein, 9 aa, Homo sapiens
  Light chain CDR3 for antibody 9415 (IGKV3-20)
QQYGSSIFT

SEQ ID NO: 18830 - protein, 18 aa, Homo sapiens
  Heavy chain CDR3 for antibody 9415 (IGHV1-46)
ARDGDYVWGSYRSNWFDP

SEQ ID NO: 18831 - protein, 8 aa, Homo sapiens
  Light chain CDR3 for antibody 9416 (IGKV3-20)
QQYGSSLT

SEQ ID NO: 18832 - protein, 9 aa, Homo sapiens
  Heavy chain CDR3 for antibody 9416 (IGHV1-18)
ARGGWGFEY

SEQ ID NO: 18833 - protein, 10 aa, Homo sapiens
  Light chain CDR3 for antibody 9417 (IGKV1-17)
LQHNSYPMYT

SEQ ID NO: 18834 - protein, 13 aa, Homo sapiens
  Heavy chain CDR3 for antibody 9417 (IGHV3-33)
ASAGNSYYNVMDV

SEQ ID NO: 18835 - protein, 8 aa, Homo sapiens
  Light chain CDR3 for antibody 9418 (IGKV3-11)
QQRSNWLT

SEQ ID NO: 18836 - protein, 15 aa, Homo sapiens
  Heavy chain CDR3 for antibody 9418 (IGHV1-46)
ARGRFFDWLLSPFDY

SEQ ID NO: 18837 - protein, 9 aa, Homo sapiens
  Light chain CDR3 for antibody 9419 (IGKV1D-16)
KQYNSYPYT

SEQ ID NO: 18838 - protein, 15 aa, Homo sapiens
  Heavy chain CDR3 for antibody 9419 (IGHV3-33)
AREQGYSGYWGHLDY

SEQ ID NO: 18839 - protein, 9 aa, Homo sapiens
  Light chain CDR3 for antibody 9420 (IGKV1D-16)
QQYAGYPPT

SEQ ID NO: 18840 - protein, 16 aa, Homo sapiens
  Heavy chain CDR3 for antibody 9420 (IGHV3-23)
AKEGMVLRYFDWLWDY

SEQ ID NO: 18841 - protein, 9 aa, Homo sapiens
  Light chain CDR3 for antibody 9421 (IGKV6-21)
HQSSSLPLT

SEQ ID NO: 18842 - protein, 14 aa, Homo sapiens
  Heavy chain CDR3 for antibody 9421 (IGHV3-33)
ARDGYDILPGPFDY

SEQ ID NO: 18843 - protein, 9 aa, Homo sapiens
  Light chain CDR3 for antibody 9422 (IGKV1-27)
QKYNSAPYT

SEQ ID NO: 18844 - protein, 9 aa, Homo sapiens
  Heavy chain CDR3 for antibody 9422 (IGHV3-33)
AANSYGLDY

SEQ ID NO: 18845 - protein, 9 aa, Homo sapiens
  Light chain CDR3 for antibody 9423 (IGKV3D-7)
QQDYNLPLT

SEQ ID NO: 18846 - protein, 12 aa, Homo sapiens
  Heavy chain CDR3 for antibody 9423 (IGHV3-33)
ARDGYSSRNFDY

SEQ ID NO: 18847 - protein, 9 aa, Homo sapiens
  Light chain CDR3 for antibody 9424 (IGKV1-17)
LQHNSYPYT

SEQ ID NO: 18848 - protein, 10 aa, Homo sapiens
  Heavy chain CDR3 for antibody 9424 (IGHV3-33)
ARDYGDYFDY

SEQ ID NO: 18849 - protein, 8 aa, Homo sapiens
  Light chain CDR3 for antibody 9425 (IGKV3D-7)
QQDYNLPT

SEQ ID NO: 18850 - protein, 16 aa, Homo sapiens
  Heavy chain CDR3 for antibody 9425 (IGHV1-24)
ATDWNDRGYYYYGMDV

SEQ ID NO: 18851 - protein, 9 aa, Homo sapiens
  Light chain CDR3 for antibody 9426 (IGKV3-11)
QQRSNWMYT

SEQ ID NO: 18852 - protein, 17 aa, Homo sapiens
  Heavy chain CDR3 for antibody 9426 (IGHV3-33)
ARDRDDILTGFYTYFDY

SEQ ID NO: 18853 - protein, 9 aa, Homo sapiens
  Light chain CDR3 for antibody 9427 (IGKV1-39)
QQSYSTPLT

SEQ ID NO: 18854 - protein, 18 aa, Homo sapiens
  Heavy chain CDR3 for antibody 9427 (IGHV3-33)
AKDGDYFGSGSYWGYFDL

SEQ ID NO: 18855 - protein, 8 aa, Homo sapiens
  Light chain CDR3 for antibody 9428 (IGKV1D-13)
QQFNNYYT

SEQ ID NO: 18856 - protein, 18 aa, Homo sapiens
  Heavy chain CDR3 for antibody 9428 (IGHV1-8)
ARSRIAAAGIYYYYGMDV

SEQ ID NO: 18857 - protein, 10 aa, Homo sapiens
  Light chain CDR3 for antibody 9429 (IGKV1-17)
LQHNSYPMYT

SEQ ID NO: 18858 - protein, 13 aa, Homo sapiens
  Heavy chain CDR3 for antibody 9429 (IGHV1-18)
ARSITMVRGVIGY

SEQ ID NO: 18859 - protein, 9 aa, Homo sapiens
  Light chain CDR3 for antibody 9430 (IGKV2D-28)
MQALQTPWT

SEQ ID NO: 18860 - protein, 10 aa, Homo sapiens
  Heavy chain CDR3 for antibody 9430 (IGHV3-48)
ARDGSGSQPI

SEQ ID NO: 18861 - protein, 9 aa, Homo sapiens
  Light chain CDR3 for antibody 9431 (IGKV2D-28)
MQALQTPWT

SEQ ID NO: 18862 - protein, 12 aa, Homo sapiens
  Heavy chain CDR3 for antibody 9431 (IGHV3-33)
ARGYFGSGYAHF

SEQ ID NO: 18863 - protein, 8 aa, Homo sapiens
  Light chain CDR3 for antibody 9432 (IGKV3-11)
QQRSNWLT

SEQ ID NO: 18864 - protein, 11 aa, Homo sapiens
  Heavy chain CDR3 for antibody 9432 (IGHV1-24)
ATELGLYYFDY

SEQ ID NO: 18865 - protein, 9 aa, Homo sapiens
  Light chain CDR3 for antibody 9433 (IGKV3D-20)
QQYGSSPYT

SEQ ID NO: 18866 - protein, 19 aa, Homo sapiens
  Heavy chain CDR3 for antibody 9433 (IGHV3-33)
ARDKYYDILTGYPWNGMDV

SEQ ID NO: 18867 - protein, 9 aa, Homo sapiens
  Light chain CDR3 for antibody 9434 (IGKV1-16)
QHYNDYPFT

SEQ ID NO: 18868 - protein, 13 aa, Homo sapiens
  Heavy chain CDR3 for antibody 9434 (IGHV3-33)
ANTGDSYYYDMDV

SEQ ID NO: 18869 - protein, 9 aa, Homo sapiens
  Light chain CDR3 for antibody 9435 (IGKV6-21)
HQSSSLPYT

SEQ ID NO: 18870 - protein, 17 aa, Homo sapiens
  Heavy chain CDR3 for antibody 9435 (IGHV3-49)
ARRVTLVRVPIKNWFDP

SEQ ID NO: 18871 - protein, 8 aa, Homo sapiens
  Light chain CDR3 for antibody 9436 (IGKV3-15)
QQYNNYPT

SEQ ID NO: 18872 - protein, 17 aa, Homo sapiens
  Heavy chain CDR3 for antibody 9436 (IGHV3-33)
ARQGVLLWFGELYYFDY

SEQ ID NO: 18873 - protein, 9 aa, Homo sapiens
  Light chain CDR3 for antibody 9437 (IGKV6-21)
QQSSSLPYT

SEQ ID NO: 18874 - protein, 17 aa, Homo sapiens
  Heavy chain CDR3 for antibody 9437 (IGHV3-33)
AREGTMVRGYYYYGMDV

SEQ ID NO: 18875 - protein, 9 aa, Homo sapiens
  Light chain CDR3 for antibody 9438 (IGKV1-9)
QQYNSYPYT

SEQ ID NO: 18876 - protein, 19 aa, Homo sapiens
  Heavy chain CDR3 for antibody 9438 (IGHV3-20)
ARDPPTQALHYYYYYGMDV

SEQ ID NO: 18877 - protein, 9 aa, Homo sapiens
  Light chain CDR3 for antibody 9439 (IGKV1-6)
QQEYNYPLT

SEQ ID NO: 18878 - protein, 19 aa, Homo sapiens
  Heavy chain CDR3 for antibody 9439 (IGHV3-33)
ARDRVVGATTYYYYYGMDV

SEQ ID NO: 18879 - protein, 9 aa, Homo sapiens
  Light chain CDR3 for antibody 9440 (IGKV1-6)
LQDYNYPRT

SEQ ID NO: 18880 - protein, 19 aa, Homo sapiens
  Heavy chain CDR3 for antibody 9440 (IGHV3-30)
ARRLGGYSGYDHYYYGMDV

SEQ ID NO: 18881 - protein, 9 aa, Homo sapiens
  Light chain CDR3 for antibody 9441 (IGKV1D-13)
QRFNNYLYT

SEQ ID NO: 18882 - protein, 18 aa, Homo sapiens
  Heavy chain CDR3 for antibody 9441 (IGHV4-59)
AREGDYVWGSYRSNWFDP

SEQ ID NO: 18883 - protein, 9 aa, Homo sapiens
  Light chain CDR3 for antibody 9442 (IGKV1-9)
QQLHSYPYT

SEQ ID NO: 18884 - protein, 16 aa, Homo sapiens
  Heavy chain CDR3 for antibody 9442 (IGHV1-46)
ARDKNTDYDILTGFDY

SEQ ID NO: 18885 - protein, 9 aa, Homo sapiens
  Light chain CDR3 for antibody 9443 (IGKV3D-7)
QQDYSFPLT

SEQ ID NO: 18886 - protein, 12 aa, Homo sapiens
  Heavy chain CDR3 for antibody 9443 (IGHV3-23)
AKGAVVTAIFDY

SEQ ID NO: 18887 - protein, 9 aa, Homo sapiens
  Light chain CDR3 for antibody 9444 (IGKV1-9)
QQLNTYPYT

SEQ ID NO: 18888 - protein, 20 aa, Homo sapiens
  Heavy chain CDR3 for antibody 9444 (IGHV3-33)
ARDNDSSGYYDYYYYYGMYV

SEQ ID NO: 18889 - protein, 10 aa, Homo sapiens
  Light chain CDR3 for antibody 9445 (IGKV3-20)
QQYGSSPPYT

SEQ ID NO: 18890 - protein, 18 aa, Homo sapiens
  Heavy chain CDR3 for antibody 9445 (IGHV4-59)
ARDNHYYSSGTYSNWFDP

SEQ ID NO: 18891 - protein, 9 aa, Homo sapiens
  Light chain CDR3 for antibody 9446 (IGKV1-9)
QQYNSYPIT

SEQ ID NO: 18892 - protein, 24 aa, Homo sapiens
  Heavy chain CDR3 for antibody 9446 (IGHV1-24)
ATEAHYDILTGYYNPHYYYYGMDV

SEQ ID NO: 18893 - protein, 9 aa, Homo sapiens
  Light chain CDR3 for antibody 9447 (IGKV1-6)
QQEYNYPLT

SEQ ID NO: 18894 - protein, 12 aa, Homo sapiens
  Heavy chain CDR3 for antibody 9447 (IGHV4-39)
ARHPRYLDAFDI

SEQ ID NO: 18895 - protein, 10 aa, Homo sapiens
  Light chain CDR3 for antibody 9448 (IGKV1-6)
LQDYNYPMYT

SEQ ID NO: 18896 - protein, 15 aa, Homo sapiens
  Heavy chain CDR3 for antibody 9448 (IGHV3-33)
ARDTGYSSSWNWFDP

SEQ ID NO: 18897 - protein, 9 aa, Homo sapiens
  Light chain CDR3 for antibody 9449 (IGKV1-17)
LQLNSFPWT

SEQ ID NO: 18898 - protein, 14 aa, Homo sapiens
  Heavy chain CDR3 for antibody 9449 (IGHV3-23)
AKSRIVGALYYCDY

SEQ ID NO: 18899 - protein, 9 aa, Homo sapiens
  Light chain CDR3 for antibody 9450 (IGKV6-21)
HQSTSLPFT

SEQ ID NO: 18900 - protein, 14 aa, Homo sapiens
  Heavy chain CDR3 for antibody 9450 (IGHV4-39)
ARRGVLVPPGGMDV

SEQ ID NO: 18901 - protein, 9 aa, Homo sapiens
  Light chain CDR3 for antibody 9451 (IGKV1-5)
QQYNTYSRT

SEQ ID NO: 18902 - protein, 7 aa, Homo sapiens
  Heavy chain CDR3 for antibody 9451 (IGHV1-46)
AREGGDY

SEQ ID NO: 18903 - protein, 9 aa, Homo sapiens
  Light chain CDR3 for antibody 9452 (IGKV1-39)
QQSYSSPFT

SEQ ID NO: 18904 - protein, 12 aa, Homo sapiens
  Heavy chain CDR3 for antibody 9452 (IGHV1-18)
AREDYDIDGMDV

SEQ ID NO: 18905 - protein, 9 aa, Homo sapiens
  Light chain CDR3 for antibody 9453 (IGKV1-9)
QQLNSYPLT

SEQ ID NO: 18906 - protein, 15 aa, Homo sapiens
  Heavy chain CDR3 for antibody 9453 (IGHV4-59)
ARDAGYSSSWYDFDY

SEQ ID NO: 18907 - protein, 9 aa, Homo sapiens
  Light chain CDR3 for antibody 9454 (IGKV1-17)
LQHNSYPPT

SEQ ID NO: 18908 - protein, 18 aa, Homo sapiens
  Heavy chain CDR3 for antibody 9454 (IGHV1-18)
ARDPTFYYVSGSYYKFDY

SEQ ID NO: 18909 - protein, 10 aa, Homo sapiens
  Light chain CDR3 for antibody 9455 (IGKV3-11)
QQRSDWPPFT

SEQ ID NO: 18910 - protein, 14 aa, Homo sapiens
  Heavy chain CDR3 for antibody 9455 (IGHV3-20)
ARDGGSTSFDWFDP

SEQ ID NO: 18911 - protein, 9 aa, Homo sapiens
  Light chain CDR3 for antibody 9456 (IGKV1D-13)
QQFNNYPRT

SEQ ID NO: 18912 - protein, 16 aa, Homo sapiens
  Heavy chain CDR3 for antibody 9456 (IGHV1-8)
AREGTMVRGVTYAFDI

SEQ ID NO: 18913 - protein, 9 aa, Homo sapiens
  Light chain CDR3 for antibody 9457 (IGKV1-6)
LQDFHYPWT

SEQ ID NO: 18914 - protein, 13 aa, Homo sapiens
  Heavy chain CDR3 for antibody 9457 (IGHV3-23)
ARIDYYYYYGMDV

SEQ ID NO: 18915 - protein, 11 aa, Homo sapiens
  Light chain CDR3 for antibody 9458 (IGKV3-11)
QQRSNWPPMYT

SEQ ID NO: 18916 - protein, 16 aa, Homo sapiens
  Heavy chain CDR3 for antibody 9458 (IGHV3-23)
AKEGEVLRYFDWLFNY

SEQ ID NO: 18917 - protein, 9 aa, Homo sapiens
  Light chain CDR3 for antibody 9459 (IGKV1-9)
QQLNSYPWP

SEQ ID NO: 18918 - protein, 15 aa, Homo sapiens
  Heavy chain CDR3 for antibody 9459 (IGHV3-33)
ARDTGYSSSWNWFDP

SEQ ID NO: 18919 - protein, 9 aa, Homo sapiens
  Light chain CDR3 for antibody 9460 (IGKV2-30)
MQGTHWPLT

SEQ ID NO: 18920 - protein, 14 aa, Homo sapiens
  Heavy chain CDR3 for antibody 9460 (IGHV3-20)
ARGGSSGWYDWFDP

SEQ ID NO: 18921 - protein, 9 aa, Homo sapiens
  Light chain CDR3 for antibody 9461 (IGKV5-2)
LQHDNFPYT

SEQ ID NO: 18922 - protein, 19 aa, Homo sapiens
  Heavy chain CDR3 for antibody 9461 (IGHV3-33)
ARDNDSSGYYDYYYYGMDV

SEQ ID NO: 18923 - protein, 9 aa, Homo sapiens
  Light chain CDR3 for antibody 9462 (IGKV1-39)
QQSYSSPFT

SEQ ID NO: 18924 - protein, 11 aa, Homo sapiens
  Heavy chain CDR3 for antibody 9462 (IGHV3-33)
ARDKSSGWSDY

SEQ ID NO: 18925 - protein, 9 aa, Homo sapiens
  Light chain CDR3 for antibody 9463 (IGKV1-6)
LQDYNYPYT

SEQ ID NO: 18926 - protein, 17 aa, Homo sapiens
  Heavy chain CDR3 for antibody 9463 (IGHV4-59)
AREEDYYGSGSFGTFDI

SEQ ID NO: 18927 - protein, 9 aa, Homo sapiens
  Light chain CDR3 for antibody 9464 (IGKV1-17)
LQHNSYPYT

SEQ ID NO: 18928 - protein, 17 aa, Homo sapiens
  Heavy chain CDR3 for antibody 9464 (IGHV1-18)
ARERYYGSGSYWGYFDP

SEQ ID NO: 18929 - protein, 9 aa, Homo sapiens
  Light chain CDR3 for antibody 9465 (IGKV3D-7)
QQDYNLPWT

SEQ ID NO: 18930 - protein, 12 aa, Homo sapiens
  Heavy chain CDR3 for antibody 9465 (IGHV3-33)
AREDYYYYGMDV

SEQ ID NO: 18931 - protein, 9 aa, Homo sapiens
  Light chain CDR3 for antibody 9466 (IGKV1-39)
QQSYSTPFT

SEQ ID NO: 18932 - protein, 14 aa, Homo sapiens
  Heavy chain CDR3 for antibody 9466 (IGHV3-33)
ARDGYDILTDPMDV

SEQ ID NO: 18933 - protein, 8 aa, Homo sapiens
  Light chain CDR3 for antibody 9467 (IGKV3-20)
QQYGSSLT

SEQ ID NO: 18934 - protein, 21 aa, Homo sapiens
  Heavy chain CDR3 for antibody 9467 (IGHV3-23)
AKDIDYYGSGSYPLYYYGMDV

SEQ ID NO: 18935 - protein, 9 aa, Homo sapiens
  Light chain CDR3 for antibody 9468 (IGKV6-21)
HQSSSLPYT

SEQ ID NO: 18936 - protein, 16 aa, Homo sapiens
  Heavy chain CDR3 for antibody 9468 (IGHV4-59)
AREPLRYFDWPDAFDI

SEQ ID NO: 18937 - protein, 8 aa, Homo sapiens
  Light chain CDR3 for antibody 9469 (IGKV3D-7)
QQDYHLLT

SEQ ID NO: 18938 - protein, 15 aa, Homo sapiens
  Heavy chain CDR3 for antibody 9469 (IGHV1-18)
ARIYYGSGSSYYFDY

SEQ ID NO: 18939 - protein, 9 aa, Homo sapiens
  Light chain CDR3 for antibody 9470 (IGKV5-2)
LQHDKFPYT

SEQ ID NO: 18940 - protein, 19 aa, Homo sapiens
  Heavy chain CDR3 for antibody 9470 (IGHV1-24)
ATAGLQWFGEKVGYYGVDV

SEQ ID NO: 18941 - protein, 9 aa, Homo sapiens
  Light chain CDR3 for antibody 9471 (IGKV1-5)
QQYNTYSRT

SEQ ID NO: 18942 - protein, 20 aa, Homo sapiens
  Heavy chain CDR3 for antibody 9471 (IGHV3-20)
ARDLCSSTSCYGYYYYGMDV

SEQ ID NO: 18943 - protein, 9 aa, Homo sapiens
  Light chain CDR3 for antibody 9472 (IGKV5-2)
LQHDNFPYT

SEQ ID NO: 18944 - protein, 15 aa, Homo sapiens
  Heavy chain CDR3 for antibody 9472 (IGHV3-11)
AREYSSGWYGDAFDI

SEQ ID NO: 18945 - protein, 9 aa, Homo sapiens
  Light chain CDR3 for antibody 9473 (IGKV1-39)
QQSYSTPIT

SEQ ID NO: 18946 - protein, 16 aa, Homo sapiens
  Heavy chain CDR3 for antibody 9473 (IGHV3-23)
AKDGIGELSYYYGMDV

SEQ ID NO: 18947 - protein, 9 aa, Homo sapiens
  Light chain CDR3 for antibody 9474 (IGKV1D-13)
QQYNNYPRT

SEQ ID NO: 18948 - protein, 11 aa, Homo sapiens
  Heavy chain CDR3 for antibody 9474 (IGHV1-46)
AREEDLGAFDI

SEQ ID NO: 18949 - protein, 9 aa, Homo sapiens
  Light chain CDR3 for antibody 9475 (IGKV3-20)
QQYGSSIFT

SEQ ID NO: 18950 - protein, 12 aa, Homo sapiens
  Heavy chain CDR3 for antibody 9475 (IGHV3-33)
ARESGGSYSFDY

SEQ ID NO: 18951 - protein, 9 aa, Homo sapiens
  Light chain CDR3 for antibody 9476 (IGKV1-39)
LQQNSYPYT

SEQ ID NO: 18952 - protein, 15 aa, Homo sapiens
  Heavy chain CDR3 for antibody 9476 (IGHV4-59)
ARDGHGNWGSGTFDY

SEQ ID NO: 18953 - protein, 8 aa, Homo sapiens
  Light chain CDR3 for antibody 9477 (IGKV3-20)
QQYGSSLT

SEQ ID NO: 18954 - protein, 15 aa, Homo sapiens
  Heavy chain CDR3 for antibody 9477 (IGHV3-23)
ARRVCSGGSCSLFDY

SEQ ID NO: 18955 - protein, 10 aa, Homo sapiens
  Light chain CDR3 for antibody 9478 (IGKV1-17)
LQHNSYPMYT

SEQ ID NO: 18956 - protein, 18 aa, Homo sapiens
  Heavy chain CDR3 for antibody 9478 (IGHV6-1)
ARDQYSYGPYYYYYGMDV

SEQ ID NO: 18957 - protein, 10 aa, Homo sapiens
  Light chain CDR3 for antibody 9479 (IGKV3-15)
QQYNNWPPLT

SEQ ID NO: 18958 - protein, 12 aa, Homo sapiens
  Heavy chain CDR3 for antibody 9479 (IGHV3-11)
VRVLLWFGESDY

SEQ ID NO: 18959 - protein, 9 aa, Homo sapiens
  Light chain CDR3 for antibody 9480 (IGKV1-17)
LQHNSYPYT

SEQ ID NO: 18960 - protein, 18 aa, Homo sapiens
  Heavy chain CDR3 for antibody 9480 (IGHV1-46)
ARDLTGRTENYYYDGMDV

SEQ ID NO: 18961 - protein, 10 aa, Homo sapiens
  Light chain CDR3 for antibody 9481 (IGKV3-11)
QQRSNWPALT

SEQ ID NO: 18962 - protein, 11 aa, Homo sapiens
  Heavy chain CDR3 for antibody 9481 (IGHV3-11)
ARASRGSYYDY

SEQ ID NO: 18963 - protein, 9 aa, Homo sapiens
  Light chain CDR3 for antibody 9482 (IGKV3-20)
QQYGTSPFP

SEQ ID NO: 18964 - protein, 19 aa, Homo sapiens
  Heavy chain CDR3 for antibody 9482 (IGHV3-33)
ARDSGYSGYDYYYYYGMDV

SEQ ID NO: 18965 - protein, 9 aa, Homo sapiens
  Light chain CDR3 for antibody 9483 (IGKV3D-7)
QQDYNLPWT

SEQ ID NO: 18966 - protein, 16 aa, Homo sapiens
  Heavy chain CDR3 for antibody 9483 (IGHV3-23)
AKDLRYFDWSLYAFDI

SEQ ID NO: 18967 - protein, 9 aa, Homo sapiens
  Light chain CDR3 for antibody 9484 (IGKV1D-13)
QQFNNYPHT

SEQ ID NO: 18968 - protein, 12 aa, Homo sapiens
  Heavy chain CDR3 for antibody 9484 (IGHV3-33)
ASGYFGSGSAHY

SEQ ID NO: 18969 - protein, 8 aa, Homo sapiens
  Light chain CDR3 for antibody 9485 (IGKV3D-7)
QQDYNLVT

SEQ ID NO: 18970 - protein, 17 aa, Homo sapiens
  Heavy chain CDR3 for antibody 9485 (IGHV4-59)
ARRLTYYYGSGSPSSDY

SEQ ID NO: 18971 - protein, 9 aa, Homo sapiens
  Light chain CDR3 for antibody 9486 (IGKV1-27)
QKYNSAPYT

SEQ ID NO: 18972 - protein, 11 aa, Homo sapiens
  Heavy chain CDR3 for antibody 9486 (IGHV4-4)
AREAYYYGLDV

SEQ ID NO: 18973 - protein, 9 aa, Homo sapiens
  Light chain CDR3 for antibody 9487 (IGKV1-6)
LQDYNHPFT

SEQ ID NO: 18974 - protein, 12 aa, Homo sapiens
  Heavy chain CDR3 for antibody 9487 (IGHV3-33)
ARDLVGATPFDY

SEQ ID NO: 18975 - protein, 9 aa, Homo sapiens
  Light chain CDR3 for antibody 9488 (IGKV1-6)
LQDYTYPYT

SEQ ID NO: 18976 - protein, 22 aa, Homo sapiens
  Heavy chain CDR3 for antibody 9488 (IGHV1-18)
ARDRYNNQSKYRNRDYYYGLDV

SEQ ID NO: 18977 - protein, 9 aa, Homo sapiens
  Light chain CDR3 for antibody 9489 (IGKV1-16)
QHYNDYPFT

SEQ ID NO: 18978 - protein, 15 aa, Homo sapiens
  Heavy chain CDR3 for antibody 9489 (IGHV1-18)
ARRSPNWGHYYGMDV

SEQ ID NO: 18979 - protein, 9 aa, Homo sapiens
  Light chain CDR3 for antibody 9490 (IGKV1D-13)
QRFNNYLYT

SEQ ID NO: 18980 - protein, 13 aa, Homo sapiens
  Heavy chain CDR3 for antibody 9490 (IGHV3-23)
ARAFFMVRGVIDF

SEQ ID NO: 18981 - protein, 9 aa, Homo sapiens
  Light chain CDR3 for antibody 9491 (IGKV1-6)
LQDFHYPWT

SEQ ID NO: 18982 - protein, 18 aa, Homo sapiens
  Heavy chain CDR3 for antibody 9491 (IGHV1-46)
ARDGDYVWGSYRSDWFDH

SEQ ID NO: 18983 - protein, 9 aa, Homo sapiens
  Light chain CDR3 for antibody 9492 (IGKV3-15)
QQYNNWPYT

SEQ ID NO: 18984 - protein, 14 aa, Homo sapiens
  Heavy chain CDR3 for antibody 9492 (IGHV3-20)
ARDRGSSFFDAFDI

SEQ ID NO: 18985 - protein, 9 aa, Homo sapiens
  Light chain CDR3 for antibody 9493 (IGKV4-1)
QQYYTTPPT

SEQ ID NO: 18986 - protein, 16 aa, Homo sapiens
  Heavy chain CDR3 for antibody 9493 (IGHV1-18)
ARYFDWLLRDYYGMDV

SEQ ID NO: 18987 - protein, 9 aa, Homo sapiens
  Light chain CDR3 for antibody 9494 (IGKV3-20)
QQYGTSPFP

SEQ ID NO: 18988 - protein, 12 aa, Homo sapiens
  Heavy chain CDR3 for antibody 9494 (IGHV3-33)
TRGYSSKSYFDY

SEQ ID NO: 18989 - protein, 9 aa, Homo sapiens
  Light chain CDR3 for antibody 9495 (IGKV1-6)
QQEYNYPLT

SEQ ID NO: 18990 - protein, 17 aa, Homo sapiens
  Heavy chain CDR3 for antibody 9495 (IGHV1-18)
ARDRAFTMVRGVPPFDY

SEQ ID NO: 18991 - protein, 9 aa, Homo sapiens
  Light chain CDR3 for antibody 9496 (IGKV1-16)
QQYNSYPRT

SEQ ID NO: 18992 - protein, 21 aa, Homo sapiens
  Heavy chain CDR3 for antibody 9496 (IGHV3-20)
AIETDYDILTGPYYNYYTMDV

SEQ ID NO: 18993 - protein, 9 aa, Homo sapiens
  Light chain CDR3 for antibody 9497 (IGKV5-2)
LQHDNFPWT

SEQ ID NO: 18994 - protein, 15 aa, Homo sapiens
  Heavy chain CDR3 for antibody 9497 (IGHV3-33)
ARRVCSGGSCPLLDY

SEQ ID NO: 18995 - protein, 9 aa, Homo sapiens
  Light chain CDR3 for antibody 9498 (IGKV1-39)
QQSYSTPYT

SEQ ID NO: 18996 - protein, 11 aa, Homo sapiens
  Heavy chain CDR3 for antibody 9498 (IGHV3-23)
AKKVYDYGSDY

SEQ ID NO: 18997 - protein, 9 aa, Homo sapiens
  Light chain CDR3 for antibody 9499 (IGKV1-9)
QQLKSYLYT

SEQ ID NO: 18998 - protein, 11 aa, Homo sapiens
  Heavy chain CDR3 for antibody 9499 (IGHV3-33)
ARDRVLTPFDY

SEQ ID NO: 18999 - protein, 9 aa, Homo sapiens
  Light chain CDR3 for antibody 9500 (IGKV1-17)
LQHNSYPIT

SEQ ID NO: 19000 - protein, 15 aa, Homo sapiens
  Heavy chain CDR3 for antibody 9500 (IGHV4-39)
ARRSKYTSAWYPFDY

SEQ ID NO: 19001 - protein, 9 aa, Homo sapiens
  Light chain CDR3 for antibody 9501 (IGKV1-39)
QQSYSTPLT

SEQ ID NO: 19002 - protein, 9 aa, Homo sapiens
  Heavy chain CDR3 for antibody 9501 (IGHV4-59)
ARSGSGIYT

SEQ ID NO: 19003 - protein, 9 aa, Homo sapiens
  Light chain CDR3 for antibody 9502 (IGKV1-39)
QQSYSTPYT

SEQ ID NO: 19004 - protein, 9 aa, Homo sapiens
  Heavy chain CDR3 for antibody 9502 (IGHV4-59)
ARDYFHFDY

SEQ ID NO: 19005 - protein, 10 aa, Homo sapiens
  Light chain CDR3 for antibody 9503 (IGKV1-9)
QQLDSYPMYT

SEQ ID NO: 19006 - protein, 15 aa, Homo sapiens
  Heavy chain CDR3 for antibody 9503 (IGHV3-33)
ARDRGWKAPGYGMDV

SEQ ID NO: 19007 - protein, 9 aa, Homo sapiens
  Light chain CDR3 for antibody 9504 (IGKV6-21)
HQSYSLPYT

SEQ ID NO: 19008 - protein, 17 aa, Homo sapiens
  Heavy chain CDR3 for antibody 9504 (IGHV3-33)
ARDQDDILTGYYWYFDL

SEQ ID NO: 19009 - protein, 9 aa, Homo sapiens
  Light chain CDR3 for antibody 9505 (IGKV1D-13)
QHFNNYMYT

SEQ ID NO: 19010 - protein, 17 aa, Homo sapiens
  Heavy chain CDR3 for antibody 9505 (IGHV3-33)
ARESLKLGIYYYYGMDV

SEQ ID NO: 19011 - protein, 10 aa, Homo sapiens
  Light chain CDR3 for antibody 9506 (IGKV1-17)
LQHNSYPMYT

SEQ ID NO: 19012 - protein, 11 aa, Homo sapiens
  Heavy chain CDR3 for antibody 9506 (IGHV3-74)
ARDRGNWGFDY

SEQ ID NO: 19013 - protein, 9 aa, Homo sapiens
  Light chain CDR3 for antibody 9507 (IGKV4-1)
QQYYSTPWT

SEQ ID NO: 19014 - protein, 13 aa, Homo sapiens
  Heavy chain CDR3 for antibody 9507 (IGHV3-33)
ARDQRYSSGWYDY

SEQ ID NO: 19015 - protein, 9 aa, Homo sapiens
  Light chain CDR3 for antibody 9508 (IGKV1-27)
QKYNSAPHT

SEQ ID NO: 19016 - protein, 9 aa, Homo sapiens
  Heavy chain CDR3 for antibody 9508 (IGHV3-33)
ARATVGVDY

SEQ ID NO: 19017 - protein, 9 aa, Homo sapiens
  Light chain CDR3 for antibody 9509 (IGKV2-30)
MQGIHWPLT

SEQ ID NO: 19018 - protein, 15 aa, Homo sapiens
  Heavy chain CDR3 for antibody 9509 (IGHV3-64)
ARDGLRYFDWLFPWY

SEQ ID NO: 19019 - protein, 9 aa, Homo sapiens
  Light chain CDR3 for antibody 9510 (IGKV1-17)
LQHNGYPLT

SEQ ID NO: 19020 - protein, 17 aa, Homo sapiens
  Heavy chain CDR3 for antibody 9510 (IGHV1-18)
ARDEGYDILTGYPHFDY

SEQ ID NO: 19021 - protein, 10 aa, Homo sapiens
  Light chain CDR3 for antibody 9511 (IGKV3-15)
QQYNNWPPYT

SEQ ID NO: 19022 - protein, 15 aa, Homo sapiens
  Heavy chain CDR3 for antibody 9511 (IGHV3-33)
ARDSRPEIIGPPFDY

SEQ ID NO: 19023 - protein, 10 aa, Homo sapiens
  Light chain CDR3 for antibody 9512 (IGKV3-11)
QQRSTWPTLI

SEQ ID NO: 19024 - protein, 10 aa, Homo sapiens
  Heavy chain CDR3 for antibody 9512 (IGHV3-74)
ARENWGGFDY

SEQ ID NO: 19025 - protein, 10 aa, Homo sapiens
  Light chain CDR3 for antibody 9513 (IGKV3-15)
QQYNNWPPYT

SEQ ID NO: 19026 - protein, 10 aa, Homo sapiens
  Heavy chain CDR3 for antibody 9513 (IGHV3-33)
AIEWFGGFDI

SEQ ID NO: 19027 - protein, 8 aa, Homo sapiens
  Light chain CDR3 for antibody 9514 (IGKV1D-13)
QQYNSYYT

SEQ ID NO: 19028 - protein, 11 aa, Homo sapiens
  Heavy chain CDR3 for antibody 9514 (IGHV3-23)
GEFSSGWSFDY

SEQ ID NO: 19029 - protein, 9 aa, Homo sapiens
  Light chain CDR3 for antibody 9515 (IGKV1D-16)
QQYNSYPLT

SEQ ID NO: 19030 - protein, 16 aa, Homo sapiens
  Heavy chain CDR3 for antibody 9515 (IGHV3-33)
ARGYYYGSGSSLIMDV

SEQ ID NO: 19031 - protein, 9 aa, Homo sapiens
  Light chain CDR3 for antibody 9516 (IGKV1-16)
QHYNDYPFT

SEQ ID NO: 19032 - protein, 13 aa, Homo sapiens
  Heavy chain CDR3 for antibody 9516 (IGHV3-23)
AKDRGYCSTSTAY

SEQ ID NO: 19033 - protein, 10 aa, Homo sapiens
  Light chain CDR3 for antibody 9517 (IGKV1-17)
LQHNSYPMYT

SEQ ID NO: 19034 - protein, 17 aa, Homo sapiens
  Heavy chain CDR3 for antibody 9517 (IGHV3-33)
ARGGAAAGPYLYYGLDV

SEQ ID NO: 19035 - protein, 9 aa, Homo sapiens
  Light chain CDR3 for antibody 9518 (IGKV1-6)
LQDYNYPRT

SEQ ID NO: 19036 - protein, 15 aa, Homo sapiens
  Heavy chain CDR3 for antibody 9518 (IGHV3-33)
ARGVDILTGYSSFDY

SEQ ID NO: 19037 - protein, 9 aa, Homo sapiens
  Light chain CDR3 for antibody 9519 (IGKV1-6)
LQVYSYPWT

SEQ ID NO: 19038 - protein, 16 aa, Homo sapiens
  Heavy chain CDR3 for antibody 9519 (IGHV3-33)
ARSPYDILTGFYGMDV

SEQ ID NO: 19039 - protein, 10 aa, Homo sapiens
  Light chain CDR3 for antibody 9520 (IGKV1-39)
QQSYSTPMYT

SEQ ID NO: 19040 - protein, 12 aa, Homo sapiens
  Heavy chain CDR3 for antibody 9520 (IGHV4-61)
ARVYSSGWLFDY

SEQ ID NO: 19041 - protein, 9 aa, Homo sapiens
  Light chain CDR3 for antibody 9521 (IGKV1-9)
LQHNSFPLT

SEQ ID NO: 19042 - protein, 15 aa, Homo sapiens
  Heavy chain CDR3 for antibody 9521 (IGHV3-30)
ARGARVRGVDYGMDV

SEQ ID NO: 19043 - protein, 9 aa, Homo sapiens
  Light chain CDR3 for antibody 9522 (IGKV2-30)
MQGTHWPLT

SEQ ID NO: 19044 - protein, 18 aa, Homo sapiens
  Heavy chain CDR3 for antibody 9522 (IGHV3-33)
ARDRHHDILTGYSDAFEI

SEQ ID NO: 19045 - protein, 10 aa, Homo sapiens
  Light chain CDR3 for antibody 9523 (IGKV3-11)
QQRSNWPIFT

SEQ ID NO: 19046 - protein, 14 aa, Homo sapiens
  Heavy chain CDR3 for antibody 9523 (IGHV3-33)
ARDRDIMAPSYFDY

SEQ ID NO: 19047 - protein, 10 aa, Homo sapiens
  Light chain CDR3 for antibody 9524 (IGKV3-11)
QQRSNWPIFT

SEQ ID NO: 19048 - protein, 12 aa, Homo sapiens
  Heavy chain CDR3 for antibody 9524 (IGHV3-h)
AREDYYYYGMDV

SEQ ID NO: 19049 - protein, 9 aa, Homo sapiens
  Light chain CDR3 for antibody 9525 (IGKV1-33)
QQYDNLPFT

SEQ ID NO: 19050 - protein, 17 aa, Homo sapiens
  Heavy chain CDR3 for antibody 9525 (IGHV3-33)
ARGYCSRTSCYLYYFDY

SEQ ID NO: 19051 - protein, 9 aa, Homo sapiens
  Light chain CDR3 for antibody 9526 (IGKV1-39)
QQSYSTPLT

SEQ ID NO: 19052 - protein, 16 aa, Homo sapiens
  Heavy chain CDR3 for antibody 9526 (IGHV2-70)
AHRAVVTSNLNCRFDF

SEQ ID NO: 19053 - protein, 9 aa, Homo sapiens
  Light chain CDR3 for antibody 9527 (IGKV1D-13)
QQFNNYPST

SEQ ID NO: 19054 - protein, 15 aa, Homo sapiens
  Heavy chain CDR3 for antibody 9527 (IGHV3-48)
ARDRVQLGYYYGMDV

SEQ ID NO: 19055 - protein, 9 aa, Homo sapiens
  Light chain CDR3 for antibody 9528 (IGKV5-2)
LQHDNFPYT

SEQ ID NO: 19056 - protein, 20 aa, Homo sapiens
  Heavy chain CDR3 for antibody 9528 (IGHV3-23)
TKDRYSDSSGYYLYYNDMDV

SEQ ID NO: 19057 - protein, 8 aa, Homo sapiens
  Light chain CDR3 for antibody 9529 (IGKV2D-28)
MQALQTPT

SEQ ID NO: 19058 - protein, 21 aa, Homo sapiens
  Heavy chain CDR3 for antibody 9529 (IGHV3-33)
ARKRLYDILTGYYKAYYGMDV

SEQ ID NO: 19059 - protein, 9 aa, Homo sapiens
  Light chain CDR3 for antibody 9530 (IGKV1-27)
QKYNSAPYT

SEQ ID NO: 19060 - protein, 20 aa, Homo sapiens
  Heavy chain CDR3 for antibody 9530 (IGHV3-33)
ARDWMVRGVIITDYYYGMDV

SEQ ID NO: 19061 - protein, 10 aa, Homo sapiens
  Light chain CDR3 for antibody 9531 (IGKV1-39)
QQSYSTPMYT

SEQ ID NO: 19062 - protein, 14 aa, Homo sapiens
  Heavy chain CDR3 for antibody 9531 (IGHV3-33)
ARDLDIMATSPFAY

SEQ ID NO: 19063 - protein, 8 aa, Homo sapiens
  Light chain CDR3 for antibody 9532 (IGKV1-9)
QQYNSYWT

SEQ ID NO: 19064 - protein, 13 aa, Homo sapiens
  Heavy chain CDR3 for antibody 9532 (IGHV4-39)
ARHHYGSGSLRDY

SEQ ID NO: 19065 - protein, 9 aa, Homo sapiens
  Light chain CDR3 for antibody 9533 (IGKV3D-7)
QQDYNLPYS

SEQ ID NO: 19066 - protein, 17 aa, Homo sapiens
  Heavy chain CDR3 for antibody 9533 (IGHV1-18)
ARVRAFTMVRGVPPFDY

SEQ ID NO: 19067 - protein, 9 aa, Homo sapiens
  Light chain CDR3 for antibody 9534 (IGKV1-6)
LQDYKSPFT

SEQ ID NO: 19068 - protein, 14 aa, Homo sapiens
  Heavy chain CDR3 for antibody 9534 (IGHV3-33)
ARDTVAAGFNGMDV

SEQ ID NO: 19069 - protein, 9 aa, Homo sapiens
  Light chain CDR3 for antibody 9535 (IGKV1-17)
LQHNGYPLT

SEQ ID NO: 19070 - protein, 9 aa, Homo sapiens
  Heavy chain CDR3 for antibody 9535 (IGHV3-23)
AKEQLLFDY

SEQ ID NO: 19071 - protein, 9 aa, Homo sapiens
  Light chain CDR3 for antibody 9536 (IGKV1-9)
QQLYTYPYT

SEQ ID NO: 19072 - protein, 12 aa, Homo sapiens
  Heavy chain CDR3 for antibody 9536 (IGHV3-33)
AREEAVAEAFDI

SEQ ID NO: 19073 - protein, 8 aa, Homo sapiens
  Light chain CDR3 for antibody 9537 (IGKV1-5)
QQYNSYYT

SEQ ID NO: 19074 - protein, 18 aa, Homo sapiens
  Heavy chain CDR3 for antibody 9537 (IGHV3-33)
AREGSYYGSGSFPNWFDP

SEQ ID NO: 19075 - protein, 8 aa, Homo sapiens
  Light chain CDR3 for antibody 9538 (IGKV3-11)
LQRGNWPT

SEQ ID NO: 19076 - protein, 17 aa, Homo sapiens
  Heavy chain CDR3 for antibody 9538 (IGHV3-33)
ARVYYDILTGYSPAFDI

SEQ ID NO: 19077 - protein, 9 aa, Homo sapiens
  Light chain CDR3 for antibody 9539 (IGKV2D-28)
MQARQTPPT

SEQ ID NO: 19078 - protein, 12 aa, Homo sapiens
  Heavy chain CDR3 for antibody 9539 (IGHV3-33)
AREGTRWVYFDY

SEQ ID NO: 19079 - protein, 9 aa, Homo sapiens
  Light chain CDR3 for antibody 9540 (IGKV1D-16)
QQYYSYPRT

SEQ ID NO: 19080 - protein, 17 aa, Homo sapiens
  Heavy chain CDR3 for antibody 9540 (IGHV3-23)
SKERNWNDGYYYFGMDA

SEQ ID NO: 19081 - protein, 9 aa, Homo sapiens
  Light chain CDR3 for antibody 9541 (IGKV1-6)
QQEYNYPLT

SEQ ID NO: 19082 - protein, 14 aa, Homo sapiens
  Heavy chain CDR3 for antibody 9541 (IGHV1-46)
ARKGIVGGFDAFDV

SEQ ID NO: 19083 - protein, 9 aa, Homo sapiens
  Light chain CDR3 for antibody 9542 (IGKV1-6)
LQDYNYPYT

SEQ ID NO: 19084 - protein, 18 aa, Homo sapiens
  Heavy chain CDR3 for antibody 9542 (IGHV3-33)
AREDYDILTGYAYYGMDV

SEQ ID NO: 19085 - protein, 9 aa, Homo sapiens
  Light chain CDR3 for antibody 9543 (IGKV1-33)
QQYDNLPFT

SEQ ID NO: 19086 - protein, 14 aa, Homo sapiens
  Heavy chain CDR3 for antibody 9543 (IGHV3-64)
ARDAYDILTGYYDY

SEQ ID NO: 19087 - protein, 8 aa, Homo sapiens
  Light chain CDR3 for antibody 9544 (IGKV3D-7)
QQDYSLLT

SEQ ID NO: 19088 - protein, 15 aa, Homo sapiens
  Heavy chain CDR3 for antibody 9544 (IGHV3-23)
AKEFTMVRGVITPDY

SEQ ID NO: 19089 - protein, 9 aa, Homo sapiens
  Light chain CDR3 for antibody 9545 (IGKV3-15)
QQYNNWPFT

SEQ ID NO: 19090 - protein, 18 aa, Homo sapiens
  Heavy chain CDR3 for antibody 9545 (IGHV1-46)
ARDGDYVWGSYHSDWFDP

SEQ ID NO: 19091 - protein, 9 aa, Homo sapiens
  Light chain CDR3 for antibody 9546 (IGKV1-27)
QKYNSAPYT

SEQ ID NO: 19092 - protein, 14 aa, Homo sapiens
  Heavy chain CDR3 for antibody 9546 (IGHV3-23)
AKGSDVLTGYYPDY

SEQ ID NO: 19093 - protein, 9 aa, Homo sapiens
  Light chain CDR3 for antibody 9547 (IGKV3-11)
QQRSNWMYT

SEQ ID NO: 19094 - protein, 10 aa, Homo sapiens
  Heavy chain CDR3 for antibody 9547 (IGHV3-33)
ARVVDTAMAY

SEQ ID NO: 19095 - protein, 9 aa, Homo sapiens
  Light chain CDR3 for antibody 9548 (IGKV1-39)
QQSYRTPLT

SEQ ID NO: 19096 - protein, 13 aa, Homo sapiens
  Heavy chain CDR3 for antibody 9548 (IGHV4-39)
ARHEVMIRGVFDY

SEQ ID NO: 19097 - protein, 9 aa, Homo sapiens
  Light chain CDR3 for antibody 9549 (IGKV1-9)
QQLNSYPRT

SEQ ID NO: 19098 - protein, 16 aa, Homo sapiens
  Heavy chain CDR3 for antibody 9549 (IGHV4-39)
ARDTPYYAGSGSPFDY

SEQ ID NO: 19099 - protein, 9 aa, Homo sapiens
  Light chain CDR3 for antibody 9550 (IGKV1-9)
QQLNSYPWP

SEQ ID NO: 19100 - protein, 11 aa, Homo sapiens
  Heavy chain CDR3 for antibody 9550 (IGHV4-59)
AREMGHDTFDI

SEQ ID NO: 19101 - protein, 9 aa, Homo sapiens
  Light chain CDR3 for antibody 9551 (IGKV3-15)
QQYSNCPLT

SEQ ID NO: 19102 - protein, 18 aa, Homo sapiens
  Heavy chain CDR3 for antibody 9551 (IGHV3-23)
AKDGDYFGSGSYWGYFDL

SEQ ID NO: 19103 - protein, 9 aa, Homo sapiens
  Light chain CDR3 for antibody 9552 (IGKV1D-16)
QQYNYFPLT

SEQ ID NO: 19104 - protein, 20 aa, Homo sapiens
  Heavy chain CDR3 for antibody 9552 (IGHV4-61)
AREVGIAVAGTRYYYYGMDV

SEQ ID NO: 19105 - protein, 9 aa, Homo sapiens
  Light chain CDR3 for antibody 9553 (IGKV3-20)
QQYGSSPRT

SEQ ID NO: 19106 - protein, 16 aa, Homo sapiens
  Heavy chain CDR3 for antibody 9553 (IGHV1-24)
ATEDSSAYYSYYGMDV

SEQ ID NO: 19107 - protein, 9 aa, Homo sapiens
  Light chain CDR3 for antibody 9554 (IGKV1-16)
QQYSRYPYT

SEQ ID NO: 19108 - protein, 18 aa, Homo sapiens
  Heavy chain CDR3 for antibody 9554 (IGHV4-59)
AREGDYVWGSYRSDWFDH

SEQ ID NO: 19109 - protein, 9 aa, Homo sapiens
  Light chain CDR3 for antibody 9555 (IGKV1D-16)
QQYSSYPYT

SEQ ID NO: 19110 - protein, 13 aa, Homo sapiens
  Heavy chain CDR3 for antibody 9555 (IGHV3-13)
AKDRGYSSASTAY

SEQ ID NO: 19111 - protein, 9 aa, Homo sapiens
  Light chain CDR3 for antibody 9556 (IGKV3-15)
QQYNNWPRT

SEQ ID NO: 19112 - protein, 17 aa, Homo sapiens
  Heavy chain CDR3 for antibody 9556 (IGHV3-33)
AREDYDILTGYPFYFDY

SEQ ID NO: 19113 - protein, 9 aa, Homo sapiens
  Light chain CDR3 for antibody 9557 (IGKV1-37)
QRTYNAPYT

SEQ ID NO: 19114 - protein, 14 aa, Homo sapiens
  Heavy chain CDR3 for antibody 9557 (IGHV3-33)
ARDGYDILTGPFDY

SEQ ID NO: 19115 - protein, 9 aa, Homo sapiens
  Light chain CDR3 for antibody 9558 (IGKV1-16)
QQFNNYPRT

SEQ ID NO: 19116 - protein, 18 aa, Homo sapiens
  Heavy chain CDR3 for antibody 9558 (IGHV3-30)
ARRGVGARGYYYYYGMDV

SEQ ID NO: 19117 - protein, 9 aa, Homo sapiens
  Light chain CDR3 for antibody 9559 (IGKV1-27)
QKYNSAPYT

SEQ ID NO: 19118 - protein, 18 aa, Homo sapiens
  Heavy chain CDR3 for antibody 9559 (IGHV3-23)
AKVGDFFASGNYWDYFDY

SEQ ID NO: 19119 - protein, 9 aa, Homo sapiens
  Light chain CDR3 for antibody 9560 (IGKV1-37)
QRTSNAPYT

SEQ ID NO: 19120 - protein, 15 aa, Homo sapiens
  Heavy chain CDR3 for antibody 9560 (IGHV3-74)
ARGSGSHYHYYGMDV

SEQ ID NO: 19121 - protein, 10 aa, Homo sapiens
  Light chain CDR3 for antibody 9561 (IGKV3-11)
QQRSNWPIFT

SEQ ID NO: 19122 - protein, 9 aa, Homo sapiens
  Heavy chain CDR3 for antibody 9561 (IGHV4-59)
ARGGAGFEY

SEQ ID NO: 19123 - protein, 9 aa, Homo sapiens
  Light chain CDR3 for antibody 9562 (IGKV1-16)
QQYNRYPYT

SEQ ID NO: 19124 - protein, 18 aa, Homo sapiens
  Heavy chain CDR3 for antibody 9562 (IGHV4-59)
AREGDYLWWSYRPNWFDP

SEQ ID NO: 19125 - protein, 9 aa, Homo sapiens
  Light chain CDR3 for antibody 9563 (IGKV1D-13)
QQFNNYQYT

SEQ ID NO: 19126 - protein, 16 aa, Homo sapiens
  Heavy chain CDR3 for antibody 9563 (IGHV3-33)
AKDAFYYGSGSHLFDY

SEQ ID NO: 19127 - protein, 8 aa, Homo sapiens
  Light chain CDR3 for antibody 9564 (IGKV3-20)
QQYGSSLT

SEQ ID NO: 19128 - protein, 20 aa, Homo sapiens
  Heavy chain CDR3 for antibody 9564 (IGHV1-8)
ARGDGTMVRGIYYYYYGMDV

SEQ ID NO: 19129 - protein, 9 aa, Homo sapiens
  Light chain CDR3 for antibody 9565 (IGKV3D-7)
QQDYNLPLT

SEQ ID NO: 19130 - protein, 12 aa, Homo sapiens
  Heavy chain CDR3 for antibody 9565 (IGHV3-33)
VRKWFGELYFDY

SEQ ID NO: 19131 - protein, 9 aa, Homo sapiens
  Light chain CDR3 for antibody 9566 (IGKV1-6)
LQDYNYPWT

SEQ ID NO: 19132 - protein, 14 aa, Homo sapiens
  Heavy chain CDR3 for antibody 9566 (IGHV3-33)
ARDGYDFLAGALDY

SEQ ID NO: 19133 - protein, 10 aa, Homo sapiens
  Light chain CDR3 for antibody 9567 (IGKV1-39)
QQSYSTPMYT

SEQ ID NO: 19134 - protein, 13 aa, Homo sapiens
  Heavy chain CDR3 for antibody 9567 (IGHV3-33)
ARIDYYYYYGMDV

SEQ ID NO: 19135 - protein, 10 aa, Homo sapiens
  Light chain CDR3 for antibody 9568 (IGKV1-39)
QQSYSTPMYT

SEQ ID NO: 19136 - protein, 16 aa, Homo sapiens
  Heavy chain CDR3 for antibody 9568 (IGHV3-23)
AKDLRYFDWSLYAFDI

SEQ ID NO: 19137 - protein, 9 aa, Homo sapiens
  Light chain CDR3 for antibody 9569 (IGKV1-9)
QQLKSYPYT

SEQ ID NO: 19138 - protein, 13 aa, Homo sapiens
  Heavy chain CDR3 for antibody 9569 (IGHV3-33)
AKEDGDYHHYFDY

SEQ ID NO: 19139 - protein, 9 aa, Homo sapiens
  Light chain CDR3 for antibody 9570 (IGKV1-27)
QKYNSAPYT

SEQ ID NO: 19140 - protein, 9 aa, Homo sapiens
  Heavy chain CDR3 for antibody 9570 (IGHV3-33)
ARGSGWSDY

SEQ ID NO: 19141 - protein, 9 aa, Homo sapiens
  Light chain CDR3 for antibody 9571 (IGKV3-11)
QQRSNWMYT

SEQ ID NO: 19142 - protein, 13 aa, Homo sapiens
  Heavy chain CDR3 for antibody 9571 (IGHV4-39)
ARHVLLWFGEFDP

SEQ ID NO: 19143 - protein, 9 aa, Homo sapiens
  Light chain CDR3 for antibody 9572 (IGKV1-16)
QQYDCYPPT

SEQ ID NO: 19144 - protein, 18 aa, Homo sapiens
  Heavy chain CDR3 for antibody 9572 (IGHV1-46)
ARDGDYVWGSYRSDWFDP

SEQ ID NO: 19145 - protein, 8 aa, Homo sapiens
  Light chain CDR3 for antibody 9573 (IGKV1D-13)
QQFNNYPT

SEQ ID NO: 19146 - protein, 18 aa, Homo sapiens
  Heavy chain CDR3 for antibody 9573 (IGHV3-33)
ARDRYYDILTGYSYYFDY

SEQ ID NO: 19147 - protein, 9 aa, Homo sapiens
  Light chain CDR3 for antibody 9574 (IGKV1-9)
QQYYSYPRT

SEQ ID NO: 19148 - protein, 12 aa, Homo sapiens
  Heavy chain CDR3 for antibody 9574 (IGHV3-33)
ARGYFGSGYGHF

SEQ ID NO: 19149 - protein, 9 aa, Homo sapiens
  Light chain CDR3 for antibody 9575 (IGKV1D-16)
QKYNSYPYT

SEQ ID NO: 19150 - protein, 16 aa, Homo sapiens
  Heavy chain CDR3 for antibody 9575 (IGHV3-33)
ARDAGYPNYDYSGMDV

SEQ ID NO: 19151 - protein, 9 aa, Homo sapiens
  Light chain CDR3 for antibody 9576 (IGKV1-27)
QKYNSAPYT

SEQ ID NO: 19152 - protein, 13 aa, Homo sapiens
  Heavy chain CDR3 for antibody 9576 (IGHV3-33)
ANTGDSYYYDMEV

SEQ ID NO: 19153 - protein, 9 aa, Homo sapiens
  Light chain CDR3 for antibody 9577 (IGKV1-33)
QQYDNLPFT

SEQ ID NO: 19154 - protein, 18 aa, Homo sapiens
  Heavy chain CDR3 for antibody 9577 (IGHV3-33)
ARERYYYGSGSYPDAFDI

SEQ ID NO: 19155 - protein, 9 aa, Homo sapiens
  Light chain CDR3 for antibody 9578 (IGKV5-2)
LQHDNFPWT

SEQ ID NO: 19156 - protein, 15 aa, Homo sapiens
  Heavy chain CDR3 for antibody 9578 (IGHV1-18)
ARLRWFGELSGWFDP

SEQ ID NO: 19157 - protein, 9 aa, Homo sapiens
  Light chain CDR3 for antibody 9579 (IGKV1D-16)
QQYGYSPLT

SEQ ID NO: 19158 - protein, 15 aa, Homo sapiens
  Heavy chain CDR3 for antibody 9579 (IGHV3-20)
ARDRGSSGWRGWFDP

SEQ ID NO: 19159 - protein, 9 aa, Homo sapiens
  Light chain CDR3 for antibody 9580 (IGKV1-6)
LQDYDYPWT

SEQ ID NO: 19160 - protein, 13 aa, Homo sapiens
  Heavy chain CDR3 for antibody 9580 (IGHV3-33)
ARDHYYDSSGYDY

SEQ ID NO: 19161 - protein, 10 aa, Homo sapiens
  Light chain CDR3 for antibody 9581 (IGKV1-39)
QQSYSTPMYT

SEQ ID NO: 19162 - protein, 17 aa, Homo sapiens
  Heavy chain CDR3 for antibody 9581 (IGHV3-33)
ARCGYSSSWYAPYYFDY

SEQ ID NO: 19163 - protein, 9 aa, Homo sapiens
  Light chain CDR3 for antibody 9582 (IGKV1-16)
QKYNSAPLT

SEQ ID NO: 19164 - protein, 17 aa, Homo sapiens
  Heavy chain CDR3 for antibody 9582 (IGHV3-33)
ARSPYDILTGYSYYFDY

SEQ ID NO: 19165 - protein, 8 aa, Homo sapiens
  Light chain CDR3 for antibody 9583 (IGKV3D-7)
QQDYNLLT

SEQ ID NO: 19166 - protein, 13 aa, Homo sapiens
  Heavy chain CDR3 for antibody 9583 (IGHV3-33)
ARDGYSYGPYFDY

SEQ ID NO: 19167 - protein, 8 aa, Homo sapiens
  Light chain CDR3 for antibody 9584 (IGKV3-20)
QQYGSSLT

SEQ ID NO: 19168 - protein, 12 aa, Homo sapiens
  Heavy chain CDR3 for antibody 9584 (IGHV3-33)
ARDSSGWSHFDY

SEQ ID NO: 19169 - protein, 9 aa, Homo sapiens
  Light chain CDR3 for antibody 9585 (IGKV3D-20)
QQYAGYPPT

SEQ ID NO: 19170 - protein, 13 aa, Homo sapiens
  Heavy chain CDR3 for antibody 9585 (IGHV4-34)
ASNFYYYYYGMDV

SEQ ID NO: 19171 - protein, 9 aa, Homo sapiens
  Light chain CDR3 for antibody 9586 (IGKV1-37)
QRTSNAPYT

SEQ ID NO: 19172 - protein, 13 aa, Homo sapiens
  Heavy chain CDR3 for antibody 9586 (IGHV3-33)
ARVDTMVRGVMAY

SEQ ID NO: 19173 - protein, 10 aa, Homo sapiens
  Light chain CDR3 for antibody 9587 (IGKV1-39)
QQSYSTPMYT

SEQ ID NO: 19174 - protein, 14 aa, Homo sapiens
  Heavy chain CDR3 for antibody 9587 (IGHV3-33)
AREEDYYYHYDMDV

SEQ ID NO: 19175 - protein, 9 aa, Homo sapiens
  Light chain CDR3 for antibody 9588 (IGKV1-9)
QQLNGYPFT

SEQ ID NO: 19176 - protein, 21 aa, Homo sapiens
  Heavy chain CDR3 for antibody 9588 (IGHV3-33)
ARDEYYEIVTGYGYYHYGMDV

SEQ ID NO: 19177 - protein, 9 aa, Homo sapiens
  Light chain CDR3 for antibody 9589 (IGKV3-15)
QQYINWPLT

SEQ ID NO: 19178 - protein, 10 aa, Homo sapiens
  Heavy chain CDR3 for antibody 9589 (IGHV4-31)
ARHGVAGTNY

SEQ ID NO: 19179 - protein, 9 aa, Homo sapiens
  Light chain CDR3 for antibody 9590 (IGKV3D-7)
QQDYTLPLT

SEQ ID NO: 19180 - protein, 9 aa, Homo sapiens
  Heavy chain CDR3 for antibody 9590 (IGHV3-20)
ASIRGYFDY

SEQ ID NO: 19181 - protein, 8 aa, Homo sapiens
  Light chain CDR3 for antibody 9591 (IGKV3-11)
QQRSNWLT

SEQ ID NO: 19182 - protein, 17 aa, Homo sapiens
  Heavy chain CDR3 for antibody 9591 (IGHV3-33)
ARGYCSRTSCYLYYFDY

SEQ ID NO: 19183 - protein, 10 aa, Homo sapiens
  Light chain CDR3 for antibody 9592 (IGKV1-27)
QKYNSAPMYT

SEQ ID NO: 19184 - protein, 15 aa, Homo sapiens
  Heavy chain CDR3 for antibody 9592 (IGHV3-33)
ARDTGYSSSWNWFDP

SEQ ID NO: 19185 - protein, 8 aa, Homo sapiens
  Light chain CDR3 for antibody 9593 (IGKV1-5)
QQYNSYYT

SEQ ID NO: 19186 - protein, 17 aa, Homo sapiens
  Heavy chain CDR3 for antibody 9593 (IGHV3-23)
AKDTITMVRGALFGMDV

SEQ ID NO: 19187 - protein, 9 aa, Homo sapiens
  Light chain CDR3 for antibody 9594 (IGKV1-9)
QQLNGYPFT

SEQ ID NO: 19188 - protein, 15 aa, Homo sapiens
  Heavy chain CDR3 for antibody 9594 (IGHV4-39)
ARQGLVATIKGYFQH

SEQ ID NO: 19189 - protein, 9 aa, Homo sapiens
  Light chain CDR3 for antibody 9595 (IGKV1-17)
LQHNSYPPT

SEQ ID NO: 19190 - protein, 11 aa, Homo sapiens
  Heavy chain CDR3 for antibody 9595 (IGHV1-24)
ATREYSSSCDY

SEQ ID NO: 19191 - protein, 9 aa, Homo sapiens
  Light chain CDR3 for antibody 9596 (IGKV3D-7)
QQDYTLPYT

SEQ ID NO: 19192 - protein, 13 aa, Homo sapiens
  Heavy chain CDR3 for antibody 9596 (IGHV3-33)
ARVDYYNYYGLDV

SEQ ID NO: 19193 - protein, 9 aa, Homo sapiens
  Light chain CDR3 for antibody 9597 (IGKV1-6)
LQDYNYPYT

SEQ ID NO: 19194 - protein, 12 aa, Homo sapiens
  Heavy chain CDR3 for antibody 9597 (IGHV3-23)
AGGDFWGGNPLY

SEQ ID NO: 19195 - protein, 9 aa, Homo sapiens
  Light chain CDR3 for antibody 9598 (IGKV1-6)
LQDYNYPYT

SEQ ID NO: 19196 - protein, 16 aa, Homo sapiens
  Heavy chain CDR3 for antibody 9598 (IGHV3-20)
ARLLRYFDWPLGAFDI

SEQ ID NO: 19197 - protein, 9 aa, Homo sapiens
  Light chain CDR3 for antibody 9599 (IGKV3-11)
QQRSSWPPT

SEQ ID NO: 19198 - protein, 11 aa, Homo sapiens
  Heavy chain CDR3 for antibody 9599 (IGHV3-23)
AKGLWSYYFDY

SEQ ID NO: 19199 - protein, 8 aa, Homo sapiens
  Light chain CDR3 for antibody 9600 (IGKV3D-7)
QQDYNLLT

SEQ ID NO: 19200 - protein, 13 aa, Homo sapiens
  Heavy chain CDR3 for antibody 9600 (IGHV3-33)
AREYFDWLLPLDY

SEQ ID NO: 19201 - protein, 8 aa, Homo sapiens
  Light chain CDR3 for antibody 9601 (IGKV1-5)
QQYNSYYT

SEQ ID NO: 19202 - protein, 10 aa, Homo sapiens
  Heavy chain CDR3 for antibody 9601 (IGHV3-33)
ARDLGWSFDF

SEQ ID NO: 19203 - protein, 9 aa, Homo sapiens
  Light chain CDR3 for antibody 9602 (IGKV1-39)
QQSYSSPYT

SEQ ID NO: 19204 - protein, 18 aa, Homo sapiens
  Heavy chain CDR3 for antibody 9602 (IGHV1-18)
ARDRGYYYGSGSYSPFDY

SEQ ID NO: 19205 - protein, 9 aa, Homo sapiens
  Light chain CDR3 for antibody 9603 (IGKV1-6)
QQYNSYPFT

SEQ ID NO: 19206 - protein, 17 aa, Homo sapiens
  Heavy chain CDR3 for antibody 9603 (IGHV4-59)
ARRITMVREIIITAFDY

SEQ ID NO: 19207 - protein, 9 aa, Homo sapiens
  Light chain CDR3 for antibody 9604 (IGKV3-20)
QQYGSSPYT

SEQ ID NO: 19208 - protein, 20 aa, Homo sapiens
  Heavy chain CDR3 for antibody 9604 (IGHV1-f)
ATHYDILTGSPYYYYCALDV

SEQ ID NO: 19209 - protein, 9 aa, Homo sapiens
  Light chain CDR3 for antibody 9605 (IGKV5-2)
LQHDNFPYT

SEQ ID NO: 19210 - protein, 16 aa, Homo sapiens
  Heavy chain CDR3 for antibody 9605 (IGHV3-33)
ARGGLTGGGDYDAFDI

SEQ ID NO: 19211 - protein, 8 aa, Homo sapiens
  Light chain CDR3 for antibody 9606 (IGKV3-11)
QQRSNWLT

SEQ ID NO: 19212 - protein, 17 aa, Homo sapiens
  Heavy chain CDR3 for antibody 9606 (IGHV3-64)
ARERYYGSGSYYNWFDP

SEQ ID NO: 19213 - protein, 9 aa, Homo sapiens
  Light chain CDR3 for antibody 9607 (IGKV1-39)
QQSYSTPST

SEQ ID NO: 19214 - protein, 11 aa, Homo sapiens
  Heavy chain CDR3 for antibody 9607 (IGHV3-48)
AREGALYAFDF

SEQ ID NO: 19215 - protein, 9 aa, Homo sapiens
  Light chain CDR3 for antibody 9608 (IGKV1-16)
QQYYSYPYT

SEQ ID NO: 19216 - protein, 11 aa, Homo sapiens
  Heavy chain CDR3 for antibody 9608 (IGHV3-33)
VREAYYYGLDV

SEQ ID NO: 19217 - protein, 9 aa, Homo sapiens
  Light chain CDR3 for antibody 9609 (IGKV1-6)
LQDYNYPWT

SEQ ID NO: 19218 - protein, 9 aa, Homo sapiens
  Heavy chain CDR3 for antibody 9609 (IGHV3-33)
ARELGYFDF

SEQ ID NO: 19219 - protein, 9 aa, Homo sapiens
  Light chain CDR3 for antibody 9610 (IGKV1-9)
QQLKSYPYT

SEQ ID NO: 19220 - protein, 14 aa, Homo sapiens
  Heavy chain CDR3 for antibody 9610 (IGHV3-33)
VRDAMGAPTAWFDP

SEQ ID NO: 19221 - protein, 8 aa, Homo sapiens
  Light chain CDR3 for antibody 9611 (IGKV3-11)
QQRGNWPS

SEQ ID NO: 19222 - protein, 14 aa, Homo sapiens
  Heavy chain CDR3 for antibody 9611 (IGHV3-33)
AREGYSSNWYDFDY

SEQ ID NO: 19223 - protein, 9 aa, Homo sapiens
  Light chain CDR3 for antibody 9612 (IGKV3D-7)
QQDYEFPLT

SEQ ID NO: 19224 - protein, 8 aa, Homo sapiens
  Heavy chain CDR3 for antibody 9612 (IGHV4-59)
ARGARFDP

SEQ ID NO: 19225 - protein, 9 aa, Homo sapiens
  Light chain CDR3 for antibody 9613 (IGKV2-30)
MQGTHWPLT

SEQ ID NO: 19226 - protein, 15 aa, Homo sapiens
  Heavy chain CDR3 for antibody 9613 (IGHV3-33)
AKDRNSGYDWGGFDY

SEQ ID NO: 19227 - protein, 9 aa, Homo sapiens
  Light chain CDR3 for antibody 9614 (IGKV1-6)
LQDFHYPWT

SEQ ID NO: 19228 - protein, 14 aa, Homo sapiens
  Heavy chain CDR3 for antibody 9614 (IGHV3-33)
ARDWNDVYYYGMDV

SEQ ID NO: 19229 - protein, 9 aa, Homo sapiens
  Light chain CDR3 for antibody 9615 (IGKV1-17)
LQHNSYPWT

SEQ ID NO: 19230 - protein, 6 aa, Homo sapiens
  Heavy chain CDR3 for antibody 9615 (IGHV3-33)
VREGDY

SEQ ID NO: 19231 - protein, 9 aa, Homo sapiens
  Light chain CDR3 for antibody 9616 (IGKV3D-7)
QQDYDLPYP

SEQ ID NO: 19232 - protein, 17 aa, Homo sapiens
  Heavy chain CDR3 for antibody 9616 (IGHV4-39)
ARVLRYFDWLSHDAFDI

SEQ ID NO: 19233 - protein, 9 aa, Homo sapiens
  Light chain CDR3 for antibody 9617 (IGKV1D-16)
QQYNSYPLT

SEQ ID NO: 19234 - protein, 15 aa, Homo sapiens
  Heavy chain CDR3 for antibody 9617 (IGHV4-39)
ARRSKYSSAWYPSDY

SEQ ID NO: 19235 - protein, 9 aa, Homo sapiens
  Light chain CDR3 for antibody 9618 (IGKV3D-7)
QQDYNLPYT

SEQ ID NO: 19236 - protein, 15 aa, Homo sapiens
  Heavy chain CDR3 for antibody 9618 (IGHV3-74)
ARGSGSHYFYYGMDV

SEQ ID NO: 19237 - protein, 9 aa, Homo sapiens
  Light chain CDR3 for antibody 9619 (IGKV1-6)
LQDYSSPWT

SEQ ID NO: 19238 - protein, 16 aa, Homo sapiens
  Heavy chain CDR3 for antibody 9619 (IGHV3-33)
ARAVYYGSGSSLIMDV

SEQ ID NO: 19239 - protein, 8 aa, Homo sapiens
  Light chain CDR3 for antibody 9620 (IGKV3-20)
QQYGSSRT

SEQ ID NO: 19240 - protein, 17 aa, Homo sapiens
  Heavy chain CDR3 for antibody 9620 (IGHV3-23)
AKDGSFYSSGWYDAFDI

SEQ ID NO: 19241 - protein, 9 aa, Homo sapiens
  Light chain CDR3 for antibody 9621 (IGKV1D-13)
QHFNNYMYT

SEQ ID NO: 19242 - protein, 9 aa, Homo sapiens
  Heavy chain CDR3 for antibody 9621 (IGHV1-8)
ARGRLDFDY

SEQ ID NO: 19243 - protein, 8 aa, Homo sapiens
  Light chain CDR3 for antibody 9622 (IGKV1-5)
QQYNSYYT

SEQ ID NO: 19244 - protein, 20 aa, Homo sapiens
  Heavy chain CDR3 for antibody 9622 (IGHV3-23)
AKGMGGLRYFDWPHYYGMDV

SEQ ID NO: 19245 - protein, 9 aa, Homo sapiens
  Light chain CDR3 for antibody 9623 (IGKV2-30)
MQGTHWPYT

SEQ ID NO: 19246 - protein, 18 aa, Homo sapiens
  Heavy chain CDR3 for antibody 9623 (IGHV3-33)
ARKGGYYSGSGSYRHFDF

SEQ ID NO: 19247 - protein, 10 aa, Homo sapiens
  Light chain CDR3 for antibody 9624 (IGKV3-15)
QQYNNWPPYT

SEQ ID NO: 19248 - protein, 9 aa, Homo sapiens
  Heavy chain CDR3 for antibody 9624 (IGHV3-33)
AREYKEFDY

SEQ ID NO: 19249 - protein, 9 aa, Homo sapiens
  Light chain CDR3 for antibody 9625 (IGKV6-21)
HQSTSLPFT

SEQ ID NO: 19250 - protein, 13 aa, Homo sapiens
  Heavy chain CDR3 for antibody 9625 (IGHV4-34)
ASDFYYYYYGMDV

SEQ ID NO: 19251 - protein, 9 aa, Homo sapiens
  Light chain CDR3 for antibody 9626 (IGKV1-9)
QQLNSYPYT

SEQ ID NO: 19252 - protein, 14 aa, Homo sapiens
  Heavy chain CDR3 for antibody 9626 (IGHV3-33)
ARMAAAAGPRDFQH

SEQ ID NO: 19253 - protein, 8 aa, Homo sapiens
  Light chain CDR3 for antibody 9627 (IGKV1-5)
QQYNSYWT

SEQ ID NO: 19254 - protein, 9 aa, Homo sapiens
  Heavy chain CDR3 for antibody 9627 (IGHV4-59)
ARGGASFDY

SEQ ID NO: 19255 - protein, 8 aa, Homo sapiens
  Light chain CDR3 for antibody 9628 (IGKV3-11)
QQRSNWLT

SEQ ID NO: 19256 - protein, 21 aa, Homo sapiens
  Heavy chain CDR3 for antibody 9628 (IGHV1-18)
ASGVLIWFGELLSEDYYDMDV

SEQ ID NO: 19257 - protein, 9 aa, Homo sapiens
  Light chain CDR3 for antibody 9629 (IGKV1-39)
QQSYSTPLT

SEQ ID NO: 19258 - protein, 15 aa, Homo sapiens
  Heavy chain CDR3 for antibody 9629 (IGHV3-23)
AKDRSGSGSYNLFDY

SEQ ID NO: 19259 - protein, 9 aa, Homo sapiens
  Light chain CDR3 for antibody 9630 (IGKV2-30)
MQGTHWPLT

SEQ ID NO: 19260 - protein, 13 aa, Homo sapiens
  Heavy chain CDR3 for antibody 9630 (IGHV3-33)
ARDYTMVRGVMTY

SEQ ID NO: 19261 - protein, 10 aa, Homo sapiens
  Light chain CDR3 for antibody 9631 (IGKV3-15)
QQYNNWPPLT

SEQ ID NO: 19262 - protein, 14 aa, Homo sapiens
  Heavy chain CDR3 for antibody 9631 (IGHV3-33)
ARDREQQLVRYFDY

SEQ ID NO: 19263 - protein, 9 aa, Homo sapiens
  Light chain CDR3 for antibody 9632 (IGKV1D-13)
QQFNNYPHT

SEQ ID NO: 19264 - protein, 14 aa, Homo sapiens
  Heavy chain CDR3 for antibody 9632 (IGHV3-15)
SIYYYGSGRDYFDY

SEQ ID NO: 19265 - protein, 10 aa, Homo sapiens
  Light chain CDR3 for antibody 9633 (IGKV3-11)
QQRSNWPIFT

SEQ ID NO: 19266 - protein, 19 aa, Homo sapiens
  Heavy chain CDR3 for antibody 9633 (IGHV3-23)
AKDREMAATSHYYYYGMDV

SEQ ID NO: 19267 - protein, 9 aa, Homo sapiens
  Light chain CDR3 for antibody 9634 (IGKV1-9)
QQLKSYPYT

SEQ ID NO: 19268 - protein, 18 aa, Homo sapiens
  Heavy chain CDR3 for antibody 9634 (IGHV1-46)
ARDGRISLVRGIIDAFDI

SEQ ID NO: 19269 - protein, 10 aa, Homo sapiens
  Light chain CDR3 for antibody 9635 (IGKV3-11)
QQRSNWPMYT

SEQ ID NO: 19270 - protein, 9 aa, Homo sapiens
  Heavy chain CDR3 for antibody 9635 (IGHV3-33)
AREYKEFDY

SEQ ID NO: 19271 - protein, 9 aa, Homo sapiens
  Light chain CDR3 for antibody 9636 (IGKV1D-16)
QQYSSYPYT

SEQ ID NO: 19272 - protein, 12 aa, Homo sapiens
  Heavy chain CDR3 for antibody 9636 (IGHV3-33)
ARGYFGSGYARF

SEQ ID NO: 19273 - protein, 9 aa, Homo sapiens
  Light chain CDR3 for antibody 9637 (IGKV1D-16)
QQYNSYPLT

SEQ ID NO: 19274 - protein, 15 aa, Homo sapiens
  Heavy chain CDR3 for antibody 9637 (IGHV3-33)
ARAYDLPHYYYGMDV

SEQ ID NO: 19275 - protein, 9 aa, Homo sapiens
  Light chain CDR3 for antibody 9638 (IGKV1-6)
LQDFHYPWT

SEQ ID NO: 19276 - protein, 14 aa, Homo sapiens
  Heavy chain CDR3 for antibody 9638 (IGHV3-33)
ARDRIAAASSDFDC

SEQ ID NO: 19277 - protein, 8 aa, Homo sapiens
  Light chain CDR3 for antibody 9639 (IGKV2D-28)
MQALQTPT

SEQ ID NO: 19278 - protein, 11 aa, Homo sapiens
  Heavy chain CDR3 for antibody 9639 (IGHV3-33)
ARARYTTGLDY

SEQ ID NO: 19279 - protein, 9 aa, Homo sapiens
  Light chain CDR3 for antibody 9640 (IGKV1-5)
QQYNTYSRT

SEQ ID NO: 19280 - protein, 11 aa, Homo sapiens
  Heavy chain CDR3 for antibody 9640 (IGHV3-33)
ARDKSSGWSDY

SEQ ID NO: 19281 - protein, 8 aa, Homo sapiens
  Light chain CDR3 for antibody 9641 (IGKV6-21)
HQSSSLPT

SEQ ID NO: 19282 - protein, 16 aa, Homo sapiens
  Heavy chain CDR3 for antibody 9641 (IGHV3-33)
ARAVYYGSGSSLIMDV

SEQ ID NO: 19283 - protein, 9 aa, Homo sapiens
  Light chain CDR3 for antibody 9642 (IGKV1-9)
QQLNSYPYT

SEQ ID NO: 19284 - protein, 10 aa, Homo sapiens
  Heavy chain CDR3 for antibody 9642 (IGHV3-23)
AKDHYGDCPY

SEQ ID NO: 19285 - protein, 8 aa, Homo sapiens
  Light chain CDR3 for antibody 9643 (IGKV3-11)
LQRGNWPT

SEQ ID NO: 19286 - protein, 11 aa, Homo sapiens
  Heavy chain CDR3 for antibody 9643 (IGHV4-59)
ARSLRYSFFDY

SEQ ID NO: 19287 - protein, 9 aa, Homo sapiens
  Light chain CDR3 for antibody 9644 (IGKV1D-16)
QQYNSYPFT

SEQ ID NO: 19288 - protein, 15 aa, Homo sapiens
  Heavy chain CDR3 for antibody 9644 (IGHV4-59)
AREMGHYYGSVSIDY

SEQ ID NO: 19289 - protein, 9 aa, Homo sapiens
  Light chain CDR3 for antibody 9645 (IGKV1-9)
QQLISYPLT

SEQ ID NO: 19290 - protein, 20 aa, Homo sapiens
  Heavy chain CDR3 for antibody 9645 (IGHV1-18)
AREVGIAVAGTLYYYYGMDV

SEQ ID NO: 19291 - protein, 9 aa, Homo sapiens
  Light chain CDR3 for antibody 9646 (IGKV1-17)
LHSNNYPWT

SEQ ID NO: 19292 - protein, 12 aa, Homo sapiens
  Heavy chain CDR3 for antibody 9646 (IGHV3-33)
ARDRAYRGSLDY

SEQ ID NO: 19293 - protein, 9 aa, Homo sapiens
  Light chain CDR3 for antibody 9647 (IGKV1-6)
LQDFNYPRT

SEQ ID NO: 19294 - protein, 14 aa, Homo sapiens
  Heavy chain CDR3 for antibody 9647 (IGHV3-33)
ARDNILTAYYLFDY

SEQ ID NO: 19295 - protein, 10 aa, Homo sapiens
  Light chain CDR3 for antibody 9648 (IGKV3-11)
QQRSNWPIFT

SEQ ID NO: 19296 - protein, 10 aa, Homo sapiens
  Heavy chain CDR3 for antibody 9648 (IGHV3-23)
AKDHWGDFDY

SEQ ID NO: 19297 - protein, 9 aa, Homo sapiens
  Light chain CDR3 for antibody 9649 (IGKV3-15)
QQYHNWPRT

SEQ ID NO: 19298 - protein, 16 aa, Homo sapiens
  Heavy chain CDR3 for antibody 9649 (IGHV3-33)
ARDRGGMTMVRGGFDY

SEQ ID NO: 19299 - protein, 8 aa, Homo sapiens
  Light chain CDR3 for antibody 9650 (IGKV1-5)
QQYNSYWT

SEQ ID NO: 19300 - protein, 10 aa, Homo sapiens
  Heavy chain CDR3 for antibody 9650 (IGHV3-33)
ARDGSGSQPI

SEQ ID NO: 19301 - protein, 9 aa, Homo sapiens
  Light chain CDR3 for antibody 9651 (IGKV3D-7)
QQDYTLPLT

SEQ ID NO: 19302 - protein, 10 aa, Homo sapiens
  Heavy chain CDR3 for antibody 9651 (IGHV4-59)
VSSGTSLLAY

SEQ ID NO: 19303 - protein, 9 aa, Homo sapiens
  Light chain CDR3 for antibody 9652 (IGKV3D-7)
QQDYNLPLT

SEQ ID NO: 19304 - protein, 18 aa, Homo sapiens
  Heavy chain CDR3 for antibody 9652 (IGHV3-23)
AKEGDYYSSGSYWGYFDL

SEQ ID NO: 19305 - protein, 10 aa, Homo sapiens
  Light chain CDR3 for antibody 9653 (IGKV3-15)
QQYNNWPPIT

SEQ ID NO: 19306 - protein, 13 aa, Homo sapiens
  Heavy chain CDR3 for antibody 9653 (IGHV4-59)
ANRDYYGYYGMDV

SEQ ID NO: 19307 - protein, 9 aa, Homo sapiens
  Light chain CDR3 for antibody 9654 (IGKV1-27)
QKYNSAPYT

SEQ ID NO: 19308 - protein, 16 aa, Homo sapiens
  Heavy chain CDR3 for antibody 9654 (IGHV4-59)
ARYSGSYYGDYYGMDV

SEQ ID NO: 19309 - protein, 9 aa, Homo sapiens
  Light chain CDR3 for antibody 9655 (IGKV1-9)
QQLKSYLYT

SEQ ID NO: 19310 - protein, 20 aa, Homo sapiens
  Heavy chain CDR3 for antibody 9655 (IGHV1-f)
ATHYDILTGSPYYYYCALDV

SEQ ID NO: 19311 - protein, 9 aa, Homo sapiens
  Light chain CDR3 for antibody 9656 (IGKV1D-13)
QQFNNYPHT

SEQ ID NO: 19312 - protein, 18 aa, Homo sapiens
  Heavy chain CDR3 for antibody 9656 (IGHV4-39)
VKYITMVRGDIITGPFAY

SEQ ID NO: 19313 - protein, 9 aa, Homo sapiens
  Light chain CDR3 for antibody 9657 (IGKV1D-16)
LQHNIYPPT

SEQ ID NO: 19314 - protein, 18 aa, Homo sapiens
  Heavy chain CDR3 for antibody 9657 (IGHV1-46)
ARDLTGRTENYYYYGMDV

SEQ ID NO: 19315 - protein, 8 aa, Homo sapiens
  Light chain CDR3 for antibody 9658 (IGKV1-13)
QQFNTYPT

SEQ ID NO: 19316 - protein, 13 aa, Homo sapiens
  Heavy chain CDR3 for antibody 9658 (IGHV3-33)
ARKAYGDYFYFDY

SEQ ID NO: 19317 - protein, 8 aa, Homo sapiens
  Light chain CDR3 for antibody 9659 (IGKV1-5)
QQYNSYYT

SEQ ID NO: 19318 - protein, 15 aa, Homo sapiens
  Heavy chain CDR3 for antibody 9659 (IGHV3-33)
ARDALAVTGTGWFDP

SEQ ID NO: 19319 - protein, 9 aa, Homo sapiens
  Light chain CDR3 for antibody 9660 (IGKV1-9)
QQLKSYLYT

SEQ ID NO: 19320 - protein, 21 aa, Homo sapiens
  Heavy chain CDR3 for antibody 9660 (IGHV1-69)
ASGVLIWFGELLSEDYYDMDV

SEQ ID NO: 19321 - protein, 9 aa, Homo sapiens
  Light chain CDR3 for antibody 9661 (IGKV3D-7)
QQDYEFPIT

SEQ ID NO: 19322 - protein, 13 aa, Homo sapiens
  Heavy chain CDR3 for antibody 9661 (IGHV4-61)
ASRYSSGRYPFDY

SEQ ID NO: 19323 - protein, 10 aa, Homo sapiens
  Light chain CDR3 for antibody 9662 (IGKV3-20)
QQYGSSPPYT

SEQ ID NO: 19324 - protein, 10 aa, Homo sapiens
  Heavy chain CDR3 for antibody 9662 (IGHV1-18)
AREQRLGFDY

SEQ ID NO: 19325 - protein, 9 aa, Homo sapiens
  Light chain CDR3 for antibody 9663 (IGKV1-6)
LQDFHYPWT

SEQ ID NO: 19326 - protein, 14 aa, Homo sapiens
  Heavy chain CDR3 for antibody 9663 (IGHV3-33)
ARQYSYGYPYYFDY

SEQ ID NO: 19327 - protein, 9 aa, Homo sapiens
  Light chain CDR3 for antibody 9664 (IGKV3D-20)
HQYGSSPLT

SEQ ID NO: 19328 - protein, 13 aa, Homo sapiens
  Heavy chain CDR3 for antibody 9664 (IGHV4-34)
ASNFYYYYYCMKV

SEQ ID NO: 19329 - protein, 9 aa, Homo sapiens
  Light chain CDR3 for antibody 9665 (IGKV3D-7)
QQDYKSPLT

SEQ ID NO: 19330 - protein, 7 aa, Homo sapiens
  Heavy chain CDR3 for antibody 9665 (IGHV1-46)
AREGGDY

SEQ ID NO: 19331 - protein, 9 aa, Homo sapiens
  Light chain CDR3 for antibody 9666 (IGKV1-37)
QRTSNAPYT

SEQ ID NO: 19332 - protein, 11 aa, Homo sapiens
  Heavy chain CDR3 for antibody 9666 (IGHV3-33)
ARDRATATVDY

SEQ ID NO: 19333 - protein, 10 aa, Homo sapiens
  Light chain CDR3 for antibody 9667 (IGKV3-20)
QQYGSSPPYT

SEQ ID NO: 19334 - protein, 13 aa, Homo sapiens
  Heavy chain CDR3 for antibody 9667 (IGHV3-33)
ARDWGYSHGYFDY

SEQ ID NO: 19335 - protein, 8 aa, Homo sapiens
  Light chain CDR3 for antibody 9668 (IGKV6-21)
HQSSSLYT

SEQ ID NO: 19336 - protein, 17 aa, Homo sapiens
  Heavy chain CDR3 for antibody 9668 (IGHV3-66)
ARVQYDILTGYSPYFDN

SEQ ID NO: 19337 - protein, 9 aa, Homo sapiens
  Light chain CDR3 for antibody 9669 (IGKV1-9)
QQLNGYPFT

SEQ ID NO: 19338 - protein, 14 aa, Homo sapiens
  Heavy chain CDR3 for antibody 9669 (IGHV3-33)
ARRGSPLRPSHLDV

SEQ ID NO: 19339 - protein, 9 aa, Homo sapiens
  Light chain CDR3 for antibody 9670 (IGKV1D-13)
QHFNNYMYT

SEQ ID NO: 19340 - protein, 18 aa, Homo sapiens
  Heavy chain CDR3 for antibody 9670 (IGHV4-59)
AREGHYYTSGSYYKAFDY

SEQ ID NO: 19341 - protein, 9 aa, Homo sapiens
  Light chain CDR3 for antibody 9671 (IGKV5-2)
LQHDKFPYT

SEQ ID NO: 19342 - protein, 15 aa, Homo sapiens
  Heavy chain CDR3 for antibody 9671 (IGHV3-33)
ARGVDILTGYSSFDY

SEQ ID NO: 19343 - protein, 9 aa, Homo sapiens
  Light chain CDR3 for antibody 9672 (IGKV3-11)
QQRSKWPLT

SEQ ID NO: 19344 - protein, 18 aa, Homo sapiens
  Heavy chain CDR3 for antibody 9672 (IGHV3-33)
ARREGITMIFYYYYGMDV

SEQ ID NO: 19345 - protein, 8 aa, Homo sapiens
  Light chain CDR3 for antibody 9673 (IGKV1-5)
QQYNSYYT

SEQ ID NO: 19346 - protein, 16 aa, Homo sapiens
  Heavy chain CDR3 for antibody 9673 (IGHV3-11)
ARDSELRYFDWFGMDV

SEQ ID NO: 19347 - protein, 9 aa, Homo sapiens
  Light chain CDR3 for antibody 9674 (IGKV1D-13)
QQFNNYLYT

SEQ ID NO: 19348 - protein, 20 aa, Homo sapiens
  Heavy chain CDR3 for antibody 9674 (IGHV3-33)
ARDRCSSTSCYGYYYYGMDV

SEQ ID NO: 19349 - protein, 9 aa, Homo sapiens
  Light chain CDR3 for antibody 9675 (IGKV1-17)
LQHNSYPYT

SEQ ID NO: 19350 - protein, 13 aa, Homo sapiens
  Heavy chain CDR3 for antibody 9675 (IGHV3-23)
ATGAWASSWWGDY

SEQ ID NO: 19351 - protein, 10 aa, Homo sapiens
  Light chain CDR3 for antibody 9676 (IGKV3-15)
QQYNNWPPYT

SEQ ID NO: 19352 - protein, 13 aa, Homo sapiens
  Heavy chain CDR3 for antibody 9676 (IGHV3-33)
ASGYSGYDWYFDL

SEQ ID NO: 19353 - protein, 6 aa, Homo sapiens
  Light chain CDR3 for antibody 9677 (IGKV3-20)
QQYGST

SEQ ID NO: 19354 - protein, 15 aa, Homo sapiens
  Heavy chain CDR3 for antibody 9677 (IGHV3-33)
ARDHLTGYYYYGMDV

SEQ ID NO: 19355 - protein, 9 aa, Homo sapiens
  Light chain CDR3 for antibody 9678 (IGKV4-1)
QQYYSTPPT

SEQ ID NO: 19356 - protein, 17 aa, Homo sapiens
  Heavy chain CDR3 for antibody 9678 (IGHV3-23)
AKDGSFYSSGWYDAFDI

SEQ ID NO: 19357 - protein, 9 aa, Homo sapiens
  Light chain CDR3 for antibody 9679 (IGKV3-15)
QQYNNWPRT

SEQ ID NO: 19358 - protein, 14 aa, Homo sapiens
  Heavy chain CDR3 for antibody 9679 (IGHV3-13)
ARDRIAAASSDFDC

SEQ ID NO: 19359 - protein, 10 aa, Homo sapiens
  Light chain CDR3 for antibody 9680 (IGKV1-9)
QQLDSYPMYT

SEQ ID NO: 19360 - protein, 17 aa, Homo sapiens
  Heavy chain CDR3 for antibody 9680 (IGHV3-33)
AREDYDILTGYPFYFDY

SEQ ID NO: 19361 - protein, 9 aa, Homo sapiens
  Light chain CDR3 for antibody 9681 (IGKV1D-13)
QRFNNYLYT

SEQ ID NO: 19362 - protein, 10 aa, Homo sapiens
  Heavy chain CDR3 for antibody 9681 (IGHV3-33)
ARDGSGSYPI

SEQ ID NO: 19363 - protein, 9 aa, Homo sapiens
  Light chain CDR3 for antibody 9682 (IGKV1D-13)
QQFNNYPST

SEQ ID NO: 19364 - protein, 12 aa, Homo sapiens
  Heavy chain CDR3 for antibody 9682 (IGHV3-33)
ARDWMVRGVIAY

SEQ ID NO: 19365 - protein, 9 aa, Homo sapiens
  Light chain CDR3 for antibody 9683 (IGKV1-9)
QQLNSYPWT

SEQ ID NO: 19366 - protein, 20 aa, Homo sapiens
  Heavy chain CDR3 for antibody 9683 (IGHV1-f)
ATGLITFVRGVILTYRSFDY

SEQ ID NO: 19367 - protein, 8 aa, Homo sapiens
  Light chain CDR3 for antibody 9684 (IGKV3-11)
QQRSNWWT

SEQ ID NO: 19368 - protein, 12 aa, Homo sapiens
  Heavy chain CDR3 for antibody 9684 (IGHV3-33)
AREGDILTGYYL

SEQ ID NO: 19369 - protein, 9 aa, Homo sapiens
  Light chain CDR3 for antibody 9685 (IGKV1-6)
LQDYNYPWT

SEQ ID NO: 19370 - protein, 15 aa, Homo sapiens
  Heavy chain CDR3 for antibody 9685 (IGHV3-66)
ARDSRPEITGPPFDY

SEQ ID NO: 19371 - protein, 9 aa, Homo sapiens
  Light chain CDR3 for antibody 9686 (IGKV1D-13)
QQFNNYPYT

SEQ ID NO: 19372 - protein, 13 aa, Homo sapiens
  Heavy chain CDR3 for antibody 9686 (IGHV4-39)
ARRDVLAPAAFEY

SEQ ID NO: 19373 - protein, 8 aa, Homo sapiens
  Light chain CDR3 for antibody 9687 (IGKV3D-7)
QQDYNLLT

SEQ ID NO: 19374 - protein, 12 aa, Homo sapiens
  Heavy chain CDR3 for antibody 9687 (IGHV3-33)
AREGIAVAGVDP

SEQ ID NO: 19375 - protein, 9 aa, Homo sapiens
  Light chain CDR3 for antibody 9688 (IGKV3-20)
QQYGSSPYT

SEQ ID NO: 19376 - protein, 15 aa, Homo sapiens
  Heavy chain CDR3 for antibody 9688 (IGHV4-39)
ARRVRGLIITRYFDY

SEQ ID NO: 19377 - protein, 10 aa, Homo sapiens
  Light chain CDR3 for antibody 9689 (IGKV1-27)
QKYNSAPMYT

SEQ ID NO: 19378 - protein, 18 aa, Homo sapiens
  Heavy chain CDR3 for antibody 9689 (IGHV3-23)
AKDRITGTTYGYYSGLDV

SEQ ID NO: 19379 - protein, 9 aa, Homo sapiens
  Light chain CDR3 for antibody 9690 (IGKV1-39)
QQSYSTPYT

SEQ ID NO: 19380 - protein, 10 aa, Homo sapiens
  Heavy chain CDR3 for antibody 9690 (IGHV3-30)
ARDNFEGMDV

SEQ ID NO: 19381 - protein, 10 aa, Homo sapiens
  Light chain CDR3 for antibody 9691 (IGKV3-15)
QQYNNWPPYT

SEQ ID NO: 19382 - protein, 21 aa, Homo sapiens
  Heavy chain CDR3 for antibody 9691 (IGHV1-69)
ARDEYYEIVTGYGYYHYGMDV

SEQ ID NO: 19383 - protein, 9 aa, Homo sapiens
  Light chain CDR3 for antibody 9692 (IGKV1-5)
QQYNTYSRT

SEQ ID NO: 19384 - protein, 9 aa, Homo sapiens
  Heavy chain CDR3 for antibody 9692 (IGHV3-23)
AKEQQLFDY

SEQ ID NO: 19385 - protein, 9 aa, Homo sapiens
  Light chain CDR3 for antibody 9693 (IGKV3-11)
QQRSNWPLT

SEQ ID NO: 19386 - protein, 18 aa, Homo sapiens
  Heavy chain CDR3 for antibody 9693 (IGHV4-59)
AREGDYVWGSYRPNWFDP

SEQ ID NO: 19387 - protein, 9 aa, Homo sapiens
  Light chain CDR3 for antibody 9694 (IGKV2D-28)
MQALQTPPT

SEQ ID NO: 19388 - protein, 14 aa, Homo sapiens
  Heavy chain CDR3 for antibody 9694 (IGHV1-46)
ARDGVGAKEGGFDY

SEQ ID NO: 19389 - protein, 8 aa, Homo sapiens
  Light chain CDR3 for antibody 9695 (IGKV3-11)
QQRGNWPS

SEQ ID NO: 19390 - protein, 13 aa, Homo sapiens
  Heavy chain CDR3 for antibody 9695 (IGHV3-33)
ARGDNWNDGGFDY

SEQ ID NO: 19391 - protein, 10 aa, Homo sapiens
  Light chain CDR3 for antibody 9696 (IGKV3-11)
QQRSNWPALT

SEQ ID NO: 19392 - protein, 15 aa, Homo sapiens
  Heavy chain CDR3 for antibody 9696 (IGHV3-33)
ARHSSGFYYYYGMDV

SEQ ID NO: 19393 - protein, 9 aa, Homo sapiens
  Light chain CDR3 for antibody 9697 (IGKV3-11)
QQRSNWQYT

SEQ ID NO: 19394 - protein, 11 aa, Homo sapiens
  Heavy chain CDR3 for antibody 9697 (IGHV4-59)
ARSLRYSVFDY

SEQ ID NO: 19395 - protein, 9 aa, Homo sapiens
  Light chain CDR3 for antibody 9698 (IGKV2D-24)
TQATQFPHT

SEQ ID NO: 19396 - protein, 13 aa, Homo sapiens
  Heavy chain CDR3 for antibody 9698 (IGHV4-39)
ARHPPSRDYGMDV

SEQ ID NO: 19397 - protein, 9 aa, Homo sapiens
  Light chain CDR3 for antibody 9699 (IGKV1D-13)
QQFNNYPHT

SEQ ID NO: 19398 - protein, 19 aa, Homo sapiens
  Heavy chain CDR3 for antibody 9699 (IGHV3-33)
ARIHGIAVAGGYYYYGMDV

SEQ ID NO: 19399 - protein, 8 aa, Homo sapiens
  Light chain CDR3 for antibody 9700 (IGKV1-5)
QQYNSYYT

SEQ ID NO: 19400 - protein, 8 aa, Homo sapiens
  Heavy chain CDR3 for antibody 9700 (IGHV3-23)
AKESLLDY

SEQ ID NO: 19401 - protein, 10 aa, Homo sapiens
  Light chain CDR3 for antibody 9701 (IGKV1-39)
QQSYSTPMYT

SEQ ID NO: 19402 - protein, 18 aa, Homo sapiens
  Heavy chain CDR3 for antibody 9701 (IGHV3-33)
ARDGRISLVRGIIDAFDI

SEQ ID NO: 19403 - protein, 9 aa, Homo sapiens
  Light chain CDR3 for antibody 9702 (IGKV1-39)
QQSYRTPLT

SEQ ID NO: 19404 - protein, 15 aa, Homo sapiens
  Heavy chain CDR3 for antibody 9702 (IGHV3-33)
ARPPIAVAGPEYFQH

SEQ ID NO: 19405 - protein, 9 aa, Homo sapiens
  Light chain CDR3 for antibody 9703 (IGKV1-9)
QQLTSFPRT

SEQ ID NO: 19406 - protein, 15 aa, Homo sapiens
  Heavy chain CDR3 for antibody 9703 (IGHV3-30)
ARGAMVRGVDYGMDV

SEQ ID NO: 19407 - protein, 9 aa, Homo sapiens
  Light chain CDR3 for antibody 9704 (IGKV3-15)
QQYNNWPRT

SEQ ID NO: 19408 - protein, 19 aa, Homo sapiens
  Heavy chain CDR3 for antibody 9704 (IGHV3-30)
ARRFSGYSGYDHYYYGMDV

SEQ ID NO: 19409 - protein, 8 aa, Homo sapiens
  Light chain CDR3 for antibody 9705 (IGKV3-11)
LQRGNWPT

SEQ ID NO: 19410 - protein, 10 aa, Homo sapiens
  Heavy chain CDR3 for antibody 9705 (IGHV3-15)
AKDQVGATDC

SEQ ID NO: 19411 - protein, 10 aa, Homo sapiens
  Light chain CDR3 for antibody 9706 (IGKV1-17)
LQHNSYPMYT

SEQ ID NO: 19412 - protein, 15 aa, Homo sapiens
  Heavy chain CDR3 for antibody 9706 (IGHV3-33)
ARDRDYYYYYYGMDV

SEQ ID NO: 19413 - protein, 9 aa, Homo sapiens
  Light chain CDR3 for antibody 9707 (IGKV1D-16)
QQYNSYPLT

SEQ ID NO: 19414 - protein, 14 aa, Homo sapiens
  Heavy chain CDR3 for antibody 9707 (IGHV3-33)
ARDHRDNSYYGMDV

SEQ ID NO: 19415 - protein, 9 aa, Homo sapiens
  Light chain CDR3 for antibody 9708 (IGKV1-17)
LHSNNYPWT

SEQ ID NO: 19416 - protein, 18 aa, Homo sapiens
  Heavy chain CDR3 for antibody 9708 (IGHV3-33)
ARRSAAGTGDYYYYGMDV

SEQ ID NO: 19417 - protein, 8 aa, Homo sapiens
  Light chain CDR3 for antibody 9709 (IGKV3-15)
QQYNNYPT

SEQ ID NO: 19418 - protein, 18 aa, Homo sapiens
  Heavy chain CDR3 for antibody 9709 (IGHV3-33)
ARERGYYGSDIYPAAFDI

SEQ ID NO: 19419 - protein, 9 aa, Homo sapiens
  Light chain CDR3 for antibody 9710 (IGKV1D-16)
QQYNSYPYT

SEQ ID NO: 19420 - protein, 16 aa, Homo sapiens
  Heavy chain CDR3 for antibody 9710 (IGHV3-33)
ARRATLVRGVDYGMDV

SEQ ID NO: 19421 - protein, 9 aa, Homo sapiens
  Light chain CDR3 for antibody 9711 (IGKV1D-16)
QQYYSYPRT

SEQ ID NO: 19422 - protein, 14 aa, Homo sapiens
  Heavy chain CDR3 for antibody 9711 (IGHV3-33)
ARTTAAAGPRDFQH

SEQ ID NO: 19423 - protein, 9 aa, Homo sapiens
  Light chain CDR3 for antibody 9712 (IGKV1D-16)
QQYNSYPWT

SEQ ID NO: 19424 - protein, 17 aa, Homo sapiens
  Heavy chain CDR3 for antibody 9712 (IGHV4-59)
ARDCLVRGEGSYYGMDV

SEQ ID NO: 19425 - protein, 9 aa, Homo sapiens
  Light chain CDR3 for antibody 9713 (IGKV1-12)
QQADTIPVT

SEQ ID NO: 19426 - protein, 13 aa, Homo sapiens
  Heavy chain CDR3 for antibody 9713 (IGHV4-59)
ARDAGYSSSWFDY

SEQ ID NO: 19427 - protein, 9 aa, Homo sapiens
  Light chain CDR3 for antibody 9714 (IGKV6-21)
HQSTSLPFT

SEQ ID NO: 19428 - protein, 17 aa, Homo sapiens
  Heavy chain CDR3 for antibody 9714 (IGHV4-39)
AGRLTYYYGSGSPYSDY

SEQ ID NO: 19429 - protein, 9 aa, Homo sapiens
  Light chain CDR3 for antibody 9715 (IGKV1-16)
QQLKSYPYT

SEQ ID NO: 19430 - protein, 12 aa, Homo sapiens
  Heavy chain CDR3 for antibody 9715 (IGHV1-18)
AGVLFDGDYSDY

SEQ ID NO: 19431 - protein, 9 aa, Homo sapiens
  Light chain CDR3 for antibody 9716 (IGKV1-5)
QQYNTYSRT

SEQ ID NO: 19432 - protein, 14 aa, Homo sapiens
  Heavy chain CDR3 for antibody 9716 (IGHV3-33)
VRDAMGATTAWFDP

SEQ ID NO: 19433 - protein, 9 aa, Homo sapiens
  Light chain CDR3 for antibody 9717 (IGKV1-27)
QKYNSAPYT

SEQ ID NO: 19434 - protein, 12 aa, Homo sapiens
  Heavy chain CDR3 for antibody 9717 (IGHV3-33)
ARNYDILDYFDY

SEQ ID NO: 19435 - protein, 9 aa, Homo sapiens
  Light chain CDR3 for antibody 9718 (IGKV2-30)
MQGTHWPLT

SEQ ID NO: 19436 - protein, 11 aa, Homo sapiens
  Heavy chain CDR3 for antibody 9718 (IGHV4-59)
VRERGYYGMDV

SEQ ID NO: 19437 - protein, 9 aa, Homo sapiens
  Light chain CDR3 for antibody 9719 (IGKV1D-13)
QRFNNYLYT

SEQ ID NO: 19438 - protein, 14 aa, Homo sapiens
  Heavy chain CDR3 for antibody 9719 (IGHV3-33)
ARMTAAAGPRDFQH

SEQ ID NO: 19439 - protein, 9 aa, Homo sapiens
  Light chain CDR3 for antibody 9720 (IGKV1-9)
QQLKSYPYT

SEQ ID NO: 19440 - protein, 12 aa, Homo sapiens
  Heavy chain CDR3 for antibody 9720 (IGHV1-46)
ARALTVGASFDY

SEQ ID NO: 19441 - protein, 8 aa, Homo sapiens
  Light chain CDR3 for antibody 9721 (IGKV3D-7)
QQDYNLLT

SEQ ID NO: 19442 - protein, 13 aa, Homo sapiens
  Heavy chain CDR3 for antibody 9721 (IGHV4-39)
ARPGIVAAGWFDP

SEQ ID NO: 19443 - protein, 9 aa, Homo sapiens
  Light chain CDR3 for antibody 9722 (IGKV1-6)
LQDYNSPWT

SEQ ID NO: 19444 - protein, 10 aa, Homo sapiens
  Heavy chain CDR3 for antibody 9722 (IGHV3-33)
ARDLGWSFDH

SEQ ID NO: 19445 - protein, 10 aa, Homo sapiens
  Light chain CDR3 for antibody 9723 (IGKV1-39)
QQSYSTPMYT

SEQ ID NO: 19446 - protein, 18 aa, Homo sapiens
  Heavy chain CDR3 for antibody 9723 (IGHV3-30)
ARDRHHDILTGYSDAFEI

SEQ ID NO: 19447 - protein, 9 aa, Homo sapiens
  Light chain CDR3 for antibody 9724 (IGKV3D-20)
QQYGRSPRT

SEQ ID NO: 19448 - protein, 20 aa, Homo sapiens
  Heavy chain CDR3 for antibody 9724 (IGHV3-11)
ARGGATLIRGLIDYYYGMDV

SEQ ID NO: 19449 - protein, 9 aa, Homo sapiens
  Light chain CDR3 for antibody 9725 (IGKV2D-28)
MQALQTPPT

SEQ ID NO: 19450 - protein, 11 aa, Homo sapiens
  Heavy chain CDR3 for antibody 9725 (IGHV3-33)
AREGAVARFDY

SEQ ID NO: 19451 - protein, 9 aa, Homo sapiens
  Light chain CDR3 for antibody 9726 (IGKV1-17)
QQLKSYPYT

SEQ ID NO: 19452 - protein, 18 aa, Homo sapiens
  Heavy chain CDR3 for antibody 9726 (IGHV3-23)
AKDRITGTTYGYYSGLDV

SEQ ID NO: 19453 - protein, 9 aa, Homo sapiens
  Light chain CDR3 for antibody 9727 (IGKV1D-13)
QQFNNYPST

SEQ ID NO: 19454 - protein, 16 aa, Homo sapiens
  Heavy chain CDR3 for antibody 9727 (IGHV3-20)
ARDSSSLDYYYYGMDV

SEQ ID NO: 19455 - protein, 9 aa, Homo sapiens
  Light chain CDR3 for antibody 9728 (IGKV1-9)
QQLYTYPYT

SEQ ID NO: 19456 - protein, 12 aa, Homo sapiens
  Heavy chain CDR3 for antibody 9728 (IGHV3-33)
TRGYSSKSYFDY

SEQ ID NO: 19457 - protein, 8 aa, Homo sapiens
  Light chain CDR3 for antibody 9729 (IGKV3-15)
QQYNNYPT

SEQ ID NO: 19458 - protein, 12 aa, Homo sapiens
  Heavy chain CDR3 for antibody 9729 (IGHV3-13)
AIGTMVRGIPDY

SEQ ID NO: 19459 - protein, 8 aa, Homo sapiens
  Light chain CDR3 for antibody 9730 (IGKV1-6)
LQDYNYYT

SEQ ID NO: 19460 - protein, 11 aa, Homo sapiens
  Heavy chain CDR3 for antibody 9730 (IGHV3-33)
ARDRSSGPFDY

SEQ ID NO: 19461 - protein, 10 aa, Homo sapiens
  Light chain CDR3 for antibody 9731 (IGKV3-11)
QQRSNWPAYT

SEQ ID NO: 19462 - protein, 18 aa, Homo sapiens
  Heavy chain CDR3 for antibody 9731 (IGHV3-33)
ARDYDSLTTYPEDYGMDV

SEQ ID NO: 19463 - protein, 9 aa, Homo sapiens
  Light chain CDR3 for antibody 9732 (IGKV3D-7)
QQDYEFPIT

SEQ ID NO: 19464 - protein, 13 aa, Homo sapiens
  Heavy chain CDR3 for antibody 9732 (IGHV3-11)
ARDGGAAAGTWDS

SEQ ID NO: 19465 - protein, 9 aa, Homo sapiens
  Light chain CDR3 for antibody 9733 (IGKV1-17)
LQHNSFPLT

SEQ ID NO: 19466 - protein, 18 aa, Homo sapiens
  Heavy chain CDR3 for antibody 9733 (IGHV3-33)
ARREGITLIFYYYYGMDV

SEQ ID NO: 19467 - protein, 9 aa, Homo sapiens
  Light chain CDR3 for antibody 9734 (IGKV2D-28)
MQALQTPPT

SEQ ID NO: 19468 - protein, 12 aa, Homo sapiens
  Heavy chain CDR3 for antibody 9734 (IGHV3-23)
AKEGIVGVPFDY

SEQ ID NO: 19469 - protein, 10 aa, Homo sapiens [sequence omitted]

SEQ ID NO: 19470 - protein, 13 aa, Homo sapiens
  Heavy chain CDR3 for antibody 9735 (IGHV4-39)
ARHEVMVRGVFDY

SEQ ID NO: 19471 - protein, 8 aa, Homo sapiens
  Light chain CDR3 for antibody 9736 (IGKV1D-13)
QQFNNYPT

SEQ ID NO: 19472 - protein, 18 aa, Homo sapiens
  Heavy chain CDR3 for antibody 9736 (IGHV3-13)
ARDYYGSGSLYYYYGMDV

SEQ ID NO: 19473 - protein, 10 aa, Homo sapiens
  Light chain CDR3 for antibody 9737 (IGKV1-17)
LQHNSYPMYT

SEQ ID NO: 19474 - protein, 11 aa, Homo sapiens
  Heavy chain CDR3 for antibody 9737 (IGHV3-23)
AKGLWSYYFDY

SEQ ID NO: 19475 - protein, 9 aa, Homo sapiens
  Light chain CDR3 for antibody 9738 (IGKV1-27)
QKYSCAPYT

SEQ ID NO: 19476 - protein, 20 aa, Homo sapiens
  Heavy chain CDR3 for antibody 9738 (IGHV3-33)
AREDYYGSGSYYPAYNWFDP

SEQ ID NO: 19477 - protein, 9 aa, Homo sapiens
  Light chain CDR3 for antibody 9739 (IGKV3-11)
QQRSNWPPT

SEQ ID NO: 19478 - protein, 13 aa, Homo sapiens
  Heavy chain CDR3 for antibody 9739 (IGHV3-30)
AAPFMLRGDGMDV

SEQ ID NO: 19479 - protein, 9 aa, Homo sapiens
  Light chain CDR3 for antibody 9740 (IGKV3D-11)
QQRSNWQYT

SEQ ID NO: 19480 - protein, 12 aa, Homo sapiens
  Heavy chain CDR3 for antibody 9740 (IGHV3-33)
ARGYFTSGSAHY

SEQ ID NO: 19481 - protein, 8 aa, Homo sapiens
  Light chain CDR3 for antibody 9741 (IGKV1-5)
QQYNSYYT

SEQ ID NO: 19482 - protein, 11 aa, Homo sapiens
  Heavy chain CDR3 for antibody 9741 (IGHV4-4)
AREAYYYGLDV

SEQ ID NO: 19483 - protein, 9 aa, Homo sapiens
  Light chain CDR3 for antibody 9742 (IGKV3D-7)
QQDYSFPLT

SEQ ID NO: 19484 - protein, 8 aa, Homo sapiens
  Heavy chain CDR3 for antibody 9742 (IGHV3-23)
EKSAGEDV

SEQ ID NO: 19485 - protein, 9 aa, Homo sapiens
  Light chain CDR3 for antibody 9743 (IGKV1-6)
QQEYNYPLT

SEQ ID NO: 19486 - protein, 14 aa, Homo sapiens
  Heavy chain CDR3 for antibody 9743 (IGHV1-46)
ARDKTYPLSYGMDV

SEQ ID NO: 19487 - protein, 10 aa, Homo sapiens
  Light chain CDR3 for antibody 9744 (IGKV1-39)
QQSYSTPMYT

SEQ ID NO: 19488 - protein, 18 aa, Homo sapiens
  Heavy chain CDR3 for antibody 9744 (IGHV3-33)
ARGYNQGSGSYYNVCFDY

SEQ ID NO: 19489 - protein, 11 aa, Homo sapiens
  Light chain CDR3 for antibody 9745 (IGKV3-11)
QQRSNWPPMYT

SEQ ID NO: 19490 - protein, 17 aa, Homo sapiens
  Heavy chain CDR3 for antibody 9745 (IGHV4-34)
ARDGSGSYTHYYYGMDV

SEQ ID NO: 19491 - protein, 8 aa, Homo sapiens
  Light chain CDR3 for antibody 9746 (IGKV3-11)
LQRGNWPT

SEQ ID NO: 19492 - protein, 8 aa, Homo sapiens
  Heavy chain CDR3 for antibody 9746 (IGHV3-23)
AKETGNNY

SEQ ID NO: 19493 - protein, 9 aa, Homo sapiens
  Light chain CDR3 for antibody 9747 (IGKV1-39)
QQSYSSPFT

SEQ ID NO: 19494 - protein, 16 aa, Homo sapiens
  Heavy chain CDR3 for antibody 9747 (IGHV3-23)
AKEGMVLRYFDWLWDY

SEQ ID NO: 19495 - protein, 9 aa, Homo sapiens
  Light chain CDR3 for antibody 9748 (IGKV1-9)
QQLNSYPRT

SEQ ID NO: 19496 - protein, 12 aa, Homo sapiens
  Heavy chain CDR3 for antibody 9748 (IGHV4-59)
AIDPYSSRGFDY

SEQ ID NO: 19497 - protein, 9 aa, Homo sapiens
  Light chain CDR3 for antibody 9749 (IGKV2D-28)
MQALQTPPT

SEQ ID NO: 19498 - protein, 12 aa, Homo sapiens
  Heavy chain CDR3 for antibody 9749 (IGHV3-21)
AREGTGGNWFDP

SEQ ID NO: 19499 - protein, 9 aa, Homo sapiens
  Light chain CDR3 for antibody 9750 (IGKV1-9)
QQLISYPLT

SEQ ID NO: 19500 - protein, 16 aa, Homo sapiens
  Heavy chain CDR3 for antibody 9750 (IGHV3-20)
AREGYSSSWFDRNFDY

SEQ ID NO: 19501 - protein, 8 aa, Homo sapiens
  Light chain CDR3 for antibody 9751 (IGKV3-20)
QQYGSSLT

SEQ ID NO: 19502 - protein, 13 aa, Homo sapiens
  Heavy chain CDR3 for antibody 9751 (IGHV3-23)
ASTGDSYYYGMDV

SEQ ID NO: 19503 - protein, 9 aa, Homo sapiens
  Light chain CDR3 for antibody 9752 (IGKV1D-16)
QQYNYFPLT

SEQ ID NO: 19504 - protein, 12 aa, Homo sapiens
  Heavy chain CDR3 for antibody 9752 (IGHV1-46)
ARGLTGDHAGDI

SEQ ID NO: 19505 - protein, 9 aa, Homo sapiens
  Light chain CDR3 for antibody 9753 (IGKV3-11)
QQRSNWPYT

SEQ ID NO: 19506 - protein, 10 aa, Homo sapiens
  Heavy chain CDR3 for antibody 9753 (IGHV4-39)
ASSNWNDGPL

SEQ ID NO: 19507 - protein, 9 aa, Homo sapiens
  Light chain CDR3 for antibody 9754 (IGKV1-39)
QQYYSTPWT

SEQ ID NO: 19508 - protein, 11 aa, Homo sapiens
  Heavy chain CDR3 for antibody 9754 (IGHV3-33)
ARDTWDDYFDY

SEQ ID NO: 19509 - protein, 10 aa, Homo sapiens
  Light chain CDR3 for antibody 9755 (IGKV1-9)
QQLDSYPMYT

SEQ ID NO: 19510 - protein, 15 aa, Homo sapiens
  Heavy chain CDR3 for antibody 9755 (IGHV3-33)
ARRICSGGSCSLFDY

SEQ ID NO: 19511 - protein, 9 aa, Homo sapiens
  Light chain CDR3 for antibody 9756 (IGKV1-16)
QQYYSYPRT

SEQ ID NO: 19512 - protein, 12 aa, Homo sapiens
  Heavy chain CDR3 for antibody 9756 (IGHV3-33)
VRKWFGELYFDY

SEQ ID NO: 19513 - protein, 10 aa, Homo sapiens
  Light chain CDR3 for antibody 9757 (IGKV3-11)
QQRSNWPMYT

SEQ ID NO: 19514 - protein, 13 aa, Homo sapiens
  Heavy chain CDR3 for antibody 9757 (IGHV1-2)
ARDGVRGSFGMDV

SEQ ID NO: 19515 - protein, 9 aa, Homo sapiens
  Light chain CDR3 for antibody 9758 (IGKV1D-13)
QQFNNYPHT

SEQ ID NO: 19516 - protein, 10 aa, Homo sapiens
  Heavy chain CDR3 for antibody 9758 (IGHV3-30)
ARDNFEGMDV

SEQ ID NO: 19517 - protein, 9 aa, Homo sapiens
  Light chain CDR3 for antibody 9759 (IGKV1-37)
QRTYNAPYT

SEQ ID NO: 19518 - protein, 12 aa, Homo sapiens
  Heavy chain CDR3 for antibody 9759 (IGHV3-23)
AKEGLGSDYEPY

SEQ ID NO: 19519 - protein, 9 aa, Homo sapiens
  Light chain CDR3 for antibody 9760 (IGKV1D-16)
QQYNSYPLT

SEQ ID NO: 19520 - protein, 14 aa, Homo sapiens
  Heavy chain CDR3 for antibody 9760 (IGHV3-66)
ARSTAPAGPPDFQH

SEQ ID NO: 19521 - protein, 9 aa, Homo sapiens
  Light chain CDR3 for antibody 9761 (IGKV1-16)
QQYSSYPIT

SEQ ID NO: 19522 - protein, 12 aa, Homo sapiens
  Heavy chain CDR3 for antibody 9761 (IGHV1-46)
ARGLTGDHASDI

SEQ ID NO: 19523 - protein, 9 aa, Homo sapiens
  Light chain CDR3 for antibody 9762 (IGKV1-8)
QQYYSYPPT

SEQ ID NO: 19524 - protein, 24 aa, Homo sapiens
  Heavy chain CDR3 for antibody 9762 (IGHV3-20)
ARGRITMVRGVIIDPLDYYNGMDV

SEQ ID NO: 19525 - protein, 9 aa, Homo sapiens
  Light chain CDR3 for antibody 9763 (IGKV1-6)
LQDFHYPWT

SEQ ID NO: 19526 - protein, 9 aa, Homo sapiens
  Heavy chain CDR3 for antibody 9763 (IGHV3-30)
ARDYFHYDY

SEQ ID NO: 19527 - protein, 9 aa, Homo sapiens
  Light chain CDR3 for antibody 9764 (IGKV3D-7)
QQDYNLPWT

SEQ ID NO: 19528 - protein, 18 aa, Homo sapiens
  Heavy chain CDR3 for antibody 9764 (IGHV3-33)
ARGYNQGSGSYYNVCFDY

SEQ ID NO: 19529 - protein, 9 aa, Homo sapiens
  Light chain CDR3 for antibody 9765 (IGKV3-20)
QQYGGSLFT

SEQ ID NO: 19530 - protein, 16 aa, Homo sapiens
  Heavy chain CDR3 for antibody 9765 (IGHV3-23)
AKEGMVLRYFDWLWDY

SEQ ID NO: 19531 - protein, 8 aa, Homo sapiens
  Light chain CDR3 for antibody 9766 (IGKV1-5)
QQYNSYYT

SEQ ID NO: 19532 - protein, 17 aa, Homo sapiens
  Heavy chain CDR3 for antibody 9766 (IGHV4-39)
AREEDYFGSGSFGTFDI

SEQ ID NO: 19533 - protein, 11 aa, Homo sapiens
  Light chain CDR3 for antibody 9767 (IGKV3-11)
QQRSDWPPTWT

SEQ ID NO: 19534 - protein, 15 aa, Homo sapiens
  Heavy chain CDR3 for antibody 9767 (IGHV3-33)
ARDRVVRGVMGYFDY

SEQ ID NO: 19535 - protein, 9 aa, Homo sapiens
  Light chain CDR3 for antibody 9768 (IGKV3-11)
QQRSSWPPT

SEQ ID NO: 19536 - protein, 14 aa, Homo sapiens
  Heavy chain CDR3 for antibody 9768 (IGHV3-23)
AKSRIVGALYYFDY

SEQ ID NO: 19537 - protein, 9 aa, Homo sapiens
  Light chain CDR3 for antibody 9769 (IGKV1-17)
LQHSSYPRT

SEQ ID NO: 19538 - protein, 14 aa, Homo sapiens
  Heavy chain CDR3 for antibody 9769 (IGHV3-33)
ARDKSYPLYYGMDV

SEQ ID NO: 19539 - protein, 9 aa, Homo sapiens
  Light chain CDR3 for antibody 9770 (IGKV1D-13)
QQFNNYPYT

SEQ ID NO: 19540 - protein, 18 aa, Homo sapiens
  Heavy chain CDR3 for antibody 9770 (IGHV3-33)
ARGAYSSGWDYYYYGLDV

SEQ ID NO: 19541 - protein, 9 aa, Homo sapiens
  Light chain CDR3 for antibody 9771 (IGKV1-6)
LQDFHYPWT

SEQ ID NO: 19542 - protein, 11 aa, Homo sapiens
  Heavy chain CDR3 for antibody 9771 (IGHV3-33)
ARDKSSGWSDY

SEQ ID NO: 19543 - protein, 10 aa, Homo sapiens
  Light chain CDR3 for antibody 9772 (IGKV3-20)
QQYGRSPPVT

SEQ ID NO: 19544 - protein, 9 aa, Homo sapiens
  Heavy chain CDR3 for antibody 9772 (IGHV1-18)
ARGKDWFDP

SEQ ID NO: 19545 - protein, 8 aa, Homo sapiens
  Light chain CDR3 for antibody 9773 (IGKV3-20)
QQYGSSLT

SEQ ID NO: 19546 - protein, 14 aa, Homo sapiens
  Heavy chain CDR3 for antibody 9773 (IGHV3-15)
SIYFYGSGRDYFDY

SEQ ID NO: 19547 - protein, 10 aa, Homo sapiens
  Light chain CDR3 for antibody 9774 (IGKV3-15)
QQYNNWPPYT

SEQ ID NO: 19548 - protein, 17 aa, Homo sapiens
  Heavy chain CDR3 for antibody 9774 (IGHV3-23)
AKEGSSSSWYGGIYFDY

SEQ ID NO: 19549 - protein, 9 aa, Homo sapiens
  Light chain CDR3 for antibody 9775 (IGKV6-21)
HQSSSLPYT

SEQ ID NO: 19550 - protein, 10 aa, Homo sapiens
  Heavy chain CDR3 for antibody 9775 (IGHV3-23)
AKEGMYYDIL

SEQ ID NO: 19551 - protein, 10 aa, Homo sapiens
  Light chain CDR3 for antibody 9776 (IGKV3-20)
QQYGSSPPYT

SEQ ID NO: 19552 - protein, 11 aa, Homo sapiens
  Heavy chain CDR3 for antibody 9776 (IGHV3-33)
ARAGIAAVFDY

SEQ ID NO: 19553 - protein, 9 aa, Homo sapiens
  Light chain CDR3 for antibody 9777 (IGKV3-20)
QQYSSSIFT

SEQ ID NO: 19554 - protein, 14 aa, Homo sapiens
  Heavy chain CDR3 for antibody 9777 (IGHV3-23)
AKSRIVGALYYFDY

SEQ ID NO: 19555 - protein, 9 aa, Homo sapiens
  Light chain CDR3 for antibody 9778 (IGKV1D-16)
QQYSSYQYT

SEQ ID NO: 19556 - protein, 14 aa, Homo sapiens
  Heavy chain CDR3 for antibody 9778 (IGHV3-23)
AKSRIVGALYYFDY

SEQ ID NO: 19557 - protein, 9 aa, Homo sapiens
  Light chain CDR3 for antibody 9779 (IGKV1-9)
QQLNGYPFT

SEQ ID NO: 19558 - protein, 18 aa, Homo sapiens
  Heavy chain CDR3 for antibody 9779 (IGHV3-33)
ARDRDRYGSGTYPDAIDI

SEQ ID NO: 19559 - protein, 8 aa, Homo sapiens
  Light chain CDR3 for antibody 9780 (IGKV3D-7)
QQDYSLLT

SEQ ID NO: 19560 - protein, 19 aa, Homo sapiens
  Heavy chain CDR3 for antibody 9780 (IGHV3-33)
ARDSGYSGYDYYYYYGMDV

SEQ ID NO: 19561 - protein, 10 aa, Homo sapiens
  Light chain CDR3 for antibody 9781 (IGKV1-39)
QQSYSTPMYT

SEQ ID NO: 19562 - protein, 20 aa, Homo sapiens
  Heavy chain CDR3 for antibody 9781 (IGHV3-33)
ARDNDSSGYYDYYYYYGMDV

SEQ ID NO: 19563 - protein, 9 aa, Homo sapiens
  Light chain CDR3 for antibody 9782 (IGKV3-20)
QQYGSSPRT

SEQ ID NO: 19564 - protein, 12 aa, Homo sapiens
  Heavy chain CDR3 for antibody 9782 (IGHV4-39)
ALDEWHPSWYKY

SEQ ID NO: 19565 - protein, 9 aa, Homo sapiens
  Light chain CDR3 for antibody 9783 (IGKV1-17)
LQHNSYPYT

SEQ ID NO: 19566 - protein, 15 aa, Homo sapiens
  Heavy chain CDR3 for antibody 9783 (IGHV3-33)
ARDNILTGYSYYFDY

SEQ ID NO: 19567 - protein, 8 aa, Homo sapiens
  Light chain CDR3 for antibody 9784 (IGKV1D-13)
QQYNNYPT

SEQ ID NO: 19568 - protein, 14 aa, Homo sapiens
  Heavy chain CDR3 for antibody 9784 (IGHV3-33)
VSAISGSSYWYFAL

SEQ ID NO: 19569 - protein, 9 aa, Homo sapiens
  Light chain CDR3 for antibody 9785 (IGKV2D-28)
MQALQTPPT

SEQ ID NO: 19570 - protein, 13 aa, Homo sapiens
  Heavy chain CDR3 for antibody 9785 (IGHV3-33)
ARGDNWNDGGFDY

SEQ ID NO: 19571 - protein, 9 aa, Homo sapiens
  Light chain CDR3 for antibody 9786 (IGKV1-39)
QQSYSTPIT

SEQ ID NO: 19572 - protein, 14 aa, Homo sapiens
  Heavy chain CDR3 for antibody 9786 (IGHV3-23)
AKGGDILTGYYTDY

SEQ ID NO: 19573 - protein, 9 aa, Homo sapiens
  Light chain CDR3 for antibody 9787 (IGKV6-21)
HQSSSLPQT

SEQ ID NO: 19574 - protein, 11 aa, Homo sapiens
  Heavy chain CDR3 for antibody 9787 (IGHV3-33)
ATERDMVRGDY

SEQ ID NO: 19575 - protein, 9 aa, Homo sapiens
  Light chain CDR3 for antibody 9788 (IGKV1-16)
QQYTSYPYT

SEQ ID NO: 19576 - protein, 12 aa, Homo sapiens
  Heavy chain CDR3 for antibody 9788 (IGHV4-59)
ARKAYALYVLDV

SEQ ID NO: 19577 - protein, 8 aa, Homo sapiens
  Light chain CDR3 for antibody 9789 (IGKV3-11)
QQRGNWPS

SEQ ID NO: 19578 - protein, 19 aa, Homo sapiens
  Heavy chain CDR3 for antibody 9789 (IGHV3-30)
ARRFSGYSGYDHYYYGMDV

SEQ ID NO: 19579 - protein, 9 aa, Homo sapiens
  Light chain CDR3 for antibody 9790 (IGKV3-15)
QQYNNWPRT

SEQ ID NO: 19580 - protein, 18 aa, Homo sapiens
  Heavy chain CDR3 for antibody 9790 (IGHV3-33)
ARREGITLIFYYYYGMDV

SEQ ID NO: 19581 - protein, 10 aa, Homo sapiens
  Light chain CDR3 for antibody 9791 (IGKV1-9)
QQLDSYPMYT

SEQ ID NO: 19582 - protein, 13 aa, Homo sapiens
  Heavy chain CDR3 for antibody 9791 (IGHV3-33)
ARDQRYSSGWYDY

SEQ ID NO: 19583 - protein, 8 aa, Homo sapiens
  Light chain CDR3 for antibody 9792 (IGKV3D-7)
QQDYNSLT

SEQ ID NO: 19584 - protein, 20 aa, Homo sapiens
  Heavy chain CDR3 for antibody 9792 (IGHV3-23)
AKGMGGLRYFDWPHYYGMDV

SEQ ID NO: 19585 - protein, 9 aa, Homo sapiens
  Light chain CDR3 for antibody 9793 (IGKV1-16)
QQYKSYPYT

SEQ ID NO: 19586 - protein, 14 aa, Homo sapiens
  Heavy chain CDR3 for antibody 9793 (IGHV3-23)
AKSRIVGALYYCDY

SEQ ID NO: 19587 - protein, 9 aa, Homo sapiens
  Light chain CDR3 for antibody 9794 (IGKV1-17)
LQHNSYPYT

SEQ ID NO: 19588 - protein, 18 aa, Homo sapiens
  Heavy chain CDR3 for antibody 9794 (IGHV3-33)
ARDRYHDILTGYYMGVDY

SEQ ID NO: 19589 - protein, 8 aa, Homo sapiens
  Light chain CDR3 for antibody 9795 (IGKV3-11)
LQRGNWPT

SEQ ID NO: 19590 - protein, 20 aa, Homo sapiens
  Heavy chain CDR3 for antibody 9795 (IGHV3-33)
ARGGATLIRGLIDYYYGMDV

SEQ ID NO: 19591 - protein, 9 aa, Homo sapiens
  Light chain CDR3 for antibody 9796 (IGKV1-17)
LQHDSYPIT

SEQ ID NO: 19592 - protein, 12 aa, Homo sapiens
  Heavy chain CDR3 for antibody 9796 (IGHV3-33)
ARERGIGRYFDL

SEQ ID NO: 19593 - protein, 9 aa, Homo sapiens
  Light chain CDR3 for antibody 9797 (IGKV1-6)
QQEYNYPLT

SEQ ID NO: 19594 - protein, 12 aa, Homo sapiens
  Heavy chain CDR3 for antibody 9797 (IGHV3-30)
ARDPGYYYGLDV

SEQ ID NO: 19595 - protein, 9 aa, Homo sapiens
  Light chain CDR3 for antibody 9798 (IGKV3-20)
LQYGSSPST

SEQ ID NO: 19596 - protein, 12 aa, Homo sapiens
  Heavy chain CDR3 for antibody 9798 (IGHV3-23)
ARESGGSYSFDY

SEQ ID NO: 19597 - protein, 9 aa, Homo sapiens
  Light chain CDR3 for antibody 9799 (IGKV1-9)
QQLNSYPNT

SEQ ID NO: 19598 - protein, 16 aa, Homo sapiens
  Heavy chain CDR3 for antibody 9799 (IGHV3-23)
AKEGMVLRYFDRLWDY

SEQ ID NO: 19599 - protein, 9 aa, Homo sapiens
  Light chain CDR3 for antibody 9800 (IGKV1-6)
LQVYSYPWT

SEQ ID NO: 19600 - protein, 17 aa, Homo sapiens
  Heavy chain CDR3 for antibody 9800 (IGHV3-23)
AKDGSFYSSGWYDAFDI

SEQ ID NO: 19601 - protein, 9 aa, Homo sapiens
  Light chain CDR3 for antibody 9801 (IGKV3-20)
QQYGSSIFT

SEQ ID NO: 19602 - protein, 10 aa, Homo sapiens
  Heavy chain CDR3 for antibody 9801 (IGHV3-33)
ARENSHPLDY

SEQ ID NO: 19603 - protein, 9 aa, Homo sapiens
  Light chain CDR3 for antibody 9802 (IGKV6-21)
HQSSSLPYS

SEQ ID NO: 19604 - protein, 18 aa, Homo sapiens
  Heavy chain CDR3 for antibody 9802 (IGHV3-33)
ARDQYSGYDFYYYYGMDV

SEQ ID NO: 19605 - protein, 9 aa, Homo sapiens
  Light chain CDR3 for antibody 9803 (IGKV1D-13)
QQLNNYLFT

SEQ ID NO: 19606 - protein, 18 aa, Homo sapiens
  Heavy chain CDR3 for antibody 9803 (IGHV1-46)
ARDGDYVWGSYRSNWFDP

SEQ ID NO: 19607 - protein, 9 aa, Homo sapiens
  Light chain CDR3 for antibody 9804 (IGKV1-39)
QQSYSTPFT

SEQ ID NO: 19608 - protein, 16 aa, Homo sapiens
  Heavy chain CDR3 for antibody 9804 (IGHV3-33)
ARGAWYSNGWYGTFDI

SEQ ID NO: 19609 - protein, 9 aa, Homo sapiens
  Light chain CDR3 for antibody 9805 (IGKV3-11)
QQRSKWPPT

SEQ ID NO: 19610 - protein, 13 aa, Homo sapiens
  Heavy chain CDR3 for antibody 9805 (IGHV3-33)
ASAGNSYYNVMDV

SEQ ID NO: 19611 - protein, 9 aa, Homo sapiens
  Light chain CDR3 for antibody 9806 (IGKV1-6)
LQDFHYPWT

SEQ ID NO: 19612 - protein, 13 aa, Homo sapiens
  Heavy chain CDR3 for antibody 9806 (IGHV4-39)
ARQWPSGYWYFDL

SEQ ID NO: 19613 - protein, 9 aa, Homo sapiens
  Light chain CDR3 for antibody 9807 (IGKV2D-28)
MQALQTPGT

SEQ ID NO: 19614 - protein, 14 aa, Homo sapiens
  Heavy chain CDR3 for antibody 9807 (IGHV4-39)
ARDSGYDYYYAMDV

SEQ ID NO: 19615 - protein, 10 aa, Homo sapiens
  Light chain CDR3 for antibody 9808 (IGKV3-20)
QQYGRSPPVT

SEQ ID NO: 19616 - protein, 21 aa, Homo sapiens
  Heavy chain CDR3 for antibody 9808 (IGHV3-33)
ARKRLYDILTGYYKAYYGMDV

SEQ ID NO: 19617 - protein, 9 aa, Homo sapiens
  Light chain CDR3 for antibody 9809 (IGKV4-1)
QQYYTYPYT

SEQ ID NO: 19618 - protein, 14 aa, Homo sapiens
  Heavy chain CDR3 for antibody 9809 (IGHV3-33)
ARGYGSGSYYSFDY

SEQ ID NO: 19619 - protein, 8 aa, Homo sapiens
  Light chain CDR3 for antibody 9810 (IGKV3D-7)
QQDYNLLT

SEQ ID NO: 19620 - protein, 17 aa, Homo sapiens
  Heavy chain CDR3 for antibody 9810 (IGHV3-23)
AKEGSSSSWYGGLYFDY

SEQ ID NO: 19621 - protein, 9 aa, Homo sapiens
  Light chain CDR3 for antibody 9811 (IGKV1-33)
QQYDNLPFT

SEQ ID NO: 19622 - protein, 14 aa, Homo sapiens
  Heavy chain CDR3 for antibody 9811 (IGHV4-39)
ARDSGYDYYYAMDV

SEQ ID NO: 19623 - protein, 9 aa, Homo sapiens
  Light chain CDR3 for antibody 9812 (IGKV1-6)
QQEYNYPLT

SEQ ID NO: 19624 - protein, 9 aa, Homo sapiens
  Heavy chain CDR3 for antibody 9812 (IGHV3-66)
ARDNWGFDY

SEQ ID NO: 19625 - protein, 9 aa, Homo sapiens
  Light chain CDR3 for antibody 9813 (IGKV5-2)
LQHDKFPYT

SEQ ID NO: 19626 - protein, 12 aa, Homo sapiens
  Heavy chain CDR3 for antibody 9813 (IGHV3-53)
ARVLLWFGETDY

SEQ ID NO: 19627 - protein, 9 aa, Homo sapiens
  Light chain CDR3 for antibody 9814 (IGKV3D-7)
QQDYELPLT

SEQ ID NO: 19628 - protein, 13 aa, Homo sapiens
  Heavy chain CDR3 for antibody 9814 (IGHV3-15)
TTDRLLLFGAFDY

SEQ ID NO: 19629 - protein, 10 aa, Homo sapiens
  Light chain CDR3 for antibody 9815 (IGKV3-20)
QQYGSSPPYT

SEQ ID NO: 19630 - protein, 11 aa, Homo sapiens
  Heavy chain CDR3 for antibody 9815 (IGHV3-33)
AREGAVARFDY

SEQ ID NO: 19631 - protein, 11 aa, Homo sapiens
  Light chain CDR3 for antibody 9816 (IGKV3-11)
QQRSNWPPTWT

SEQ ID NO: 19632 - protein, 11 aa, Homo sapiens
  Heavy chain CDR3 for antibody 9816 (IGHV4-59)
ARETGDDAFDI

SEQ ID NO: 19633 - protein, 9 aa, Homo sapiens
  Light chain CDR3 for antibody 9817 (IGKV1-39)
QQSYRTPLT

SEQ ID NO: 19634 - protein, 17 aa, Homo sapiens
  Heavy chain CDR3 for antibody 9817 (IGHV4-39)
AGRLTYYYGSGSPSSDY

SEQ ID NO: 19635 - protein, 9 aa, Homo sapiens
  Light chain CDR3 for antibody 9818 (IGKV1-9)
QQGNTYSRT

SEQ ID NO: 19636 - protein, 18 aa, Homo sapiens
  Heavy chain CDR3 for antibody 9818 (IGHV6-1)
ARDQYSYGPYYYYYGMDV

SEQ ID NO: 19637 - protein, 8 aa, Homo sapiens
  Light chain CDR3 for antibody 9819 (IGKV2D-28)
MQALQTPT

SEQ ID NO: 19638 - protein, 18 aa, Homo sapiens
  Heavy chain CDR3 for antibody 9819 (IGHV3-33)
ARGGYSSGWDYYYYGMDV

SEQ ID NO: 19639 - protein, 8 aa, Homo sapiens
  Light chain CDR3 for antibody 9820 (IGKV1-5)
QQYNSYWT

SEQ ID NO: 19640 - protein, 13 aa, Homo sapiens
  Heavy chain CDR3 for antibody 9820 (IGHV3-33)
ASGYSGYAWYFDL

SEQ ID NO: 19641 - protein, 8 aa, Homo sapiens
  Light chain CDR3 for antibody 9821 (IGKV3-20)
QQYGSSLT

SEQ ID NO: 19642 - protein, 13 aa, Homo sapiens
  Heavy chain CDR3 for antibody 9821 (IGHV3-23)
ARAFFMVRGVIDF

SEQ ID NO: 19643 - protein, 9 aa, Homo sapiens
  Light chain CDR3 for antibody 9822 (IGKV1-9)
QQYISYPLT

SEQ ID NO: 19644 - protein, 10 aa, Homo sapiens
  Heavy chain CDR3 for antibody 9822 (IGHV3-20)
ATIVGPFLDV

SEQ ID NO: 19645 - protein, 10 aa, Homo sapiens
  Light chain CDR3 for antibody 9823 (IGKV3-11)
QQRSNWLMYT

SEQ ID NO: 19646 - protein, 16 aa, Homo sapiens
  Heavy chain CDR3 for antibody 9823 (IGHV3-33)
ARGGRSDWLYYYGMDV

SEQ ID NO: 19647 - protein, 10 aa, Homo sapiens
  Light chain CDR3 for antibody 9824 (IGKV3-15)
QQYNNWPPYT

SEQ ID NO: 19648 - protein, 14 aa, Homo sapiens
  Heavy chain CDR3 for antibody 9824 (IGHV1-46)
ARRGIVGALDAFDI

SEQ ID NO: 19649 - protein, 9 aa, Homo sapiens
  Light chain CDR3 for antibody 9825 (IGKV1-9)
QQLNSYPWP

SEQ ID NO: 19650 - protein, 18 aa, Homo sapiens
  Heavy chain CDR3 for antibody 9825 (IGHV3-33)
ARDRYYDILTGYYMGFDY

SEQ ID NO: 19651 - protein, 9 aa, Homo sapiens
  Light chain CDR3 for antibody 9826 (IGKV1-17)
LQHNSYPLT

SEQ ID NO: 19652 - protein, 12 aa, Homo sapiens
  Heavy chain CDR3 for antibody 9826 (IGHV3-33)
AKEGLGNDYEPY

SEQ ID NO: 19653 - protein, 9 aa, Homo sapiens
  Light chain CDR3 for antibody 9827 (IGKV6-21)
HQSSSLPYT

SEQ ID NO: 19654 - protein, 15 aa, Homo sapiens
  Heavy chain CDR3 for antibody 9827 (IGHV3-33)
ARDRVQLGYYYGMDV

SEQ ID NO: 19655 - protein, 9 aa, Homo sapiens
  Light chain CDR3 for antibody 9828 (IGKV3-11)
QQRSNWPPT

SEQ ID NO: 19656 - protein, 14 aa, Homo sapiens
  Heavy chain CDR3 for antibody 9828 (IGHV3-33)
ARWELPFYYSGMDV

SEQ ID NO: 19657 - protein, 9 aa, Homo sapiens
  Light chain CDR3 for antibody 9829 (IGKV1-39)
QQSYSTPIT

SEQ ID NO: 19658 - protein, 9 aa, Homo sapiens
  Heavy chain CDR3 for antibody 9829 (IGHV3-23)
AKEQLLFDY

SEQ ID NO: 19659 - protein, 9 aa, Homo sapiens
  Light chain CDR3 for antibody 9830 (IGKV1-6)
LQGYNYPRS

SEQ ID NO: 19660 - protein, 18 aa, Homo sapiens
  Heavy chain CDR3 for antibody 9830 (IGHV1-46)
ARDGDYVWGSYRSDWFDP

SEQ ID NO: 19661 - protein, 9 aa, Homo sapiens
  Light chain CDR3 for antibody 9831 (IGKV1-39)
QQSYSTPLT

SEQ ID NO: 19662 - protein, 23 aa, Homo sapiens
  Heavy chain CDR3 for antibody 9831 (IGHV3-11)
ARDRGITMVRGVITYYYFYGMDV

SEQ ID NO: 19663 - protein, 9 aa, Homo sapiens
  Light chain CDR3 for antibody 9832 (IGKV5-2)
LQHDNFPWT

SEQ ID NO: 19664 - protein, 15 aa, Homo sapiens
  Heavy chain CDR3 for antibody 9832 (IGHV3-23)
AKDRGWYDYYYGMDV

SEQ ID NO: 19665 - protein, 9 aa, Homo sapiens
  Light chain CDR3 for antibody 9833 (IGKV3-20)
QQYGSSPYT

SEQ ID NO: 19666 - protein, 17 aa, Homo sapiens
  Heavy chain CDR3 for antibody 9833 (IGHV3-33)
ARGEQWLGYYYYCGMDV

SEQ ID NO: 19667 - protein, 8 aa, Homo sapiens
  Light chain CDR3 for antibody 9834 (IGKV1-5)
QQYNSYYT

SEQ ID NO: 19668 - protein, 17 aa, Homo sapiens
  Heavy chain CDR3 for antibody 9834 (IGHV3-23)
AKGNYGSGSYYNGDFQH

SEQ ID NO: 19669 - protein, 9 aa, Homo sapiens
  Light chain CDR3 for antibody 9835 (IGKV3-11)
QQRSSWPPT

SEQ ID NO: 19670 - protein, 13 aa, Homo sapiens
  Heavy chain CDR3 for antibody 9835 (IGHV3-33)
ARDQRYSSGWYDY

SEQ ID NO: 19671 - protein, 9 aa, Homo sapiens
  Light chain CDR3 for antibody 9836 (IGKV4-1)
QQYYSYPWT

SEQ ID NO: 19672 - protein, 14 aa, Homo sapiens
  Heavy chain CDR3 for antibody 9836 (IGHV3-33)
AREGYSSGWDYFDH

SEQ ID NO: 19673 - protein, 9 aa, Homo sapiens
  Light chain CDR3 for antibody 9837 (IGKV6-21)
HQSSSLPYT

SEQ ID NO: 19674 - protein, 10 aa, Homo sapiens
  Heavy chain CDR3 for antibody 9837 (IGHV3-23)
AKDRYGDYVY

SEQ ID NO: 19675 - protein, 8 aa, Homo sapiens
  Light chain CDR3 for antibody 9838 (IGKV3-15)
QQYNNWPT

SEQ ID NO: 19676 - protein, 11 aa, Homo sapiens
  Heavy chain CDR3 for antibody 9838 (IGHV3-33)
ARDILTAFLDH

SEQ ID NO: 19677 - protein, 9 aa, Homo sapiens
  Light chain CDR3 for antibody 9839 (IGKV2-30)
MQGTHWPLT

SEQ ID NO: 19678 - protein, 12 aa, Homo sapiens
  Heavy chain CDR3 for antibody 9839 (IGHV3-33)
AKDPGWQQLAEY

SEQ ID NO: 19679 - protein, 8 aa, Homo sapiens
  Light chain CDR3 for antibody 9840 (IGKV3D-7)
QQDYHLLT

SEQ ID NO: 19680 - protein, 17 aa, Homo sapiens
  Heavy chain CDR3 for antibody 9840 (IGHV3-23)
AKDGSFYSSGWYDAFDI

SEQ ID NO: 19681 - protein, 9 aa, Homo sapiens
  Light chain CDR3 for antibody 9841 (IGKV1-6)
QQEYNYPLT

SEQ ID NO: 19682 - protein, 12 aa, Homo sapiens
  Heavy chain CDR3 for antibody 9841 (IGHV3-33)
ARGYFGSGYAHF

SEQ ID NO: 19683 - protein, 9 aa, Homo sapiens
  Light chain CDR3 for antibody 9842 (IGKV3-15)
QQYNNWPRT

SEQ ID NO: 19684 - protein, 15 aa, Homo sapiens
  Heavy chain CDR3 for antibody 9842 (IGHV1-18)
ARRSPNWGHYYGRDV

SEQ ID NO: 19685 - protein, 9 aa, Homo sapiens
  Light chain CDR3 for antibody 9843 (IGKV1-9)
QQLKSYPYT

SEQ ID NO: 19686 - protein, 12 aa, Homo sapiens
  Heavy chain CDR3 for antibody 9843 (IGHV3-23)
AKEYDILTGYFH

SEQ ID NO: 19687 - protein, 9 aa, Homo sapiens
  Light chain CDR3 for antibody 9844 (IGKV1-9)
QQYNTYSRT

SEQ ID NO: 19688 - protein, 11 aa, Homo sapiens
  Heavy chain CDR3 for antibody 9844 (IGHV3-33)
ARGSGSYAFDY

SEQ ID NO: 19689 - protein, 8 aa, Homo sapiens
  Light chain CDR3 for antibody 9845 (IGKV6-21)
HQSSSLPT

SEQ ID NO: 19690 - protein, 14 aa, Homo sapiens
  Heavy chain CDR3 for antibody 9845 (IGHV3-74)
ARDNILTAYYLFDY

SEQ ID NO: 19691 - protein, 9 aa, Homo sapiens
  Light chain CDR3 for antibody 9846 (IGKV1-17)
LHSNNYPWT

SEQ ID NO: 19692 - protein, 14 aa, Homo sapiens
  Heavy chain CDR3 for antibody 9846 (IGHV3-33)
ARTTAAAGPRDFQH

SEQ ID NO: 19693 - protein, 9 aa, Homo sapiens
  Light chain CDR3 for antibody 9847 (IGKV1-9)
QQVKGYPYT

SEQ ID NO: 19694 - protein, 7 aa, Homo sapiens
  Heavy chain CDR3 for antibody 9847 (IGHV1-46)
AREGGDY

SEQ ID NO: 19695 - protein, 9 aa, Homo sapiens
  Light chain CDR3 for antibody 9848 (IGKV1-17)
LHSNNYPWT

SEQ ID NO: 19696 - protein, 10 aa, Homo sapiens
  Heavy chain CDR3 for antibody 9848 (IGHV3-33)
ARDGSGSQPI

SEQ ID NO: 19697 - protein, 9 aa, Homo sapiens
  Light chain CDR3 for antibody 9849 (IGKV1-6)
LQDFHYPWT

SEQ ID NO: 19698 - protein, 10 aa, Homo sapiens
  Heavy chain CDR3 for antibody 9849 (IGHV3-23)
AKGDRWRFDP

SEQ ID NO: 19699 - protein, 9 aa, Homo sapiens
  Light chain CDR3 for antibody 9850 (IGKV1-33)
QQYDNLPFT

SEQ ID NO: 19700 - protein, 8 aa, Homo sapiens
  Heavy chain CDR3 for antibody 9850 (IGHV3-23)
AETFLFDY

SEQ ID NO: 19701 - protein, 8 aa, Homo sapiens
  Light chain CDR3 for antibody 9851 (IGKV1-5)
QQYNSYYT

SEQ ID NO: 19702 - protein, 17 aa, Homo sapiens
  Heavy chain CDR3 for antibody 9851 (IGHV4-59)
ARDRELLWFGEFGGMDV

SEQ ID NO: 19703 - protein, 9 aa, Homo sapiens
  Light chain CDR3 for antibody 9852 (IGKV1-16)
QQYYSYPRT

SEQ ID NO: 19704 - protein, 9 aa, Homo sapiens
  Heavy chain CDR3 for antibody 9852 (IGHV3-20)
ASIRGYFDY

SEQ ID NO: 19705 - protein, 9 aa, Homo sapiens
  Light chain CDR3 for antibody 9853 (IGKV1-6)
LQDYSYPWT

SEQ ID NO: 19706 - protein, 20 aa, Homo sapiens
  Heavy chain CDR3 for antibody 9853 (IGHV3-h)
ARDRCSSTSCYGYYYYGMDV

SEQ ID NO: 19707 - protein, 10 aa, Homo sapiens
  Light chain CDR3 for antibody 9854 (IGKV3-20)
QQYGRSPPVT

SEQ ID NO: 19708 - protein, 12 aa, Homo sapiens
  Heavy chain CDR3 for antibody 9854 (IGHV3-33)
ARVDTAAPYFDY

SEQ ID NO: 19709 - protein, 9 aa, Homo sapiens
  Light chain CDR3 for antibody 9855 (IGKV2-30)
MQGTHWPLT

SEQ ID NO: 19710 - protein, 17 aa, Homo sapiens
  Heavy chain CDR3 for antibody 9855 (IGHV3-23)
AKDRDWNDGQYYFGMDV

SEQ ID NO: 19711 - protein, 8 aa, Homo sapiens
  Light chain CDR3 for antibody 9856 (IGKV2D-28)
MQALQTPT

SEQ ID NO: 19712 - protein, 17 aa, Homo sapiens
  Heavy chain CDR3 for antibody 9856 (IGHV1-18)
ARERYYGSGIYKYAMDV

SEQ ID NO: 19713 - protein, 9 aa, Homo sapiens
  Light chain CDR3 for antibody 9857 (IGKV5-2)
LQHDNFPWT

SEQ ID NO: 19714 - protein, 6 aa, Homo sapiens
  Heavy chain CDR3 for antibody 9857 (IGHV1-18)
ARDDIL

SEQ ID NO: 19715 - protein, 9 aa, Homo sapiens
  Light chain CDR3 for antibody 9858 (IGKV3-15)
QQYNNWPLT

SEQ ID NO: 19716 - protein, 16 aa, Homo sapiens
  Heavy chain CDR3 for antibody 9858 (IGHV1-46)
ARGGGYSESYSNWFDP

SEQ ID NO: 19717 - protein, 9 aa, Homo sapiens
  Light chain CDR3 for antibody 9859 (IGKV1-33)
QQYDNLPFT

SEQ ID NO: 19718 - protein, 12 aa, Homo sapiens
  Heavy chain CDR3 for antibody 9859 (IGHV3-33)
ASRDILTGYLGY

SEQ ID NO: 19719 - protein, 9 aa, Homo sapiens
  Light chain CDR3 for antibody 9860 (IGKV1-6)
LQDFNYPRT

SEQ ID NO: 19720 - protein, 13 aa, Homo sapiens
  Heavy chain CDR3 for antibody 9860 (IGHV4-61)
ASRYSSGWYPFDY

SEQ ID NO: 19721 - protein, 9 aa, Homo sapiens
  Light chain CDR3 for antibody 9861 (IGKV1-17)
QQYIRYPYT

SEQ ID NO: 19722 - protein, 18 aa, Homo sapiens
  Heavy chain CDR3 for antibody 9861 (IGHV4-59)
ARDGYSGYDYYYYYGMDV

SEQ ID NO: 19723 - protein, 9 aa, Homo sapiens
  Light chain CDR3 for antibody 9862 (IGKV1D-13)
QHFNNYMYT

SEQ ID NO: 19724 - protein, 20 aa, Homo sapiens
  Heavy chain CDR3 for antibody 9862 (IGHV3-23)
AKGMGGLRYFDWPHYYGMDV

SEQ ID NO: 19725 - protein, 9 aa, Homo sapiens
  Light chain CDR3 for antibody 9863 (IGKV1D-13)
QQFNNYPST

SEQ ID NO: 19726 - protein, 7 aa, Homo sapiens
  Heavy chain CDR3 for antibody 9863 (IGHV3-33)
ARELFNY

SEQ ID NO: 19727 - protein, 8 aa, Homo sapiens
  Light chain CDR3 for antibody 9864 (IGKV2D-28)
MQALQTPT

SEQ ID NO: 19728 - protein, 13 aa, Homo sapiens
  Heavy chain CDR3 for antibody 9864 (IGHV4-39)
ARREVVGGRGFDY

SEQ ID NO: 19729 - protein, 9 aa, Homo sapiens
  Light chain CDR3 for antibody 9865 (IGKV1-17)
LQQSSYPWT

SEQ ID NO: 19730 - protein, 17 aa, Homo sapiens
  Heavy chain CDR3 for antibody 9865 (IGHV1-18)
ARDEGYDILTGYPHFDY

SEQ ID NO: 19731 - protein, 10 aa, Homo sapiens
  Light chain CDR3 for antibody 9866 (IGKV1-39)
QQSYSSPMYT

SEQ ID NO: 19732 - protein, 18 aa, Homo sapiens
  Heavy chain CDR3 for antibody 9866 (IGHV3-33)
ARDEYYGSGIYYNYGMDV

SEQ ID NO: 19733 - protein, 9 aa, Homo sapiens
  Light chain CDR3 for antibody 9867 (IGKV1-17)
LQYNSYPWT

SEQ ID NO: 19734 - protein, 14 aa, Homo sapiens
  Heavy chain CDR3 for antibody 9867 (IGHV3-33)
ARASSESSYWYFDL

SEQ ID NO: 19735 - protein, 9 aa, Homo sapiens
  Light chain CDR3 for antibody 9868 (IGKV6-21)
HQSTSLPFT

SEQ ID NO: 19736 - protein, 18 aa, Homo sapiens
  Heavy chain CDR3 for antibody 9868 (IGHV4-39)
ARGALTYYDILTGYFFDY

SEQ ID NO: 19737 - protein, 9 aa, Homo sapiens
  Light chain CDR3 for antibody 9869 (IGKV1-16)
QQYNSYPIT

SEQ ID NO: 19738 - protein, 10 aa, Homo sapiens
  Heavy chain CDR3 for antibody 9869 (IGHV4-59)
ARVVRGVFDY

SEQ ID NO: 19739 - protein, 9 aa, Homo sapiens
  Light chain CDR3 for antibody 9870 (IGKV6-21)
HQSSSFPYT

SEQ ID NO: 19740 - protein, 15 aa, Homo sapiens
  Heavy chain CDR3 for antibody 9870 (IGHV3-33)
ARDTGYSGSWNWFDP

SEQ ID NO: 19741 - protein, 9 aa, Homo sapiens
  Light chain CDR3 for antibody 9871 (IGKV6-21)
HQSSSLPLT

SEQ ID NO: 19742 - protein, 15 aa, Homo sapiens
  Heavy chain CDR3 for antibody 9871 (IGHV3-74)
SRGSGSHYFYYGMDV

SEQ ID NO: 19743 - protein, 10 aa, Homo sapiens
  Light chain CDR3 for antibody 9872 (IGKV3-11)
QQRSNWPIWT

SEQ ID NO: 19744 - protein, 14 aa, Homo sapiens
  Heavy chain CDR3 for antibody 9872 (IGHV3-33)
ARGLEWGGDNWFDP

SEQ ID NO: 19745 - protein, 9 aa, Homo sapiens
  Light chain CDR3 for antibody 9873 (IGKV1-9)
QQYNSYPYT

SEQ ID NO: 19746 - protein, 13 aa, Homo sapiens
  Heavy chain CDR3 for antibody 9873 (IGHV3-33)
VRRIAVAGTEGDC

SEQ ID NO: 19747 - protein, 9 aa, Homo sapiens
  Light chain CDR3 for antibody 9874 (IGKV3-20)
QQYGRSPRT

SEQ ID NO: 19748 - protein, 16 aa, Homo sapiens
  Heavy chain CDR3 for antibody 9874 (IGHV4-59)
ARGRYFDWLLGDVFDI

SEQ ID NO: 19749 - protein, 9 aa, Homo sapiens
  Light chain CDR3 for antibody 9875 (IGKV3D-7)
QQDYNLPYT

SEQ ID NO: 19750 - protein, 14 aa, Homo sapiens
  Heavy chain CDR3 for antibody 9875 (IGHV3-33)
AREEDYYYHYDMDV

SEQ ID NO: 19751 - protein, 10 aa, Homo sapiens
  Light chain CDR3 for antibody 9876 (IGKV3-11)
QQRSNWPIFT

SEQ ID NO: 19752 - protein, 14 aa, Homo sapiens
  Heavy chain CDR3 for antibody 9876 (IGHV1-24)
ATWLPLYYYYGMDV

SEQ ID NO: 19753 - protein, 8 aa, Homo sapiens
  Light chain CDR3 for antibody 9877 (IGKV3-11)
QQRGNWPS

SEQ ID NO: 19754 - protein, 15 aa, Homo sapiens
  Heavy chain CDR3 for antibody 9877 (IGHV3-33)
ARRGYNDYDPYGMDV

SEQ ID NO: 19755 - protein, 8 aa, Homo sapiens
  Light chain CDR3 for antibody 9878 (IGKV1-5)
QQYHSYYT

SEQ ID NO: 19756 - protein, 14 aa, Homo sapiens
  Heavy chain CDR3 for antibody 9878 (IGHV1-18)
ARCFGSGSYGWFDP

SEQ ID NO: 19757 - protein, 10 aa, Homo sapiens
  Light chain CDR3 for antibody 9879 (IGKV3-20)
QQYGRSPPVT

SEQ ID NO: 19758 - protein, 11 aa, Homo sapiens
  Heavy chain CDR3 for antibody 9879 (IGHV4-59)
AREMGHDTFDI

SEQ ID NO: 19759 - protein, 10 aa, Homo sapiens
  Light chain CDR3 for antibody 9880 (IGKV3-20)
QQYGSSPPYT

SEQ ID NO: 19760 - protein, 26 aa, Homo sapiens
  Heavy chain CDR3 for antibody 9880 (IGHV4-39)
ARQGLLWFGDLKAYDSSGYYYGYFHH

SEQ ID NO: 19761 - protein, 8 aa, Homo sapiens
  Light chain CDR3 for antibody 9881 (IGKV6-21)
HQSSSLPT

SEQ ID NO: 19762 - protein, 10 aa, Homo sapiens
  Heavy chain CDR3 for antibody 9881 (IGHV3-33)
ARENSTPLDY

SEQ ID NO: 19763 - protein, 9 aa, Homo sapiens
  Light chain CDR3 for antibody 9882 (IGKV2D-24)
TQATQFPHT

SEQ ID NO: 19764 - protein, 17 aa, Homo sapiens
  Heavy chain CDR3 for antibody 9882 (IGHV1-18)
ATEGYDILPGYYNVLDY

SEQ ID NO: 19765 - protein, 8 aa, Homo sapiens
  Light chain CDR3 for antibody 9883 (IGKV6-21)
HQSSSLPT

SEQ ID NO: 19766 - protein, 11 aa, Homo sapiens
  Heavy chain CDR3 for antibody 9883 (IGHV3-33)
ARAGIAALFDY

SEQ ID NO: 19767 - protein, 8 aa, Homo sapiens
  Light chain CDR3 for antibody 9884 (IGKV6-21)
HQSSSLYT

SEQ ID NO: 19768 - protein, 8 aa, Homo sapiens
  Heavy chain CDR3 for antibody 9884 (IGHV3-23)
AKETGNNY

SEQ ID NO: 19769 - protein, 9 aa, Homo sapiens
  Light chain CDR3 for antibody 9885 (IGKV3-11)
QQRSNWPLT

SEQ ID NO: 19770 - protein, 23 aa, Homo sapiens
  Heavy chain CDR3 for antibody 9885 (IGHV1-18)
ARNLHYDILTGYFPYYFYYGMDV

SEQ ID NO: 19771 - protein, 9 aa, Homo sapiens
  Light chain CDR3 for antibody 9886 (IGKV1-16)
QQYNSYPYT

SEQ ID NO: 19772 - protein, 15 aa, Homo sapiens
  Heavy chain CDR3 for antibody 9886 (IGHV3-33)
ARYRGWKAPVYGMDV

SEQ ID NO: 19773 - protein, 9 aa, Homo sapiens
  Light chain CDR3 for antibody 9887 (IGKV2D-28)
MQALQTPWT

SEQ ID NO: 19774 - protein, 12 aa, Homo sapiens
  Heavy chain CDR3 for antibody 9887 (IGHV4-39)
ARHPRYLDAFDI

SEQ ID NO: 19775 - protein, 9 aa, Homo sapiens
  Light chain CDR3 for antibody 9888 (IGKV1-39)
QQSYSTPLT

SEQ ID NO: 19776 - protein, 13 aa, Homo sapiens
  Heavy chain CDR3 for antibody 9888 (IGHV3-30)
ARVGDSVMVPFDY

SEQ ID NO: 19777 - protein, 8 aa, Homo sapiens
  Light chain CDR3 for antibody 9889 (IGKV3-20)
QQYGRSFT

SEQ ID NO: 19778 - protein, 13 aa, Homo sapiens
  Heavy chain CDR3 for antibody 9889 (IGHV3-11)
ARDEGYRGYVLDT

SEQ ID NO: 19779 - protein, 9 aa, Homo sapiens
  Light chain CDR3 for antibody 9890 (IGKV1-16)
QHYNDYPFT

SEQ ID NO: 19780 - protein, 14 aa, Homo sapiens
  Heavy chain CDR3 for antibody 9890 (IGHV3-33)
ARDREQQLVRYFDY

SEQ ID NO: 19781 - protein, 8 aa, Homo sapiens
  Light chain CDR3 for antibody 9891 (IGKV3-11)
QQRSNWWT

SEQ ID NO: 19782 - protein, 11 aa, Homo sapiens
  Heavy chain CDR3 for antibody 9891 (IGHV3-33)
ARARYTTGLDY

SEQ ID NO: 19783 - protein, 9 aa, Homo sapiens
  Light chain CDR3 for antibody 9892 (IGKV1-6)
LQDYKSPFT

SEQ ID NO: 19784 - protein, 19 aa, Homo sapiens
  Heavy chain CDR3 for antibody 9892 (IGHV3-33)
ARGPYYDILTGYGYYGMDV

SEQ ID NO: 19785 - protein, 10 aa, Homo sapiens
  Light chain CDR3 for antibody 9893 (IGKV3-11)
QQRSNWPMYT

SEQ ID NO: 19786 - protein, 18 aa, Homo sapiens
  Heavy chain CDR3 for antibody 9893 (IGHV3-23)
AKEGDYYGSGSYWGYFDP

SEQ ID NO: 19787 - protein, 9 aa, Homo sapiens
  Light chain CDR3 for antibody 9894 (IGKV4-1)
QQYYTTPPT

SEQ ID NO: 19788 - protein, 16 aa, Homo sapiens
  Heavy chain CDR3 for antibody 9894 (IGHV3-33)
ARDNFGSGSYYSHFHY

SEQ ID NO: 19789 - protein, 9 aa, Homo sapiens
  Light chain CDR3 for antibody 9895 (IGKV1-9)
QQLDNYLFT

SEQ ID NO: 19790 - protein, 13 aa, Homo sapiens
  Heavy chain CDR3 for antibody 9895 (IGHV3-23)
ASPFNWNDGFFDY

SEQ ID NO: 19791 - protein, 9 aa, Homo sapiens
  Light chain CDR3 for antibody 9896 (IGKV3-15)
QQYNNWPPT

SEQ ID NO: 19792 - protein, 13 aa, Homo sapiens
  Heavy chain CDR3 for antibody 9896 (IGHV4-4)
ARERGIAAAGPDY

SEQ ID NO: 19793 - protein, 10 aa, Homo sapiens
  Light chain CDR3 for antibody 9897 (IGKV1-9)
QQLDSYPMYT

SEQ ID NO: 19794 - protein, 9 aa, Homo sapiens
  Heavy chain CDR3 for antibody 9897 (IGHV3-33)
ARATVGVDY

SEQ ID NO: 19795 - protein, 10 aa, Homo sapiens
  Light chain CDR3 for antibody 9898 (IGKV3-11)
QQRSNWPILT

SEQ ID NO: 19796 - protein, 19 aa, Homo sapiens
  Heavy chain CDR3 for antibody 9898 (IGHV3-33)
AREDYYGSGSYYNEDWFDP

SEQ ID NO: 19797 - protein, 9 aa, Homo sapiens
  Light chain CDR3 for antibody 9899 (IGKV3-20)
QQYGSPPYT

SEQ ID NO: 19798 - protein, 16 aa, Homo sapiens
  Heavy chain CDR3 for antibody 9899 (IGHV3-33)
AKYAGYPNYDYSGMDV

SEQ ID NO: 19799 - protein, 9 aa, Homo sapiens
  Light chain CDR3 for antibody 9900 (IGKV3D-7)
QQDYNLPWT

SEQ ID NO: 19800 - protein, 18 aa, Homo sapiens
  Heavy chain CDR3 for antibody 9900 (IGHV3-30)
ARDRHHDILTGYSDAFEI

SEQ ID NO: 19801 - protein, 10 aa, Homo sapiens
  Light chain CDR3 for antibody 9901 (IGKV1-39)
QQSYSTPMYT

SEQ ID NO: 19802 - protein, 14 aa, Homo sapiens
  Heavy chain CDR3 for antibody 9901 (IGHV3-33)
AKDRYRGYEGLFDY

SEQ ID NO: 19803 - protein, 9 aa, Homo sapiens
  Light chain CDR3 for antibody 9902 (IGKV1-6)
LQAYNYPRT

SEQ ID NO: 19804 - protein, 12 aa, Homo sapiens
  Heavy chain CDR3 for antibody 9902 (IGHV3-33)
ARKGYDMHAFDI

SEQ ID NO: 19805 - protein, 9 aa, Homo sapiens
  Light chain CDR3 for antibody 9903 (IGKV6-21)
HQSTSLPFT

SEQ ID NO: 19806 - protein, 18 aa, Homo sapiens
  Heavy chain CDR3 for antibody 9903 (IGHV4-59)
AREGHYYTSGSYYKAFDY

SEQ ID NO: 19807 - protein, 9 aa, Homo sapiens
  Light chain CDR3 for antibody 9904 (IGKV2D-28)
MQALQTPPT

SEQ ID NO: 19808 - protein, 18 aa, Homo sapiens
  Heavy chain CDR3 for antibody 9904 (IGHV3-13)
ARDYYGSGSLYYYYGMDV

SEQ ID NO: 19809 - protein, 9 aa, Homo sapiens
  Light chain CDR3 for antibody 9905 (IGKV2D-24)
TQATQFPHT

SEQ ID NO: 19810 - protein, 15 aa, Homo sapiens
  Heavy chain CDR3 for antibody 9905 (IGHV1-46)
ARGRFFDWLLSPFDY

SEQ ID NO: 19811 - protein, 9 aa, Homo sapiens
  Light chain CDR3 for antibody 9906 (IGKV5-2)
LQHDKFPYT

SEQ ID NO: 19812 - protein, 14 aa, Homo sapiens
  Heavy chain CDR3 for antibody 9906 (IGHV3-33)
ARGYYGSGSFPFDY

SEQ ID NO: 19813 - protein, 9 aa, Homo sapiens
  Light chain CDR3 for antibody 9907 (IGKV3D-7)
QQDYTLPRT

SEQ ID NO: 19814 - protein, 18 aa, Homo sapiens
  Heavy chain CDR3 for antibody 9907 (IGHV3-33)
ARDQGIVVLPGAPWYFDP

SEQ ID NO: 19815 - protein, 9 aa, Homo sapiens
  Light chain CDR3 for antibody 9908 (IGKV1-17)
LQHNSYPYT

SEQ ID NO: 19816 - protein, 17 aa, Homo sapiens
  Heavy chain CDR3 for antibody 9908 (IGHV3-33)
ARELRYFDLLLSDAFDI

SEQ ID NO: 19817 - protein, 10 aa, Homo sapiens
  Light chain CDR3 for antibody 9909 (IGKV1-17)
LQHNSYPMYT

SEQ ID NO: 19818 - protein, 12 aa, Homo sapiens
  Heavy chain CDR3 for antibody 9909 (IGHV3-33)
ARDSSGWSHFDY

SEQ ID NO: 19819 - protein, 9 aa, Homo sapiens
  Light chain CDR3 for antibody 9910 (IGKV1-27)
QKYNSAPYT

SEQ ID NO: 19820 - protein, 18 aa, Homo sapiens
  Heavy chain CDR3 for antibody 9910 (IGHV3-33)
AREEYFGSGSYYRNWFDP

SEQ ID NO: 19821 - protein, 9 aa, Homo sapiens
  Light chain CDR3 for antibody 9911 (IGKV1-39)
QQSYSTPYT

SEQ ID NO: 19822 - protein, 12 aa, Homo sapiens
  Heavy chain CDR3 for antibody 9911 (IGHV3-30)
ARDYGSGSFFDY

SEQ ID NO: 19823 - protein, 9 aa, Homo sapiens
  Light chain CDR3 for antibody 9912 (IGKV3-15)
QQYHNWPRT

SEQ ID NO: 19824 - protein, 12 aa, Homo sapiens
  Heavy chain CDR3 for antibody 9912 (IGHV3-33)
TRGYSSKSYFDY

SEQ ID NO: 19825 - protein, 9 aa, Homo sapiens
  Light chain CDR3 for antibody 9913 (IGKV1-17)
LQHNSYPPT

SEQ ID NO: 19826 - protein, 17 aa, Homo sapiens
  Heavy chain CDR3 for antibody 9913 (IGHV4-39)
AGRLTYYYGSGSPSSDY

SEQ ID NO: 19827 - protein, 8 aa, Homo sapiens
  Light chain CDR3 for antibody 9914 (IGKV6-21)
HQSSSLPT

SEQ ID NO: 19828 - protein, 18 aa, Homo sapiens
  Heavy chain CDR3 for antibody 9914 (IGHV3-33)
ARGLLWFGVSYYYYGMDV

SEQ ID NO: 19829 - protein, 9 aa, Homo sapiens
  Light chain CDR3 for antibody 9915 (IGKV1-16)
QHYNDYPFT

SEQ ID NO: 19830 - protein, 13 aa, Homo sapiens
  Heavy chain CDR3 for antibody 9915 (IGHV4-39)
ARHVLLWFGEFDP

SEQ ID NO: 19831 - protein, 9 aa, Homo sapiens
  Light chain CDR3 for antibody 9916 (IGKV1-27)
QKYNSAPHT

SEQ ID NO: 19832 - protein, 13 aa, Homo sapiens
  Heavy chain CDR3 for antibody 9916 (IGHV3-23)
ARDSTLVRGVFPY

SEQ ID NO: 19833 - protein, 9 aa, Homo sapiens
  Light chain CDR3 for antibody 9917 (IGKV1-9)
LHSNNYPWT

SEQ ID NO: 19834 - protein, 20 aa, Homo sapiens
  Heavy chain CDR3 for antibody 9917 (IGHV3-33)
ARDNDSSGYYDYYYYYGMDV

SEQ ID NO: 19835 - protein, 10 aa, Homo sapiens
  Light chain CDR3 for antibody 9918 (IGKV3-20)
QQYGRSPPVP

SEQ ID NO: 19836 - protein, 14 aa, Homo sapiens
  Heavy chain CDR3 for antibody 9918 (IGHV3-33)
AREGYSSNWYDFDY

SEQ ID NO: 19837 - protein, 10 aa, Homo sapiens
  Light chain CDR3 for antibody 9919 (IGKV3-11)
QQRSNWPPWT

SEQ ID NO: 19838 - protein, 10 aa, Homo sapiens
  Heavy chain CDR3 for antibody 9919 (IGHV3-23)
AKDRYGDYVY

SEQ ID NO: 19839 - protein, 9 aa, Homo sapiens
  Light chain CDR3 for antibody 9920 (IGKV1-6)
LQDYNYPYT

SEQ ID NO: 19840 - protein, 18 aa, Homo sapiens
  Heavy chain CDR3 for antibody 9920 (IGHV1-8)
ARGAWYYYGSGSYYTFDY

SEQ ID NO: 19841 - protein, 10 aa, Homo sapiens
  Light chain CDR3 for antibody 9921 (IGKV3-11)
QQRSNWPALT

SEQ ID NO: 19842 - protein, 16 aa, Homo sapiens
  Heavy chain CDR3 for antibody 9921 (IGHV3-33)
ARGDDILTHQYYGVDV

SEQ ID NO: 19843 - protein, 9 aa, Homo sapiens
  Light chain CDR3 for antibody 9922 (IGKV1-16)
QHYNDYPFT

SEQ ID NO: 19844 - protein, 11 aa, Homo sapiens
  Heavy chain CDR3 for antibody 9922 (IGHV3-33)
ARGSGSYAFDY

SEQ ID NO: 19845 - protein, 10 aa, Homo sapiens
  Light chain CDR3 for antibody 9923 (IGKV1-39)
QQSYSSPMYT

SEQ ID NO: 19846 - protein, 15 aa, Homo sapiens
  Heavy chain CDR3 for antibody 9923 (IGHV3-33)
ARAYDLPHYYYGMDV

SEQ ID NO: 19847 - protein, 9 aa, Homo sapiens
  Light chain CDR3 for antibody 9924 (IGKV1-6)
QQEYNYPLT

SEQ ID NO: 19848 - protein, 11 aa, Homo sapiens
  Heavy chain CDR3 for antibody 9924 (IGHV1-18)
SRGGFSVGYDS

SEQ ID NO: 19849 - protein, 9 aa, Homo sapiens
  Light chain CDR3 for antibody 9925 (IGKV1D-16)
LHSNNYPWT

SEQ ID NO: 19850 - protein, 12 aa, Homo sapiens
  Heavy chain CDR3 for antibody 9925 (IGHV3-23)
AKEYDILTGYFH

SEQ ID NO: 19851 - protein, 8 aa, Homo sapiens
  Light chain CDR3 for antibody 9926 (IGKV1D-13)
QQFNNYYT

SEQ ID NO: 19852 - protein, 14 aa, Homo sapiens
  Heavy chain CDR3 for antibody 9926 (IGHV1-46)
ARKGIVGAFDAFDI

SEQ ID NO: 19853 - protein, 9 aa, Homo sapiens
  Light chain CDR3 for antibody 9927 (IGKV1-39)
QQLNRYPYT

SEQ ID NO: 19854 - protein, 10 aa, Homo sapiens
  Heavy chain CDR3 for antibody 9927 (IGHV3-23)
AKGDRWRFDP

SEQ ID NO: 19855 - protein, 9 aa, Homo sapiens
  Light chain CDR3 for antibody 9928 (IGKV2-30)
MQGTHWPLT

SEQ ID NO: 19856 - protein, 19 aa, Homo sapiens
  Heavy chain CDR3 for antibody 9928 (IGHV1-18)
ARGGHIGVVTAFHGYGMDV

SEQ ID NO: 19857 - protein, 9 aa, Homo sapiens
  Light chain CDR3 for antibody 9929 (IGKV1-39)
QQSYSTPLT

SEQ ID NO: 19858 - protein, 16 aa, Homo sapiens
  Heavy chain CDR3 for antibody 9929 (IGHV3-21)
AKDAFYYGSGSHLFDY

SEQ ID NO: 19859 - protein, 9 aa, Homo sapiens
  Light chain CDR3 for antibody 9930 (IGKV2D-24)
TQATQFPHT

SEQ ID NO: 19860 - protein, 17 aa, Homo sapiens
  Heavy chain CDR3 for antibody 9930 (IGHV1-8)
ARGDYYGSGSPYWYFDL

SEQ ID NO: 19861 - protein, 9 aa, Homo sapiens
  Light chain CDR3 for antibody 9931 (IGKV4-1)
QQYYTTPPT

SEQ ID NO: 19862 - protein, 18 aa, Homo sapiens
  Heavy chain CDR3 for antibody 9931 (IGHV4-59)
AREGDYVWGSYRPNWFDP

SEQ ID NO: 19863 - protein, 9 aa, Homo sapiens
  Light chain CDR3 for antibody 9932 (IGKV1-9)
QQLNSYPWT

SEQ ID NO: 19864 - protein, 15 aa, Homo sapiens
  Heavy chain CDR3 for antibody 9932 (IGHV1-18)
ARGYCSSTSCYYFDY

SEQ ID NO: 19865 - protein, 6 aa, Homo sapiens
  Light chain CDR3 for antibody 9933 (IGKV3-20)
QQYGST

SEQ ID NO: 19866 - protein, 17 aa, Homo sapiens
  Heavy chain CDR3 for antibody 9933 (IGHV3-33)
AREGYYYGSGSYHFFDY

SEQ ID NO: 19867 - protein, 10 aa, Homo sapiens
  Light chain CDR3 for antibody 9934 (IGKV1-27)
QKYNSAPMYT

SEQ ID NO: 19868 - protein, 12 aa, Homo sapiens
  Heavy chain CDR3 for antibody 9934 (IGHV1-46)
ARGLTGDHAVDI

SEQ ID NO: 19869 - protein, 10 aa, Homo sapiens
  Light chain CDR3 for antibody 9935 (IGKV3-15)
QQYNNWPPLT

SEQ ID NO: 19870 - protein, 16 aa, Homo sapiens
  Heavy chain CDR3 for antibody 9935 (IGHV3-33)
ARDRNWGPHLYWYFDL

SEQ ID NO: 19871 - protein, 9 aa, Homo sapiens
  Light chain CDR3 for antibody 9936 (IGKV1D-13)
QQFNNYPST

SEQ ID NO: 19872 - protein, 17 aa, Homo sapiens
  Heavy chain CDR3 for antibody 9936 (IGHV3-33)
ARDQDDILTGYYWYFDL

SEQ ID NO: 19873 - protein, 9 aa, Homo sapiens
  Light chain CDR3 for antibody 9937 (IGKV2D-28)
MQALQTPPT

SEQ ID NO: 19874 - protein, 14 aa, Homo sapiens
  Heavy chain CDR3 for antibody 9937 (IGHV3-23)
AKDRYRGYEGLFDY

SEQ ID NO: 19875 - protein, 9 aa, Homo sapiens
  Light chain CDR3 for antibody 9938 (IGKV1-9)
QQYNSYPLT

SEQ ID NO: 19876 - protein, 19 aa, Homo sapiens
  Heavy chain CDR3 for antibody 9938 (IGHV3-33)
ARGSDYDILTGYSSDAFDI

SEQ ID NO: 19877 - protein, 9 aa, Homo sapiens
  Light chain CDR3 for antibody 9939 (IGKV1-16)
QHYNDYPFT

SEQ ID NO: 19878 - protein, 11 aa, Homo sapiens
  Heavy chain CDR3 for antibody 9939 (IGHV3-33)
ARDTWDDYFDY

SEQ ID NO: 19879 - protein, 8 aa, Homo sapiens
  Light chain CDR3 for antibody 9940 (IGKV1D-13)
QQFNTYPT

SEQ ID NO: 19880 - protein, 15 aa, Homo sapiens
  Heavy chain CDR3 for antibody 9940 (IGHV3-33)
AKEALRYFDWSGMDV

SEQ ID NO: 19881 - protein, 9 aa, Homo sapiens
  Light chain CDR3 for antibody 9941 (IGKV3D-7)
QQDYNFALT

SEQ ID NO: 19882 - protein, 17 aa, Homo sapiens
  Heavy chain CDR3 for antibody 9941 (IGHV3-33)
ARGEQWLGYYYYYGMDV

SEQ ID NO: 19883 - protein, 9 aa, Homo sapiens
  Light chain CDR3 for antibody 9942 (IGKV2-30)
MQGTHWPLT

SEQ ID NO: 19884 - protein, 19 aa, Homo sapiens
  Heavy chain CDR3 for antibody 9942 (IGHV1-18)
ARDTTLVRGLMNYYYGMDV

SEQ ID NO: 19885 - protein, 9 aa, Homo sapiens
  Light chain CDR3 for antibody 9943 (IGKV1-9)
QQLNGYPFT

SEQ ID NO: 19886 - protein, 8 aa, Homo sapiens
  Heavy chain CDR3 for antibody 9943 (IGHV3-33)
ARDRGFDY

SEQ ID NO: 19887 - protein, 9 aa, Homo sapiens
  Light chain CDR3 for antibody 9944 (IGKV1D-13)
QQFNNYPYT

SEQ ID NO: 19888 - protein, 11 aa, Homo sapiens
  Heavy chain CDR3 for antibody 9944 (IGHV3-33)
ARDRATAGLDY

SEQ ID NO: 19889 - protein, 9 aa, Homo sapiens
  Light chain CDR3 for antibody 9945 (IGKV6-21)
HQSTSLPFT

SEQ ID NO: 19890 - protein, 10 aa, Homo sapiens
  Heavy chain CDR3 for antibody 9945 (IGHV3-33)
ARDGSGSYPI

SEQ ID NO: 19891 - protein, 9 aa, Homo sapiens
  Light chain CDR3 for antibody 9946 (IGKV1-17)
LQHNTYPWT

SEQ ID NO: 19892 - protein, 14 aa, Homo sapiens
  Heavy chain CDR3 for antibody 9946 (IGHV3-33)
ARTTAAAGPRDLHH

SEQ ID NO: 19893 - protein, 9 aa, Homo sapiens
  Light chain CDR3 for antibody 9947 (IGKV1D-16)
QQYYSYPYT

SEQ ID NO: 19894 - protein, 9 aa, Homo sapiens
  Heavy chain CDR3 for antibody 9947 (IGHV3-30)
ARDDYGVDV

SEQ ID NO: 19895 - protein, 8 aa, Homo sapiens
  Light chain CDR3 for antibody 9948 (IGKV3-20)
QQYGSSRT

SEQ ID NO: 19896 - protein, 17 aa, Homo sapiens
  Heavy chain CDR3 for antibody 9948 (IGHV1-18)
ARERYYGSGSYKYNMDV

SEQ ID NO: 19897 - protein, 8 aa, Homo sapiens
  Light chain CDR3 for antibody 9949 (IGKV3-11)
QQRGNWPS

SEQ ID NO: 19898 - protein, 18 aa, Homo sapiens
  Heavy chain CDR3 for antibody 9949 (IGHV3-23)
AKDRITGTTYGYYSGLDV

SEQ ID NO: 19899 - protein, 9 aa, Homo sapiens
  Light chain CDR3 for antibody 9950 (IGKV6-21)
HQSYSYPLT

SEQ ID NO: 19900 - protein, 13 aa, Homo sapiens
  Heavy chain CDR3 for antibody 9950 (IGHV4-59)
ARDAGYSSSWFDY

SEQ ID NO: 19901 - protein, 9 aa, Homo sapiens
  Light chain CDR3 for antibody 9951 (IGKV3D-20)
QQYGSSPYT

SEQ ID NO: 19902 - protein, 17 aa, Homo sapiens
  Heavy chain CDR3 for antibody 9951 (IGHV3-66)
ARCYCHTTICYLYYFDY

SEQ ID NO: 19903 - protein, 9 aa, Homo sapiens
  Light chain CDR3 for antibody 9952 (IGKV1-9)
QQLKSYLYT

SEQ ID NO: 19904 - protein, 15 aa, Homo sapiens
  Heavy chain CDR3 for antibody 9952 (IGHV3-20)
ARDRGSSGWRDWFDP

SEQ ID NO: 19905 - protein, 9 aa, Homo sapiens
  Light chain CDR3 for antibody 9953 (IGKV3D-7)
QQDYTLPLT

SEQ ID NO: 19906 - protein, 13 aa, Homo sapiens
  Heavy chain CDR3 for antibody 9953 (IGHV4-39)
ARPGIVAAGWFDP

SEQ ID NO: 19907 - protein, 9 aa, Homo sapiens
  Light chain CDR3 for antibody 9954 (IGKV5-2)
LQHDKFPYT

SEQ ID NO: 19908 - protein, 13 aa, Homo sapiens
  Heavy chain CDR3 for antibody 9954 (IGHV3-33)
AREGDPQPDAFDI

SEQ ID NO: 19909 - protein, 10 aa, Homo sapiens
  Light chain CDR3 for antibody 9955 (IGKV1-9)
QQLNSFLMYT

SEQ ID NO: 19910 - protein, 13 aa, Homo sapiens
  Heavy chain CDR3 for antibody 9955 (IGHV4-39)
ARREVVGGRGFDY

SEQ ID NO: 19911 - protein, 9 aa, Homo sapiens
  Light chain CDR3 for antibody 9956 (IGKV1D-16)
QQYNSYPYT

SEQ ID NO: 19912 - protein, 18 aa, Homo sapiens
  Heavy chain CDR3 for antibody 9956 (IGHV3-33)
ARREGIVGATTYYDGMDV

SEQ ID NO: 19913 - protein, 10 aa, Homo sapiens
  Light chain CDR3 for antibody 9957 (IGKV3-11)
QQRSNWPIYT

SEQ ID NO: 19914 - protein, 13 aa, Homo sapiens
  Heavy chain CDR3 for antibody 9957 (IGHV3-33)
ARDYTMVRGVMNY

SEQ ID NO: 19915 - protein, 8 aa, Homo sapiens
  Light chain CDR3 for antibody 9958 (IGKV3-20)
QQYGSSLT

SEQ ID NO: 19916 - protein, 17 aa, Homo sapiens
  Heavy chain CDR3 for antibody 9958 (IGHV3-33)
ARAYYDILTGYSYYFDY

SEQ ID NO: 19917 - protein, 9 aa, Homo sapiens
  Light chain CDR3 for antibody 9959 (IGKV3D-7)
QQDYNLPYT

SEQ ID NO: 19918 - protein, 15 aa, Homo sapiens
  Heavy chain CDR3 for antibody 9959 (IGHV3-33)
ARRSILTGSYWYFDL

SEQ ID NO: 19919 - protein, 9 aa, Homo sapiens
  Light chain CDR3 for antibody 9960 (IGKV2-30)
MQGKHWPLT

SEQ ID NO: 19920 - protein, 17 aa, Homo sapiens
  Heavy chain CDR3 for antibody 9960 (IGHV3-33)
ARSGIVGATDYYYGLDV

SEQ ID NO: 19921 - protein, 10 aa, Homo sapiens
  Light chain CDR3 for antibody 9961 (IGKV3-11)
QQRSTWPTLT

SEQ ID NO: 19922 - protein, 18 aa, Homo sapiens
  Heavy chain CDR3 for antibody 9961 (IGHV4-59)
AREGHYYTSGSYYKAFDY

SEQ ID NO: 19923 - protein, 8 aa, Homo sapiens
  Light chain CDR3 for antibody 9962 (IGKV3-11)
LQRGNWPT

SEQ ID NO: 19924 - protein, 17 aa, Homo sapiens
  Heavy chain CDR3 for antibody 9962 (IGHV3-23)
AKDGSFYSSGWYDAFDI

SEQ ID NO: 19925 - protein, 10 aa, Homo sapiens
  Light chain CDR3 for antibody 9963 (IGKV3-15)
QQYNNWPPYT

SEQ ID NO: 19926 - protein, 11 aa, Homo sapiens
  Heavy chain CDR3 for antibody 9963 (IGHV3-64)
ARERGSYAFDI

SEQ ID NO: 19927 - protein, 9 aa, Homo sapiens
  Light chain CDR3 for antibody 9964 (IGKV3D-20)
QQYGSSPYT

SEQ ID NO: 19928 - protein, 17 aa, Homo sapiens
  Heavy chain CDR3 for antibody 9964 (IGHV3-33)
ARELRYFDWLLSDAFDI

SEQ ID NO: 19929 - protein, 10 aa, Homo sapiens
  Light chain CDR3 for antibody 9965 (IGKV1-39)
QQSYSSPMYT

SEQ ID NO: 19930 - protein, 13 aa, Homo sapiens
  Heavy chain CDR3 for antibody 9965 (IGHV3-66)
ARGDNWNDGGFDY

SEQ ID NO: 19931 - protein, 9 aa, Homo sapiens
  Light chain CDR3 for antibody 9966 (IGKV1-6)
LQDYNYPYT

SEQ ID NO: 19932 - protein, 20 aa, Homo sapiens
  Heavy chain CDR3 for antibody 9966 (IGHV3-33)
ARAGDIAVAGTHYYYYGMDV

SEQ ID NO: 19933 - protein, 10 aa, Homo sapiens
  Light chain CDR3 for antibody 9967 (IGKV3-15)
QQYNNWPPIT

SEQ ID NO: 19934 - protein, 17 aa, Homo sapiens
  Heavy chain CDR3 for antibody 9967 (IGHV3-33)
TRDSGMVRGIIIYGMDV

SEQ ID NO: 19935 - protein, 9 aa, Homo sapiens
  Light chain CDR3 for antibody 9968 (IGKV1-9)
QQLHIYPWT

SEQ ID NO: 19936 - protein, 14 aa, Homo sapiens
  Heavy chain CDR3 for antibody 9968 (IGHV3-33)
ANWAYDILTGYLDY

SEQ ID NO: 19937 - protein, 10 aa, Homo sapiens
  Light chain CDR3 for antibody 9969 (IGKV3-11)
QQRSNCPALA

SEQ ID NO: 19938 - protein, 13 aa, Homo sapiens
  Heavy chain CDR3 for antibody 9969 (IGHV3-33)
AKEDGDYHHYFDY

SEQ ID NO: 19939 - protein, 10 aa, Homo sapiens
  Light chain CDR3 for antibody 9970 (IGKV1-39)
QQSYSTPMYT

SEQ ID NO: 19940 - protein, 18 aa, Homo sapiens
  Heavy chain CDR3 for antibody 9970 (IGHV3-23)
AKERGYYGSGSYSNWFDP

SEQ ID NO: 19941 - protein, 9 aa, Homo sapiens
  Light chain CDR3 for antibody 9971 (IGKV2-30)
MQGTHWPLT

SEQ ID NO: 19942 - protein, 13 aa, Homo sapiens
  Heavy chain CDR3 for antibody 9971 (IGHV3-33)
AKCIVAAIGGFDY

SEQ ID NO: 19943 - protein, 9 aa, Homo sapiens
  Light chain CDR3 for antibody 9972 (IGKV6-21)
HQSSSLPYT

SEQ ID NO: 19944 - protein, 13 aa, Homo sapiens
  Heavy chain CDR3 for antibody 9972 (IGHV3-23)
AKERLRYFDWLAY

SEQ ID NO: 19945 - protein, 8 aa, Homo sapiens
  Light chain CDR3 for antibody 9973 (IGKV1-5)
QQYNSYST

SEQ ID NO: 19946 - protein, 19 aa, Homo sapiens
  Heavy chain CDR3 for antibody 9973 (IGHV1-18)
ARDDILTGYSLYYYYGMDV

SEQ ID NO: 19947 - protein, 10 aa, Homo sapiens
  Light chain CDR3 for antibody 9974 (IGKV3-15)
QQYNNWPPIT

SEQ ID NO: 19948 - protein, 11 aa, Homo sapiens
  Heavy chain CDR3 for antibody 9974 (IGHV4-59)
ARDGVRGVFDI

SEQ ID NO: 19949 - protein, 9 aa, Homo sapiens
  Light chain CDR3 for antibody 9975 (IGKV1-9)
QQYNSYPYT

SEQ ID NO: 19950 - protein, 13 aa, Homo sapiens
  Heavy chain CDR3 for antibody 9975 (IGHV3-33)
AKCIVAAIGGLDY

SEQ ID NO: 19951 - protein, 9 aa, Homo sapiens
  Light chain CDR3 for antibody 9976 (IGKV1-9)
QQLNSYPWT

SEQ ID NO: 19952 - protein, 20 aa, Homo sapiens
  Heavy chain CDR3 for antibody 9976 (IGHV1-18)
AREVGIAVAGTLYYYYGMEV

SEQ ID NO: 19953 - protein, 6 aa, Homo sapiens
  Light chain CDR3 for antibody 9977 (IGKV3-20)
QQYGST

SEQ ID NO: 19954 - protein, 17 aa, Homo sapiens
  Heavy chain CDR3 for antibody 9977 (IGHV3-33)
ARDLIGPLSSSWYPFDY

SEQ ID NO: 19955 - protein, 10 aa, Homo sapiens
  Light chain CDR3 for antibody 9978 (IGKV1-39)
QQSYSTPMYT

SEQ ID NO: 19956 - protein, 14 aa, Homo sapiens
  Heavy chain CDR3 for antibody 9978 (IGHV4-39)
ARQGTMIRGGYFDY

SEQ ID NO: 19957 - protein, 9 aa, Homo sapiens
  Light chain CDR3 for antibody 9979 (IGKV1-9)
QQYKSYPYT

SEQ ID NO: 19958 - protein, 13 aa, Homo sapiens
  Heavy chain CDR3 for antibody 9979 (IGHV3-33)
ARAFIMVRGVIDY

SEQ ID NO: 19959 - protein, 8 aa, Homo sapiens
  Light chain CDR3 for antibody 9980 (IGKV3-20)
QQYGSSRT

SEQ ID NO: 19960 - protein, 10 aa, Homo sapiens
  Heavy chain CDR3 for antibody 9980 (IGHV3-23)
AKGDRWRFDP

SEQ ID NO: 19961 - protein, 9 aa, Homo sapiens
  Light chain CDR3 for antibody 9981 (IGKV3D-11)
QQRSNWQYT

SEQ ID NO: 19962 - protein, 16 aa, Homo sapiens
  Heavy chain CDR3 for antibody 9981 (IGHV3-33)
ARIAAPGSEYYYGMDV

SEQ ID NO: 19963 - protein, 9 aa, Homo sapiens
  Light chain CDR3 for antibody 9982 (IGKV1-6)
LQAYSYPFT

SEQ ID NO: 19964 - protein, 15 aa, Homo sapiens
  Heavy chain CDR3 for antibody 9982 (IGHV3-23)
AKEALRYFDWSGMDV

SEQ ID NO: 19965 - protein, 8 aa, Homo sapiens
  Light chain CDR3 for antibody 9983 (IGKV3-20)
QQYGRSFT

SEQ ID NO: 19966 - protein, 19 aa, Homo sapiens
  Heavy chain CDR3 for antibody 9983 (IGHV3-33)
TRDPHYDILTGYAYYGMDV

SEQ ID NO: 19967 - protein, 9 aa, Homo sapiens
  Light chain CDR3 for antibody 9984 (IGKV1-17)
LQQNSYPWT

SEQ ID NO: 19968 - protein, 9 aa, Homo sapiens
  Heavy chain CDR3 for antibody 9984 (IGHV4-59)
AREGGSGSL

SEQ ID NO: 19969 - protein, 9 aa, Homo sapiens
  Light chain CDR3 for antibody 9985 (IGKV3-11)
QQRSNWPPT

SEQ ID NO: 19970 - protein, 14 aa, Homo sapiens
  Heavy chain CDR3 for antibody 9985 (IGHV3-33)
AKKGYSGRYYYFDY

SEQ ID NO: 19971 - protein, 9 aa, Homo sapiens
  Light chain CDR3 for antibody 9986 (IGKV6-21)
HQSSSLPRT

SEQ ID NO: 19972 - protein, 12 aa, Homo sapiens
  Heavy chain CDR3 for antibody 9986 (IGHV4-61)
ARVGSSGWYFDY

SEQ ID NO: 19973 - protein, 9 aa, Homo sapiens
  Light chain CDR3 for antibody 9987 (IGKV1-9)
QQLTSFPRT

SEQ ID NO: 19974 - protein, 18 aa, Homo sapiens
  Heavy chain CDR3 for antibody 9987 (IGHV1-46)
ARDGDYVWGSYRSDWFDP

SEQ ID NO: 19975 - protein, 9 aa, Homo sapiens
  Light chain CDR3 for antibody 9988 (IGKV1D-16)
QQYYSYPRT

SEQ ID NO: 19976 - protein, 24 aa, Homo sapiens
  Heavy chain CDR3 for antibody 9988 (IGHV1-46)
ARDEARGLLTGYYNMREYYYGMDV

SEQ ID NO: 19977 - protein, 10 aa, Homo sapiens
  Light chain CDR3 for antibody 9989 (IGKV3-15)
QQYNNWPPIT

SEQ ID NO: 19978 - protein, 8 aa, Homo sapiens
  Heavy chain CDR3 for antibody 9989 (IGHV3-33)
ARDRGFDY

SEQ ID NO: 19979 - protein, 10 aa, Homo sapiens
  Light chain CDR3 for antibody 9990 (IGKV3-11)
QQRSNWPALT

SEQ ID NO: 19980 - protein, 13 aa, Homo sapiens
  Heavy chain CDR3 for antibody 9990 (IGHV4-61)
ASRYSSGWYPFDY

SEQ ID NO: 19981 - protein, 9 aa, Homo sapiens
  Light chain CDR3 for antibody 9991 (IGKV1D-13)
QQFNNYPHT

SEQ ID NO: 19982 - protein, 18 aa, Homo sapiens
  Heavy chain CDR3 for antibody 9991 (IGHV1-8)
ARGRYNSGWNYYYFGMDV

SEQ ID NO: 19983 - protein, 8 aa, Homo sapiens
  Light chain CDR3 for antibody 9992 (IGKV2D-28)
MQALQTPT

SEQ ID NO: 19984 - protein, 14 aa, Homo sapiens
  Heavy chain CDR3 for antibody 9992 (IGHV3-30)
ARAISGSSYWYFDL

SEQ ID NO: 19985 - protein, 9 aa, Homo sapiens
  Light chain CDR3 for antibody 9993 (IGKV2D-24)
TQATQFPHT

SEQ ID NO: 19986 - protein, 13 aa, Homo sapiens
  Heavy chain CDR3 for antibody 9993 (IGHV1-46)
ARRQVGYYYGMDV

SEQ ID NO: 19987 - protein, 9 aa, Homo sapiens
  Light chain CDR3 for antibody 9994 (IGKV1-6)
LQDYSYPWT

SEQ ID NO: 19988 - protein, 11 aa, Homo sapiens
  Heavy chain CDR3 for antibody 9994 (IGHV3-33)
ARAGIAALCDY

SEQ ID NO: 19989 - protein, 9 aa, Homo sapiens
  Light chain CDR3 for antibody 9995 (IGKV1-6)
LQGYNYPRS

SEQ ID NO: 19990 - protein, 12 aa, Homo sapiens
  Heavy chain CDR3 for antibody 9995 (IGHV1-46)
ARGLTGDHAFDI

SEQ ID NO: 19991 - protein, 8 aa, Homo sapiens
  Light chain CDR3 for antibody 9996 (IGKV1D-13)
QQFNTYHT

SEQ ID NO: 19992 - protein, 13 aa, Homo sapiens
  Heavy chain CDR3 for antibody 9996 (IGHV4-39)
ARQWPSGYWYFDL

SEQ ID NO: 19993 - protein, 9 aa, Homo sapiens
  Light chain CDR3 for antibody 9997 (IGKV3D-11)
QQRSNWQYT

SEQ ID NO: 19994 - protein, 14 aa, Homo sapiens
  Heavy chain CDR3 for antibody 9997 (IGHV3-33)
ARDNILTAYYLFDY

SEQ ID NO: 19995 - protein, 8 aa, Homo sapiens
  Light chain CDR3 for antibody 9998 (IGKV6-21)
HQSSSLPT

SEQ ID NO: 19996 - protein, 12 aa, Homo sapiens
  Heavy chain CDR3 for antibody 9998 (IGHV3-33)
ARDLVGATPFDY

SEQ ID NO: 19997 - protein, 9 aa, Homo sapiens
  Light chain CDR3 for antibody 9999 (IGKV2-30)
MQGTHWPLT

SEQ ID NO: 19998 - protein, 18 aa, Homo sapiens
  Heavy chain CDR3 for antibody 9999 (IGHV3-33)
AKERGYYGSGSYSNWFDP

SEQ ID NO: 19999 - protein, 8 aa, Homo sapiens
  Light chain CDR3 for antibody 10000 (IGKV1-5)
QQYNSYYT

SEQ ID NO: 20000 - protein, 15 aa, Homo sapiens
  Heavy chain CDR3 for antibody 10000 (IGHV3-33)
AKDLSSGWYAYFFDY

SEQ ID NO: 20001 - protein, 10 aa, Homo sapiens
  Light chain CDR3 for antibody 10001 (IGKV4-1)
QQYYDISMYT

SEQ ID NO: 20002 - protein, 17 aa, Homo sapiens
  Heavy chain CDR3 for antibody 10001 (IGHV4-59)
ARDLLVRGEGSYYGMDV

SEQ ID NO: 20003 - protein, 10 aa, Homo sapiens
  Light chain CDR3 for antibody 10002 (IGKV3-11)
QQRSNWPIFT

SEQ ID NO: 20004 - protein, 8 aa, Homo sapiens
  Heavy chain CDR3 for antibody 10002 (IGHV3-33)
ARDRGFDY

SEQ ID NO: 20005 - protein, 9 aa, Homo sapiens
  Light chain CDR3 for antibody 10003 (IGKV3-11)
QQRINWPWT

SEQ ID NO: 20006 - protein, 11 aa, Homo sapiens
  Heavy chain CDR3 for antibody 10003 (IGHV3-23)
AKGLWPYYFDY

SEQ ID NO: 20007 - protein, 9 aa, Homo sapiens
  Light chain CDR3 for antibody 10004 (IGKV3D-7)
QQDYKSPLT

SEQ ID NO: 20008 - protein, 12 aa, Homo sapiens
  Heavy chain CDR3 for antibody 10004 (IGHV3-33)
ARKGYDMHEFDI

SEQ ID NO: 20009 - protein, 9 aa, Homo sapiens
  Light chain CDR3 for antibody 10005 (IGKV1-6)
LQVYNYPWT

SEQ ID NO: 20010 - protein, 12 aa, Homo sapiens
  Heavy chain CDR3 for antibody 10005 (IGHV3-33)
ARKGYDMHAFDI

SEQ ID NO: 20011 - protein, 8 aa, Homo sapiens
  Light chain CDR3 for antibody 10006 (IGKV1-5)
QQYNSYYT

SEQ ID NO: 20012 - protein, 15 aa, Homo sapiens
  Heavy chain CDR3 for antibody 10006 (IGHV3-23)
AKDRDYDFLSGPFDY

SEQ ID NO: 20013 - protein, 9 aa, Homo sapiens
  Light chain CDR3 for antibody 10007 (IGKV1-17)
LQHYSYPPT

SEQ ID NO: 20014 - protein, 12 aa, Homo sapiens
  Heavy chain CDR3 for antibody 10007 (IGHV3-9)
AEDPFLGTSFDY

SEQ ID NO: 20015 - protein, 10 aa, Homo sapiens
  Light chain CDR3 for antibody 10008 (IGKV3-15)
QQYNNWPPYT

SEQ ID NO: 20016 - protein, 12 aa, Homo sapiens
  Heavy chain CDR3 for antibody 10008 (IGHV3-23)
AKEGLGSDYEPY

SEQ ID NO: 20017 - protein, 9 aa, Homo sapiens
  Light chain CDR3 for antibody 10009 (IGKV1-17)
LQHNSYPYT

SEQ ID NO: 20018 - protein, 11 aa, Homo sapiens
  Heavy chain CDR3 for antibody 10009 (IGHV3-h)
AREDYYYGMDV

SEQ ID NO: 20019 - protein, 9 aa, Homo sapiens
  Light chain CDR3 for antibody 10010 (IGKV1-9)
QQLNSYPLT

SEQ ID NO: 20020 - protein, 12 aa, Homo sapiens
  Heavy chain CDR3 for antibody 10010 (IGHV4-39)
ARDSGSYYFLDY

SEQ ID NO: 20021 - protein, 9 aa, Homo sapiens
  Light chain CDR3 for antibody 10011 (IGKV1-6)
LQDYNYPRT

SEQ ID NO: 20022 - protein, 10 aa, Homo sapiens
  Heavy chain CDR3 for antibody 10011 (IGHV3-21)
ARRWERYFDY

SEQ ID NO: 20023 - protein, 9 aa, Homo sapiens
  Light chain CDR3 for antibody 10012 (IGKV1-6)
LQDYNYPRT

SEQ ID NO: 20024 - protein, 11 aa, Homo sapiens
  Heavy chain CDR3 for antibody 10012 (IGHV1-46)
AREQHGQAPDY

SEQ ID NO: 20025 - protein, 9 aa, Homo sapiens
  Light chain CDR3 for antibody 10013 (IGKV1-37)
QRTSNAPYT

SEQ ID NO: 20026 - protein, 14 aa, Homo sapiens
  Heavy chain CDR3 for antibody 10013 (IGHV3-33)
ARDKSYPLSYGMDV

SEQ ID NO: 20027 - protein, 9 aa, Homo sapiens
  Light chain CDR3 for antibody 10014 (IGKV2D-28)
MQALQTPPT

SEQ ID NO: 20028 - protein, 16 aa, Homo sapiens
  Heavy chain CDR3 for antibody 10014 (IGHV3-33)
ARGGRSDWLYYYGMDV

SEQ ID NO: 20029 - protein, 9 aa, Homo sapiens
  Light chain CDR3 for antibody 10015 (IGKV3D-7)
QQDYELPLT

SEQ ID NO: 20030 - protein, 17 aa, Homo sapiens
  Heavy chain CDR3 for antibody 10015 (IGHV3-13)
AREGWFGELWGYYGMDV

SEQ ID NO: 20031 - protein, 10 aa, Homo sapiens
  Light chain CDR3 for antibody 10016 (IGKV1-39)
QQSYSTPMYT

SEQ ID NO: 20032 - protein, 16 aa, Homo sapiens
  Heavy chain CDR3 for antibody 10016 (IGHV3-33)
ARDKNTDYDILTGFDY

SEQ ID NO: 20033 - protein, 9 aa, Homo sapiens
  Light chain CDR3 for antibody 10017 (IGKV2-30)
MQGTHWPLT

SEQ ID NO: 20034 - protein, 19 aa, Homo sapiens
  Heavy chain CDR3 for antibody 10017 (IGHV1-24)
ATAGLQWFGEKIGYYGMDV

SEQ ID NO: 20035 - protein, 9 aa, Homo sapiens
  Light chain CDR3 for antibody 10018 (IGKV1-9)
QQLNNYLFT

SEQ ID NO: 20036 - protein, 20 aa, Homo sapiens
  Heavy chain CDR3 for antibody 10018 (IGHV4-59)
ARDRGYDILTGYYGYYGMDV

SEQ ID NO: 20037 - protein, 6 aa, Homo sapiens
  Light chain CDR3 for antibody 10019 (IGKV3-20)
QQYGST

SEQ ID NO: 20038 - protein, 12 aa, Homo sapiens
  Heavy chain CDR3 for antibody 10019 (IGHV3-33)
ARGYFGSGYAHF

SEQ ID NO: 20039 - protein, 10 aa, Homo sapiens
  Light chain CDR3 for antibody 10020 (IGKV3-11)
QQRSNWPIFT

SEQ ID NO: 20040 - protein, 17 aa, Homo sapiens
  Heavy chain CDR3 for antibody 10020 (IGHV3-33)
ARDWFGELSDYYYGMDV

SEQ ID NO: 20041 - protein, 8 aa, Homo sapiens
  Light chain CDR3 for antibody 10021 (IGKV3-15)
QQYNNYPT

SEQ ID NO: 20042 - protein, 13 aa, Homo sapiens
  Heavy chain CDR3 for antibody 10021 (IGHV4-39)
ARREVVGGRGFDY

SEQ ID NO: 20043 - protein, 9 aa, Homo sapiens
  Light chain CDR3 for antibody 10022 (IGKV3D-7)
QQDYTLPLT

SEQ ID NO: 20044 - protein, 11 aa, Homo sapiens
  Heavy chain CDR3 for antibody 10022 (IGHV4-39)
ARLSGEGHFDS

SEQ ID NO: 20045 - protein, 9 aa, Homo sapiens
  Light chain CDR3 for antibody 10023 (IGKV1-17)
LHSNNYPWT

SEQ ID NO: 20046 - protein, 13 aa, Homo sapiens
  Heavy chain CDR3 for antibody 10023 (IGHV3-23)
ARDGGAAAGTWDS

SEQ ID NO: 20047 - protein, 9 aa, Homo sapiens
  Light chain CDR3 for antibody 10024 (IGKV1-9)
QQLKSYLYT

SEQ ID NO: 20048 - protein, 13 aa, Homo sapiens
  Heavy chain CDR3 for antibody 10024 (IGHV3-33)
ARVDTMVRGVMAY

SEQ ID NO: 20049 - protein, 9 aa, Homo sapiens
  Light chain CDR3 for antibody 10025 (IGKV2D-28)
MQALQTPPT

SEQ ID NO: 20050 - protein, 15 aa, Homo sapiens
  Heavy chain CDR3 for antibody 10025 (IGHV3-23)
ARRICSGGSCSLFDY

SEQ ID NO: 20051 - protein, 9 aa, Homo sapiens
  Light chain CDR3 for antibody 10026 (IGKV1-9)
QQLISYPLT

SEQ ID NO: 20052 - protein, 14 aa, Homo sapiens
  Heavy chain CDR3 for antibody 10026 (IGHV3-23)
AKDDIVRATGAFDI

SEQ ID NO: 20053 - protein, 10 aa, Homo sapiens
  Light chain CDR3 for antibody 10027 (IGKV1-9)
QQLNSFLMYT

SEQ ID NO: 20054 - protein, 12 aa, Homo sapiens
  Heavy chain CDR3 for antibody 10027 (IGHV1-46)
ARGLTGDHAVDI

SEQ ID NO: 20055 - protein, 8 aa, Homo sapiens
  Light chain CDR3 for antibody 10028 (IGKV1-5)
QQYNSYYT

SEQ ID NO: 20056 - protein, 12 aa, Homo sapiens
  Heavy chain CDR3 for antibody 10028 (IGHV3-23)
AKEGIVGVPFDY

SEQ ID NO: 20057 - protein, 9 aa, Homo sapiens
  Light chain CDR3 for antibody 10029 (IGKV1-16)
QHYNDYPFT

SEQ ID NO: 20058 - protein, 17 aa, Homo sapiens
  Heavy chain CDR3 for antibody 10029 (IGHV3-66)
ARVQYDILTGYSPYFDN

SEQ ID NO: 20059 - protein, 9 aa, Homo sapiens
  Light chain CDR3 for antibody 10030 (IGKV1-6)
LQAYNYPYT

SEQ ID NO: 20060 - protein, 9 aa, Homo sapiens
  Heavy chain CDR3 for antibody 10030 (IGHV3-73)
TRLLTGFDY

SEQ ID NO: 20061 - protein, 9 aa, Homo sapiens
  Light chain CDR3 for antibody 10031 (IGKV3-15)
QQYNNYPYT

SEQ ID NO: 20062 - protein, 18 aa, Homo sapiens
  Heavy chain CDR3 for antibody 10031 (IGHV3-64)
ARDEYYYGSGSYYNYFDW

SEQ ID NO: 20063 - protein, 9 aa, Homo sapiens
  Light chain CDR3 for antibody 10032 (IGKV1-9)
QQLNSYPRT

SEQ ID NO: 20064 - protein, 5 aa, Homo sapiens
  Heavy chain CDR3 for antibody 10032 (IGHV1-8)
ARGDY

SEQ ID NO: 20065 - protein, 9 aa, Homo sapiens
  Light chain CDR3 for antibody 10033 (IGKV1-9)
QQLNSYPRT

SEQ ID NO: 20066 - protein, 13 aa, Homo sapiens
  Heavy chain CDR3 for antibody 10033 (IGHV1-24)
ATGYSLNLYDFDY

SEQ ID NO: 20067 - protein, 9 aa, Homo sapiens
  Light chain CDR3 for antibody 10034 (IGKV1-9)
QQLNSYPYT

SEQ ID NO: 20068 - protein, 19 aa, Homo sapiens
  Heavy chain CDR3 for antibody 10034 (IGHV1-46)
ASKGHYDILTGYYPDAFDI

SEQ ID NO: 20069 - protein, 10 aa, Homo sapiens
  Light chain CDR3 for antibody 10035 (IGKV1-27)
QKYNSAPMYT

SEQ ID NO: 20070 - protein, 12 aa, Homo sapiens
  Heavy chain CDR3 for antibody 10035 (IGHV4-39)
ARHGSGSSYFDY

SEQ ID NO: 20071 - protein, 9 aa, Homo sapiens
  Light chain CDR3 for antibody 10036 (IGKV3-11)
QQRINWPYT

SEQ ID NO: 20072 - protein, 9 aa, Homo sapiens
  Heavy chain CDR3 for antibody 10036 (IGHV3-33)
AANSYGLDY

SEQ ID NO: 20073 - protein, 9 aa, Homo sapiens
  Light chain CDR3 for antibody 10037 (IGKV3-20)
LQYGSSPYT

SEQ ID NO: 20074 - protein, 12 aa, Homo sapiens
  Heavy chain CDR3 for antibody 10037 (IGHV4-61)
ARVDSSGWYFDY

SEQ ID NO: 20075 - protein, 10 aa, Homo sapiens
  Light chain CDR3 for antibody 10038 (IGKV3-20)
QQYGRSPPVT

SEQ ID NO: 20076 - protein, 18 aa, Homo sapiens
  Heavy chain CDR3 for antibody 10038 (IGHV1-46)
ARDGDYVWGSYRSDWFDP

SEQ ID NO: 20077 - protein, 9 aa, Homo sapiens
  Light chain CDR3 for antibody 10039 (IGKV3D-7)
QQDYEFPLT

SEQ ID NO: 20078 - protein, 13 aa, Homo sapiens
  Heavy chain CDR3 for antibody 10039 (IGHV3-33)
ARGDNWNDGGFDY

SEQ ID NO: 20079 - protein, 9 aa, Homo sapiens
  Light chain CDR3 for antibody 10040 (IGKV1-39)
QQSYSTPLT

SEQ ID NO: 20080 - protein, 18 aa, Homo sapiens
  Heavy chain CDR3 for antibody 10040 (IGHV3-33)
AREGYFGSGSYYRNWFDP

SEQ ID NO: 20081 - protein, 6 aa, Homo sapiens
  Light chain CDR3 for antibody 10041 (IGKV3-20)
QQYGST

SEQ ID NO: 20082 - protein, 17 aa, Homo sapiens
  Heavy chain CDR3 for antibody 10041 (IGHV3-66)
ARVQYDILTGYSPYFDN

SEQ ID NO: 20083 - protein, 8 aa, Homo sapiens
  Light chain CDR3 for antibody 10042 (IGKV1-13)
QQFNTYPT

SEQ ID NO: 20084 - protein, 9 aa, Homo sapiens
  Heavy chain CDR3 for antibody 10042 (IGHV3-33)
AREYKEFDY

SEQ ID NO: 20085 - protein, 9 aa, Homo sapiens
  Light chain CDR3 for antibody 10043 (IGKV2D-28)
MQVLQTPFT

SEQ ID NO: 20086 - protein, 11 aa, Homo sapiens
  Heavy chain CDR3 for antibody 10043 (IGHV4-59)
AGGSGSSYFDY

SEQ ID NO: 20087 - protein, 9 aa, Homo sapiens
  Light chain CDR3 for antibody 10044 (IGKV1-5)
QQYNTYSRT

SEQ ID NO: 20088 - protein, 13 aa, Homo sapiens
  Heavy chain CDR3 for antibody 10044 (IGHV3-33)
ARRATLVRGVLDP

SEQ ID NO: 20089 - protein, 9 aa, Homo sapiens
  Light chain CDR3 for antibody 10045 (IGKV1-6)
LQDYKSPFT

SEQ ID NO: 20090 - protein, 13 aa, Homo sapiens
  Heavy chain CDR3 for antibody 10045 (IGHV3-33)
ARRYRSGWYPFDY

SEQ ID NO: 20091 - protein, 8 aa, Homo sapiens
  Light chain CDR3 for antibody 10046 (IGKV3-20)
QQYGSSLT

SEQ ID NO: 20092 - protein, 17 aa, Homo sapiens
  Heavy chain CDR3 for antibody 10046 (IGHV3-15)
TTERYPRRYYYYFGMDV

SEQ ID NO: 20093 - protein, 9 aa, Homo sapiens
  Light chain CDR3 for antibody 10047 (IGKV1D-13)
QHFNNYMYT

SEQ ID NO: 20094 - protein, 12 aa, Homo sapiens
  Heavy chain CDR3 for antibody 10047 (IGHV3-23)
AKDGWFGESLDY

SEQ ID NO: 20095 - protein, 9 aa, Homo sapiens
  Light chain CDR3 for antibody 10048 (IGKV2D-28)
MQALQTPPT

SEQ ID NO: 20096 - protein, 17 aa, Homo sapiens
  Heavy chain CDR3 for antibody 10048 (IGHV3-23)
AKDGSFYSSGWYDAFDI

SEQ ID NO: 20097 - protein, 9 aa, Homo sapiens
  Light chain CDR3 for antibody 10049 (IGKV2-30)
MQGTHWPLT

SEQ ID NO: 20098 - protein, 13 aa, Homo sapiens
  Heavy chain CDR3 for antibody 10049 (IGHV3-33)
ARVEYYNYYGLDV

SEQ ID NO: 20099 - protein, 9 aa, Homo sapiens
  Light chain CDR3 for antibody 10050 (IGKV1-5)
QQYNTYSRT

SEQ ID NO: 20100 - protein, 14 aa, Homo sapiens
  Heavy chain CDR3 for antibody 10050 (IGHV3-33)
ARDNILTAYYLFDY

SEQ ID NO: 20101 - protein, 8 aa, Homo sapiens
  Light chain CDR3 for antibody 10051 (IGKV3-15)
QQYNNYPT

SEQ ID NO: 20102 - protein, 17 aa, Homo sapiens
  Heavy chain CDR3 for antibody 10051 (IGHV3-33)
ARGGAAAGPYLYYGLDV

SEQ ID NO: 20103 - protein, 9 aa, Homo sapiens
  Light chain CDR3 for antibody 10052 (IGKV1-9)
QQYNTYSRT

SEQ ID NO: 20104 - protein, 13 aa, Homo sapiens
  Heavy chain CDR3 for antibody 10052 (IGHV3-33)
ARDQRYSSGWYDY

SEQ ID NO: 20105 - protein, 9 aa, Homo sapiens
  Light chain CDR3 for antibody 10053 (IGKV1-16)
QQYNSYPYT

SEQ ID NO: 20106 - protein, 18 aa, Homo sapiens
  Heavy chain CDR3 for antibody 10053 (IGHV1-24)
ATGLRYFDWPIISDLFDY

SEQ ID NO: 20107 - protein, 8 aa, Homo sapiens
  Light chain CDR3 for antibody 10054 (IGKV6-21)
HQSSSLPT

SEQ ID NO: 20108 - protein, 20 aa, Homo sapiens
  Heavy chain CDR3 for antibody 10054 (IGHV3-33)
ARDPAQLERRYYYFYYGIDV

SEQ ID NO: 20109 - protein, 9 aa, Homo sapiens
  Light chain CDR3 for antibody 10055 (IGKV1-6)
QQYKSYPRT

SEQ ID NO: 20110 - protein, 14 aa, Homo sapiens
  Heavy chain CDR3 for antibody 10055 (IGHV1-2)
ARDYYGSGNYYMGY

SEQ ID NO: 20111 - protein, 9 aa, Homo sapiens
  Light chain CDR3 for antibody 10056 (IGKV5-2)
LQHDKFPYT

SEQ ID NO: 20112 - protein, 10 aa, Homo sapiens
  Heavy chain CDR3 for antibody 10056 (IGHV3-33)
ARDLRADFDY

SEQ ID NO: 20113 - protein, 10 aa, Homo sapiens
  Light chain CDR3 for antibody 10057 (IGKV1-17)
LQHNSYPIYT

SEQ ID NO: 20114 - protein, 18 aa, Homo sapiens
  Heavy chain CDR3 for antibody 10057 (IGHV3-23)
ARDEYYGSGIYYNYGMDV

SEQ ID NO: 20115 - protein, 9 aa, Homo sapiens
  Light chain CDR3 for antibody 10058 (IGKV5-2)
LQHDKFPYT

SEQ ID NO: 20116 - protein, 7 aa, Homo sapiens
  Heavy chain CDR3 for antibody 10058 (IGHV3-33)
ARDRGPY

SEQ ID NO: 20117 - protein, 10 aa, Homo sapiens
  Light chain CDR3 for antibody 10059 (IGKV3-15)
QQYNNWPPYT

SEQ ID NO: 20118 - protein, 15 aa, Homo sapiens
  Heavy chain CDR3 for antibody 10059 (IGHV3-11)
ARDRAVAGTIHAFDI

SEQ ID NO: 20119 - protein, 10 aa, Homo sapiens
  Light chain CDR3 for antibody 10060 (IGKV4-1)
QQYYDISMYT

SEQ ID NO: 20120 - protein, 15 aa, Homo sapiens
  Heavy chain CDR3 for antibody 10060 (IGHV4-59)
ARDLGHYYGSVSIDY

SEQ ID NO: 20121 - protein, 11 aa, Homo sapiens
  Light chain CDR3 for antibody 10061 (IGKV3-11)
QQRSNWPPTWT

SEQ ID NO: 20122 - protein, 18 aa, Homo sapiens
  Heavy chain CDR3 for antibody 10061 (IGHV4-59)
ARERGKWNDVDYYYGMDV

SEQ ID NO: 20123 - protein, 9 aa, Homo sapiens
  Light chain CDR3 for antibody 10062 (IGKV1-16)
QHYNDYPFT

SEQ ID NO: 20124 - protein, 15 aa, Homo sapiens
  Heavy chain CDR3 for antibody 10062 (IGHV3-74)
ARGSGSHYHYYGMDV

SEQ ID NO: 20125 - protein, 9 aa, Homo sapiens
  Light chain CDR3 for antibody 10063 (IGKV3-20)
QQFGTSPLT

SEQ ID NO: 20126 - protein, 20 aa, Homo sapiens
  Heavy chain CDR3 for antibody 10063 (IGHV1-f)
ATGLITFVRGVILTYRSFDY

SEQ ID NO: 20127 - protein, 9 aa, Homo sapiens
  Light chain CDR3 for antibody 10064 (IGKV2-30)
MQGTHWPLT

SEQ ID NO: 20128 - protein, 13 aa, Homo sapiens
  Heavy chain CDR3 for antibody 10064 (IGHV3-33)
ARRQVGYYYGMDV

SEQ ID NO: 20129 - protein, 8 aa, Homo sapiens
  Light chain CDR3 for antibody 10065 (IGKV3-15)
QQYNNYPT

SEQ ID NO: 20130 - protein, 13 aa, Homo sapiens
  Heavy chain CDR3 for antibody 10065 (IGHV4-39)
ARHHYGSGSLRDY

SEQ ID NO: 20131 - protein, 7 aa, Homo sapiens
  Light chain CDR3 for antibody 10066 (IGKV1-17)
LQHNSYP

SEQ ID NO: 20132 - protein, 12 aa, Homo sapiens
  Heavy chain CDR3 for antibody 10066 (IGHV3-33)
ARDLVGATPFDY

SEQ ID NO: 20133 - protein, 8 aa, Homo sapiens
  Light chain CDR3 for antibody 10067 (IGKV3-20)
QQYGSSLT

SEQ ID NO: 20134 - protein, 15 aa, Homo sapiens
  Heavy chain CDR3 for antibody 10067 (IGHV4-39)
ARHSKYSSAWYPFDY

SEQ ID NO: 20135 - protein, 8 aa, Homo sapiens
  Light chain CDR3 for antibody 10068 (IGKV3-20)
QQYGSSLT

SEQ ID NO: 20136 - protein, 10 aa, Homo sapiens
  Heavy chain CDR3 for antibody 10068 (IGHV3-33)
ARDVVVYFDY

SEQ ID NO: 20137 - protein, 9 aa, Homo sapiens
  Light chain CDR3 for antibody 10069 (IGKV1-39)
QQSYSTPPT

SEQ ID NO: 20138 - protein, 18 aa, Homo sapiens
  Heavy chain CDR3 for antibody 10069 (IGHV3-33)
ARREGITMIFYYYYGMDV

SEQ ID NO: 20139 - protein, 9 aa, Homo sapiens
  Light chain CDR3 for antibody 10070 (IGKV1-37)
QQYHSYPYT

SEQ ID NO: 20140 - protein, 16 aa, Homo sapiens
  Heavy chain CDR3 for antibody 10070 (IGHV4-39)
ARHPLILTGYPNWFDP

SEQ ID NO: 20141 - protein, 9 aa, Homo sapiens
  Light chain CDR3 for antibody 10071 (IGKV1D-16)
QQYNSYPYT

SEQ ID NO: 20142 - protein, 18 aa, Homo sapiens
  Heavy chain CDR3 for antibody 10071 (IGHV3-33)
ARDHCSGGSCYYYYGMDV

SEQ ID NO: 20143 - protein, 9 aa, Homo sapiens
  Light chain CDR3 for antibody 10072 (IGKV1D-16)
QQYACYPPT

SEQ ID NO: 20144 - protein, 14 aa, Homo sapiens
  Heavy chain CDR3 for antibody 10072 (IGHV3-33)
AREGYSSNWYDFDY

SEQ ID NO: 20145 - protein, 8 aa, Homo sapiens
  Light chain CDR3 for antibody 10073 (IGKV1D-13)
QQYNNYPT

SEQ ID NO: 20146 - protein, 14 aa, Homo sapiens
  Heavy chain CDR3 for antibody 10073 (IGHV3-23)
ANWAYDILTGYLDY

SEQ ID NO: 20147 - protein, 8 aa, Homo sapiens
  Light chain CDR3 for antibody 10074 (IGKV1D-13)
QQFNNYPT

SEQ ID NO: 20148 - protein, 17 aa, Homo sapiens
  Heavy chain CDR3 for antibody 10074 (IGHV3-66)
ARVQYDILTGYSPYFDN

SEQ ID NO: 20149 - protein, 9 aa, Homo sapiens
  Light chain CDR3 for antibody 10075 (IGKV1-27)
QKYNSAPYT

SEQ ID NO: 20150 - protein, 13 aa, Homo sapiens
  Heavy chain CDR3 for antibody 10075 (IGHV3-33)
ARVHFDWLDAFDI

SEQ ID NO: 20151 - protein, 9 aa, Homo sapiens
  Light chain CDR3 for antibody 10076 (IGKV3D-7)
QQDYKLPLT

SEQ ID NO: 20152 - protein, 13 aa, Homo sapiens
  Heavy chain CDR3 for antibody 10076 (IGHV3-33)
ARALYSSSWPGDY

SEQ ID NO: 20153 - protein, 9 aa, Homo sapiens
  Light chain CDR3 for antibody 10077 (IGKV2-30)
MQGTHWPYT

SEQ ID NO: 20154 - protein, 10 aa, Homo sapiens
  Heavy chain CDR3 for antibody 10077 (IGHV4-39)
ARQLGNWFDP

SEQ ID NO: 20155 - protein, 9 aa, Homo sapiens
  Light chain CDR3 for antibody 10078 (IGKV1-39)
QQGFSTPWT

SEQ ID NO: 20156 - protein, 17 aa, Homo sapiens
  Heavy chain CDR3 for antibody 10078 (IGHV1-18)
ARDEGYDILTGYPHFDY

SEQ ID NO: 20157 - protein, 8 aa, Homo sapiens
  Light chain CDR3 for antibody 10079 (IGKV3-11)
QQRSNWLT

SEQ ID NO: 20158 - protein, 12 aa, Homo sapiens
  Heavy chain CDR3 for antibody 10079 (IGHV3-23)
AKGYTSFWYFDL

SEQ ID NO: 20159 - protein, 9 aa, Homo sapiens
  Light chain CDR3 for antibody 10080 (IGKV3-11)
QQRINWPWT

SEQ ID NO: 20160 - protein, 18 aa, Homo sapiens
  Heavy chain CDR3 for antibody 10080 (IGHV1-8)
AREGAAAGSYYYYNGMDV

SEQ ID NO: 20161 - protein, 9 aa, Homo sapiens
  Light chain CDR3 for antibody 10081 (IGKV1-39)
QQSYSTPLT

SEQ ID NO: 20162 - protein, 12 aa, Homo sapiens
  Heavy chain CDR3 for antibody 10081 (IGHV3-11)
ARDGPVAGLFDY

SEQ ID NO: 20163 - protein, 9 aa, Homo sapiens
  Light chain CDR3 for antibody 10082 (IGKV1-27)
QKYNSAPYT

SEQ ID NO: 20164 - protein, 13 aa, Homo sapiens
  Heavy chain CDR3 for antibody 10082 (IGHV3-33)
ARSGSCWGYYFDY

SEQ ID NO: 20165 - protein, 10 aa, Homo sapiens
  Light chain CDR3 for antibody 10083 (IGKV3-20)
QQYGRSPPVT

SEQ ID NO: 20166 - protein, 19 aa, Homo sapiens
  Heavy chain CDR3 for antibody 10083 (IGHV5-51)
ARHGEKGKRITMVRGSLDV

SEQ ID NO: 20167 - protein, 9 aa, Homo sapiens
  Light chain CDR3 for antibody 10084 (IGKV1-27)
QKYNSAPYT

SEQ ID NO: 20168 - protein, 13 aa, Homo sapiens
  Heavy chain CDR3 for antibody 10084 (IGHV3-33)
ARCIVAAMGGFDY

SEQ ID NO: 20169 - protein, 9 aa, Homo sapiens
  Light chain CDR3 for antibody 10085 (IGKV1D-13)
QQFNNYPYT

SEQ ID NO: 20170 - protein, 15 aa, Homo sapiens
  Heavy chain CDR3 for antibody 10085 (IGHV1-18)
ARLRWFGELSGWFDP

SEQ ID NO: 20171 - protein, 9 aa, Homo sapiens
  Light chain CDR3 for antibody 10086 (IGKV1D-16)
QQYDSYPYT

SEQ ID NO: 20172 - protein, 18 aa, Homo sapiens
  Heavy chain CDR3 for antibody 10086 (IGHV3-23)
AKEGDYYGSGSYWGYFDP

SEQ ID NO: 20173 - protein, 8 aa, Homo sapiens
  Light chain CDR3 for antibody 10087 (IGKV3-11)
QQRSNWLT

SEQ ID NO: 20174 - protein, 20 aa, Homo sapiens
  Heavy chain CDR3 for antibody 10087 (IGHV3-11)
ARGGATLIRGLIDYYYGMDV

SEQ ID NO: 20175 - protein, 8 aa, Homo sapiens
  Light chain CDR3 for antibody 10088 (IGKV6-21)
HQSSSLPT

SEQ ID NO: 20176 - protein, 14 aa, Homo sapiens
  Heavy chain CDR3 for antibody 10088 (IGHV3-33)
ARKGYSGRYYYFDY

SEQ ID NO: 20177 - protein, 10 aa, Homo sapiens
  Light chain CDR3 for antibody 10089 (IGKV3-11)
QQHSNWPIFT

SEQ ID NO: 20178 - protein, 12 aa, Homo sapiens
  Heavy chain CDR3 for antibody 10089 (IGHV3-23)
AKEGIVGVPFDY

SEQ ID NO: 20179 - protein, 9 aa, Homo sapiens
  Light chain CDR3 for antibody 10090 (IGKV1D-13)
QQFNSYPYT

SEQ ID NO: 20180 - protein, 13 aa, Homo sapiens
  Heavy chain CDR3 for antibody 10090 (IGHV3-11)
ARDGGYRGYVLDN

SEQ ID NO: 20181 - protein, 9 aa, Homo sapiens
  Light chain CDR3 for antibody 10091 (IGKV3D-7)
QQDYKLPYT

SEQ ID NO: 20182 - protein, 11 aa, Homo sapiens
  Heavy chain CDR3 for antibody 10091 (IGHV3-33)
ARGTTVTHFDY

SEQ ID NO: 20183 - protein, 8 aa, Homo sapiens
  Light chain CDR3 for antibody 10092 (IGKV6-21)
HQSSSLYT

SEQ ID NO: 20184 - protein, 15 aa, Homo sapiens
  Heavy chain CDR3 for antibody 10092 (IGHV3-33)
ARDRVVRGVMGYFDY

SEQ ID NO: 20185 - protein, 10 aa, Homo sapiens
  Light chain CDR3 for antibody 10093 (IGKV1-27)
QKYNSAPMYT

SEQ ID NO: 20186 - protein, 13 aa, Homo sapiens
  Heavy chain CDR3 for antibody 10093 (IGHV4-59)
ARTMVRGVAPFDY

SEQ ID NO: 20187 - protein, 9 aa, Homo sapiens
  Light chain CDR3 for antibody 10094 (IGKV1-17)
LQHNSYPYT

SEQ ID NO: 20188 - protein, 15 aa, Homo sapiens
  Heavy chain CDR3 for antibody 10094 (IGHV3-33)
ASRDILTGYSPAFEI

SEQ ID NO: 20189 - protein, 9 aa, Homo sapiens
  Light chain CDR3 for antibody 10095 (IGKV1-9)
QQLISYPLT

SEQ ID NO: 20190 - protein, 15 aa, Homo sapiens
  Heavy chain CDR3 for antibody 10095 (IGHV3-33)
VCVLYDYGDYVRFDY

SEQ ID NO: 20191 - protein, 8 aa, Homo sapiens
  Light chain CDR3 for antibody 10096 (IGKV1-9)
QQYNSYYT

SEQ ID NO: 20192 - protein, 24 aa, Homo sapiens
  Heavy chain CDR3 for antibody 10096 (IGHV1-46)
ARDEARGLLTGYYNMREYYYGMDV

SEQ ID NO: 20193 - protein, 9 aa, Homo sapiens
  Light chain CDR3 for antibody 10097 (IGKV2-30)
MQGTHWPLT

SEQ ID NO: 20194 - protein, 16 aa, Homo sapiens
  Heavy chain CDR3 for antibody 10097 (IGHV3-23)
ARDLGIAAAGTGWFDP

SEQ ID NO: 20195 - protein, 9 aa, Homo sapiens
  Light chain CDR3 for antibody 10098 (IGKV1D-16)
QQYNSYPFT

SEQ ID NO: 20196 - protein, 14 aa, Homo sapiens
  Heavy chain CDR3 for antibody 10098 (IGHV4-39)
ARDSGYDYYYGMDA

SEQ ID NO: 20197 - protein, 9 aa, Homo sapiens
  Light chain CDR3 for antibody 10099 (IGKV1-33)
QQYDNLPFT

SEQ ID NO: 20198 - protein, 9 aa, Homo sapiens
  Heavy chain CDR3 for antibody 10099 (IGHV3-30)
AREYKEFDY

SEQ ID NO: 20199 - protein, 9 aa, Homo sapiens
  Light chain CDR3 for antibody 10100 (IGKV1-16)
QQYITYPYT

SEQ ID NO: 20200 - protein, 8 aa, Homo sapiens
  Heavy chain CDR3 for antibody 10100 (IGHV3-23)
AETFLFDY

SEQ ID NO: 20201 - protein, 9 aa, Homo sapiens
  Light chain CDR3 for antibody 10101 (IGKV2D-28)
MQVLQTPFT

SEQ ID NO: 20202 - protein, 9 aa, Homo sapiens
  Heavy chain CDR3 for antibody 10101 (IGHV4-59)
ARGGASFDY

SEQ ID NO: 20203 - protein, 9 aa, Homo sapiens
  Light chain CDR3 for antibody 10102 (IGKV3-20)
LQYGSSPYT

SEQ ID NO: 20204 - protein, 16 aa, Homo sapiens
  Heavy chain CDR3 for antibody 10102 (IGHV4-59)
ARYIGSYYRDYYGMDV

SEQ ID NO: 20205 - protein, 8 aa, Homo sapiens
  Light chain CDR3 for antibody 10103 (IGKV6-21)
HQSSSLPT

SEQ ID NO: 20206 - protein, 13 aa, Homo sapiens
  Heavy chain CDR3 for antibody 10103 (IGHV3-33)
ARKAYGDYFYFDY

SEQ ID NO: 20207 - protein, 9 aa, Homo sapiens
  Light chain CDR3 for antibody 10104 (IGKV1-6)
LQDYNSPWT

SEQ ID NO: 20208 - protein, 9 aa, Homo sapiens
  Heavy chain CDR3 for antibody 10104 (IGHV3-33)
ARVRGVIDY

SEQ ID NO: 20209 - protein, 9 aa, Homo sapiens
  Light chain CDR3 for antibody 10105 (IGKV1-6)
QQLNSYPWP

SEQ ID NO: 20210 - protein, 17 aa, Homo sapiens
  Heavy chain CDR3 for antibody 10105 (IGHV3-33)
ARGYCSRTSCYLYYFDY

SEQ ID NO: 20211 - protein, 9 aa, Homo sapiens
  Light chain CDR3 for antibody 10106 (IGKV3-20)
QLYGSSPYT

SEQ ID NO: 20212 - protein, 17 aa, Homo sapiens
  Heavy chain CDR3 for antibody 10106 (IGHV1-18)
ARDEGYDILTGYPHFDY

SEQ ID NO: 20213 - protein, 9 aa, Homo sapiens
  Light chain CDR3 for antibody 10107 (IGKV1-39)
QQGFSTPWT

SEQ ID NO: 20214 - protein, 11 aa, Homo sapiens
  Heavy chain CDR3 for antibody 10107 (IGHV4-59)
ARESFYGSGNL

SEQ ID NO: 20215 - protein, 10 aa, Homo sapiens
  Light chain CDR3 for antibody 10108 (IGKV3-15)
QQYNNWPPYT

SEQ ID NO: 20216 - protein, 11 aa, Homo sapiens
  Heavy chain CDR3 for antibody 10108 (IGHV3-33)
ARAGIAALFDY

SEQ ID NO: 20217 - protein, 10 aa, Homo sapiens
  Light chain CDR3 for antibody 10109 (IGKV1-39)
QQSYSTPMYT

SEQ ID NO: 20218 - protein, 14 aa, Homo sapiens
  Heavy chain CDR3 for antibody 10109 (IGHV3-33)
AREDYYGPLNWFDP

SEQ ID NO: 20219 - protein, 9 aa, Homo sapiens
  Light chain CDR3 for antibody 10110 (IGKV3-15)
QQYINWPLT

SEQ ID NO: 20220 - protein, 16 aa, Homo sapiens
  Heavy chain CDR3 for antibody 10110 (IGHV3-33)
AREMAGSYYYYYGMDV

SEQ ID NO: 20221 - protein, 9 aa, Homo sapiens
  Light chain CDR3 for antibody 10111 (IGKV1D-16)
QQYNTYSRT

SEQ ID NO: 20222 - protein, 17 aa, Homo sapiens
  Heavy chain CDR3 for antibody 10111 (IGHV3-33)
ARAYYDILTGYSYYFDY

SEQ ID NO: 20223 - protein, 9 aa, Homo sapiens
  Light chain CDR3 for antibody 10112 (IGKV1-9)
QQLNSYPHT

SEQ ID NO: 20224 - protein, 10 aa, Homo sapiens
  Heavy chain CDR3 for antibody 10112 (IGHV3-33)
ARDILTGYYH

SEQ ID NO: 20225 - protein, 9 aa, Homo sapiens
  Light chain CDR3 for antibody 10113 (IGKV3-11)
QQRSNWPPT

SEQ ID NO: 20226 - protein, 23 aa, Homo sapiens
  Heavy chain CDR3 for antibody 10113 (IGHV3-11)
ARDEGVTMLRGVISYYYYYGMDV

SEQ ID NO: 20227 - protein, 8 aa, Homo sapiens
  Light chain CDR3 for antibody 10114 (IGKV3D-7)
QQDYNLLT

SEQ ID NO: 20228 - protein, 18 aa, Homo sapiens
  Heavy chain CDR3 for antibody 10114 (IGHV3-33)
ARGGYDILTGYYRTGMDV

SEQ ID NO: 20229 - protein, 9 aa, Homo sapiens
  Light chain CDR3 for antibody 10115 (IGKV3-15)
QQYNNWPRT

SEQ ID NO: 20230 - protein, 7 aa, Homo sapiens
  Heavy chain CDR3 for antibody 10115 (IGHV3-33)
ARELVDY

SEQ ID NO: 20231 - protein, 9 aa, Homo sapiens
  Light chain CDR3 for antibody 10116 (IGKV1-17)
LQHTSYPFT

SEQ ID NO: 20232 - protein, 12 aa, Homo sapiens
  Heavy chain CDR3 for antibody 10116 (IGHV1-46)
ARGLTGDHAVDI

SEQ ID NO: 20233 - protein, 9 aa, Homo sapiens
  Light chain CDR3 for antibody 10117 (IGKV1-9)
QQLNSYPLT

SEQ ID NO: 20234 - protein, 15 aa, Homo sapiens
  Heavy chain CDR3 for antibody 10117 (IGHV4-39)
ARRSKYSSAWYPFDY

SEQ ID NO: 20235 - protein, 8 aa, Homo sapiens
  Light chain CDR3 for antibody 10118 (IGKV3-11)
LQRGNWPT

SEQ ID NO: 20236 - protein, 12 aa, Homo sapiens
  Heavy chain CDR3 for antibody 10118 (IGHV3-23)
AKDGWFGESLDY

SEQ ID NO: 20237 - protein, 9 aa, Homo sapiens
  Light chain CDR3 for antibody 10119 (IGKV1-17)
LQQNSYPWT

SEQ ID NO: 20238 - protein, 12 aa, Homo sapiens
  Heavy chain CDR3 for antibody 10119 (IGHV3-33)
ARGYFGSGYADF

SEQ ID NO: 20239 - protein, 9 aa, Homo sapiens
  Light chain CDR3 for antibody 10120 (IGKV3-11)
QQRINWPLT

SEQ ID NO: 20240 - protein, 17 aa, Homo sapiens
  Heavy chain CDR3 for antibody 10120 (IGHV1-24)
ATEGYDILPGYYNVLDY

SEQ ID NO: 20241 - protein, 8 aa, Homo sapiens
  Light chain CDR3 for antibody 10121 (IGKV3-20)
QQYGSSFT

SEQ ID NO: 20242 - protein, 13 aa, Homo sapiens
  Heavy chain CDR3 for antibody 10121 (IGHV4-39)
ARRDVLAPAAFDY

SEQ ID NO: 20243 - protein, 8 aa, Homo sapiens
  Light chain CDR3 for antibody 10122 (IGKV3D-7)
QQDYNLVT

SEQ ID NO: 20244 - protein, 12 aa, Homo sapiens
  Heavy chain CDR3 for antibody 10122 (IGHV4-39)
ARQGAYSRFFDY

SEQ ID NO: 20245 - protein, 9 aa, Homo sapiens
  Light chain CDR3 for antibody 10123 (IGKV2D-24)
TQATQFPHT

SEQ ID NO: 20246 - protein, 18 aa, Homo sapiens
  Heavy chain CDR3 for antibody 10123 (IGHV3-33)
ARDGYSGYDYYYYYGMDV

SEQ ID NO: 20247 - protein, 9 aa, Homo sapiens
  Light chain CDR3 for antibody 10124 (IGKV2-30)
MQGTHWPLT

SEQ ID NO: 20248 - protein, 15 aa, Homo sapiens
  Heavy chain CDR3 for antibody 10124 (IGHV1-18)
ARRSPNWGHYYGMDV

SEQ ID NO: 20249 - protein, 9 aa, Homo sapiens
  Light chain CDR3 for antibody 10125 (IGKV1-6)
LQVYSYPWT

SEQ ID NO: 20250 - protein, 15 aa, Homo sapiens
  Heavy chain CDR3 for antibody 10125 (IGHV3-30)
ARGAMVRGVDYGMDV

SEQ ID NO: 20251 - protein, 9 aa, Homo sapiens
  Light chain CDR3 for antibody 10126 (IGKV1-6)
LQDYNYPYT

SEQ ID NO: 20252 - protein, 12 aa, Homo sapiens
  Heavy chain CDR3 for antibody 10126 (IGHV3-23)
AKDGYSYGYFDY

SEQ ID NO: 20253 - protein, 8 aa, Homo sapiens
  Light chain CDR3 for antibody 10127 (IGKV3-20)
QQYGSSLT

SEQ ID NO: 20254 - protein, 18 aa, Homo sapiens
  Heavy chain CDR3 for antibody 10127 (IGHV3-33)
ARDRDRYGSGTYPDAIDI

SEQ ID NO: 20255 - protein, 9 aa, Homo sapiens
  Light chain CDR3 for antibody 10128 (IGKV3D-7)
QQDYTLPLT

SEQ ID NO: 20256 - protein, 18 aa, Homo sapiens
  Heavy chain CDR3 for antibody 10128 (IGHV4-55)
AREGDYVWGSYRPNWFDP

SEQ ID NO: 20257 - protein, 9 aa, Homo sapiens
  Light chain CDR3 for antibody 10129 (IGKV3-11)
QQRSSWPPT

SEQ ID NO: 20258 - protein, 18 aa, Homo sapiens
  Heavy chain CDR3 for antibody 10129 (IGHV3-23)
AKDRITGTTYGYYSGLDV

SEQ ID NO: 20259 - protein, 9 aa, Homo sapiens
  Light chain CDR3 for antibody 10130 (IGKV4-1)
QQYYTTPPT

SEQ ID NO: 20260 - protein, 18 aa, Homo sapiens
  Heavy chain CDR3 for antibody 10130 (IGHV1-46)
ARDGDYAWGSYRSDWFDP

SEQ ID NO: 20261 - protein, 9 aa, Homo sapiens
  Light chain CDR3 for antibody 10131 (IGKV1-17)
LQQNSYPWT

SEQ ID NO: 20262 - protein, 17 aa, Homo sapiens
  Heavy chain CDR3 for antibody 10131 (IGHV4-59)
ARDGLVRGEGSYYGMDV

SEQ ID NO: 20263 - protein, 9 aa, Homo sapiens
  Light chain CDR3 for antibody 10132 (IGKV3D-7)
QQDYEFPIT

SEQ ID NO: 20264 - protein, 14 aa, Homo sapiens
  Heavy chain CDR3 for antibody 10132 (IGHV4-39)
ARQGTMIRGGYFDY

SEQ ID NO: 20265 - protein, 9 aa, Homo sapiens
  Light chain CDR3 for antibody 10133 (IGKV3D-7)
QQDYNLPWT

SEQ ID NO: 20266 - protein, 18 aa, Homo sapiens
  Heavy chain CDR3 for antibody 10133 (IGHV3-33)
ARRSAAGTGDYYYCGIDV

SEQ ID NO: 20267 - protein, 9 aa, Homo sapiens
  Light chain CDR3 for antibody 10134 (IGKV1D-13)
QQFNNYPYT

SEQ ID NO: 20268 - protein, 18 aa, Homo sapiens
  Heavy chain CDR3 for antibody 10134 (IGHV3-64)
ARDEYYYGSGSYYNYFDW

SEQ ID NO: 20269 - protein, 9 aa, Homo sapiens
  Light chain CDR3 for antibody 10135 (IGKV1-39)
QQSYRTPLT

SEQ ID NO: 20270 - protein, 14 aa, Homo sapiens
  Heavy chain CDR3 for antibody 10135 (IGHV3-33)
AREGILTGYYPFDY

SEQ ID NO: 20271 - protein, 8 aa, Homo sapiens
  Light chain CDR3 for antibody 10136 (IGKV3D-7)
QQDYSLLT

SEQ ID NO: 20272 - protein, 12 aa, Homo sapiens
  Heavy chain CDR3 for antibody 10136 (IGHV3-33)
ARGGIAVDVCDI

SEQ ID NO: 20273 - protein, 9 aa, Homo sapiens
  Light chain CDR3 for antibody 10137 (IGKV1-6)
LQSNNYPWT

SEQ ID NO: 20274 - protein, 12 aa, Homo sapiens
  Heavy chain CDR3 for antibody 10137 (IGHV3-33)
AREGDILTGYAL

SEQ ID NO: 20275 - protein, 9 aa, Homo sapiens
  Light chain CDR3 for antibody 10138 (IGKV1-9)
QQLNNYLFT

SEQ ID NO: 20276 - protein, 11 aa, Homo sapiens
  Heavy chain CDR3 for antibody 10138 (IGHV4-59)
AREMGHDTFDI

SEQ ID NO: 20277 - protein, 10 aa, Homo sapiens
  Light chain CDR3 for antibody 10139 (IGKV1-17)
LQHNSYPMYT

SEQ ID NO: 20278 - protein, 16 aa, Homo sapiens
  Heavy chain CDR3 for antibody 10139 (IGHV3-33)
ARDNFGSGSYYSHFHY

SEQ ID NO: 20279 - protein, 9 aa, Homo sapiens
  Light chain CDR3 for antibody 10140 (IGKV1-9)
QQLHIYPWT

SEQ ID NO: 20280 - protein, 13 aa, Homo sapiens
  Heavy chain CDR3 for antibody 10140 (IGHV4-39)
ARQWPSGYWYFDL

SEQ ID NO: 20281 - protein, 9 aa, Homo sapiens
  Light chain CDR3 for antibody 10141 (IGKV2-30)
MQGTHWPLT

SEQ ID NO: 20282 - protein, 13 aa, Homo sapiens
  Heavy chain CDR3 for antibody 10141 (IGHV4-39)
ARHEVMIRGVFDY

SEQ ID NO: 20283 - protein, 9 aa, Homo sapiens
  Light chain CDR3 for antibody 10142 (IGKV3-20)
QQYGSSPYT

SEQ ID NO: 20284 - protein, 13 aa, Homo sapiens
  Heavy chain CDR3 for antibody 10142 (IGHV3-53)
ARDRDSSGSYFDY

SEQ ID NO: 20285 - protein, 9 aa, Homo sapiens
  Light chain CDR3 for antibody 10143 (IGKV3-15)
QQYNNWPRT

SEQ ID NO: 20286 - protein, 15 aa, Homo sapiens
  Heavy chain CDR3 for antibody 10143 (IGHV3-33)
ARRGYNDYDPYGMDV

SEQ ID NO: 20287 - protein, 9 aa, Homo sapiens
  Light chain CDR3 for antibody 10144 (IGKV1-16)
QQLNSYPWT

SEQ ID NO: 20288 - protein, 16 aa, Homo sapiens
  Heavy chain CDR3 for antibody 10144 (IGHV4-39)
ARDTPYYSGSGRPFDY

SEQ ID NO: 20289 - protein, 9 aa, Homo sapiens
  Light chain CDR3 for antibody 10145 (IGKV1-9)
QQLNNYLFT

SEQ ID NO: 20290 - protein, 12 aa, Homo sapiens
  Heavy chain CDR3 for antibody 10145 (IGHV4-39)
ARQMVREGWFDP

SEQ ID NO: 20291 - protein, 8 aa, Homo sapiens
  Light chain CDR3 for antibody 10146 (IGKV3D-7)
QQDYNLLT

SEQ ID NO: 20292 - protein, 19 aa, Homo sapiens
  Heavy chain CDR3 for antibody 10146 (IGHV3-33)
ARGRGSYYYGPGSHYGMDV

SEQ ID NO: 20293 - protein, 8 aa, Homo sapiens
  Light chain CDR3 for antibody 10147 (IGKV3-20)
QQYGRSFT

SEQ ID NO: 20294 - protein, 9 aa, Homo sapiens
  Heavy chain CDR3 for antibody 10147 (IGHV3-13)
ARERWYFDL

SEQ ID NO: 20295 - protein, 9 aa, Homo sapiens
  Light chain CDR3 for antibody 10148 (IGKV1-9)
QQYNTYSRT

SEQ ID NO: 20296 - protein, 15 aa, Homo sapiens
  Heavy chain CDR3 for antibody 10148 (IGHV3-33)
ARRICSGGSCSLFDY

SEQ ID NO: 20297 - protein, 9 aa, Homo sapiens
  Light chain CDR3 for antibody 10149 (IGKV1D-16)
QQYNSYPYT

SEQ ID NO: 20298 - protein, 17 aa, Homo sapiens
  Heavy chain CDR3 for antibody 10149 (IGHV3-23)
AKGNYGSGSYYKGDFHH

SEQ ID NO: 20299 - protein, 9 aa, Homo sapiens
  Light chain CDR3 for antibody 10150 (IGKV1-16)
QHYNDYPFT

SEQ ID NO: 20300 - protein, 9 aa, Homo sapiens
  Heavy chain CDR3 for antibody 10150 (IGHV3-13)
ARDRWYFDL

SEQ ID NO: 20301 - protein, 9 aa, Homo sapiens
  Light chain CDR3 for antibody 10151 (IGKV1-6)
LQDYNHPFT

SEQ ID NO: 20302 - protein, 15 aa, Homo sapiens
  Heavy chain CDR3 for antibody 10151 (IGHV3-33)
ARDTGYSSSWNWFDP

SEQ ID NO: 20303 - protein, 9 aa, Homo sapiens
  Light chain CDR3 for antibody 10152 (IGKV1D-16)
QQYDSYPLT

SEQ ID NO: 20304 - protein, 14 aa, Homo sapiens
  Heavy chain CDR3 for antibody 10152 (IGHV3-33)
ARDNILTGYYLFDY

SEQ ID NO: 20305 - protein, 9 aa, Homo sapiens
  Light chain CDR3 for antibody 10153 (IGKV1-6)
LQDYNYPYT

SEQ ID NO: 20306 - protein, 15 aa, Homo sapiens
  Heavy chain CDR3 for antibody 10153 (IGHV3-33)
ARERGYYGSGSFFDY

SEQ ID NO: 20307 - protein, 9 aa, Homo sapiens
  Light chain CDR3 for antibody 10154 (IGKV3-11)
QQRSNWMYT

SEQ ID NO: 20308 - protein, 12 aa, Homo sapiens
  Heavy chain CDR3 for antibody 10154 (IGHV4-28)
ARKDSGYDWFDY

SEQ ID NO: 20309 - protein, 9 aa, Homo sapiens
  Light chain CDR3 for antibody 10155 (IGKV1-17)
QQDKSYPYT

SEQ ID NO: 20310 - protein, 16 aa, Homo sapiens
  Heavy chain CDR3 for antibody 10155 (IGHV1-24)
TTEGGTVDYYYYGMDV

SEQ ID NO: 20311 - protein, 9 aa, Homo sapiens
  Light chain CDR3 for antibody 10156 (IGKV1-6)
LQDYNYPYT

SEQ ID NO: 20312 - protein, 12 aa, Homo sapiens
  Heavy chain CDR3 for antibody 10156 (IGHV3-21)
ARDGGRYGDFDY

SEQ ID NO: 20313 - protein, 9 aa, Homo sapiens
  Light chain CDR3 for antibody 10157 (IGKV1-9)
QQLNGYPFT

SEQ ID NO: 20314 - protein, 10 aa, Homo sapiens
  Heavy chain CDR3 for antibody 10157 (IGHV3-23)
AKDQVGATDC

SEQ ID NO: 20315 - protein, 9 aa, Homo sapiens
  Light chain CDR3 for antibody 10158 (IGKV2D-28)
MQALQTPPT

SEQ ID NO: 20316 - protein, 18 aa, Homo sapiens
  Heavy chain CDR3 for antibody 10158 (IGHV3-23)
ARGGYSSGWDYYYYGMDV

SEQ ID NO: 20317 - protein, 9 aa, Homo sapiens
  Light chain CDR3 for antibody 10159 (IGKV3-11)
QQRSNWMYT

SEQ ID NO: 20318 - protein, 16 aa, Homo sapiens
  Heavy chain CDR3 for antibody 10159 (IGHV4-55)
ARYSGSYYGDYYGMDV

SEQ ID NO: 20319 - protein, 6 aa, Homo sapiens
  Light chain CDR3 for antibody 10160 (IGKV3-20)
QQYGST

SEQ ID NO: 20320 - protein, 14 aa, Homo sapiens
  Heavy chain CDR3 for antibody 10160 (IGHV3-33)
AREGYSSNWYDFDY

SEQ ID NO: 20321 - protein, 9 aa, Homo sapiens
  Light chain CDR3 for antibody 10161 (IGKV4-1)
QQYYSTPPT

SEQ ID NO: 20322 - protein, 12 aa, Homo sapiens
  Heavy chain CDR3 for antibody 10161 (IGHV1-46)
ARGLTGDYAVDI

SEQ ID NO: 20323 - protein, 9 aa, Homo sapiens
  Light chain CDR3 for antibody 10162 (IGKV3D-7)
QQDYNLPFT

SEQ ID NO: 20324 - protein, 16 aa, Homo sapiens
  Heavy chain CDR3 for antibody 10162 (IGHV3-23)
AKDGIGELSYYYGMDV

SEQ ID NO: 20325 - protein, 9 aa, Homo sapiens
  Light chain CDR3 for antibody 10163 (IGKV3-15)
QQYNNWPYT

SEQ ID NO: 20326 - protein, 12 aa, Homo sapiens
  Heavy chain CDR3 for antibody 10163 (IGHV4-61)
ARVDSSGWYFDY

SEQ ID NO: 20327 - protein, 10 aa, Homo sapiens
  Light chain CDR3 for antibody 10164 (IGKV1-6)
LQDYNYPMYT

SEQ ID NO: 20328 - protein, 14 aa, Homo sapiens
  Heavy chain CDR3 for antibody 10164 (IGHV3-33)
ARDWNDVYYYGMDV

SEQ ID NO: 20329 - protein, 8 aa, Homo sapiens
  Light chain CDR3 for antibody 10165 (IGKV6-21)
HQSSSLPT

SEQ ID NO: 20330 - protein, 14 aa, Homo sapiens
  Heavy chain CDR3 for antibody 10165 (IGHV3-64)
VRDQGSMVRGGGDY

SEQ ID NO: 20331 - protein, 9 aa, Homo sapiens
  Light chain CDR3 for antibody 10166 (IGKV1-6)
LQDFHYPWT

SEQ ID NO: 20332 - protein, 14 aa, Homo sapiens
  Heavy chain CDR3 for antibody 10166 (IGHV1-46)
ARRGIVGALDALDI

SEQ ID NO: 20333 - protein, 9 aa, Homo sapiens
  Light chain CDR3 for antibody 10167 (IGKV1-33)
QQYDNLPFT

SEQ ID NO: 20334 - protein, 20 aa, Homo sapiens
  Heavy chain CDR3 for antibody 10167 (IGHV3-33)
SRGGATLVRGVIDYYYGMDV

SEQ ID NO: 20335 - protein, 9 aa, Homo sapiens
  Light chain CDR3 for antibody 10168 (IGKV3-11)
QQRSNWPYT

SEQ ID NO: 20336 - protein, 21 aa, Homo sapiens
  Heavy chain CDR3 for antibody 10168 (IGHV3-33)
ARDGGITMGRGVYYYYYGMDV

SEQ ID NO: 20337 - protein, 10 aa, Homo sapiens
  Light chain CDR3 for antibody 10169 (IGKV3-11)
QQRSNWPMYT

SEQ ID NO: 20338 - protein, 13 aa, Homo sapiens
  Heavy chain CDR3 for antibody 10169 (IGHV3-11)
AREGIAVAGDFDF

SEQ ID NO: 20339 - protein, 9 aa, Homo sapiens
  Light chain CDR3 for antibody 10170 (IGKV3-11)
QQRSYWPLT

SEQ ID NO: 20340 - protein, 8 aa, Homo sapiens
  Heavy chain CDR3 for antibody 10170 (IGHV4-4)
ARGARFDP

SEQ ID NO: 20341 - protein, 8 aa, Homo sapiens
  Light chain CDR3 for antibody 10171 (IGKV3-11)
LQRGNWPT

SEQ ID NO: 20342 - protein, 14 aa, Homo sapiens
  Heavy chain CDR3 for antibody 10171 (IGHV3-15)
ARTTAAAGPRDFQH

SEQ ID NO: 20343 - protein, 11 aa, Homo sapiens
  Light chain CDR3 for antibody 10172 (IGKV3-11)
QQRSNWPPMYT

SEQ ID NO: 20344 - protein, 13 aa, Homo sapiens
  Heavy chain CDR3 for antibody 10172 (IGHV3-23)
AKDRGLRYYGMDV

SEQ ID NO: 20345 - protein, 8 aa, Homo sapiens
  Light chain CDR3 for antibody 10173 (IGKV3-20)
QQYGRSFT

SEQ ID NO: 20346 - protein, 14 aa, Homo sapiens
  Heavy chain CDR3 for antibody 10173 (IGHV4-39)
ARQGTMIRGGYFDY

SEQ ID NO: 20347 - protein, 9 aa, Homo sapiens
  Light chain CDR3 for antibody 10174 (IGKV1D-16)
QQYDSYPYT

SEQ ID NO: 20348 - protein, 15 aa, Homo sapiens
  Heavy chain CDR3 for antibody 10174 (IGHV3-23)
ARAFFMVRGVITPDY

SEQ ID NO: 20349 - protein, 9 aa, Homo sapiens
  Light chain CDR3 for antibody 10175 (IGKV1-5)
QQYNTYSRT

SEQ ID NO: 20350 - protein, 8 aa, Homo sapiens
  Heavy chain CDR3 for antibody 10175 (IGHV3-23)
AETFLFDY

SEQ ID NO: 20351 - protein, 9 aa, Homo sapiens
  Light chain CDR3 for antibody 10176 (IGKV1-5)
QQYNTYSRT

SEQ ID NO: 20352 - protein, 13 aa, Homo sapiens
  Heavy chain CDR3 for antibody 10176 (IGHV1-18)
ARSITMVRGVIGY

SEQ ID NO: 20353 - protein, 9 aa, Homo sapiens
  Light chain CDR3 for antibody 10177 (IGKV2-30)
MQGTHWPLT

SEQ ID NO: 20354 - protein, 10 aa, Homo sapiens
  Heavy chain CDR3 for antibody 10177 (IGHV3-33)
ARVVDTAMAY

SEQ ID NO: 20355 - protein, 9 aa, Homo sapiens
  Light chain CDR3 for antibody 10178 (IGKV3-15)
QQYHNWPLT

SEQ ID NO: 20356 - protein, 20 aa, Homo sapiens
  Heavy chain CDR3 for antibody 10178 (IGHV1-f)
ATGLITFVRGVILTYRSFDY

SEQ ID NO: 20357 - protein, 9 aa, Homo sapiens
  Light chain CDR3 for antibody 10179 (IGKV1-6)
LQDYNYPYT

SEQ ID NO: 20358 - protein, 20 aa, Homo sapiens
  Heavy chain CDR3 for antibody 10179 (IGHV3-30)
ARVGAAMIRGLIDYYYGMDV

SEQ ID NO: 20359 - protein, 9 aa, Homo sapiens
  Light chain CDR3 for antibody 10180 (IGKV1-39)
QQSYSTPYT

SEQ ID NO: 20360 - protein, 11 aa, Homo sapiens
  Heavy chain CDR3 for antibody 10180 (IGHV3-33)
ARDRGYSYFDY

SEQ ID NO: 20361 - protein, 9 aa, Homo sapiens
  Light chain CDR3 for antibody 10181 (IGKV1-9)
QQLNSYPWP

SEQ ID NO: 20362 - protein, 15 aa, Homo sapiens
  Heavy chain CDR3 for antibody 10181 (IGHV3-33)
ARRGYNDYDPYGMDV

SEQ ID NO: 20363 - protein, 9 aa, Homo sapiens
  Light chain CDR3 for antibody 10182 (IGKV1-6)
LQDYNYPYT

SEQ ID NO: 20364 - protein, 16 aa, Homo sapiens
  Heavy chain CDR3 for antibody 10182 (IGHV1-24)
ATDGYYYGSGSYLFDY

SEQ ID NO: 20365 - protein, 9 aa, Homo sapiens
  Light chain CDR3 for antibody 10183 (IGKV2D-28)
MQALQTPYT

SEQ ID NO: 20366 - protein, 17 aa, Homo sapiens
  Heavy chain CDR3 for antibody 10183 (IGHV3-33)
VREGGLLWVGELSLFDY

SEQ ID NO: 20367 - protein, 10 aa, Homo sapiens
  Light chain CDR3 for antibody 10184 (IGKV3-15)
QQYNNWPPYT

SEQ ID NO: 20368 - protein, 13 aa, Homo sapiens
  Heavy chain CDR3 for antibody 10184 (IGHV4-39)
ARREVVGGRGFDY

SEQ ID NO: 20369 - protein, 9 aa, Homo sapiens
  Light chain CDR3 for antibody 10185 (IGKV3D-7)
QQDYILPWT

SEQ ID NO: 20370 - protein, 12 aa, Homo sapiens
  Heavy chain CDR3 for antibody 10185 (IGHV3-h)
AREDYYYYGMDV

SEQ ID NO: 20371 - protein, 9 aa, Homo sapiens
  Light chain CDR3 for antibody 10186 (IGKV3D-7)
QQDSNLPYT

SEQ ID NO: 20372 - protein, 17 aa, Homo sapiens
  Heavy chain CDR3 for antibody 10186 (IGHV4-39)
ARQGWYYGSGSSLLFDY

SEQ ID NO: 20373 - protein, 8 aa, Homo sapiens
  Light chain CDR3 for antibody 10187 (IGKV3-20)
QQYGSSFT

SEQ ID NO: 20374 - protein, 10 aa, Homo sapiens
  Heavy chain CDR3 for antibody 10187 (IGHV1-46)
ARGAYYGMDV

SEQ ID NO: 20375 - protein, 9 aa, Homo sapiens
  Light chain CDR3 for antibody 10188 (IGKV1-5)
QQYNTYSRT

SEQ ID NO: 20376 - protein, 18 aa, Homo sapiens
  Heavy chain CDR3 for antibody 10188 (IGHV3-74)
ARDRDRYGSGTYPDAIDI

SEQ ID NO: 20377 - protein, 8 aa, Homo sapiens
  Light chain CDR3 for antibody 10189 (IGKV1-5)
QQYNSYST

SEQ ID NO: 20378 - protein, 12 aa, Homo sapiens
  Heavy chain CDR3 for antibody 10189 (IGHV1-18)
ARRDGSGTSFDY

SEQ ID NO: 20379 - protein, 9 aa, Homo sapiens
  Light chain CDR3 for antibody 10190 (IGKV1D-13)
QQFNNYPYT

SEQ ID NO: 20380 - protein, 14 aa, Homo sapiens
  Heavy chain CDR3 for antibody 10190 (IGHV3-33)
ARDGYDILTGPMDV

SEQ ID NO: 20381 - protein, 9 aa, Homo sapiens
  Light chain CDR3 for antibody 10191 (IGKV1D-13)
QQFNNYMYT

SEQ ID NO: 20382 - protein, 14 aa, Homo sapiens
  Heavy chain CDR3 for antibody 10191 (IGHV3-15)
SIYYYGSGRDFFDY

SEQ ID NO: 20383 - protein, 9 aa, Homo sapiens
  Light chain CDR3 for antibody 10192 (IGKV1-6)
LQAYNFPYT

SEQ ID NO: 20384 - protein, 17 aa, Homo sapiens
  Heavy chain CDR3 for antibody 10192 (IGHV3-33)
ARDRDDILTGVCTYLDY

SEQ ID NO: 20385 - protein, 8 aa, Homo sapiens
  Light chain CDR3 for antibody 10193 (IGKV2D-28)
MQALQTPT

SEQ ID NO: 20386 - protein, 13 aa, Homo sapiens
  Heavy chain CDR3 for antibody 10193 (IGHV3-33)
ARQSSGWFDAFDI

SEQ ID NO: 20387 - protein, 9 aa, Homo sapiens
  Light chain CDR3 for antibody 10194 (IGKV1-16)
QQYKSYPYT

SEQ ID NO: 20388 - protein, 13 aa, Homo sapiens
  Heavy chain CDR3 for antibody 10194 (IGHV3-33)
ARTDYYYYYGMDV

SEQ ID NO: 20389 - protein, 9 aa, Homo sapiens
  Light chain CDR3 for antibody 10195 (IGKV4-1)
QQYYSTPYT

SEQ ID NO: 20390 - protein, 13 aa, Homo sapiens
  Heavy chain CDR3 for antibody 10195 (IGHV3-33)
ANTGDSYYYDMDV

SEQ ID NO: 20391 - protein, 9 aa, Homo sapiens
  Light chain CDR3 for antibody 10196 (IGKV2-30)
MQGTHWPLT

SEQ ID NO: 20392 - protein, 15 aa, Homo sapiens
  Heavy chain CDR3 for antibody 10196 (IGHV3-33)
ARDRVQLGYYYGMDV

SEQ ID NO: 20393 - protein, 9 aa, Homo sapiens
  Light chain CDR3 for antibody 10197 (IGKV5-2)
LQRDKFPYT

SEQ ID NO: 20394 - protein, 19 aa, Homo sapiens
  Heavy chain CDR3 for antibody 10197 (IGHV3-33)
ARGVRLRYFDPYYYYCMDV

SEQ ID NO: 20395 - protein, 9 aa, Homo sapiens
  Light chain CDR3 for antibody 10198 (IGKV3-20)
QQYGSSLYT

SEQ ID NO: 20396 - protein, 16 aa, Homo sapiens
  Heavy chain CDR3 for antibody 10198 (IGHV1-18)
ARANPGAVGYYYGMDV

SEQ ID NO: 20397 - protein, 10 aa, Homo sapiens
  Light chain CDR3 for antibody 10199 (IGKV1-17)
LQHNSYPMYT

SEQ ID NO: 20398 - protein, 13 aa, Homo sapiens
  Heavy chain CDR3 for antibody 10199 (IGHV3-33)
ARQSSGWFDAFDI

SEQ ID NO: 20399 - protein, 7 aa, Homo sapiens
  Light chain CDR3 for antibody 10200 (IGKV1-17)
LQHNSYP

SEQ ID NO: 20400 - protein, 17 aa, Homo sapiens
  Heavy chain CDR3 for antibody 10200 (IGHV1-18)
ARDEGYDILTGYPHFDY

SEQ ID NO: 20401 - protein, 9 aa, Homo sapiens
  Light chain CDR3 for antibody 10201 (IGKV1-16)
QHYNDYPFT

SEQ ID NO: 20402 - protein, 12 aa, Homo sapiens
  Heavy chain CDR3 for antibody 10201 (IGHV3-33)
ARESGGSYSFDY

SEQ ID NO: 20403 - protein, 9 aa, Homo sapiens
  Light chain CDR3 for antibody 10202 (IGKV1-6)
LQQNSYPYT

SEQ ID NO: 20404 - protein, 14 aa, Homo sapiens
  Heavy chain CDR3 for antibody 10202 (IGHV4-34)
ARGGYNWNDDWFDP

SEQ ID NO: 20405 - protein, 9 aa, Homo sapiens
  Light chain CDR3 for antibody 10203 (IGKV1-9)
QQLISYPLT

SEQ ID NO: 20406 - protein, 20 aa, Homo sapiens
  Heavy chain CDR3 for antibody 10203 (IGHV3-33)
AREDYYGSGSYYPAYNWFDP

SEQ ID NO: 20407 - protein, 9 aa, Homo sapiens
  Light chain CDR3 for antibody 10204 (IGKV1D-16)
LQHNTYPLT

SEQ ID NO: 20408 - protein, 16 aa, Homo sapiens
  Heavy chain CDR3 for antibody 10204 (IGHV3-33)
AREMAGSYYYYYGMDV

SEQ ID NO: 20409 - protein, 9 aa, Homo sapiens
  Light chain CDR3 for antibody 10205 (IGKV6-21)
HQSTSLPFT

SEQ ID NO: 20410 - protein, 12 aa, Homo sapiens
  Heavy chain CDR3 for antibody 10205 (IGHV4-61)
ARVYSSGWLFDY

SEQ ID NO: 20411 - protein, 10 aa, Homo sapiens
  Light chain CDR3 for antibody 10206 (IGKV3-15)
QQYNNWPPLT

SEQ ID NO: 20412 - protein, 11 aa, Homo sapiens
  Heavy chain CDR3 for antibody 10206 (IGHV3-33)
ARDILTGFLDH

SEQ ID NO: 20413 - protein, 8 aa, Homo sapiens
  Light chain CDR3 for antibody 10207 (IGKV3-20)
QQYGSSLT

SEQ ID NO: 20414 - protein, 18 aa, Homo sapiens
  Heavy chain CDR3 for antibody 10207 (IGHV3-33)
AREGDYYGSGGFPNWFDP

SEQ ID NO: 20415 - protein, 9 aa, Homo sapiens
  Light chain CDR3 for antibody 10208 (IGKV3D-7)
QQDYKLPLT

SEQ ID NO: 20416 - protein, 21 aa, Homo sapiens
  Heavy chain CDR3 for antibody 10208 (IGHV4-59)
ARDGGITMGRGVYYYYYGMDV

SEQ ID NO: 20417 - protein, 9 aa, Homo sapiens
  Light chain CDR3 for antibody 10209 (IGKV1-9)
QQLNSYPYT

SEQ ID NO: 20418 - protein, 16 aa, Homo sapiens
  Heavy chain CDR3 for antibody 10209 (IGHV4-39)
ARHPLILTGYPNWFDP

SEQ ID NO: 20419 - protein, 11 aa, Homo sapiens
  Light chain CDR3 for antibody 10210 (IGKV3-11)
QQRSNWPPMYT

SEQ ID NO: 20420 - protein, 15 aa, Homo sapiens
  Heavy chain CDR3 for antibody 10210 (IGHV3-23)
AKEFTMVRGVITPDY

SEQ ID NO: 20421 - protein, 10 aa, Homo sapiens
  Light chain CDR3 for antibody 10211 (IGKV1-39)
QQSYSTPMYT

SEQ ID NO: 20422 - protein, 17 aa, Homo sapiens
  Heavy chain CDR3 for antibody 10211 (IGHV3-33)
AKDGSFYSSGWYDAFDI

SEQ ID NO: 20423 - protein, 10 aa, Homo sapiens
  Light chain CDR3 for antibody 10212 (IGKV3-11)
QQRSNWPILT

SEQ ID NO: 20424 - protein, 21 aa, Homo sapiens
  Heavy chain CDR3 for antibody 10212 (IGHV3-23)
AAGVLLWFGEPNYYYYYGMDV

SEQ ID NO: 20425 - protein, 9 aa, Homo sapiens
  Light chain CDR3 for antibody 10213 (IGKV1D-13)
QQFNNYPHT

SEQ ID NO: 20426 - protein, 14 aa, Homo sapiens
  Heavy chain CDR3 for antibody 10213 (IGHV3-33)
VRDAMGAPPAWFDP

SEQ ID NO: 20427 - protein, 8 aa, Homo sapiens
  Light chain CDR3 for antibody 10214 (IGKV1D-13)
QQYNNYPT

SEQ ID NO: 20428 - protein, 12 aa, Homo sapiens
  Heavy chain CDR3 for antibody 10214 (IGHV3-23)
AKEYDILTGYFH

SEQ ID NO: 20429 - protein, 9 aa, Homo sapiens
  Light chain CDR3 for antibody 10215 (IGKV1D-13)
QQFTNYPYT

SEQ ID NO: 20430 - protein, 17 aa, Homo sapiens
  Heavy chain CDR3 for antibody 10215 (IGHV3-33)
ARSMVTTYGYYYYGMDV

SEQ ID NO: 20431 - protein, 10 aa, Homo sapiens
  Light chain CDR3 for antibody 10216 (IGKV3-11)
QQRSNWPALT

SEQ ID NO: 20432 - protein, 17 aa, Homo sapiens
  Heavy chain CDR3 for antibody 10216 (IGHV3-33)
AREDYDILTGYPFYFDY

SEQ ID NO: 20433 - protein, 9 aa, Homo sapiens
  Light chain CDR3 for antibody 10217 (IGKV1-16)
QQYSSYPYT

SEQ ID NO: 20434 - protein, 14 aa, Homo sapiens
  Heavy chain CDR3 for antibody 10217 (IGHV3-23)
AKEDTAMASYYFDY

SEQ ID NO: 20435 - protein, 10 aa, Homo sapiens
  Light chain CDR3 for antibody 10218 (IGKV3-15)
QQYNNWPPYT

SEQ ID NO: 20436 - protein, 11 aa, Homo sapiens
  Heavy chain CDR3 for antibody 10218 (IGHV1-24)
ATELGLYYFDY

SEQ ID NO: 20437 - protein, 9 aa, Homo sapiens
  Light chain CDR3 for antibody 10219 (IGKV1-9)
QQLNGYPWT

SEQ ID NO: 20438 - protein, 16 aa, Homo sapiens
  Heavy chain CDR3 for antibody 10219 (IGHV4-59)
ARDTPYYSGSGRPFDH

SEQ ID NO: 20439 - protein, 9 aa, Homo sapiens
  Light chain CDR3 for antibody 10220 (IGKV3D-20)
QQYGSSPYT

SEQ ID NO: 20440 - protein, 8 aa, Homo sapiens
  Heavy chain CDR3 for antibody 10220 (IGHV4-4)
ARGARFDP

SEQ ID NO: 20441 - protein, 9 aa, Homo sapiens
  Light chain CDR3 for antibody 10221 (IGKV3D-7)
QQDYNLPLT

SEQ ID NO: 20442 - protein, 14 aa, Homo sapiens
  Heavy chain CDR3 for antibody 10221 (IGHV3-20)
ARNGGSTWYDWFDP

SEQ ID NO: 20443 - protein, 10 aa, Homo sapiens
  Light chain CDR3 for antibody 10222 (IGKV1-9)
QQLDSYPMYT

SEQ ID NO: 20444 - protein, 14 aa, Homo sapiens
  Heavy chain CDR3 for antibody 10222 (IGHV3-33)
VRDAMGATTAWFDP

SEQ ID NO: 20445 - protein, 9 aa, Homo sapiens
  Light chain CDR3 for antibody 10223 (IGKV5-2)
LQHDNFPYT

SEQ ID NO: 20446 - protein, 19 aa, Homo sapiens
  Heavy chain CDR3 for antibody 10223 (IGHV3-23)
AKDREMAATSHYYYYGMDV

SEQ ID NO: 20447 - protein, 9 aa, Homo sapiens
  Light chain CDR3 for antibody 10224 (IGKV1-16)
QQYNSYPLT

SEQ ID NO: 20448 - protein, 13 aa, Homo sapiens
  Heavy chain CDR3 for antibody 10224 (IGHV1-24)
ATGYSLNWYEFDY

SEQ ID NO: 20449 - protein, 8 aa, Homo sapiens
  Light chain CDR3 for antibody 10225 (IGKV1D-13)
QQFNNYPT

SEQ ID NO: 20450 - protein, 12 aa, Homo sapiens
  Heavy chain CDR3 for antibody 10225 (IGHV3-23)
AKEGLGNDYEPY

SEQ ID NO: 20451 - protein, 8 aa, Homo sapiens
  Light chain CDR3 for antibody 10226 (IGKV6-21)
HQSSSLPT

SEQ ID NO: 20452 - protein, 14 aa, Homo sapiens
  Heavy chain CDR3 for antibody 10226 (IGHV1-46)
ARKGIVGALDAFDI

SEQ ID NO: 20453 - protein, 9 aa, Homo sapiens
  Light chain CDR3 for antibody 10227 (IGKV3D-7)
QQDYNLPFT

SEQ ID NO: 20454 - protein, 12 aa, Homo sapiens
  Heavy chain CDR3 for antibody 10227 (IGHV3-33)
ARDYISTYGMDV

SEQ ID NO: 20455 - protein, 9 aa, Homo sapiens
  Light chain CDR3 for antibody 10228 (IGKV1-39)
QQSYSTPIT

SEQ ID NO: 20456 - protein, 11 aa, Homo sapiens
  Heavy chain CDR3 for antibody 10228 (IGHV3-33)
AREGAVASFDY

SEQ ID NO: 20457 - protein, 9 aa, Homo sapiens
  Light chain CDR3 for antibody 10229 (IGKV1D-13)
QQFNNYPHT

SEQ ID NO: 20458 - protein, 9 aa, Homo sapiens
  Heavy chain CDR3 for antibody 10229 (IGHV1-8)
ARGPRIMDV

SEQ ID NO: 20459 - protein, 9 aa, Homo sapiens
  Light chain CDR3 for antibody 10230 (IGKV1D-13)
QQFNNYMYT

SEQ ID NO: 20460 - protein, 11 aa, Homo sapiens
  Heavy chain CDR3 for antibody 10230 (IGHV4-59)
ARETGDDAFDI

SEQ ID NO: 20461 - protein, 9 aa, Homo sapiens
  Light chain CDR3 for antibody 10231 (IGKV5-2)
LQHDKFPYT

SEQ ID NO: 20462 - protein, 17 aa, Homo sapiens
  Heavy chain CDR3 for antibody 10231 (IGHV3-33)
AREGWFGELWGYYGMDV

SEQ ID NO: 20463 - protein, 10 aa, Homo sapiens
  Light chain CDR3 for antibody 10232 (IGKV1-39)
QQSYSTPMYT

SEQ ID NO: 20464 - protein, 18 aa, Homo sapiens
  Heavy chain CDR3 for antibody 10232 (IGHV4-39)
ARQYYFGSGNYYRGWFDP

SEQ ID NO: 20465 - protein, 8 aa, Homo sapiens
  Light chain CDR3 for antibody 10233 (IGKV1-5)
QQYNSYST

SEQ ID NO: 20466 - protein, 20 aa, Homo sapiens
  Heavy chain CDR3 for antibody 10233 (IGHV1-18)
AREVGIAVAGTLYYYYGRDV

SEQ ID NO: 20467 - protein, 9 aa, Homo sapiens
  Light chain CDR3 for antibody 10234 (IGKV1-6)
LQDYNYPWT

SEQ ID NO: 20468 - protein, 17 aa, Homo sapiens
  Heavy chain CDR3 for antibody 10234 (IGHV3-33)
SRGGATLVRGVDYGMDV

SEQ ID NO: 20469 - protein, 9 aa, Homo sapiens
  Light chain CDR3 for antibody 10235 (IGKV1-6)
QQEYNYPLT

SEQ ID NO: 20470 - protein, 14 aa, Homo sapiens
  Heavy chain CDR3 for antibody 10235 (IGHV1-46)
ARGAAAGNFYGLDV

SEQ ID NO: 20471 - protein, 9 aa, Homo sapiens
  Light chain CDR3 for antibody 10236 (IGKV3D-7)
QQDYTLPLT

SEQ ID NO: 20472 - protein, 17 aa, Homo sapiens
  Heavy chain CDR3 for antibody 10236 (IGHV3-33)
ARDRELLWFGEFGGMDV

SEQ ID NO: 20473 - protein, 9 aa, Homo sapiens
  Light chain CDR3 for antibody 10237 (IGKV1D-16)
QQYNSYPIT

SEQ ID NO: 20474 - protein, 17 aa, Homo sapiens
  Heavy chain CDR3 for antibody 10237 (IGHV4-59)
AREMGHDILTGYPHFDY

SEQ ID NO: 20475 - protein, 9 aa, Homo sapiens
  Light chain CDR3 for antibody 10238 (IGKV1-9)
QQLKSYLYT

SEQ ID NO: 20476 - protein, 13 aa, Homo sapiens
  Heavy chain CDR3 for antibody 10238 (IGHV1-18)
ARSITMVRGVIGY

SEQ ID NO: 20477 - protein, 9 aa, Homo sapiens
  Light chain CDR3 for antibody 10239 (IGKV3-15)
QQYNNWPRT

SEQ ID NO: 20478 - protein, 14 aa, Homo sapiens
  Heavy chain CDR3 for antibody 10239 (IGHV3-33)
ARDGAAAALDAFDI

SEQ ID NO: 20479 - protein, 8 aa, Homo sapiens
  Light chain CDR3 for antibody 10240 (IGKV3-11)
LQRGNWPT

SEQ ID NO: 20480 - protein, 17 aa, Homo sapiens
  Heavy chain CDR3 for antibody 10240 (IGHV4-59)
ARDFLVRGEGSYYGMDV

SEQ ID NO: 20481 - protein, 8 aa, Homo sapiens
  Light chain CDR3 for antibody 10241 (IGKV3-15)
QQYNNWPT

SEQ ID NO: 20482 - protein, 15 aa, Homo sapiens
  Heavy chain CDR3 for antibody 10241 (IGHV3-33)
ARDRVVRGVMGYFDY

SEQ ID NO: 20483 - protein, 9 aa, Homo sapiens
  Light chain CDR3 for antibody 10242 (IGKV1-37)
QRTYNAPYT

SEQ ID NO: 20484 - protein, 13 aa, Homo sapiens
  Heavy chain CDR3 for antibody 10242 (IGHV3-33)
ARRYRSGWYPFDY

SEQ ID NO: 20485 - protein, 9 aa, Homo sapiens
  Light chain CDR3 for antibody 10243 (IGKV6-21)
HQSSSLPYT

SEQ ID NO: 20486 - protein, 24 aa, Homo sapiens
  Heavy chain CDR3 for antibody 10243 (IGHV1-24)
ATEAHYDILTGYYNPHYYYYGMDV

SEQ ID NO: 20487 - protein, 9 aa, Homo sapiens
  Light chain CDR3 for antibody 10244 (IGKV1D-16)
QQYNSYPYT

SEQ ID NO: 20488 - protein, 20 aa, Homo sapiens
  Heavy chain CDR3 for antibody 10244 (IGHV3-20)
ARDPPRIVGTTYYYYYVMDV

SEQ ID NO: 20489 - protein, 9 aa, Homo sapiens
  Light chain CDR3 for antibody 10245 (IGKV1-6)
LQDYKSPFT

SEQ ID NO: 20490 - protein, 14 aa, Homo sapiens
  Heavy chain CDR3 for antibody 10245 (IGHV3-66)
ARDGYDILTGPMDV

SEQ ID NO: 20491 - protein, 9 aa, Homo sapiens
  Light chain CDR3 for antibody 10246 (IGKV2D-28)
MQALQTPPT

SEQ ID NO: 20492 - protein, 13 aa, Homo sapiens
  Heavy chain CDR3 for antibody 10246 (IGHV3-23)
ARSGSYWGYYFDY

SEQ ID NO: 20493 - protein, 9 aa, Homo sapiens
  Light chain CDR3 for antibody 10247 (IGKV3-20)
HQYGSSPDT

SEQ ID NO: 20494 - protein, 14 aa, Homo sapiens
  Heavy chain CDR3 for antibody 10247 (IGHV3-33)
ARDKTYPLSYGMDV

SEQ ID NO: 20495 - protein, 8 aa, Homo sapiens
  Light chain CDR3 for antibody 10248 (IGKV1D-13)
QQFNNYPT

SEQ ID NO: 20496 - protein, 9 aa, Homo sapiens
  Heavy chain CDR3 for antibody 10248 (IGHV4-59)
AGGSWDFDY

SEQ ID NO: 20497 - protein, 9 aa, Homo sapiens
  Light chain CDR3 for antibody 10249 (IGKV3-15)
QQYNNWPRT

SEQ ID NO: 20498 - protein, 16 aa, Homo sapiens
  Heavy chain CDR3 for antibody 10249 (IGHV3-23)
AKEGEVLRYFDWLFNY

SEQ ID NO: 20499 - protein, 8 aa, Homo sapiens
  Light chain CDR3 for antibody 10250 (IGKV3-20)
QQYGSSFT

SEQ ID NO: 20500 - protein, 12 aa, Homo sapiens
  Heavy chain CDR3 for antibody 10250 (IGHV3-33)
ARDYISTYGMDV

SEQ ID NO: 20501 - protein, 9 aa, Homo sapiens
  Light chain CDR3 for antibody 10251 (IGKV1-17)
LHSNNYPWT

SEQ ID NO: 20502 - protein, 18 aa, Homo sapiens
  Heavy chain CDR3 for antibody 10251 (IGHV3-33)
ARREGIVGATTYYYGMDV

SEQ ID NO: 20503 - protein, 9 aa, Homo sapiens
  Light chain CDR3 for antibody 10252 (IGKV5-2)
LQHDKFPYT

SEQ ID NO: 20504 - protein, 18 aa, Homo sapiens
  Heavy chain CDR3 for antibody 10252 (IGHV3-33)
ARRSAAGTGDYYYCGMDV

SEQ ID NO: 20505 - protein, 9 aa, Homo sapiens
  Light chain CDR3 for antibody 10253 (IGKV2D-28)
MQATQFPHT

SEQ ID NO: 20506 - protein, 13 aa, Homo sapiens
  Heavy chain CDR3 for antibody 10253 (IGHV3-33)
ARDYCGGDCYLDY

SEQ ID NO: 20507 - protein, 9 aa, Homo sapiens
  Light chain CDR3 for antibody 10254 (IGKV1-6)
LQDYNHPFT

SEQ ID NO: 20508 - protein, 12 aa, Homo sapiens
  Heavy chain CDR3 for antibody 10254 (IGHV3-33)
ARDRAYRGSLDY

SEQ ID NO: 20509 - protein, 9 aa, Homo sapiens
  Light chain CDR3 for antibody 10255 (IGKV4-1)
QQYYTTPYT

SEQ ID NO: 20510 - protein, 19 aa, Homo sapiens
  Heavy chain CDR3 for antibody 10255 (IGHV3-33)
ARRRDDILTGWDYYFGMDV

SEQ ID NO: 20511 - protein, 9 aa, Homo sapiens
  Light chain CDR3 for antibody 10256 (IGKV1-16)
QQYNSYPYT

SEQ ID NO: 20512 - protein, 9 aa, Homo sapiens
  Heavy chain CDR3 for antibody 10256 (IGHV3-33)
AKDRNSGYD

SEQ ID NO: 20513 - protein, 9 aa, Homo sapiens
  Light chain CDR3 for antibody 10257 (IGKV3-15)
QQYNNWPRT

SEQ ID NO: 20514 - protein, 14 aa, Homo sapiens
  Heavy chain CDR3 for antibody 10257 (IGHV3-33)
VRDQGSMVRGGGDY

SEQ ID NO: 20515 - protein, 10 aa, Homo sapiens
  Light chain CDR3 for antibody 10258 (IGKV3-11)
QQRSNWPIYT

SEQ ID NO: 20516 - protein, 16 aa, Homo sapiens
  Heavy chain CDR3 for antibody 10258 (IGHV3-33)
AKDAFYYGSGSHLFDY

SEQ ID NO: 20517 - protein, 9 aa, Homo sapiens
  Light chain CDR3 for antibody 10259 (IGKV1D-13)
QHFNNYMYT

SEQ ID NO: 20518 - protein, 12 aa, Homo sapiens
  Heavy chain CDR3 for antibody 10259 (IGHV4-59)
ARDRSGWAYFDY

SEQ ID NO: 20519 - protein, 8 aa, Homo sapiens
  Light chain CDR3 for antibody 10260 (IGKV3D-7)
QQDYNLLT

SEQ ID NO: 20520 - protein, 18 aa, Homo sapiens
  Heavy chain CDR3 for antibody 10260 (IGHV3-33)
ARDPYSSGWYDYYFGMDV

SEQ ID NO: 20521 - protein, 9 aa, Homo sapiens
  Light chain CDR3 for antibody 10261 (IGKV3-15)
QQYSNWPLT

SEQ ID NO: 20522 - protein, 13 aa, Homo sapiens
  Heavy chain CDR3 for antibody 10261 (IGHV3-23)
ARDEGYSGYNLDN

SEQ ID NO: 20523 - protein, 9 aa, Homo sapiens
  Light chain CDR3 for antibody 10262 (IGKV1-16)
QQYNSYPFT

SEQ ID NO: 20524 - protein, 11 aa, Homo sapiens
  Heavy chain CDR3 for antibody 10262 (IGHV4-59)
AREKGHDSFDL

SEQ ID NO: 20525 - protein, 9 aa, Homo sapiens
  Light chain CDR3 for antibody 10263 (IGKV1D-13)
QQFNNYPYT

SEQ ID NO: 20526 - protein, 12 aa, Homo sapiens
  Heavy chain CDR3 for antibody 10263 (IGHV4-39)
ARREVILGAFDY

SEQ ID NO: 20527 - protein, 8 aa, Homo sapiens
  Light chain CDR3 for antibody 10264 (IGKV1-39)
QQSYTTPT

SEQ ID NO: 20528 - protein, 13 aa, Homo sapiens
  Heavy chain CDR3 for antibody 10264 (IGHV4-34)
ASNFYYYYYGMDV

SEQ ID NO: 20529 - protein, 9 aa, Homo sapiens
  Light chain CDR3 for antibody 10265 (IGKV1-6)
QQYDSYPYT

SEQ ID NO: 20530 - protein, 21 aa, Homo sapiens
  Heavy chain CDR3 for antibody 10265 (IGHV3-33)
AKKRLYDILTGYYKAYYGMDV

SEQ ID NO: 20531 - protein, 9 aa, Homo sapiens
  Light chain CDR3 for antibody 10266 (IGKV1-9)
QQYSSYPYT

SEQ ID NO: 20532 - protein, 16 aa, Homo sapiens
  Heavy chain CDR3 for antibody 10266 (IGHV3-30)
ARDISVAGHVYYGMDV

SEQ ID NO: 20533 - protein, 9 aa, Homo sapiens
  Light chain CDR3 for antibody 10267 (IGKV1-39)
QHYNDYPFT

SEQ ID NO: 20534 - protein, 11 aa, Homo sapiens
  Heavy chain CDR3 for antibody 10267 (IGHV3-33)
AREAANWGFDY

SEQ ID NO: 20535 - protein, 9 aa, Homo sapiens
  Light chain CDR3 for antibody 10268 (IGKV1D-13)
QQFNNYPST

SEQ ID NO: 20536 - protein, 10 aa, Homo sapiens
  Heavy chain CDR3 for antibody 10268 (IGHV3-23)
AKDQVGATDY

SEQ ID NO: 20537 - protein, 9 aa, Homo sapiens
  Light chain CDR3 for antibody 10269 (IGKV1-6)
LQDYNYPRT

SEQ ID NO: 20538 - protein, 22 aa, Homo sapiens
  Heavy chain CDR3 for antibody 10269 (IGHV3-11)
ARDVRDYDILTGYYNGKNYFDY

SEQ ID NO: 20539 - protein, 9 aa, Homo sapiens
  Light chain CDR3 for antibody 10270 (IGKV1-17)
LQHNGYPLT

SEQ ID NO: 20540 - protein, 14 aa, Homo sapiens
  Heavy chain CDR3 for antibody 10270 (IGHV3-23)
ARGRRDFYYYGMDV

SEQ ID NO: 20541 - protein, 9 aa, Homo sapiens
  Light chain CDR3 for antibody 10271 (IGKV1-6)
LQDYKSPFT

SEQ ID NO: 20542 - protein, 13 aa, Homo sapiens
  Heavy chain CDR3 for antibody 10271 (IGHV4-39)
ARQWPSGYWYFDL

SEQ ID NO: 20543 - protein, 8 aa, Homo sapiens
  Light chain CDR3 for antibody 10272 (IGKV1-5)
QQYNSYYT

SEQ ID NO: 20544 - protein, 12 aa, Homo sapiens
  Heavy chain CDR3 for antibody 10272 (IGHV3-33)
AREGIAVAGVDP

SEQ ID NO: 20545 - protein, 9 aa, Homo sapiens
  Light chain CDR3 for antibody 10273 (IGKV1-6)
LQDYNYPRT

SEQ ID NO: 20546 - protein, 19 aa, Homo sapiens
  Heavy chain CDR3 for antibody 10273 (IGHV1-18)
ARDLPYYDILTGYYPLFDY

SEQ ID NO: 20547 - protein, 9 aa, Homo sapiens
  Light chain CDR3 for antibody 10274 (IGKV1-9)
QQLHIYPWT

SEQ ID NO: 20548 - protein, 12 aa, Homo sapiens
  Heavy chain CDR3 for antibody 10274 (IGHV3-33)
ARDSSGWSHFDY

SEQ ID NO: 20549 - protein, 9 aa, Homo sapiens
  Light chain CDR3 for antibody 10275 (IGKV3-11)
QQRSNWPPT

SEQ ID NO: 20550 - protein, 13 aa, Homo sapiens
  Heavy chain CDR3 for antibody 10275 (IGHV3-33)
ARDYTMVRGVMNY

SEQ ID NO: 20551 - protein, 10 aa, Homo sapiens
  Light chain CDR3 for antibody 10276 (IGKV3-20)
QQYGSSPPYT

SEQ ID NO: 20552 - protein, 24 aa, Homo sapiens
  Heavy chain CDR3 for antibody 10276 (IGHV3-20)
ARGRITMVRGVIINPLDYYNGMDV

SEQ ID NO: 20553 - protein, 9 aa, Homo sapiens
  Light chain CDR3 for antibody 10277 (IGKV1-17)
LQHNSYPYT

SEQ ID NO: 20554 - protein, 19 aa, Homo sapiens
  Heavy chain CDR3 for antibody 10277 (IGHV3-20)
ARGGSGSYYNGYYYYGMDV

SEQ ID NO: 20555 - protein, 9 aa, Homo sapiens
  Light chain CDR3 for antibody 10278 (IGKV1-6)
LQDFHYPWT

SEQ ID NO: 20556 - protein, 14 aa, Homo sapiens
  Heavy chain CDR3 for antibody 10278 (IGHV3-20)
ARDRGSSFFDAFDI

SEQ ID NO: 20557 - protein, 9 aa, Homo sapiens
  Light chain CDR3 for antibody 10279 (IGKV1-6)
LQDYSYPWT

SEQ ID NO: 20558 - protein, 19 aa, Homo sapiens
  Heavy chain CDR3 for antibody 10279 (IGHV3-33)
ARDSGYSGYDYYYYYGMDV

SEQ ID NO: 20559 - protein, 9 aa, Homo sapiens
  Light chain CDR3 for antibody 10280 (IGKV3-15)
QQYINWPLT

SEQ ID NO: 20560 - protein, 10 aa, Homo sapiens
  Heavy chain CDR3 for antibody 10280 (IGHV3-11)
ARGQWPPLDY

SEQ ID NO: 20561 - protein, 9 aa, Homo sapiens
  Light chain CDR3 for antibody 10281 (IGKV1-6)
LQDYNYPRT

SEQ ID NO: 20562 - protein, 15 aa, Homo sapiens
  Heavy chain CDR3 for antibody 10281 (IGHV3-23)
AKVFTMVRGMGYFDL

SEQ ID NO: 20563 - protein, 8 aa, Homo sapiens
  Light chain CDR3 for antibody 10282 (IGKV1-5)
QQYNSYWT

SEQ ID NO: 20564 - protein, 16 aa, Homo sapiens
  Heavy chain CDR3 for antibody 10282 (IGHV3-33)
ARGANYYGSGIPNFEY

SEQ ID NO: 20565 - protein, 9 aa, Homo sapiens
  Light chain CDR3 for antibody 10283 (IGKV1D-13)
QQFNNYPYT

SEQ ID NO: 20566 - protein, 14 aa, Homo sapiens
  Heavy chain CDR3 for antibody 10283 (IGHV3-23)
AKGGGVGAYNWFDP

SEQ ID NO: 20567 - protein, 8 aa, Homo sapiens
  Light chain CDR3 for antibody 10284 (IGKV3-20)
QQYGRSFT

SEQ ID NO: 20568 - protein, 13 aa, Homo sapiens
  Heavy chain CDR3 for antibody 10284 (IGHV4-28)
ARKGATGYYGMDV

SEQ ID NO: 20569 - protein, 10 aa, Homo sapiens
  Light chain CDR3 for antibody 10285 (IGKV1-17)
LQHNSYPMYT

SEQ ID NO: 20570 - protein, 17 aa, Homo sapiens
  Heavy chain CDR3 for antibody 10285 (IGHV3-64)
ARERYYGSGSYYNWFDP

SEQ ID NO: 20571 - protein, 9 aa, Homo sapiens
  Light chain CDR3 for antibody 10286 (IGKV3-20)
QQYGSSPYT

SEQ ID NO: 20572 - protein, 12 aa, Homo sapiens
  Heavy chain CDR3 for antibody 10286 (IGHV1-46)
ARGLTGDHAFDI

SEQ ID NO: 20573 - protein, 9 aa, Homo sapiens
  Light chain CDR3 for antibody 10287 (IGKV3-20)
QQYATSPIT

SEQ ID NO: 20574 - protein, 16 aa, Homo sapiens
  Heavy chain CDR3 for antibody 10287 (IGHV3-23)
AKEGMVLRYFDWLWDY

SEQ ID NO: 20575 - protein, 9 aa, Homo sapiens
  Light chain CDR3 for antibody 10288 (IGKV6-21)
QQSSNLPYT

SEQ ID NO: 20576 - protein, 12 aa, Homo sapiens
  Heavy chain CDR3 for antibody 10288 (IGHV4-59)
ARDRSGWAYFDY

SEQ ID NO: 20577 - protein, 9 aa, Homo sapiens
  Light chain CDR3 for antibody 10289 (IGKV2D-24)
TQATQFPHT

SEQ ID NO: 20578 - protein, 15 aa, Homo sapiens
  Heavy chain CDR3 for antibody 10289 (IGHV3-33)
ARDTGYSSSWNWFDP

SEQ ID NO: 20579 - protein, 10 aa, Homo sapiens
  Light chain CDR3 for antibody 10290 (IGKV1-9)
QQLDSYPMYT

SEQ ID NO: 20580 - protein, 19 aa, Homo sapiens
  Heavy chain CDR3 for antibody 10290 (IGHV3-33)
ARGPYYDILTGYGYYGMDV

SEQ ID NO: 20581 - protein, 9 aa, Homo sapiens
  Light chain CDR3 for antibody 10291 (IGKV3-15)
QQYNNWPRT

SEQ ID NO: 20582 - protein, 11 aa, Homo sapiens
  Heavy chain CDR3 for antibody 10291 (IGHV4-39)
ARLLVGATTDY

SEQ ID NO: 20583 - protein, 9 aa, Homo sapiens
  Light chain CDR3 for antibody 10292 (IGKV6-21)
HQSSSLPYT

SEQ ID NO: 20584 - protein, 17 aa, Homo sapiens
  Heavy chain CDR3 for antibody 10292 (IGHV3-23)
AKEGMVLRYFDWSGMDV

SEQ ID NO: 20585 - protein, 9 aa, Homo sapiens
  Light chain CDR3 for antibody 10293 (IGKV1-9)
QQLNTYPWT

SEQ ID NO: 20586 - protein, 11 aa, Homo sapiens
  Heavy chain CDR3 for antibody 10293 (IGHV3-33)
ARERSSGPFAY

SEQ ID NO: 20587 - protein, 9 aa, Homo sapiens
  Light chain CDR3 for antibody 10294 (IGKV1-39)
QQSHTLPCT

SEQ ID NO: 20588 - protein, 11 aa, Homo sapiens
  Heavy chain CDR3 for antibody 10294 (IGHV1-18)
SRGGFSVGYDS

SEQ ID NO: 20589 - protein, 9 aa, Homo sapiens
  Light chain CDR3 for antibody 10295 (IGKV1-39)
QQSYRTPLT

SEQ ID NO: 20590 - protein, 11 aa, Homo sapiens
  Heavy chain CDR3 for antibody 10295 (IGHV3-23)
AKEGTYFDIPH

SEQ ID NO: 20591 - protein, 9 aa, Homo sapiens
  Light chain CDR3 for antibody 10296 (IGKV3-15)
QQYINWPRT

SEQ ID NO: 20592 - protein, 20 aa, Homo sapiens
  Heavy chain CDR3 for antibody 10296 (IGHV3-33)
SRGGATLVRGVIDYYYGMDV

SEQ ID NO: 20593 - protein, 8 aa, Homo sapiens
  Light chain CDR3 for antibody 10297 (IGKV1D-13)
QQFNNYPT

SEQ ID NO: 20594 - protein, 10 aa, Homo sapiens
  Heavy chain CDR3 for antibody 10297 (IGHV3-23)
AKDHWGDFDY

SEQ ID NO: 20595 - protein, 8 aa, Homo sapiens
  Light chain CDR3 for antibody 10298 (IGKV1D-13)
QQFNNYPT

SEQ ID NO: 20596 - protein, 17 aa, Homo sapiens
  Heavy chain CDR3 for antibody 10298 (IGHV3-33)
AREDYDILTGYPFYFDY

SEQ ID NO: 20597 - protein, 8 aa, Homo sapiens
  Light chain CDR3 for antibody 10299 (IGKV1-5)
QQYNSYWT

SEQ ID NO: 20598 - protein, 14 aa, Homo sapiens
  Heavy chain CDR3 for antibody 10299 (IGHV3-33)
ARDRDIMATSYFDY

SEQ ID NO: 20599 - protein, 8 aa, Homo sapiens
  Light chain CDR3 for antibody 10300 (IGKV3D-7)
QQDYSLLT

SEQ ID NO: 20600 - protein, 11 aa, Homo sapiens
  Heavy chain CDR3 for antibody 10300 (IGHV3-64)
ARERGSYAFDI

SEQ ID NO: 20601 - protein, 9 aa, Homo sapiens
  Light chain CDR3 for antibody 10301 (IGKV1D-13)
QQFNNYPYT

SEQ ID NO: 20602 - protein, 20 aa, Homo sapiens
  Heavy chain CDR3 for antibody 10301 (IGHV3-33)
ARDLGWATMVRGVIRAPFDY

SEQ ID NO: 20603 - protein, 9 aa, Homo sapiens
  Light chain CDR3 for antibody 10302 (IGKV5-2)
LQHDKFPYT

SEQ ID NO: 20604 - protein, 14 aa, Homo sapiens
  Heavy chain CDR3 for antibody 10302 (IGHV3-33)
ARDREQQLVRYFDY

SEQ ID NO: 20605 - protein, 10 aa, Homo sapiens
  Light chain CDR3 for antibody 10303 (IGKV3-15)
QQYNNWPPYT

SEQ ID NO: 20606 - protein, 11 aa, Homo sapiens
  Heavy chain CDR3 for antibody 10303 (IGHV3-13)
AREAIIGPFDY

SEQ ID NO: 20607 - protein, 8 aa, Homo sapiens
  Light chain CDR3 for antibody 10304 (IGKV3-15)
QQYNNWPT

SEQ ID NO: 20608 - protein, 18 aa, Homo sapiens
  Heavy chain CDR3 for antibody 10304 (IGHV3-23)
AKVGDFFASGNYWDYFDY

SEQ ID NO: 20609 - protein, 8 aa, Homo sapiens
  Light chain CDR3 for antibody 10305 (IGKV1-5)
QQYNSYYT

SEQ ID NO: 20610 - protein, 14 aa, Homo sapiens
  Heavy chain CDR3 for antibody 10305 (IGHV3-20)
ARGYGSGSYYSFDY

SEQ ID NO: 20611 - protein, 8 aa, Homo sapiens
  Light chain CDR3 for antibody 10306 (IGKV1D-13)
QQFNNYYT

SEQ ID NO: 20612 - protein, 8 aa, Homo sapiens
  Heavy chain CDR3 for antibody 10306 (IGHV3-23)
AKETGTSY

SEQ ID NO: 20613 - protein, 9 aa, Homo sapiens
  Light chain CDR3 for antibody 10307 (IGKV3-20)
QQYGSSPYT

SEQ ID NO: 20614 - protein, 17 aa, Homo sapiens
  Heavy chain CDR3 for antibody 10307 (IGHV3-30)
ARESLWFGEANHFVMDV

SEQ ID NO: 20615 - protein, 8 aa, Homo sapiens
  Light chain CDR3 for antibody 10308 (IGKV3-20)
QQYGSSLT

SEQ ID NO: 20616 - protein, 9 aa, Homo sapiens
  Heavy chain CDR3 for antibody 10308 (IGHV4-59)
AGGSWDFDY

SEQ ID NO: 20617 - protein, 9 aa, Homo sapiens
  Light chain CDR3 for antibody 10309 (IGKV3-20)
QQYGTSPFP

SEQ ID NO: 20618 - protein, 11 aa, Homo sapiens
  Heavy chain CDR3 for antibody 10309 (IGHV3-33)
ARDRSSGPFDY

SEQ ID NO: 20619 - protein, 10 aa, Homo sapiens
  Light chain CDR3 for antibody 10310 (IGKV1-39)
QQSYSTPMYT

SEQ ID NO: 20620 - protein, 12 aa, Homo sapiens
  Heavy chain CDR3 for antibody 10310 (IGHV3-33)
ARDRGYSGYFDY

SEQ ID NO: 20621 - protein, 11 aa, Homo sapiens
  Light chain CDR3 for antibody 10311 (IGKV3-11)
QQRSNWPPTWT

SEQ ID NO: 20622 - protein, 10 aa, Homo sapiens
  Heavy chain CDR3 for antibody 10311 (IGHV3-33)
ARDVVVYFDY

SEQ ID NO: 20623 - protein, 9 aa, Homo sapiens
  Light chain CDR3 for antibody 10312 (IGKV1-6)
LQDYNYPRT

SEQ ID NO: 20624 - protein, 12 aa, Homo sapiens
  Heavy chain CDR3 for antibody 10312 (IGHV3-33)
ARGYCGSGYADF

SEQ ID NO: 20625 - protein, 8 aa, Homo sapiens
  Light chain CDR3 for antibody 10313 (IGKV3D-7)
QQDYNLLT

SEQ ID NO: 20626 - protein, 12 aa, Homo sapiens
  Heavy chain CDR3 for antibody 10313 (IGHV3-33)
ARDYISTYGMDV

SEQ ID NO: 20627 - protein, 9 aa, Homo sapiens
  Light chain CDR3 for antibody 10314 (IGKV1-12)
QQANSFPFT

SEQ ID NO: 20628 - protein, 12 aa, Homo sapiens
  Heavy chain CDR3 for antibody 10314 (IGHV3-33)
ARDLVGATPFDY

SEQ ID NO: 20629 - protein, 11 aa, Homo sapiens
  Light chain CDR3 for antibody 10315 (IGKV3-11)
QQRSNWPPTWT

SEQ ID NO: 20630 - protein, 14 aa, Homo sapiens
  Heavy chain CDR3 for antibody 10315 (IGHV3-33)
ARAISGSSYWYFDL

SEQ ID NO: 20631 - protein, 8 aa, Homo sapiens
  Light chain CDR3 for antibody 10316 (IGKV6-21)
HQSSSLPT

SEQ ID NO: 20632 - protein, 11 aa, Homo sapiens
  Heavy chain CDR3 for antibody 10316 (IGHV4-59)
ARSIRYSFFDY

SEQ ID NO: 20633 - protein, 9 aa, Homo sapiens
  Light chain CDR3 for antibody 10317 (IGKV1-27)
QKYNSAPHM

SEQ ID NO: 20634 - protein, 9 aa, Homo sapiens
  Heavy chain CDR3 for antibody 10317 (IGHV3-33)
ARELAYFDY

SEQ ID NO: 20635 - protein, 9 aa, Homo sapiens
  Light chain CDR3 for antibody 10318 (IGKV4-1)
QQYYTTPPT

SEQ ID NO: 20636 - protein, 20 aa, Homo sapiens
  Heavy chain CDR3 for antibody 10318 (IGHV3-23)
AKGMGGLRYFDWPHYYGMDV

SEQ ID NO: 20637 - protein, 9 aa, Homo sapiens
  Light chain CDR3 for antibody 10319 (IGKV2-30)
MQGTHWPLT

SEQ ID NO: 20638 - protein, 13 aa, Homo sapiens
  Heavy chain CDR3 for antibody 10319 (IGHV3-33)
ARDPLYSGSYFDY

SEQ ID NO: 20639 - protein, 9 aa, Homo sapiens
  Light chain CDR3 for antibody 10320 (IGKV6-21)
HQSSSLPYT

SEQ ID NO: 20640 - protein, 11 aa, Homo sapiens
  Heavy chain CDR3 for antibody 10320 (IGHV3-30)
VRVGTGEFFDL

SEQ ID NO: 20641 - protein, 10 aa, Homo sapiens
  Light chain CDR3 for antibody 10321 (IGKV1-17)
QQLNSFLMYT

SEQ ID NO: 20642 - protein, 13 aa, Homo sapiens
  Heavy chain CDR3 for antibody 10321 (IGHV4-39)
ARHPPSRDYGMDV

SEQ ID NO: 20643 - protein, 9 aa, Homo sapiens
  Light chain CDR3 for antibody 10322 (IGKV1-6)
LQDYKSPFT

SEQ ID NO: 20644 - protein, 13 aa, Homo sapiens
  Heavy chain CDR3 for antibody 10322 (IGHV3-33)
VSTGDSYYYVMDV

SEQ ID NO: 20645 - protein, 9 aa, Homo sapiens
  Light chain CDR3 for antibody 10323 (IGKV6-21)
HQSYSLPHT

SEQ ID NO: 20646 - protein, 14 aa, Homo sapiens
  Heavy chain CDR3 for antibody 10323 (IGHV3-20)
ARDRGSSFFDAFDI

SEQ ID NO: 20647 - protein, 8 aa, Homo sapiens
  Light chain CDR3 for antibody 10324 (IGKV3-11)
QQRSNWLT

SEQ ID NO: 20648 - protein, 15 aa, Homo sapiens
  Heavy chain CDR3 for antibody 10324 (IGHV3-33)
ARDHLTGYYYYGMDV

SEQ ID NO: 20649 - protein, 9 aa, Homo sapiens
  Light chain CDR3 for antibody 10325 (IGKV2D-28)
MQALQTPPT

SEQ ID NO: 20650 - protein, 15 aa, Homo sapiens
  Heavy chain CDR3 for antibody 10325 (IGHV3-20)
AREGSSSWYLYYFDY

SEQ ID NO: 20651 - protein, 9 aa, Homo sapiens
  Light chain CDR3 for antibody 10326 (IGKV1-16)
QQYNSYPRT

SEQ ID NO: 20652 - protein, 16 aa, Homo sapiens
  Heavy chain CDR3 for antibody 10326 (IGHV3-33)
ARDVGIAAAGSGWFDT

SEQ ID NO: 20653 - protein, 9 aa, Homo sapiens
  Light chain CDR3 for antibody 10327 (IGKV1-16)
QQYDSYPYT

SEQ ID NO: 20654 - protein, 12 aa, Homo sapiens
  Heavy chain CDR3 for antibody 10327 (IGHV3-h)
AREDYYYYGMDV

SEQ ID NO: 20655 - protein, 9 aa, Homo sapiens
  Light chain CDR3 for antibody 10328 (IGKV1-16)
QQYSRYPYT

SEQ ID NO: 20656 - protein, 13 aa, Homo sapiens
  Heavy chain CDR3 for antibody 10328 (IGHV4-59)
ARTMVRGVAPFDY

SEQ ID NO: 20657 - protein, 10 aa, Homo sapiens
  Light chain CDR3 for antibody 10329 (IGKV3-11)
QQRSNWPMYT

SEQ ID NO: 20658 - protein, 17 aa, Homo sapiens
  Heavy chain CDR3 for antibody 10329 (IGHV1-18)
ARDRAFTMVRGVPPFDY

SEQ ID NO: 20659 - protein, 10 aa, Homo sapiens
  Light chain CDR3 for antibody 10330 (IGKV3-11)
QQRSNWLMYT

SEQ ID NO: 20660 - protein, 14 aa, Homo sapiens
  Heavy chain CDR3 for antibody 10330 (IGHV3-33)
ARDWNDVYYYGMDV

SEQ ID NO: 20661 - protein, 9 aa, Homo sapiens
  Light chain CDR3 for antibody 10331 (IGKV1-9)
QQLNRYPYT

SEQ ID NO: 20662 - protein, 12 aa, Homo sapiens
  Heavy chain CDR3 for antibody 10331 (IGHV3-33)
ARKGYDMHEFDI

SEQ ID NO: 20663 - protein, 8 aa, Homo sapiens
  Light chain CDR3 for antibody 10332 (IGKV6-21)
HQSSSLPT

SEQ ID NO: 20664 - protein, 11 aa, Homo sapiens
  Heavy chain CDR3 for antibody 10332 (IGHV3-33)
ARDRATATVDY

SEQ ID NO: 20665 - protein, 8 aa, Homo sapiens
  Light chain CDR3 for antibody 10333 (IGKV3D-7)
QQDYNLLT

SEQ ID NO: 20666 - protein, 18 aa, Homo sapiens
  Heavy chain CDR3 for antibody 10333 (IGHV1-18)
ARDRYYYDSGSYYYGMDV

SEQ ID NO: 20667 - protein, 9 aa, Homo sapiens
  Light chain CDR3 for antibody 10334 (IGKV1-6)
LQDYNHPFT

SEQ ID NO: 20668 - protein, 20 aa, Homo sapiens
  Heavy chain CDR3 for antibody 10334 (IGHV3-30)
ARGGATLIRGLIDYYYGMDV

SEQ ID NO: 20669 - protein, 10 aa, Homo sapiens
  Light chain CDR3 for antibody 10335 (IGKV3-11)
QQRSNWPALT

SEQ ID NO: 20670 - protein, 10 aa, Homo sapiens
  Heavy chain CDR3 for antibody 10335 (IGHV3-72)
CRDREGFGDV

SEQ ID NO: 20671 - protein, 9 aa, Homo sapiens
  Light chain CDR3 for antibody 10336 (IGKV1-9)
QQFNSYTRT

SEQ ID NO: 20672 - protein, 26 aa, Homo sapiens
  Heavy chain CDR3 for antibody 10336 (IGHV4-39)
ARQGLLWFGDLKAYDSSGYYYGYCHH

SEQ ID NO: 20673 - protein, 10 aa, Homo sapiens
  Light chain CDR3 for antibody 10337 (IGKV3-15)
QQYNNWPPYT

SEQ ID NO: 20674 - protein, 13 aa, Homo sapiens
  Heavy chain CDR3 for antibody 10337 (IGHV3-23)
AKDRGYSSTSTAY

SEQ ID NO: 20675 - protein, 8 aa, Homo sapiens
  Light chain CDR3 for antibody 10338 (IGKV6-21)
HQSSSLPT

SEQ ID NO: 20676 - protein, 15 aa, Homo sapiens
  Heavy chain CDR3 for antibody 10338 (IGHV1-46)
ARGAVDDYYYYGMDV

SEQ ID NO: 20677 - protein, 9 aa, Homo sapiens
  Light chain CDR3 for antibody 10339 (IGKV3D-7)
QQDYDLPYP

SEQ ID NO: 20678 - protein, 13 aa, Homo sapiens
  Heavy chain CDR3 for antibody 10339 (IGHV4-34)
ASNFYYYYYGMDV

SEQ ID NO: 20679 - protein, 9 aa, Homo sapiens
  Light chain CDR3 for antibody 10340 (IGKV1D-16)
QQYNSYPLT

SEQ ID NO: 20680 - protein, 9 aa, Homo sapiens
  Heavy chain CDR3 for antibody 10340 (IGHV3-33)
ASHSSGEDY

SEQ ID NO: 20681 - protein, 9 aa, Homo sapiens
  Light chain CDR3 for antibody 10341 (IGKV1-5)
QQYNTYSRT

SEQ ID NO: 20682 - protein, 13 aa, Homo sapiens
  Heavy chain CDR3 for antibody 10341 (IGHV3-33)
VSTGDSYYYVMDV

SEQ ID NO: 20683 - protein, 9 aa, Homo sapiens
  Light chain CDR3 for antibody 10342 (IGKV3D-7)
QQDYNLPLT

SEQ ID NO: 20684 - protein, 12 aa, Homo sapiens
  Heavy chain CDR3 for antibody 10342 (IGHV3-23)
AKDGYSYGYFDY

SEQ ID NO: 20685 - protein, 10 aa, Homo sapiens
  Light chain CDR3 for antibody 10343 (IGKV3-11)
QQRSNWPAYT

SEQ ID NO: 20686 - protein, 8 aa, Homo sapiens
  Heavy chain CDR3 for antibody 10343 (IGHV3-23)
APHWIFDY

SEQ ID NO: 20687 - protein, 6 aa, Homo sapiens
  Light chain CDR3 for antibody 10344 (IGKV3-20)
QQYGST

SEQ ID NO: 20688 - protein, 17 aa, Homo sapiens
  Heavy chain CDR3 for antibody 10344 (IGHV1-18)
ARDEGYDILTGYPHFDY

SEQ ID NO: 20689 - protein, 8 aa, Homo sapiens
  Light chain CDR3 for antibody 10345 (IGKV6-21)
HQSSSLPT

SEQ ID NO: 20690 - protein, 18 aa, Homo sapiens
  Heavy chain CDR3 for antibody 10345 (IGHV3-33)
ARERDYYGSGSYPDAFDI

SEQ ID NO: 20691 - protein, 8 aa, Homo sapiens
  Light chain CDR3 for antibody 10346 (IGKV1D-13)
QQFNNYYT

SEQ ID NO: 20692 - protein, 17 aa, Homo sapiens
  Heavy chain CDR3 for antibody 10346 (IGHV1-24)
ATEGYDILPGYYNVLDY

SEQ ID NO: 20693 - protein, 10 aa, Homo sapiens
  Light chain CDR3 for antibody 10347 (IGKV1-39)
QQSYSTPMYT

SEQ ID NO: 20694 - protein, 15 aa, Homo sapiens
  Heavy chain CDR3 for antibody 10347 (IGHV3-33)
AKDRNSGYDWGGFDY

SEQ ID NO: 20695 - protein, 9 aa, Homo sapiens
  Light chain CDR3 for antibody 10348 (IGKV3-20)
QQYGTSPFP

SEQ ID NO: 20696 - protein, 13 aa, Homo sapiens
  Heavy chain CDR3 for antibody 10348 (IGHV3-53)
ARSGSYWGYYFDY

SEQ ID NO: 20697 - protein, 8 aa, Homo sapiens
  Light chain CDR3 for antibody 10349 (IGKV1D-13)
QQFNNYPT

SEQ ID NO: 20698 - protein, 18 aa, Homo sapiens
  Heavy chain CDR3 for antibody 10349 (IGHV3-33)
ARERGNWNDVDYYYGMDV

SEQ ID NO: 20699 - protein, 8 aa, Homo sapiens
  Light chain CDR3 for antibody 10350 (IGKV3-11)
LQRGNWPT

SEQ ID NO: 20700 - protein, 17 aa, Homo sapiens
  Heavy chain CDR3 for antibody 10350 (IGHV1-18)
ARERYYGSGIYKYAMDV

SEQ ID NO: 20701 - protein, 9 aa, Homo sapiens
  Light chain CDR3 for antibody 10351 (IGKV1-6)
LQAYNYPFT

SEQ ID NO: 20702 - protein, 15 aa, Homo sapiens
  Heavy chain CDR3 for antibody 10351 (IGHV3-33)
ARGYYYGSGSCPFDY

SEQ ID NO: 20703 - protein, 9 aa, Homo sapiens
  Light chain CDR3 for antibody 10352 (IGKV5-2)
LQHDKFPYT

SEQ ID NO: 20704 - protein, 16 aa, Homo sapiens
  Heavy chain CDR3 for antibody 10352 (IGHV3-33)
ARGAWYSNGWYGTFDI

SEQ ID NO: 20705 - protein, 9 aa, Homo sapiens
  Light chain CDR3 for antibody 10353 (IGKV1-6)
LQDYNYPLT

SEQ ID NO: 20706 - protein, 8 aa, Homo sapiens
  Heavy chain CDR3 for antibody 10353 (IGHV3-33)
ARDRGDIL

SEQ ID NO: 20707 - protein, 9 aa, Homo sapiens
  Light chain CDR3 for antibody 10354 (IGKV4-1)
QQYYTTPPT

SEQ ID NO: 20708 - protein, 11 aa, Homo sapiens
  Heavy chain CDR3 for antibody 10354 (IGHV3-13)
AREAIIGPFDY

SEQ ID NO: 20709 - protein, 9 aa, Homo sapiens
  Light chain CDR3 for antibody 10355 (IGKV1D-13)
QQFNNYPYT

SEQ ID NO: 20710 - protein, 17 aa, Homo sapiens
  Heavy chain CDR3 for antibody 10355 (IGHV3-64)
ARESLWFGEANHFVMDV

SEQ ID NO: 20711 - protein, 9 aa, Homo sapiens
  Light chain CDR3 for antibody 10356 (IGKV1-17)
QQYSSYPPT

SEQ ID NO: 20712 - protein, 14 aa, Homo sapiens
  Heavy chain CDR3 for antibody 10356 (IGHV3-33)
ARDGYDILTGPFDY

SEQ ID NO: 20713 - protein, 9 aa, Homo sapiens
  Light chain CDR3 for antibody 10357 (IGKV3D-7)
QQDYKLPLT

SEQ ID NO: 20714 - protein, 10 aa, Homo sapiens
  Heavy chain CDR3 for antibody 10357 (IGHV3-30)
AREWYGGMEV

SEQ ID NO: 20715 - protein, 10 aa, Homo sapiens
  Light chain CDR3 for antibody 10358 (IGKV3-11)
QQRSNWPALT

SEQ ID NO: 20716 - protein, 13 aa, Homo sapiens
  Heavy chain CDR3 for antibody 10358 (IGHV4-34)
ARHPPSRDYGMDV

SEQ ID NO: 20717 - protein, 8 aa, Homo sapiens
  Light chain CDR3 for antibody 10359 (IGKV3-11)
QQRGNWPS

SEQ ID NO: 20718 - protein, 9 aa, Homo sapiens
  Heavy chain CDR3 for antibody 10359 (IGHV1-18)
ARGKDWFDP

SEQ ID NO: 20719 - protein, 9 aa, Homo sapiens
  Light chain CDR3 for antibody 10360 (IGKV1-6)
LQDYNYPWT

SEQ ID NO: 20720 - protein, 12 aa, Homo sapiens
  Heavy chain CDR3 for antibody 10360 (IGHV1-69)
ARLVGAWSGMDV

SEQ ID NO: 20721 - protein, 9 aa, Homo sapiens
  Light chain CDR3 for antibody 10361 (IGKV3-20)
QQYGRSPRT

SEQ ID NO: 20722 - protein, 16 aa, Homo sapiens
  Heavy chain CDR3 for antibody 10361 (IGHV1-24)
ATEDSSSYYYYYGMDV

SEQ ID NO: 20723 - protein, 8 aa, Homo sapiens
  Light chain CDR3 for antibody 10362 (IGKV3-11)
QQRSNWWT

SEQ ID NO: 20724 - protein, 16 aa, Homo sapiens
  Heavy chain CDR3 for antibody 10362 (IGHV3-33)
ARGGRSDWLYYYGMDV

SEQ ID NO: 20725 - protein, 11 aa, Homo sapiens
  Light chain CDR3 for antibody 10363 (IGKV3-11)
QQRSNWPPMYT

SEQ ID NO: 20726 - protein, 15 aa, Homo sapiens
  Heavy chain CDR3 for antibody 10363 (IGHV3-66)
ARDRDYYYYYYGMDV

SEQ ID NO: 20727 - protein, 9 aa, Homo sapiens
  Light chain CDR3 for antibody 10364 (IGKV2-30)
MQGTHWPLT

SEQ ID NO: 20728 - protein, 11 aa, Homo sapiens
  Heavy chain CDR3 for antibody 10364 (IGHV3-33)
ARDQGGSSFDY

SEQ ID NO: 20729 - protein, 9 aa, Homo sapiens
  Light chain CDR3 for antibody 10365 (IGKV1-5)
QQYNTYSRT

SEQ ID NO: 20730 - protein, 17 aa, Homo sapiens
  Heavy chain CDR3 for antibody 10365 (IGHV3-33)
ARGFSGYDGYYYYGMDV

SEQ ID NO: 20731 - protein, 8 aa, Homo sapiens
  Light chain CDR3 for antibody 10366 (IGKV6-21)
HQSSSLYA

SEQ ID NO: 20732 - protein, 19 aa, Homo sapiens
  Heavy chain CDR3 for antibody 10366 (IGHV4-59)
ARDRVVGATTYYYYYGMDV

SEQ ID NO: 20733 - protein, 9 aa, Homo sapiens
  Light chain CDR3 for antibody 10367 (IGKV1-6)
LQDYNYPYT

SEQ ID NO: 20734 - protein, 20 aa, Homo sapiens
  Heavy chain CDR3 for antibody 10367 (IGHV3-33)
AREGYDILTGYYKAYYGMDV

SEQ ID NO: 20735 - protein, 9 aa, Homo sapiens
  Light chain CDR3 for antibody 10368 (IGKV1-6)
LQDFHYPWT

SEQ ID NO: 20736 - protein, 14 aa, Homo sapiens
  Heavy chain CDR3 for antibody 10368 (IGHV3-23)
AKSRIVGALYYFDY

SEQ ID NO: 20737 - protein, 9 aa, Homo sapiens
  Light chain CDR3 for antibody 10369 (IGKV3-20)
QQYGSSPWK

SEQ ID NO: 20738 - protein, 13 aa, Homo sapiens
  Heavy chain CDR3 for antibody 10369 (IGHV3-33)
ARDQRYSSGWYDY

SEQ ID NO: 20739 - protein, 9 aa, Homo sapiens
  Light chain CDR3 for antibody 10370 (IGKV1-6)
LQDYNYPWT

SEQ ID NO: 20740 - protein, 18 aa, Homo sapiens
  Heavy chain CDR3 for antibody 10370 (IGHV3-33)
AREGSYYGSGSCPNWFDH

SEQ ID NO: 20741 - protein, 11 aa, Homo sapiens
  Light chain CDR3 for antibody 10371 (IGKV3-11)
QQRSNWPPTWT

SEQ ID NO: 20742 - protein, 11 aa, Homo sapiens
  Heavy chain CDR3 for antibody 10371 (IGHV3-33)
ARDRVLSPFDY

SEQ ID NO: 20743 - protein, 9 aa, Homo sapiens
  Light chain CDR3 for antibody 10372 (IGKV1-6)
LQDYNHQFT

SEQ ID NO: 20744 - protein, 12 aa, Homo sapiens
  Heavy chain CDR3 for antibody 10372 (IGHV3-33)
ARGYFGSGYAHF

SEQ ID NO: 20745 - protein, 9 aa, Homo sapiens
  Light chain CDR3 for antibody 10373 (IGKV1-9)
QQYISYPLT

SEQ ID NO: 20746 - protein, 15 aa, Homo sapiens
  Heavy chain CDR3 for antibody 10373 (IGHV3-23)
ARDSGGGAGTLPFDY

SEQ ID NO: 20747 - protein, 10 aa, Homo sapiens
  Light chain CDR3 for antibody 10374 (IGKV3-15)
QQYNNWPPLT

SEQ ID NO: 20748 - protein, 13 aa, Homo sapiens
  Heavy chain CDR3 for antibody 10374 (IGHV3-11)
ARDEGYRGYVLDT

SEQ ID NO: 20749 - protein, 9 aa, Homo sapiens
  Light chain CDR3 for antibody 10375 (IGKV1-16)
QHYNDYPFT

SEQ ID NO: 20750 - protein, 16 aa, Homo sapiens
  Heavy chain CDR3 for antibody 10375 (IGHV3-33)
ARGGRSDWLYYYGMDV

SEQ ID NO: 20751 - protein, 8 aa, Homo sapiens
  Light chain CDR3 for antibody 10376 (IGKV3D-7)
QQDYNLLT

SEQ ID NO: 20752 - protein, 15 aa, Homo sapiens
  Heavy chain CDR3 for antibody 10376 (IGHV3-23)
AKDLSSGWYAYFFDY

SEQ ID NO: 20753 - protein, 9 aa, Homo sapiens
  Light chain CDR3 for antibody 10377 (IGKV3D-20)
QQYGSSPWT

SEQ ID NO: 20754 - protein, 13 aa, Homo sapiens
  Heavy chain CDR3 for antibody 10377 (IGHV3-33)
VRRIAVAGTEGDC

SEQ ID NO: 20755 - protein, 9 aa, Homo sapiens
  Light chain CDR3 for antibody 10378 (IGKV1-6)
QQYYSYPWT

SEQ ID NO: 20756 - protein, 12 aa, Homo sapiens
  Heavy chain CDR3 for antibody 10378 (IGHV1-18)
ARILFYGDYFDY

SEQ ID NO: 20757 - protein, 9 aa, Homo sapiens
  Light chain CDR3 for antibody 10379 (IGKV2-30)
MQGTHCPYT

SEQ ID NO: 20758 - protein, 9 aa, Homo sapiens
  Heavy chain CDR3 for antibody 10379 (IGHV4-59)
ARGGASFDY

SEQ ID NO: 20759 - protein, 9 aa, Homo sapiens
  Light chain CDR3 for antibody 10380 (IGKV1-16)
LQDYNYPPT

SEQ ID NO: 20760 - protein, 14 aa, Homo sapiens
  Heavy chain CDR3 for antibody 10380 (IGHV3-33)
AKSYDILTGEAFDI

SEQ ID NO: 20761 - protein, 8 aa, Homo sapiens
  Light chain CDR3 for antibody 10381 (IGKV3D-7)
QQDYSLLT

SEQ ID NO: 20762 - protein, 18 aa, Homo sapiens
  Heavy chain CDR3 for antibody 10381 (IGHV3-33)
ARREGIVGAAAYYYGMDV

SEQ ID NO: 20763 - protein, 9 aa, Homo sapiens
  Light chain CDR3 for antibody 10382 (IGKV1-16)
QQYNSYPYT

SEQ ID NO: 20764 - protein, 20 aa, Homo sapiens
  Heavy chain CDR3 for antibody 10382 (IGHV4-59)
ARDRGYDILTGYYGYYGMDV

SEQ ID NO: 20765 - protein, 10 aa, Homo sapiens
  Light chain CDR3 for antibody 10383 (IGKV1-27)
QKYNSAPMYT

SEQ ID NO: 20766 - protein, 16 aa, Homo sapiens
  Heavy chain CDR3 for antibody 10383 (IGHV3-13)
AKEGMVLRYFDWLWDY

SEQ ID NO: 20767 - protein, 8 aa, Homo sapiens
  Light chain CDR3 for antibody 10384 (IGKV2D-28)
MQALQTPT

SEQ ID NO: 20768 - protein, 11 aa, Homo sapiens
  Heavy chain CDR3 for antibody 10384 (IGHV3-33)
AREAANWGFDY

SEQ ID NO: 20769 - protein, 9 aa, Homo sapiens
  Light chain CDR3 for antibody 10385 (IGKV3D-7)
QQDYNLPRT

SEQ ID NO: 20770 - protein, 14 aa, Homo sapiens
  Heavy chain CDR3 for antibody 10385 (IGHV3-33)
AREGYSSGWDYFDH

SEQ ID NO: 20771 - protein, 8 aa, Homo sapiens
  Light chain CDR3 for antibody 10386 (IGKV3-11)
QQRSNWWT

SEQ ID NO: 20772 - protein, 11 aa, Homo sapiens
  Heavy chain CDR3 for antibody 10386 (IGHV3-33)
ARDRVLTPFDY

SEQ ID NO: 20773 - protein, 8 aa, Homo sapiens
  Light chain CDR3 for antibody 10387 (IGKV3D-7)
QQDYNLVT

SEQ ID NO: 20774 - protein, 13 aa, Homo sapiens
  Heavy chain CDR3 for antibody 10387 (IGHV4-59)
ARESPGPYDAFDI

SEQ ID NO: 20775 - protein, 8 aa, Homo sapiens
  Light chain CDR3 for antibody 10388 (IGKV3-11)
QQRSNWLT

SEQ ID NO: 20776 - protein, 9 aa, Homo sapiens
  Heavy chain CDR3 for antibody 10388 (IGHV3-30)
ARPNWGFDY

SEQ ID NO: 20777 - protein, 8 aa, Homo sapiens
  Light chain CDR3 for antibody 10389 (IGKV3-11)
LQRGNWPT

SEQ ID NO: 20778 - protein, 19 aa, Homo sapiens
  Heavy chain CDR3 for antibody 10389 (IGHV5-78)
ARHGEKGKRITMVRGSLDV

SEQ ID NO: 20779 - protein, 9 aa, Homo sapiens
  Light chain CDR3 for antibody 10390 (IGKV1-9)
QQLISYPLT

SEQ ID NO: 20780 - protein, 12 aa, Homo sapiens
  Heavy chain CDR3 for antibody 10390 (IGHV3-30)
ARDRGYSGYIDY

SEQ ID NO: 20781 - protein, 9 aa, Homo sapiens
  Light chain CDR3 for antibody 10391 (IGKV3-15)
QQYNNWPYT

SEQ ID NO: 20782 - protein, 12 aa, Homo sapiens
  Heavy chain CDR3 for antibody 10391 (IGHV3-33)
AREGTGGNWFDP

SEQ ID NO: 20783 - protein, 9 aa, Homo sapiens
  Light chain CDR3 for antibody 10392 (IGKV5-2)
LQHDNFPYT

SEQ ID NO: 20784 - protein, 10 aa, Homo sapiens
  Heavy chain CDR3 for antibody 10392 (IGHV3-23)
AKARNGGLDY

SEQ ID NO: 20785 - protein, 9 aa, Homo sapiens
  Light chain CDR3 for antibody 10393 (IGKV1-16)
QHYNDYPFT

SEQ ID NO: 20786 - protein, 18 aa, Homo sapiens
  Heavy chain CDR3 for antibody 10393 (IGHV3-23)
AKDRITGTTYGYYSGLDV

SEQ ID NO: 20787 - protein, 9 aa, Homo sapiens
  Light chain CDR3 for antibody 10394 (IGKV1-17)
LHHHSYPYT

SEQ ID NO: 20788 - protein, 13 aa, Homo sapiens
  Heavy chain CDR3 for antibody 10394 (IGHV3-33)
ARDQRYSSGWYDY

SEQ ID NO: 20789 - protein, 9 aa, Homo sapiens
  Light chain CDR3 for antibody 10395 (IGKV3D-7)
QQDYNLPLT

SEQ ID NO: 20790 - protein, 16 aa, Homo sapiens
  Heavy chain CDR3 for antibody 10395 (IGHV3-23)
ARIAAPGSEYYYGMDV

SEQ ID NO: 20791 - protein, 9 aa, Homo sapiens
  Light chain CDR3 for antibody 10396 (IGKV1-27)
QKYNSAPYT

SEQ ID NO: 20792 - protein, 16 aa, Homo sapiens
  Heavy chain CDR3 for antibody 10396 (IGHV3-11)
ARDSELRYFDWFGMDV

SEQ ID NO: 20793 - protein, 9 aa, Homo sapiens
  Light chain CDR3 for antibody 10397 (IGKV1-39)
QQSYSTPFT

SEQ ID NO: 20794 - protein, 16 aa, Homo sapiens
  Heavy chain CDR3 for antibody 10397 (IGHV3-23)
AKDLRYFDWSLYAFDI

SEQ ID NO: 20795 - protein, 8 aa, Homo sapiens
  Light chain CDR3 for antibody 10398 (IGKV3-15)
QQYNNWPT

SEQ ID NO: 20796 - protein, 15 aa, Homo sapiens
  Heavy chain CDR3 for antibody 10398 (IGHV3-20)
ARDRGSSGWRDWFDP

SEQ ID NO: 20797 - protein, 9 aa, Homo sapiens
  Light chain CDR3 for antibody 10399 (IGKV1-9)
QQLNSYPRT

SEQ ID NO: 20798 - protein, 14 aa, Homo sapiens
  Heavy chain CDR3 for antibody 10399 (IGHV3-33)
ARETAAAIPEAFDI

SEQ ID NO: 20799 - protein, 9 aa, Homo sapiens
  Light chain CDR3 for antibody 10400 (IGKV3D-7)
QQDYKLPLT

SEQ ID NO: 20800 - protein, 13 aa, Homo sapiens
  Heavy chain CDR3 for antibody 10400 (IGHV3-33)
ARAFTMVRGVIDY

SEQ ID NO: 20801 - protein, 9 aa, Homo sapiens
  Light chain CDR3 for antibody 10401 (IGKV1-17)
LQHNSYPYT

SEQ ID NO: 20802 - protein, 13 aa, Homo sapiens
  Heavy chain CDR3 for antibody 10401 (IGHV4-39)
ARRDGSYYGYFGY

SEQ ID NO: 20803 - protein, 9 aa, Homo sapiens
  Light chain CDR3 for antibody 10402 (IGKV3-15)
QQYINWPLT

SEQ ID NO: 20804 - protein, 18 aa, Homo sapiens
  Heavy chain CDR3 for antibody 10402 (IGHV3-33)
ARERDYYGSGSYPDAFDI

SEQ ID NO: 20805 - protein, 9 aa, Homo sapiens
  Light chain CDR3 for antibody 10403 (IGKV3D-20)
HQYGSSPYT

SEQ ID NO: 20806 - protein, 16 aa, Homo sapiens
  Heavy chain CDR3 for antibody 10403 (IGHV1-24)
ATDWNDRGYYYYGMDV

SEQ ID NO: 20807 - protein, 9 aa, Homo sapiens
  Light chain CDR3 for antibody 10404 (IGKV2-30)
MQGTHWPLT

SEQ ID NO: 20808 - protein, 16 aa, Homo sapiens
  Heavy chain CDR3 for antibody 10404 (IGHV4-59)
AGGSGSYRDYYYGMDV

SEQ ID NO: 20809 - protein, 9 aa, Homo sapiens
  Light chain CDR3 for antibody 10405 (IGKV1-6)
LQDYKSPFT

SEQ ID NO: 20810 - protein, 20 aa, Homo sapiens
  Heavy chain CDR3 for antibody 10405 (IGHV1-18)
AREVGIAVAGTLYYYYGMDV

SEQ ID NO: 20811 - protein, 9 aa, Homo sapiens
  Light chain CDR3 for antibody 10406 (IGKV3D-7)
QQDYNLPYT

SEQ ID NO: 20812 - protein, 7 aa, Homo sapiens
  Heavy chain CDR3 for antibody 10406 (IGHV3-33)
ARELVDY

SEQ ID NO: 20813 - protein, 10 aa, Homo sapiens
  Light chain CDR3 for antibody 10407 (IGKV3-11)
QQRSNWPALT

SEQ ID NO: 20814 - protein, 8 aa, Homo sapiens
  Heavy chain CDR3 for antibody 10407 (IGHV3-23)
AKETGISY

SEQ ID NO: 20815 - protein, 9 aa, Homo sapiens
  Light chain CDR3 for antibody 10408 (IGKV1D-16)
QQFNNYPST

SEQ ID NO: 20816 - protein, 19 aa, Homo sapiens
  Heavy chain CDR3 for antibody 10408 (IGHV3-33)
ARGRGSYYYGPGSHNGMDV

SEQ ID NO: 20817 - protein, 9 aa, Homo sapiens
  Light chain CDR3 for antibody 10409 (IGKV3-11)
QQRSNWPPT

SEQ ID NO: 20818 - protein, 14 aa, Homo sapiens
  Heavy chain CDR3 for antibody 10409 (IGHV3-20)
ARDGGSSSFDWFDP

SEQ ID NO: 20819 - protein, 9 aa, Homo sapiens
  Light chain CDR3 for antibody 10410 (IGKV3D-7)
QQDYNLPLT

SEQ ID NO: 20820 - protein, 14 aa, Homo sapiens
  Heavy chain CDR3 for antibody 10410 (IGHV1-24)
ATWLPLYYYYGMDV

SEQ ID NO: 20821 - protein, 10 aa, Homo sapiens
  Light chain CDR3 for antibody 10411 (IGKV3-15)
QQYNNWPPYT

SEQ ID NO: 20822 - protein, 12 aa, Homo sapiens
  Heavy chain CDR3 for antibody 10411 (IGHV3-33)
ARDYISTYGMDV

SEQ ID NO: 20823 - protein, 9 aa, Homo sapiens
  Light chain CDR3 for antibody 10412 (IGKV3-11)
QQRSNWPYT

SEQ ID NO: 20824 - protein, 14 aa, Homo sapiens
  Heavy chain CDR3 for antibody 10412 (IGHV3-20)
ARDEGSGGYDVFDI

SEQ ID NO: 20825 - protein, 8 aa, Homo sapiens
  Light chain CDR3 for antibody 10413 (IGKV3-20)
QQYGSSRT

SEQ ID NO: 20826 - protein, 18 aa, Homo sapiens
  Heavy chain CDR3 for antibody 10413 (IGHV4-59)
AREGHYYTAGSYYKALDY

SEQ ID NO: 20827 - protein, 9 aa, Homo sapiens
  Light chain CDR3 for antibody 10414 (IGKV1-9)
QQLKSYLYT

SEQ ID NO: 20828 - protein, 11 aa, Homo sapiens
  Heavy chain CDR3 for antibody 10414 (IGHV3-33)
ARDILTGFLDH

SEQ ID NO: 20829 - protein, 10 aa, Homo sapiens
  Light chain CDR3 for antibody 10415 (IGKV3-20)
QQYGRSPPVT

SEQ ID NO: 20830 - protein, 17 aa, Homo sapiens
  Heavy chain CDR3 for antibody 10415 (IGHV3-33)
ARGEQWLGYYYYYGMDV

SEQ ID NO: 20831 - protein, 9 aa, Homo sapiens
  Light chain CDR3 for antibody 10416 (IGKV3-20)
QQYGTSPFP

SEQ ID NO: 20832 - protein, 11 aa, Homo sapiens
  Heavy chain CDR3 for antibody 10416 (IGHV3-33)
AREGAVARFDY

SEQ ID NO: 20833 - protein, 9 aa, Homo sapiens
  Light chain CDR3 for antibody 10417 (IGKV1-39)
QQSYSSPFT

SEQ ID NO: 20834 - protein, 17 aa, Homo sapiens
  Heavy chain CDR3 for antibody 10417 (IGHV1-18)
ARERYYGSGIYKYAMDV

SEQ ID NO: 20835 - protein, 11 aa, Homo sapiens
  Light chain CDR3 for antibody 10418 (IGKV3-11)
QQRSNWPPTWT

SEQ ID NO: 20836 - protein, 14 aa, Homo sapiens
  Heavy chain CDR3 for antibody 10418 (IGHV3-33)
ARRGSPLRPSHLDV

SEQ ID NO: 20837 - protein, 10 aa, Homo sapiens
  Light chain CDR3 for antibody 10419 (IGKV1-39)
QQSYSTPMYT

SEQ ID NO: 20838 - protein, 12 aa, Homo sapiens
  Heavy chain CDR3 for antibody 10419 (IGHV3-33)
ARGYFTSGSAHY

SEQ ID NO: 20839 - protein, 8 aa, Homo sapiens
  Light chain CDR3 for antibody 10420 (IGKV6-21)
HQSSSLPT

SEQ ID NO: 20840 - protein, 19 aa, Homo sapiens
  Heavy chain CDR3 for antibody 10420 (IGHV1-18)
ARDDILTGYSLYYYYGMDV

SEQ ID NO: 20841 - protein, 10 aa, Homo sapiens
  Light chain CDR3 for antibody 10421 (IGKV3-15)
QQYNNWPPIT

SEQ ID NO: 20842 - protein, 17 aa, Homo sapiens
  Heavy chain CDR3 for antibody 10421 (IGHV1-24)
ATHYGSGSHYKGYGMDV

SEQ ID NO: 20843 - protein, 9 aa, Homo sapiens
  Light chain CDR3 for antibody 10422 (IGKV1-6)
LQDYNYPRT

SEQ ID NO: 20844 - protein, 16 aa, Homo sapiens
  Heavy chain CDR3 for antibody 10422 (IGHV3-33)
AREGDILTGYPYYFDY

SEQ ID NO: 20845 - protein, 9 aa, Homo sapiens
  Light chain CDR3 for antibody 10423 (IGKV2D-24)
MQATQFPHT

SEQ ID NO: 20846 - protein, 10 aa, Homo sapiens
  Heavy chain CDR3 for antibody 10423 (IGHV3-33)
ARDGSGSQPI

SEQ ID NO: 20847 - protein, 9 aa, Homo sapiens
  Light chain CDR3 for antibody 10424 (IGKV1D-13)
QQFNNYPST

SEQ ID NO: 20848 - protein, 13 aa, Homo sapiens
  Heavy chain CDR3 for antibody 10424 (IGHV3-33)
ARDDDYGDYPFDY

SEQ ID NO: 20849 - protein, 9 aa, Homo sapiens
  Light chain CDR3 for antibody 10425 (IGKV1-16)
QHYNDYPFT

SEQ ID NO: 20850 - protein, 17 aa, Homo sapiens
  Heavy chain CDR3 for antibody 10425 (IGHV3-23)
AKDGIGELSYYYYGMDV

SEQ ID NO: 20851 - protein, 9 aa, Homo sapiens
  Light chain CDR3 for antibody 10426 (IGKV6-21)
HQSYSLPHT

SEQ ID NO: 20852 - protein, 13 aa, Homo sapiens
  Heavy chain CDR3 for antibody 10426 (IGHV3-33)
ARRYSSGWYPFDY

SEQ ID NO: 20853 - protein, 9 aa, Homo sapiens
  Light chain CDR3 for antibody 10427 (IGKV3-15)
QQYNYWPLT

SEQ ID NO: 20854 - protein, 17 aa, Homo sapiens
  Heavy chain CDR3 for antibody 10427 (IGHV4-59)
ARDRELLWFGEFGGMDV

SEQ ID NO: 20855 - protein, 8 aa, Homo sapiens
  Light chain CDR3 for antibody 10428 (IGKV6-21)
HQSSSLPT

SEQ ID NO: 20856 - protein, 10 aa, Homo sapiens
  Heavy chain CDR3 for antibody 10428 (IGHV3-23)
AKEQWLVPDY

SEQ ID NO: 20857 - protein, 8 aa, Homo sapiens
  Light chain CDR3 for antibody 10429 (IGKV1D-13)
QQFNNYPT

SEQ ID NO: 20858 - protein, 16 aa, Homo sapiens
  Heavy chain CDR3 for antibody 10429 (IGHV3-33)
ARDGSMVRRIHDAFDF

SEQ ID NO: 20859 - protein, 9 aa, Homo sapiens
  Light chain CDR3 for antibody 10430 (IGKV1-9)
QQLYRYPIT

SEQ ID NO: 20860 - protein, 18 aa, Homo sapiens
  Heavy chain CDR3 for antibody 10430 (IGHV3-11)
ARREGIVGATTYYYGMDV

SEQ ID NO: 20861 - protein, 8 aa, Homo sapiens
  Light chain CDR3 for antibody 10431 (IGKV1-9)
QQDYNLLT

SEQ ID NO: 20862 - protein, 13 aa, Homo sapiens
  Heavy chain CDR3 for antibody 10431 (IGHV3-23)
AKDRGYSSTSTAY

SEQ ID NO: 20863 - protein, 10 aa, Homo sapiens
  Light chain CDR3 for antibody 10432 (IGKV1-39)
QQSYSTPMYT

SEQ ID NO: 20864 - protein, 11 aa, Homo sapiens
  Heavy chain CDR3 for antibody 10432 (IGHV3-23)
GEFSSGWSFDY

SEQ ID NO: 20865 - protein, 9 aa, Homo sapiens
  Light chain CDR3 for antibody 10433 (IGKV2-30)
MQGTHWPLT

SEQ ID NO: 20866 - protein, 20 aa, Homo sapiens
  Heavy chain CDR3 for antibody 10433 (IGHV3-33)
ARDPAQLERRYYYFYYGMDV

SEQ ID NO: 20867 - protein, 9 aa, Homo sapiens
  Light chain CDR3 for antibody 10434 (IGKV1-9)
QQLNSYPWP

SEQ ID NO: 20868 - protein, 11 aa, Homo sapiens
  Heavy chain CDR3 for antibody 10434 (IGHV3-33)
ARGTTVTHFDY

SEQ ID NO: 20869 - protein, 9 aa, Homo sapiens
  Light chain CDR3 for antibody 10435 (IGKV1-17)
LQHNGYPLT

SEQ ID NO: 20870 - protein, 11 aa, Homo sapiens
  Heavy chain CDR3 for antibody 10435 (IGHV4-59)
ARSIRYSVFDY

SEQ ID NO: 20871 - protein, 9 aa, Homo sapiens
  Light chain CDR3 for antibody 10436 (IGKV1-5)
QQYNTYSRT

SEQ ID NO: 20872 - protein, 13 aa, Homo sapiens
  Heavy chain CDR3 for antibody 10436 (IGHV3-33)
ARKAYGDYFYFDY

SEQ ID NO: 20873 - protein, 9 aa, Homo sapiens
  Light chain CDR3 for antibody 10437 (IGKV1-17)
LQQNSYPYT

SEQ ID NO: 20874 - protein, 18 aa, Homo sapiens
  Heavy chain CDR3 for antibody 10437 (IGHV4-39)
ARGALTYYDILTGYFFDY

SEQ ID NO: 20875 - protein, 8 aa, Homo sapiens
  Light chain CDR3 for antibody 10438 (IGKV1D-13)
QQFNNYPT

SEQ ID NO: 20876 - protein, 16 aa, Homo sapiens
  Heavy chain CDR3 for antibody 10438 (IGHV3-33)
ARDNFGSGSYYSHFHY

SEQ ID NO: 20877 - protein, 9 aa, Homo sapiens
  Light chain CDR3 for antibody 10439 (IGKV1-9)
QQLNNYLFT

SEQ ID NO: 20878 - protein, 13 aa, Homo sapiens
  Heavy chain CDR3 for antibody 10439 (IGHV4-59)
ARTMVRGVAPFDY

SEQ ID NO: 20879 - protein, 9 aa, Homo sapiens
  Light chain CDR3 for antibody 10440 (IGKV1D-16)
QQYNSYPYT

SEQ ID NO: 20880 - protein, 17 aa, Homo sapiens
  Heavy chain CDR3 for antibody 10440 (IGHV1-18)
SRARYYGSGNYKYNMDF

SEQ ID NO: 20881 - protein, 9 aa, Homo sapiens
  Light chain CDR3 for antibody 10441 (IGKV1-9)
QQLNTYPWT

SEQ ID NO: 20882 - protein, 15 aa, Homo sapiens
  Heavy chain CDR3 for antibody 10441 (IGHV4-39)
ARRSKYTSAWYPFDY

SEQ ID NO: 20883 - protein, 9 aa, Homo sapiens
  Light chain CDR3 for antibody 10442 (IGKV1-17)
LHSNNYPWT

SEQ ID NO: 20884 - protein, 12 aa, Homo sapiens
  Heavy chain CDR3 for antibody 10442 (IGHV4-59)
ARDRSGWAYFDY

SEQ ID NO: 20885 - protein, 9 aa, Homo sapiens
  Light chain CDR3 for antibody 10443 (IGKV5-2)
LQHDKFPYT

SEQ ID NO: 20886 - protein, 12 aa, Homo sapiens
  Heavy chain CDR3 for antibody 10443 (IGHV3-13)
VREAGIPDAFDI

SEQ ID NO: 20887 - protein, 9 aa, Homo sapiens
  Light chain CDR3 for antibody 10444 (IGKV3D-7)
QQDYKLPLT

SEQ ID NO: 20888 - protein, 12 aa, Homo sapiens
  Heavy chain CDR3 for antibody 10444 (IGHV3-23)
AKEGIVGVPFDY

SEQ ID NO: 20889 - protein, 9 aa, Homo sapiens
  Light chain CDR3 for antibody 10445 (IGKV1-6)
LQDFHYPWT

SEQ ID NO: 20890 - protein, 12 aa, Homo sapiens
  Heavy chain CDR3 for antibody 10445 (IGHV1-18)
ARILFYGDYFDY

SEQ ID NO: 20891 - protein, 9 aa, Homo sapiens
  Light chain CDR3 for antibody 10446 (IGKV3-15)
QQYHNWPLT

SEQ ID NO: 20892 - protein, 18 aa, Homo sapiens
  Heavy chain CDR3 for antibody 10446 (IGHV6-1)
ARDQYSYGPYYYYYGMDV

SEQ ID NO: 20893 - protein, 9 aa, Homo sapiens
  Light chain CDR3 for antibody 10447 (IGKV1-9)
QQLISYPRT

SEQ ID NO: 20894 - protein, 9 aa, Homo sapiens
  Heavy chain CDR3 for antibody 10447 (IGHV3-30)
ARPNWGFDY

SEQ ID NO: 20895 - protein, 10 aa, Homo sapiens
  Light chain CDR3 for antibody 10448 (IGKV1-17)
LQHNSYPMYT

SEQ ID NO: 20896 - protein, 9 aa, Homo sapiens
  Heavy chain CDR3 for antibody 10448 (IGHV1-8)
ARGRLDFDY

SEQ ID NO: 20897 - protein, 9 aa, Homo sapiens
  Light chain CDR3 for antibody 10449 (IGKV1-9)
QQLNSYPLT

SEQ ID NO: 20898 - protein, 11 aa, Homo sapiens
  Heavy chain CDR3 for antibody 10449 (IGHV4-39)
ARDSGSYYFDY

SEQ ID NO: 20899 - protein, 9 aa, Homo sapiens
  Light chain CDR3 for antibody 10450 (IGKV3-20)
QQYGISPYT

SEQ ID NO: 20900 - protein, 12 aa, Homo sapiens
  Heavy chain CDR3 for antibody 10450 (IGHV1-18)
ARILSYGDYFDY

SEQ ID NO: 20901 - protein, 9 aa, Homo sapiens
  Light chain CDR3 for antibody 10451 (IGKV4-1)
QQYYTTPPT

SEQ ID NO: 20902 - protein, 11 aa, Homo sapiens
  Heavy chain CDR3 for antibody 10451 (IGHV3-33)
ARAGIAALFDY

SEQ ID NO: 20903 - protein, 9 aa, Homo sapiens
  Light chain CDR3 for antibody 10452 (IGKV1-9)
QQLISYPLT

SEQ ID NO: 20904 - protein, 12 aa, Homo sapiens
  Heavy chain CDR3 for antibody 10452 (IGHV4-59)
ARGYSSSWYFDY

SEQ ID NO: 20905 - protein, 8 aa, Homo sapiens
  Light chain CDR3 for antibody 10453 (IGKV3-20)
QQYGRSFT

SEQ ID NO: 20906 - protein, 15 aa, Homo sapiens
  Heavy chain CDR3 for antibody 10453 (IGHV4-59)
ARDIGYYGSGSPLAY

SEQ ID NO: 20907 - protein, 9 aa, Homo sapiens
  Light chain CDR3 for antibody 10454 (IGKV1D-16)
QQYDSYPWT

SEQ ID NO: 20908 - protein, 23 aa, Homo sapiens
  Heavy chain CDR3 for antibody 10454 (IGHV3-11)
ARDRGITMVRGVITYYYFYGMDV

SEQ ID NO: 20909 - protein, 9 aa, Homo sapiens
  Light chain CDR3 for antibody 10455 (IGKV1D-16)
QQYNSYPLT

SEQ ID NO: 20910 - protein, 14 aa, Homo sapiens
  Heavy chain CDR3 for antibody 10455 (IGHV3-20)
ARDEGSTWSDIFDI

SEQ ID NO: 20911 - protein, 9 aa, Homo sapiens
  Light chain CDR3 for antibody 10456 (IGKV2D-24)
TQATQFPHT

SEQ ID NO: 20912 - protein, 13 aa, Homo sapiens
  Heavy chain CDR3 for antibody 10456 (IGHV4-39)
ARQWPSGYWYFDL

SEQ ID NO: 20913 - protein, 8 aa, Homo sapiens
  Light chain CDR3 for antibody 10457 (IGKV3-11)
QQRSNWLT

SEQ ID NO: 20914 - protein, 18 aa, Homo sapiens
  Heavy chain CDR3 for antibody 10457 (IGHV3-23)
AKDRITGTTYGYYAGLDV

SEQ ID NO: 20915 - protein, 9 aa, Homo sapiens
  Light chain CDR3 for antibody 10458 (IGKV5-2)
LQHDKFPYT

SEQ ID NO: 20916 - protein, 19 aa, Homo sapiens
  Heavy chain CDR3 for antibody 10458 (IGHV3-33)
ARVLDGLSPPYYYYDGLDV

SEQ ID NO: 20917 - protein, 9 aa, Homo sapiens
  Light chain CDR3 for antibody 10459 (IGKV1D-13)
QQFNNYPYT

SEQ ID NO: 20918 - protein, 11 aa, Homo sapiens
  Heavy chain CDR3 for antibody 10459 (IGHV3-23)
AKDRPYYGSGV

SEQ ID NO: 20919 - protein, 9 aa, Homo sapiens
  Light chain CDR3 for antibody 10460 (IGKV4-1)
QQYYSTPWT

SEQ ID NO: 20920 - protein, 14 aa, Homo sapiens
  Heavy chain CDR3 for antibody 10460 (IGHV3-33)
ARRGSPLRPSHLDV

SEQ ID NO: 20921 - protein, 10 aa, Homo sapiens
  Light chain CDR3 for antibody 10461 (IGKV3-11)
QQRSIWPPYT

SEQ ID NO: 20922 - protein, 16 aa, Homo sapiens
  Heavy chain CDR3 for antibody 10461 (IGHV3-33)
ARGYDMLTGDYHCMDV

SEQ ID NO: 20923 - protein, 9 aa, Homo sapiens
  Light chain CDR3 for antibody 10462 (IGKV1-39)
QQSYRTPLT

SEQ ID NO: 20924 - protein, 17 aa, Homo sapiens
  Heavy chain CDR3 for antibody 10462 (IGHV3-33)
AKEGSSSSWYGGLYFDY

SEQ ID NO: 20925 - protein, 9 aa, Homo sapiens
  Light chain CDR3 for antibody 10463 (IGKV1-17)
LHSNNYPWT

SEQ ID NO: 20926 - protein, 13 aa, Homo sapiens
  Heavy chain CDR3 for antibody 10463 (IGHV3-33)
ARDYTMVRGVMNY

SEQ ID NO: 20927 - protein, 9 aa, Homo sapiens
  Light chain CDR3 for antibody 10464 (IGKV1-9)
QQLISYPLT

SEQ ID NO: 20928 - protein, 12 aa, Homo sapiens
  Heavy chain CDR3 for antibody 10464 (IGHV3-33)
AREEAVAEAFDI

SEQ ID NO: 20929 - protein, 9 aa, Homo sapiens
  Light chain CDR3 for antibody 10465 (IGKV1D-16)
QQYYSYPRT

SEQ ID NO: 20930 - protein, 16 aa, Homo sapiens
  Heavy chain CDR3 for antibody 10465 (IGHV1-24)
ATEDSSSYYYYYGMDV

SEQ ID NO: 20931 - protein, 8 aa, Homo sapiens
  Light chain CDR3 for antibody 10466 (IGKV1-5)
QQYNSYYT

SEQ ID NO: 20932 - protein, 17 aa, Homo sapiens
  Heavy chain CDR3 for antibody 10466 (IGHV3-33)
ARGGAAAGPYLYYGLDV

SEQ ID NO: 20933 - protein, 9 aa, Homo sapiens
  Light chain CDR3 for antibody 10467 (IGKV1-9)
QQLKSYPYT

SEQ ID NO: 20934 - protein, 12 aa, Homo sapiens
  Heavy chain CDR3 for antibody 10467 (IGHV3-13)
AREAGIPDAFDI

SEQ ID NO: 20935 - protein, 9 aa, Homo sapiens
  Light chain CDR3 for antibody 10468 (IGKV3-20)
LQHNSYPYT

SEQ ID NO: 20936 - protein, 13 aa, Homo sapiens
  Heavy chain CDR3 for antibody 10468 (IGHV3-33)
VRRIAVAGTECDC

SEQ ID NO: 20937 - protein, 10 aa, Homo sapiens
  Light chain CDR3 for antibody 10469 (IGKV3-11)
QQRSNWPALT

SEQ ID NO: 20938 - protein, 16 aa, Homo sapiens
  Heavy chain CDR3 for antibody 10469 (IGHV3-33)
ARGANYYGSGIPNFEY

SEQ ID NO: 20939 - protein, 10 aa, Homo sapiens
  Light chain CDR3 for antibody 10470 (IGKV1-27)
QKYNSAPMYT

SEQ ID NO: 20940 - protein, 9 aa, Homo sapiens
  Heavy chain CDR3 for antibody 10470 (IGHV4-59)
AREGGSGSL

SEQ ID NO: 20941 - protein, 10 aa, Homo sapiens
  Light chain CDR3 for antibody 10471 (IGKV3-11)
QQRSNWPIFT

SEQ ID NO: 20942 - protein, 17 aa, Homo sapiens
  Heavy chain CDR3 for antibody 10471 (IGHV3-33)
ARGFSGYDGYYYYGMDV

SEQ ID NO: 20943 - protein, 9 aa, Homo sapiens
  Light chain CDR3 for antibody 10472 (IGKV1-6)
LQDFHYPWT

SEQ ID NO: 20944 - protein, 17 aa, Homo sapiens
  Heavy chain CDR3 for antibody 10472 (IGHV3-21)
ARGYCSRTSCYLYYFDY

SEQ ID NO: 20945 - protein, 9 aa, Homo sapiens
  Light chain CDR3 for antibody 10473 (IGKV3D-7)
QQDYTLPYT

SEQ ID NO: 20946 - protein, 13 aa, Homo sapiens
  Heavy chain CDR3 for antibody 10473 (IGHV3-13)
ARAITMVRGVIDY

SEQ ID NO: 20947 - protein, 9 aa, Homo sapiens
  Light chain CDR3 for antibody 10474 (IGKV1-9)
QQLNTYPWT

SEQ ID NO: 20948 - protein, 9 aa, Homo sapiens
  Heavy chain CDR3 for antibody 10474 (IGHV3-23)
ARIWWLKDY

SEQ ID NO: 20949 - protein, 9 aa, Homo sapiens
  Light chain CDR3 for antibody 10475 (IGKV1-16)
QQYNSYPYT

SEQ ID NO: 20950 - protein, 11 aa, Homo sapiens
  Heavy chain CDR3 for antibody 10475 (IGHV1-69)
AREGSSGPFDY

SEQ ID NO: 20951 - protein, 10 aa, Homo sapiens
  Light chain CDR3 for antibody 10476 (IGKV3-11)
QQRSNWPIWT

SEQ ID NO: 20952 - protein, 16 aa, Homo sapiens
  Heavy chain CDR3 for antibody 10476 (IGHV3-33)
ARDRGGMTMVRGGFDY

SEQ ID NO: 20953 - protein, 9 aa, Homo sapiens
  Light chain CDR3 for antibody 10477 (IGKV3D-7)
QQDYTLPLT

SEQ ID NO: 20954 - protein, 18 aa, Homo sapiens
  Heavy chain CDR3 for antibody 10477 (IGHV1-24)
ATGLRYFDWPIISDLFDY

SEQ ID NO: 20955 - protein, 8 aa, Homo sapiens
  Light chain CDR3 for antibody 10478 (IGKV3-11)
QQRSNWLT

SEQ ID NO: 20956 - protein, 18 aa, Homo sapiens
  Heavy chain CDR3 for antibody 10478 (IGHV3-23)
AKEGNYYGSGSYWGYFDP

SEQ ID NO: 20957 - protein, 9 aa, Homo sapiens
  Light chain CDR3 for antibody 10479 (IGKV6-21)
HQSSSLPYT

SEQ ID NO: 20958 - protein, 15 aa, Homo sapiens
  Heavy chain CDR3 for antibody 10479 (IGHV1-8)
ARLRWFGELSGWFDP

SEQ ID NO: 20959 - protein, 9 aa, Homo sapiens
  Light chain CDR3 for antibody 10480 (IGKV3D-7)
QQDYNLPYT

SEQ ID NO: 20960 - protein, 13 aa, Homo sapiens
  Heavy chain CDR3 for antibody 10480 (IGHV1-2)
AKDGVRGSFGMDV

SEQ ID NO: 20961 - protein, 9 aa, Homo sapiens
  Light chain CDR3 for antibody 10481 (IGKV1-9)
QQLHIYPWT

SEQ ID NO: 20962 - protein, 18 aa, Homo sapiens
  Heavy chain CDR3 for antibody 10481 (IGHV3-33)
ARREGIVGATTYYYGMDV

SEQ ID NO: 20963 - protein, 10 aa, Homo sapiens
  Light chain CDR3 for antibody 10482 (IGKV3-11)
QQRSNWPIFT

SEQ ID NO: 20964 - protein, 17 aa, Homo sapiens
  Heavy chain CDR3 for antibody 10482 (IGHV1-18)
ARERYYGSGIYKYAMDV

SEQ ID NO: 20965 - protein, 9 aa, Homo sapiens
  Light chain CDR3 for antibody 10483 (IGKV1-9)
QQLHIYPWT

SEQ ID NO: 20966 - protein, 16 aa, Homo sapiens
  Heavy chain CDR3 for antibody 10483 (IGHV3-33)
AREVAGSYYYYYGMDV

SEQ ID NO: 20967 - protein, 9 aa, Homo sapiens
  Light chain CDR3 for antibody 10484 (IGKV1-17)
LQHNSYPPT

SEQ ID NO: 20968 - protein, 20 aa, Homo sapiens
  Heavy chain CDR3 for antibody 10484 (IGHV3-23)
AKDRETGTTSYHYYYYGMDV

SEQ ID NO: 20969 - protein, 10 aa, Homo sapiens
  Light chain CDR3 for antibody 10485 (IGKV3-15)
QQYNNWPPLT

SEQ ID NO: 20970 - protein, 12 aa, Homo sapiens
  Heavy chain CDR3 for antibody 10485 (IGHV3-33)
ARVDTAAPYLDY

SEQ ID NO: 20971 - protein, 6 aa, Homo sapiens
  Light chain CDR3 for antibody 10486 (IGKV3-20)
QQYGST

SEQ ID NO: 20972 - protein, 13 aa, Homo sapiens
  Heavy chain CDR3 for antibody 10486 (IGHV3-23)
ASPFNWNDGFFDY

SEQ ID NO: 20973 - protein, 9 aa, Homo sapiens
  Light chain CDR3 for antibody 10487 (IGKV3D-7)
QQDYNLPLT

SEQ ID NO: 20974 - protein, 15 aa, Homo sapiens
  Heavy chain CDR3 for antibody 10487 (IGHV3-20)
AREGPYYYGSGSLDY

SEQ ID NO: 20975 - protein, 11 aa, Homo sapiens
  Light chain CDR3 for antibody 10488 (IGKV3-11)
QQRSNWPPTWT

SEQ ID NO: 20976 - protein, 17 aa, Homo sapiens
  Heavy chain CDR3 for antibody 10488 (IGHV3-33)
ARGFSGYDGYYYYGMDV

SEQ ID NO: 20977 - protein, 9 aa, Homo sapiens
  Light chain CDR3 for antibody 10489 (IGKV1-6)
LQDYIYPRT

SEQ ID NO: 20978 - protein, 17 aa, Homo sapiens
  Heavy chain CDR3 for antibody 10489 (IGHV3-21)
ARDKAVAVYQFYYGLDV

SEQ ID NO: 20979 - protein, 10 aa, Homo sapiens
  Light chain CDR3 for antibody 10490 (IGKV3-11)
QQRSNWLMYT

SEQ ID NO: 20980 - protein, 17 aa, Homo sapiens
  Heavy chain CDR3 for antibody 10490 (IGHV3-33)
ARGYCSRTSCYLYYFDY

SEQ ID NO: 20981 - protein, 9 aa, Homo sapiens
  Light chain CDR3 for antibody 10491 (IGKV1-6)
LQVYSYPWT

SEQ ID NO: 20982 - protein, 14 aa, Homo sapiens
  Heavy chain CDR3 for antibody 10491 (IGHV3-33)
ARAISGSSYWYFDL

SEQ ID NO: 20983 - protein, 9 aa, Homo sapiens
  Light chain CDR3 for antibody 10492 (IGKV3D-7)
QQDYDLPYP

SEQ ID NO: 20984 - protein, 9 aa, Homo sapiens
  Heavy chain CDR3 for antibody 10492 (IGHV1-18)
ARGKDWFDH

SEQ ID NO: 20985 - protein, 9 aa, Homo sapiens
  Light chain CDR3 for antibody 10493 (IGKV1-27)
QKYNSAPHT

SEQ ID NO: 20986 - protein, 13 aa, Homo sapiens
  Heavy chain CDR3 for antibody 10493 (IGHV3-33)
ASAGNSYYNVMDV

SEQ ID NO: 20987 - protein, 8 aa, Homo sapiens
  Light chain CDR3 for antibody 10494 (IGKV3D-7)
QQDYNLLT

SEQ ID NO: 20988 - protein, 15 aa, Homo sapiens
  Heavy chain CDR3 for antibody 10494 (IGHV3-23)
AKEALRYFDWSGMDV

SEQ ID NO: 20989 - protein, 9 aa, Homo sapiens
  Light chain CDR3 for antibody 10495 (IGKV3D-20)
QQLKSYLYT

SEQ ID NO: 20990 - protein, 24 aa, Homo sapiens
  Heavy chain CDR3 for antibody 10495 (IGHV3-20)
ARGRITMVRGVIINPLDYYNGMDV

SEQ ID NO: 20991 - protein, 9 aa, Homo sapiens
  Light chain CDR3 for antibody 10496 (IGKV4-1)
QQYYTTPPT

SEQ ID NO: 20992 - protein, 15 aa, Homo sapiens
  Heavy chain CDR3 for antibody 10496 (IGHV3-23)
AKEALRYFDWSGMDV

SEQ ID NO: 20993 - protein, 8 aa, Homo sapiens
  Light chain CDR3 for antibody 10497 (IGKV3-15)
QQYNNWPT

SEQ ID NO: 20994 - protein, 15 aa, Homo sapiens
  Heavy chain CDR3 for antibody 10497 (IGHV1-46)
ARGRFFDWLLSPFDY

SEQ ID NO: 20995 - protein, 9 aa, Homo sapiens
  Light chain CDR3 for antibody 10498 (IGKV1-9)
QQRSNWQYT

SEQ ID NO: 20996 - protein, 18 aa, Homo sapiens
  Heavy chain CDR3 for antibody 10498 (IGHV3-33)
AGGGSGSYSSYYYYGMDV

SEQ ID NO: 20997 - protein, 9 aa, Homo sapiens
  Light chain CDR3 for antibody 10499 (IGKV6-21)
HQRSSLPYT

SEQ ID NO: 20998 - protein, 16 aa, Homo sapiens
  Heavy chain CDR3 for antibody 10499 (IGHV3-23)
AKEGMVLRYFAWFWDY

SEQ ID NO: 20999 - protein, 9 aa, Homo sapiens
  Light chain CDR3 for antibody 10500 (IGKV1-17)
QQYSSYPYT

SEQ ID NO: 21000 - protein, 11 aa, Homo sapiens
  Heavy chain CDR3 for antibody 10500 (IGHV4-59)
TRDRGLGSCDY

SEQ ID NO: 21001 - protein, 9 aa, Homo sapiens
  Light chain CDR3 for antibody 10501 (IGKV1-27)
QKYNSAPYT

SEQ ID NO: 21002 - protein, 19 aa, Homo sapiens
  Heavy chain CDR3 for antibody 10501 (IGHV3-33)
AKDGRSGSYDYYYYYGMDV

SEQ ID NO: 21003 - protein, 9 aa, Homo sapiens
  Light chain CDR3 for antibody 10502 (IGKV3D-20)
HQYGSSPLT

SEQ ID NO: 21004 - protein, 16 aa, Homo sapiens
  Heavy chain CDR3 for antibody 10502 (IGHV4-59)
ARGRYFEWLLGDVFDI

SEQ ID NO: 21005 - protein, 10 aa, Homo sapiens
  Light chain CDR3 for antibody 10503 (IGKV1-17)
LQHNSYPMYT

SEQ ID NO: 21006 - protein, 12 aa, Homo sapiens
  Heavy chain CDR3 for antibody 10503 (IGHV3-33)
AREGTRWVYFDY

SEQ ID NO: 21007 - protein, 9 aa, Homo sapiens
  Light chain CDR3 for antibody 10504 (IGKV5-2)
LQHDKFPYT

SEQ ID NO: 21008 - protein, 13 aa, Homo sapiens
  Heavy chain CDR3 for antibody 10504 (IGHV3-33)
ARDSGSYSYYFSY

SEQ ID NO: 21009 - protein, 10 aa, Homo sapiens
  Light chain CDR3 for antibody 10505 (IGKV3-11)
QQRSNWPAYT

SEQ ID NO: 21010 - protein, 18 aa, Homo sapiens
  Heavy chain CDR3 for antibody 10505 (IGHV3-30)
ARDQGIVVLPGAPWYFDL

SEQ ID NO: 21011 - protein, 9 aa, Homo sapiens
  Light chain CDR3 for antibody 10506 (IGKV1-17)
QQHNSYPYT

SEQ ID NO: 21012 - protein, 20 aa, Homo sapiens
  Heavy chain CDR3 for antibody 10506 (IGHV3-33)
ARAGDIAVAGTHYYYYGMDV

SEQ ID NO: 21013 - protein, 9 aa, Homo sapiens
  Light chain CDR3 for antibody 10507 (IGKV1-27)
QKYNSAPYT

SEQ ID NO: 21014 - protein, 15 aa, Homo sapiens
  Heavy chain CDR3 for antibody 10507 (IGHV3-33)
ARERYSSAWSSGMDV

SEQ ID NO: 21015 - protein, 9 aa, Homo sapiens
  Light chain CDR3 for antibody 10508 (IGKV1-13)
LQHNSYPPT

SEQ ID NO: 21016 - protein, 14 aa, Homo sapiens
  Heavy chain CDR3 for antibody 10508 (IGHV4-39)
ARDSGYDYYYAMDV

SEQ ID NO: 21017 - protein, 9 aa, Homo sapiens
  Light chain CDR3 for antibody 10509 (IGKV1-39)
QQSYSTPYT

SEQ ID NO: 21018 - protein, 13 aa, Homo sapiens
  Heavy chain CDR3 for antibody 10509 (IGHV3-33)
ARTDYYSYYGLDV

SEQ ID NO: 21019 - protein, 11 aa, Homo sapiens
  Light chain CDR3 for antibody 10510 (IGKV3-11)
QQRSDWPPTWT

SEQ ID NO: 21020 - protein, 14 aa, Homo sapiens
  Heavy chain CDR3 for antibody 10510 (IGHV3-33)
ARDKSYPLSYGMDV

SEQ ID NO: 21021 - protein, 9 aa, Homo sapiens
  Light chain CDR3 for antibody 10511 (IGKV3D-7)
QQDYNLPYT

SEQ ID NO: 21022 - protein, 12 aa, Homo sapiens
  Heavy chain CDR3 for antibody 10511 (IGHV3-74)
ARKQWLVQAFDI

SEQ ID NO: 21023 - protein, 9 aa, Homo sapiens
  Light chain CDR3 for antibody 10512 (IGKV1-39)
QQSYSTPLT

SEQ ID NO: 21024 - protein, 18 aa, Homo sapiens
  Heavy chain CDR3 for antibody 10512 (IGHV3-33)
VREGGYYGSGSYPDAFDI

SEQ ID NO: 21025 - protein, 9 aa, Homo sapiens
  Light chain CDR3 for antibody 10513 (IGKV1-33)
QQYDNLPFT

SEQ ID NO: 21026 - protein, 14 aa, Homo sapiens
  Heavy chain CDR3 for antibody 10513 (IGHV3-20)
AREGWFGDYYGMDV

SEQ ID NO: 21027 - protein, 9 aa, Homo sapiens
  Light chain CDR3 for antibody 10514 (IGKV1-33)
QQYDNLPFT

SEQ ID NO: 21028 - protein, 14 aa, Homo sapiens
  Heavy chain CDR3 for antibody 10514 (IGHV3-33)
ARDNILTGYYLFDY

SEQ ID NO: 21029 - protein, 9 aa, Homo sapiens
  Light chain CDR3 for antibody 10515 (IGKV3D-20)
QQYGISPYT

SEQ ID NO: 21030 - protein, 12 aa, Homo sapiens
  Heavy chain CDR3 for antibody 10515 (IGHV1-24)
TSDWAYYYGMDV

SEQ ID NO: 21031 - protein, 9 aa, Homo sapiens
  Light chain CDR3 for antibody 10516 (IGKV3-20)
QQYGSSPYT

SEQ ID NO: 21032 - protein, 10 aa, Homo sapiens
  Heavy chain CDR3 for antibody 10516 (IGHV3-33)
ARDHGYYFDY

SEQ ID NO: 21033 - protein, 10 aa, Homo sapiens
  Light chain CDR3 for antibody 10517 (IGKV3-15)
QQYNNWPPYT

SEQ ID NO: 21034 - protein, 14 aa, Homo sapiens
  Heavy chain CDR3 for antibody 10517 (IGHV3-33)
ARDNILTVYYLFDY

SEQ ID NO: 21035 - protein, 8 aa, Homo sapiens
  Light chain CDR3 for antibody 10518 (IGKV3-20)
QQYGSSFT

SEQ ID NO: 21036 - protein, 13 aa, Homo sapiens
  Heavy chain CDR3 for antibody 10518 (IGHV4-39)
ARHPPSRDYGMDV

SEQ ID NO: 21037 - protein, 9 aa, Homo sapiens
  Light chain CDR3 for antibody 10519 (IGKV3-11)
QQRSNWMYT

SEQ ID NO: 21038 - protein, 17 aa, Homo sapiens
  Heavy chain CDR3 for antibody 10519 (IGHV4-59)
AREEDYFGSGSFGTFDI

SEQ ID NO: 21039 - protein, 9 aa, Homo sapiens
  Light chain CDR3 for antibody 10520 (IGKV3-11)
QQRSDWPLT

SEQ ID NO: 21040 - protein, 14 aa, Homo sapiens
  Heavy chain CDR3 for antibody 10520 (IGHV3-33)
ARGGYSGYRYYFDY

SEQ ID NO: 21041 - protein, 9 aa, Homo sapiens
  Light chain CDR3 for antibody 10521 (IGKV1-6)
LQDYNYPYT

SEQ ID NO: 21042 - protein, 17 aa, Homo sapiens
  Heavy chain CDR3 for antibody 10521 (IGHV3-33)
ARVRGVIEGYHYYGMDV

SEQ ID NO: 21043 - protein, 10 aa, Homo sapiens
  Light chain CDR3 for antibody 10522 (IGKV1-17)
LQHNSYPMYT

SEQ ID NO: 21044 - protein, 15 aa, Homo sapiens
  Heavy chain CDR3 for antibody 10522 (IGHV3-23)
AKDGGWNYYYYGMDV

SEQ ID NO: 21045 - protein, 9 aa, Homo sapiens
  Light chain CDR3 for antibody 10523 (IGKV2-30)
MQGTHWPLT

SEQ ID NO: 21046 - protein, 10 aa, Homo sapiens
  Heavy chain CDR3 for antibody 10523 (IGHV1-18)
AREQRLGFDY

SEQ ID NO: 21047 - protein, 9 aa, Homo sapiens
  Light chain CDR3 for antibody 10524 (IGKV4-1)
QQYYSTPPT

SEQ ID NO: 21048 - protein, 13 aa, Homo sapiens
  Heavy chain CDR3 for antibody 10524 (IGHV3-53)
ARDEGYSGYNLDN

SEQ ID NO: 21049 - protein, 9 aa, Homo sapiens
  Light chain CDR3 for antibody 10525 (IGKV2-30)
MQGTHWPLT

SEQ ID NO: 21050 - protein, 13 aa, Homo sapiens
  Heavy chain CDR3 for antibody 10525 (IGHV3-33)
ASAGNSYYNVMDV

SEQ ID NO: 21051 - protein, 10 aa, Homo sapiens
  Light chain CDR3 for antibody 10526 (IGKV1-9)
QQLNSFLMYT

SEQ ID NO: 21052 - protein, 17 aa, Homo sapiens
  Heavy chain CDR3 for antibody 10526 (IGHV1-18)
ARDRAFTMVRGVPPFDY

SEQ ID NO: 21053 - protein, 9 aa, Homo sapiens
  Light chain CDR3 for antibody 10527 (IGKV3D-7)
QQDYNLPWT

SEQ ID NO: 21054 - protein, 17 aa, Homo sapiens
  Heavy chain CDR3 for antibody 10527 (IGHV3-23)
AKGNYGSGSYYKGDFHH

SEQ ID NO: 21055 - protein, 9 aa, Homo sapiens
  Light chain CDR3 for antibody 10528 (IGKV2D-28)
MQALQTPPT

SEQ ID NO: 21056 - protein, 21 aa, Homo sapiens
  Heavy chain CDR3 for antibody 10528 (IGHV3-33)
ARDEYYEIVTGYGYYHYGMDV

SEQ ID NO: 21057 - protein, 9 aa, Homo sapiens
  Light chain CDR3 for antibody 10529 (IGKV3-11)
QQRSSWPPT

SEQ ID NO: 21058 - protein, 14 aa, Homo sapiens
  Heavy chain CDR3 for antibody 10529 (IGHV3-33)
ARDTVAAGFNGMDV

SEQ ID NO: 21059 - protein, 9 aa, Homo sapiens
  Light chain CDR3 for antibody 10530 (IGKV1-39)
QQSYRTPLT

SEQ ID NO: 21060 - protein, 12 aa, Homo sapiens
  Heavy chain CDR3 for antibody 10530 (IGHV3-23)
AKESLYTPTDDY

SEQ ID NO: 21061 - protein, 9 aa, Homo sapiens
  Light chain CDR3 for antibody 10531 (IGKV1-17)
LQHNSHPWT

SEQ ID NO: 21062 - protein, 14 aa, Homo sapiens
  Heavy chain CDR3 for antibody 10531 (IGHV3-33)
ARATSGSSYWYFDL

SEQ ID NO: 21063 - protein, 9 aa, Homo sapiens
  Light chain CDR3 for antibody 10532 (IGKV1-6)
LQDYNHPFT

SEQ ID NO: 21064 - protein, 14 aa, Homo sapiens
  Heavy chain CDR3 for antibody 10532 (IGHV3-33)
ARGAAAGNFYGLEV

SEQ ID NO: 21065 - protein, 8 aa, Homo sapiens
  Light chain CDR3 for antibody 10533 (IGKV6-21)
HQSSSLPT

SEQ ID NO: 21066 - protein, 11 aa, Homo sapiens
  Heavy chain CDR3 for antibody 10533 (IGHV3-33)
ARGSGSYAFDY

SEQ ID NO: 21067 - protein, 9 aa, Homo sapiens
  Light chain CDR3 for antibody 10534 (IGKV3-15)
QQYNNWPRT

SEQ ID NO: 21068 - protein, 15 aa, Homo sapiens
  Heavy chain CDR3 for antibody 10534 (IGHV3-33)
AREYYYGSGSFPVDY

SEQ ID NO: 21069 - protein, 9 aa, Homo sapiens
  Light chain CDR3 for antibody 10535 (IGKV1D-13)
QRFNNYLYT

SEQ ID NO: 21070 - protein, 13 aa, Homo sapiens
  Heavy chain CDR3 for antibody 10535 (IGHV3-23)
AKEDGDYHHYFDY

SEQ ID NO: 21071 - protein, 9 aa, Homo sapiens
  Light chain CDR3 for antibody 10536 (IGKV1-6)
LQDYNYPYT

SEQ ID NO: 21072 - protein, 14 aa, Homo sapiens
  Heavy chain CDR3 for antibody 10536 (IGHV3-66)
AREEDYYYYYDMDV

SEQ ID NO: 21073 - protein, 9 aa, Homo sapiens
  Light chain CDR3 for antibody 10537 (IGKV1-17)
LQHNGYPLT

SEQ ID NO: 21074 - protein, 9 aa, Homo sapiens
  Heavy chain CDR3 for antibody 10537 (IGHV3-13)
ARDHWYFDL

SEQ ID NO: 21075 - protein, 10 aa, Homo sapiens
  Light chain CDR3 for antibody 10538 (IGKV1-39)
QQSYSTPMYT

SEQ ID NO: 21076 - protein, 18 aa, Homo sapiens
  Heavy chain CDR3 for antibody 10538 (IGHV3-33)
ARDQGIVVLPGAPWYFDP

SEQ ID NO: 21077 - protein, 9 aa, Homo sapiens
  Light chain CDR3 for antibody 10539 (IGKV3-11)
QQRSNWPLT

SEQ ID NO: 21078 - protein, 18 aa, Homo sapiens
  Heavy chain CDR3 for antibody 10539 (IGHV3-23)
AKEGDYYGSGSYWGYFDP

SEQ ID NO: 21079 - protein, 9 aa, Homo sapiens
  Light chain CDR3 for antibody 10540 (IGKV1-13)
QQYSNWPLT

SEQ ID NO: 21080 - protein, 17 aa, Homo sapiens
  Heavy chain CDR3 for antibody 10540 (IGHV3-33)
ARSGIVGATDYYYGLDV

SEQ ID NO: 21081 - protein, 9 aa, Homo sapiens
  Light chain CDR3 for antibody 10541 (IGKV1-16)
QHYNDYPFT

SEQ ID NO: 21082 - protein, 15 aa, Homo sapiens
  Heavy chain CDR3 for antibody 10541 (IGHV4-59)
ARDLGHYYGSVSIDY

SEQ ID NO: 21083 - protein, 9 aa, Homo sapiens
  Light chain CDR3 for antibody 10542 (IGKV1-6)
QQYYSYPYT

SEQ ID NO: 21084 - protein, 14 aa, Homo sapiens
  Heavy chain CDR3 for antibody 10542 (IGHV1-46)
ARGAAAGNFDGLDV

SEQ ID NO: 21085 - protein, 9 aa, Homo sapiens
  Light chain CDR3 for antibody 10543 (IGKV2D-28)
MQALQTPPT

SEQ ID NO: 21086 - protein, 10 aa, Homo sapiens
  Heavy chain CDR3 for antibody 10543 (IGHV3-21)
ARDVVVYFDY

SEQ ID NO: 21087 - protein, 9 aa, Homo sapiens
  Light chain CDR3 for antibody 10544 (IGKV5-2)
LQHDNFPYT

SEQ ID NO: 21088 - protein, 16 aa, Homo sapiens
  Heavy chain CDR3 for antibody 10544 (IGHV3-33)
ARGSVSDILTGAYFDY

SEQ ID NO: 21089 - protein, 9 aa, Homo sapiens
  Light chain CDR3 for antibody 10545 (IGKV1-17)
LQHNSYPPT

SEQ ID NO: 21090 - protein, 9 aa, Homo sapiens
  Heavy chain CDR3 for antibody 10545 (IGHV1-8)
ARGPRIMDV

SEQ ID NO: 21091 - protein, 10 aa, Homo sapiens
  Light chain CDR3 for antibody 10546 (IGKV3-11)
QQRSNWPIYT

SEQ ID NO: 21092 - protein, 13 aa, Homo sapiens
  Heavy chain CDR3 for antibody 10546 (IGHV3-15)
TTDRLLLFGAFDY

SEQ ID NO: 21093 - protein, 8 aa, Homo sapiens
  Light chain CDR3 for antibody 10547 (IGKV6-21)
HQSSSLYT

SEQ ID NO: 21094 - protein, 14 aa, Homo sapiens
  Heavy chain CDR3 for antibody 10547 (IGHV1-18)
ARCFGSGSYGWFDP

SEQ ID NO: 21095 - protein, 9 aa, Homo sapiens
  Light chain CDR3 for antibody 10548 (IGKV3-20)
QQYGSSPYT

SEQ ID NO: 21096 - protein, 13 aa, Homo sapiens
  Heavy chain CDR3 for antibody 10548 (IGHV4-61)
ARDGSSSGWDFDY

SEQ ID NO: 21097 - protein, 9 aa, Homo sapiens
  Light chain CDR3 for antibody 10549 (IGKV1-6)
LQDYNYPYT

SEQ ID NO: 21098 - protein, 12 aa, Homo sapiens
  Heavy chain CDR3 for antibody 10549 (IGHV3-9)
AEDPFLGTSFDY

SEQ ID NO: 21099 - protein, 9 aa, Homo sapiens
  Light chain CDR3 for antibody 10550 (IGKV1-6)
LQDYKSPFT

SEQ ID NO: 21100 - protein, 13 aa, Homo sapiens
  Heavy chain CDR3 for antibody 10550 (IGHV3-33)
ARQSSGWFDAFDI

SEQ ID NO: 21101 - protein, 10 aa, Homo sapiens
  Light chain CDR3 for antibody 10551 (IGKV1-39)
QQSYSTPMYT

SEQ ID NO: 21102 - protein, 20 aa, Homo sapiens
  Heavy chain CDR3 for antibody 10551 (IGHV3-33)
ARRMVRGVKKTYYYYYGLDV

SEQ ID NO: 21103 - protein, 9 aa, Homo sapiens
  Light chain CDR3 for antibody 10552 (IGKV1-39)
QQSYSTPLT

SEQ ID NO: 21104 - protein, 12 aa, Homo sapiens
  Heavy chain CDR3 for antibody 10552 (IGHV3-23)
AKGAVVTAIFDY

SEQ ID NO: 21105 - protein, 8 aa, Homo sapiens
  Light chain CDR3 for antibody 10553 (IGKV1D-13)
QQFNNYYT

SEQ ID NO: 21106 - protein, 12 aa, Homo sapiens
  Heavy chain CDR3 for antibody 10553 (IGHV4-61)
AREYSSGWLFDY

SEQ ID NO: 21107 - protein, 9 aa, Homo sapiens
  Light chain CDR3 for antibody 10554 (IGKV1-17)
LQHNGYPLT

SEQ ID NO: 21108 - protein, 14 aa, Homo sapiens
  Heavy chain CDR3 for antibody 10554 (IGHV3-33)
AREEDYYYYYDMDV

SEQ ID NO: 21109 - protein, 8 aa, Homo sapiens
  Light chain CDR3 for antibody 10555 (IGKV3D-7)
QQDYNLLT

SEQ ID NO: 21110 - protein, 19 aa, Homo sapiens
  Heavy chain CDR3 for antibody 10555 (IGHV3-33)
ARRRDDILTGWDYYFGMDV

SEQ ID NO: 21111 - protein, 9 aa, Homo sapiens
  Light chain CDR3 for antibody 10556 (IGKV1-16)
QQYNSYPLT

SEQ ID NO: 21112 - protein, 15 aa, Homo sapiens
  Heavy chain CDR3 for antibody 10556 (IGHV3-33)
ARDGGPDGDYKAFDI

SEQ ID NO: 21113 - protein, 9 aa, Homo sapiens
  Light chain CDR3 for antibody 10557 (IGKV1-33)
QQYDNLPFT

SEQ ID NO: 21114 - protein, 15 aa, Homo sapiens
  Heavy chain CDR3 for antibody 10557 (IGHV3-33)
ARDTGYSSSWNWFDP

SEQ ID NO: 21115 - protein, 9 aa, Homo sapiens
  Light chain CDR3 for antibody 10558 (IGKV3D-20)
QQYGSSPYT

SEQ ID NO: 21116 - protein, 20 aa, Homo sapiens
  Heavy chain CDR3 for antibody 10558 (IGHV1-2)
ARDGWDYYDSSAYYPSAFDL

SEQ ID NO: 21117 - protein, 9 aa, Homo sapiens
  Light chain CDR3 for antibody 10559 (IGKV1-6)
LQDYNYPWT

SEQ ID NO: 21118 - protein, 8 aa, Homo sapiens
  Heavy chain CDR3 for antibody 10559 (IGHV3-33)
ARGDGDIL

SEQ ID NO: 21119 - protein, 9 aa, Homo sapiens
  Light chain CDR3 for antibody 10560 (IGKV1-27)
QKYNSAPYT

SEQ ID NO: 21120 - protein, 14 aa, Homo sapiens
  Heavy chain CDR3 for antibody 10560 (IGHV1-46)
ARRGIVGALDAFDI

SEQ ID NO: 21121 - protein, 9 aa, Homo sapiens
  Light chain CDR3 for antibody 10561 (IGKV6-21)
HQSSSLPYT

SEQ ID NO: 21122 - protein, 6 aa, Homo sapiens
  Heavy chain CDR3 for antibody 10561 (IGHV4-59)
ARDGDY

SEQ ID NO: 21123 - protein, 9 aa, Homo sapiens
  Light chain CDR3 for antibody 10562 (IGKV3-20)
QQYGTSPFP

SEQ ID NO: 21124 - protein, 12 aa, Homo sapiens
  Heavy chain CDR3 for antibody 10562 (IGHV1-46)
ARGLTGDYAFDI

SEQ ID NO: 21125 - protein, 8 aa, Homo sapiens
  Light chain CDR3 for antibody 10563 (IGKV3-11)
QQRGNWPS

SEQ ID NO: 21126 - protein, 12 aa, Homo sapiens
  Heavy chain CDR3 for antibody 10563 (IGHV1-46)
ARILFYGDYFDY

SEQ ID NO: 21127 - protein, 9 aa, Homo sapiens
  Light chain CDR3 for antibody 10564 (IGKV1D-13)
QQFNNYPHT

SEQ ID NO: 21128 - protein, 14 aa, Homo sapiens
  Heavy chain CDR3 for antibody 10564 (IGHV4-59)
AKGGSGSYYNWFDP

SEQ ID NO: 21129 - protein, 8 aa, Homo sapiens
  Light chain CDR3 for antibody 10565 (IGKV3-11)
QQRGNWPS

SEQ ID NO: 21130 - protein, 17 aa, Homo sapiens
  Heavy chain CDR3 for antibody 10565 (IGHV1-18)
ARDEGYDILTGYPHFDY

SEQ ID NO: 21131 - protein, 9 aa, Homo sapiens
  Light chain CDR3 for antibody 10566 (IGKV1-9)
QQYNSYPLT

SEQ ID NO: 21132 - protein, 16 aa, Homo sapiens
  Heavy chain CDR3 for antibody 10566 (IGHV3-30)
ARDSSYYGSGYYGMDV

SEQ ID NO: 21133 - protein, 9 aa, Homo sapiens
  Light chain CDR3 for antibody 10567 (IGKV2-30)
MQGTHWPLT

SEQ ID NO: 21134 - protein, 14 aa, Homo sapiens
  Heavy chain CDR3 for antibody 10567 (IGHV1-24)
ATWLPLYYYYGMDV

SEQ ID NO: 21135 - protein, 9 aa, Homo sapiens
  Light chain CDR3 for antibody 10568 (IGKV1D-16)
QQYNSFPLT

SEQ ID NO: 21136 - protein, 18 aa, Homo sapiens
  Heavy chain CDR3 for antibody 10568 (IGHV4-30-2)
ARQGDYVWGSYRPNWFDH

SEQ ID NO: 21137 - protein, 11 aa, Homo sapiens
  Light chain CDR3 for antibody 10569 (IGKV3-11)
QQRSNWPPTWT

SEQ ID NO: 21138 - protein, 17 aa, Homo sapiens
  Heavy chain CDR3 for antibody 10569 (IGHV1-18)
ARERYYGSGIYKYAMDV

SEQ ID NO: 21139 - protein, 9 aa, Homo sapiens
  Light chain CDR3 for antibody 10570 (IGKV1-6)
LQHYSYPRT

SEQ ID NO: 21140 - protein, 12 aa, Homo sapiens
  Heavy chain CDR3 for antibody 10570 (IGHV3-33)
ARVDAAAPYFDY

SEQ ID NO: 21141 - protein, 11 aa, Homo sapiens
  Light chain CDR3 for antibody 10571 (IGKV3-11)
QQRSNWPPTWT

SEQ ID NO: 21142 - protein, 16 aa, Homo sapiens
  Heavy chain CDR3 for antibody 10571 (IGHV3-33)
ARAVYYGSGSSLIMDV

SEQ ID NO: 21143 - protein, 9 aa, Homo sapiens
  Light chain CDR3 for antibody 10572 (IGKV1-5)
QQYNTYSRT

SEQ ID NO: 21144 - protein, 15 aa, Homo sapiens
  Heavy chain CDR3 for antibody 10572 (IGHV3-33)
ARDHLTGYYYYGMDV

SEQ ID NO: 21145 - protein, 9 aa, Homo sapiens
  Light chain CDR3 for antibody 10573 (IGKV3-11)
QQRINWPWT

SEQ ID NO: 21146 - protein, 13 aa, Homo sapiens
  Heavy chain CDR3 for antibody 10573 (IGHV3-30)
ARAFIMVRGVIDY

SEQ ID NO: 21147 - protein, 8 aa, Homo sapiens
  Light chain CDR3 for antibody 10574 (IGKV3-11)
QQRSNWLT

SEQ ID NO: 21148 - protein, 13 aa, Homo sapiens
  Heavy chain CDR3 for antibody 10574 (IGHV3-33)
ARGDNWNDGGFDY

SEQ ID NO: 21149 - protein, 9 aa, Homo sapiens
  Light chain CDR3 for antibody 10575 (IGKV1-9)
QQLKSYPYT

SEQ ID NO: 21150 - protein, 9 aa, Homo sapiens
  Heavy chain CDR3 for antibody 10575 (IGHV4-59)
ARGGASFDY

SEQ ID NO: 21151 - protein, 8 aa, Homo sapiens
  Light chain CDR3 for antibody 10576 (IGKV1D-13)
QQYNSYYT

SEQ ID NO: 21152 - protein, 13 aa, Homo sapiens
  Heavy chain CDR3 for antibody 10576 (IGHV4-39)
ARHEVMIRGVFDY

SEQ ID NO: 21153 - protein, 9 aa, Homo sapiens
  Light chain CDR3 for antibody 10577 (IGKV1-6)
LQDYNYPYT

SEQ ID NO: 21154 - protein, 14 aa, Homo sapiens
  Heavy chain CDR3 for antibody 10577 (IGHV3-33)
ARDGYDILTGPFDY

SEQ ID NO: 21155 - protein, 9 aa, Homo sapiens
  Light chain CDR3 for antibody 10578 (IGKV1-6)
LQDYNYPRT

SEQ ID NO: 21156 - protein, 9 aa, Homo sapiens
  Heavy chain CDR3 for antibody 10578 (IGHV3-13)
AREHWYFDH

SEQ ID NO: 21157 - protein, 9 aa, Homo sapiens
  Light chain CDR3 for antibody 10579 (IGKV1-17)
LQHNTYPWT

SEQ ID NO: 21158 - protein, 13 aa, Homo sapiens
  Heavy chain CDR3 for antibody 10579 (IGHV3-11)
ARDEGYRGYVLDP

SEQ ID NO: 21159 - protein, 9 aa, Homo sapiens
  Light chain CDR3 for antibody 10580 (IGKV3-20)
QQYGSSPYT

SEQ ID NO: 21160 - protein, 7 aa, Homo sapiens
  Heavy chain CDR3 for antibody 10580 (IGHV3-33)
ARELFNY

SEQ ID NO: 21161 - protein, 10 aa, Homo sapiens
  Light chain CDR3 for antibody 10581 (IGKV3-11)
QQRSNWPALT

SEQ ID NO: 21162 - protein, 18 aa, Homo sapiens
  Heavy chain CDR3 for antibody 10581 (IGHV1-46)
ARDGDYVWGSYRSDWFDH

SEQ ID NO: 21163 - protein, 9 aa, Homo sapiens
  Light chain CDR3 for antibody 10582 (IGKV1-5)
QQYNSYPYT

SEQ ID NO: 21164 - protein, 18 aa, Homo sapiens
  Heavy chain CDR3 for antibody 10582 (IGHV1-8)
AREGAAAGSYYYYNGMDV

SEQ ID NO: 21165 - protein, 9 aa, Homo sapiens
  Light chain CDR3 for antibody 10583 (IGKV3-20)
QQYGSSPIT

SEQ ID NO: 21166 - protein, 12 aa, Homo sapiens
  Heavy chain CDR3 for antibody 10583 (IGHV3-23)
AKEGLGSDYDPY

SEQ ID NO: 21167 - protein, 10 aa, Homo sapiens
  Light chain CDR3 for antibody 10584 (IGKV1-39)
QQSYSTPMYT

SEQ ID NO: 21168 - protein, 14 aa, Homo sapiens
  Heavy chain CDR3 for antibody 10584 (IGHV3-20)
ARDGGSTCYDWFDP

SEQ ID NO: 21169 - protein, 9 aa, Homo sapiens
  Light chain CDR3 for antibody 10585 (IGKV1-39)
QQSYSTPYT

SEQ ID NO: 21170 - protein, 15 aa, Homo sapiens
  Heavy chain CDR3 for antibody 10585 (IGHV3-33)
ARGYYYGSGSFPVDY

SEQ ID NO: 21171 - protein, 9 aa, Homo sapiens
  Light chain CDR3 for antibody 10586 (IGKV3-15)
QQYDNLPFT

SEQ ID NO: 21172 - protein, 11 aa, Homo sapiens
  Heavy chain CDR3 for antibody 10586 (IGHV3-23)
AKGLWSYYFDY

SEQ ID NO: 21173 - protein, 8 aa, Homo sapiens
  Light chain CDR3 for antibody 10587 (IGKV1-5)
QQYNSYST

SEQ ID NO: 21174 - protein, 17 aa, Homo sapiens
  Heavy chain CDR3 for antibody 10587 (IGHV1-18)
ARERYYGSGIYKYAMDV

SEQ ID NO: 21175 - protein, 9 aa, Homo sapiens
  Light chain CDR3 for antibody 10588 (IGKV1-17)
QQEYNYPLT

SEQ ID NO: 21176 - protein, 10 aa, Homo sapiens
  Heavy chain CDR3 for antibody 10588 (IGHV3-23)
AKGDRWRFDP

SEQ ID NO: 21177 - protein, 8 aa, Homo sapiens
  Light chain CDR3 for antibody 10589 (IGKV3-11)
QQRSNWLT

SEQ ID NO: 21178 - protein, 12 aa, Homo sapiens
  Heavy chain CDR3 for antibody 10589 (IGHV3-23)
AKEYDILTGYFH

SEQ ID NO: 21179 - protein, 9 aa, Homo sapiens
  Light chain CDR3 for antibody 10590 (IGKV1-6)
LQQYSYPWT

SEQ ID NO: 21180 - protein, 14 aa, Homo sapiens
  Heavy chain CDR3 for antibody 10590 (IGHV3-33)
ARGGYSGYRYYFDY

SEQ ID NO: 21181 - protein, 10 aa, Homo sapiens
  Light chain CDR3 for antibody 10591 (IGKV1-9)
QQLDSYPMYT

SEQ ID NO: 21182 - protein, 18 aa, Homo sapiens
  Heavy chain CDR3 for antibody 10591 (IGHV3-23)
AKDRITGTTYGYYSGLDV

SEQ ID NO: 21183 - protein, 9 aa, Homo sapiens
  Light chain CDR3 for antibody 10592 (IGKV3-11)
QQRSNWPLT

SEQ ID NO: 21184 - protein, 17 aa, Homo sapiens
  Heavy chain CDR3 for antibody 10592 (IGHV3-23)
AKDTITMVRGALFGMDV

SEQ ID NO: 21185 - protein, 9 aa, Homo sapiens
  Light chain CDR3 for antibody 10593 (IGKV1-9)
QQLNTYPWM

SEQ ID NO: 21186 - protein, 13 aa, Homo sapiens
  Heavy chain CDR3 for antibody 10593 (IGHV4-59)
ARDAGYSSSWFDY

SEQ ID NO: 21187 - protein, 9 aa, Homo sapiens
  Light chain CDR3 for antibody 10594 (IGKV1-17)
LQHNSYQYT

SEQ ID NO: 21188 - protein, 9 aa, Homo sapiens
  Heavy chain CDR3 for antibody 10594 (IGHV4-34)
AREKYYFDY

SEQ ID NO: 21189 - protein, 9 aa, Homo sapiens
  Light chain CDR3 for antibody 10595 (IGKV1-17)
LQHNSYPRT

SEQ ID NO: 21190 - protein, 12 aa, Homo sapiens
  Heavy chain CDR3 for antibody 10595 (IGHV3-33)
ARESGGSYSFDY

SEQ ID NO: 21191 - protein, 9 aa, Homo sapiens
  Light chain CDR3 for antibody 10596 (IGKV1D-16)
QQYITYPYT

SEQ ID NO: 21192 - protein, 15 aa, Homo sapiens
  Heavy chain CDR3 for antibody 10596 (IGHV3-33)
ARGYYYGSGSFPVDY

SEQ ID NO: 21193 - protein, 8 aa, Homo sapiens
  Light chain CDR3 for antibody 10597 (IGKV3D-7)
QQDYNLLT

SEQ ID NO: 21194 - protein, 12 aa, Homo sapiens
  Heavy chain CDR3 for antibody 10597 (IGHV3-23)
AKEGIVGVPFDY

SEQ ID NO: 21195 - protein, 8 aa, Homo sapiens
  Light chain CDR3 for antibody 10598 (IGKV1-5)
QQYNSYYT

SEQ ID NO: 21196 - protein, 12 aa, Homo sapiens
  Heavy chain CDR3 for antibody 10598 (IGHV3-23)
AKESLYTPTDDY

SEQ ID NO: 21197 - protein, 10 aa, Homo sapiens
  Light chain CDR3 for antibody 10599 (IGKV3-11)
QQRSNLPALA

SEQ ID NO: 21198 - protein, 16 aa, Homo sapiens
  Heavy chain CDR3 for antibody 10599 (IGHV3-11)
AKEGMVLRYFDWLWDY

SEQ ID NO: 21199 - protein, 9 aa, Homo sapiens
  Light chain CDR3 for antibody 10600 (IGKV1D-13)
QQFNNYPHT

SEQ ID NO: 21200 - protein, 10 aa, Homo sapiens
  Heavy chain CDR3 for antibody 10600 (IGHV4-59)
ASSGTSLLAY

SEQ ID NO: 21201 - protein, 9 aa, Homo sapiens
  Light chain CDR3 for antibody 10601 (IGKV1-6)
LQDYKSPFT

SEQ ID NO: 21202 - protein, 13 aa, Homo sapiens
  Heavy chain CDR3 for antibody 10601 (IGHV3-33)
AKDSSSWYHWFDP

SEQ ID NO: 21203 - protein, 9 aa, Homo sapiens
  Light chain CDR3 for antibody 10602 (IGKV1-6)
LQDFHYPWT

SEQ ID NO: 21204 - protein, 17 aa, Homo sapiens
  Heavy chain CDR3 for antibody 10602 (IGHV4-59)
ARRITMVREIIITAFDY

SEQ ID NO: 21205 - protein, 8 aa, Homo sapiens
  Light chain CDR3 for antibody 10603 (IGKV3-11)
QQRGNWPS

SEQ ID NO: 21206 - protein, 20 aa, Homo sapiens
  Heavy chain CDR3 for antibody 10603 (IGHV3-23)
AKDREMAATSHYYYYYGMDV

SEQ ID NO: 21207 - protein, 9 aa, Homo sapiens
  Light chain CDR3 for antibody 10604 (IGKV1-6)
LQDYNYPRT

SEQ ID NO: 21208 - protein, 17 aa, Homo sapiens
  Heavy chain CDR3 for antibody 10604 (IGHV3-33)
ARGDGDILTGYYEWFDH

SEQ ID NO: 21209 - protein, 9 aa, Homo sapiens
  Light chain CDR3 for antibody 10605 (IGKV1D-16)
LQDYKSPFT

SEQ ID NO: 21210 - protein, 21 aa, Homo sapiens
  Heavy chain CDR3 for antibody 10605 (IGHV3-23)
AKDIDYYGSGSYPLYYYGMDV

SEQ ID NO: 21211 - protein, 9 aa, Homo sapiens
  Light chain CDR3 for antibody 10606 (IGKV1-6)
LQDYKSPFT

SEQ ID NO: 21212 - protein, 17 aa, Homo sapiens
  Heavy chain CDR3 for antibody 10606 (IGHV3-33)
TRDSGMVRGIIIYGMDV

SEQ ID NO: 21213 - protein, 8 aa, Homo sapiens
  Light chain CDR3 for antibody 10607 (IGKV1D-13)
QQFNNYPT

SEQ ID NO: 21214 - protein, 16 aa, Homo sapiens
  Heavy chain CDR3 for antibody 10607 (IGHV3-30)
ARDSSYYGSGYYGMDV

SEQ ID NO: 21215 - protein, 10 aa, Homo sapiens
  Light chain CDR3 for antibody 10608 (IGKV3-20)
QQYGRSPPVT

SEQ ID NO: 21216 - protein, 18 aa, Homo sapiens
  Heavy chain CDR3 for antibody 10608 (IGHV4-59)
AREGHYYTSGSYYKAFDY

SEQ ID NO: 21217 - protein, 9 aa, Homo sapiens
  Light chain CDR3 for antibody 10609 (IGKV1-6)
LQVYSYPWT

SEQ ID NO: 21218 - protein, 18 aa, Homo sapiens
  Heavy chain CDR3 for antibody 10609 (IGHV3-33)
ARREGIVGATTYYYGMDV

SEQ ID NO: 21219 - protein, 9 aa, Homo sapiens
  Light chain CDR3 for antibody 10610 (IGKV1-9)
QQVKSYPYT

SEQ ID NO: 21220 - protein, 13 aa, Homo sapiens
  Heavy chain CDR3 for antibody 10610 (IGHV4-39)
ARRDVLAPAAFDY

SEQ ID NO: 21221 - protein, 9 aa, Homo sapiens
  Light chain CDR3 for antibody 10611 (IGKV1-17)
QQYITYPYT

SEQ ID NO: 21222 - protein, 12 aa, Homo sapiens
  Heavy chain CDR3 for antibody 10611 (IGHV3-64)
ARDLVGATPFDY

SEQ ID NO: 21223 - protein, 9 aa, Homo sapiens
  Light chain CDR3 for antibody 10612 (IGKV1-6)
QQEYNYPLT

SEQ ID NO: 21224 - protein, 11 aa, Homo sapiens
  Heavy chain CDR3 for antibody 10612 (IGHV1-46)
AREEDLGAFDI

SEQ ID NO: 21225 - protein, 8 aa, Homo sapiens
  Light chain CDR3 for antibody 10613 (IGKV1-6)
QQRSNWLT

SEQ ID NO: 21226 - protein, 14 aa, Homo sapiens
  Heavy chain CDR3 for antibody 10613 (IGHV3-33)
ARDREQQLVRYFDY

SEQ ID NO: 21227 - protein, 9 aa, Homo sapiens
  Light chain CDR3 for antibody 10614 (IGKV6-21)
HQSYSLPYT

SEQ ID NO: 21228 - protein, 17 aa, Homo sapiens
  Heavy chain CDR3 for antibody 10614 (IGHV3-23)
AKGDYYGSGTYSTFFDY

SEQ ID NO: 21229 - protein, 6 aa, Homo sapiens
  Light chain CDR3 for antibody 10615 (IGKV3-20)
QQYGST

SEQ ID NO: 21230 - protein, 15 aa, Homo sapiens
  Heavy chain CDR3 for antibody 10615 (IGHV3-23)
AKDGSYYDYYYGMDV

SEQ ID NO: 21231 - protein, 9 aa, Homo sapiens
  Light chain CDR3 for antibody 10616 (IGKV3-15)
QQYNNWPLT

SEQ ID NO: 21232 - protein, 19 aa, Homo sapiens
  Heavy chain CDR3 for antibody 10616 (IGHV1-18)
ARDTTLVRGLMNYYYGMDV

SEQ ID NO: 21233 - protein, 9 aa, Homo sapiens
  Light chain CDR3 for antibody 10617 (IGKV1D-13)
QQFNNYPYT

SEQ ID NO: 21234 - protein, 12 aa, Homo sapiens
  Heavy chain CDR3 for antibody 10617 (IGHV4-34)
ARGYSSSWYFDY

SEQ ID NO: 21235 - protein, 8 aa, Homo sapiens
  Light chain CDR3 for antibody 10618 (IGKV6-21)
QQSSSLPT

SEQ ID NO: 21236 - protein, 18 aa, Homo sapiens
  Heavy chain CDR3 for antibody 10618 (IGHV3-33)
ARDRYYDILTGYYMGFDY

SEQ ID NO: 21237 - protein, 8 aa, Homo sapiens
  Light chain CDR3 for antibody 10619 (IGKV3-20)
QQYGRSFT

SEQ ID NO: 21238 - protein, 10 aa, Homo sapiens
  Heavy chain CDR3 for antibody 10619 (IGHV3-33)
ARENSTPLDY

SEQ ID NO: 21239 - protein, 9 aa, Homo sapiens
  Light chain CDR3 for antibody 10620 (IGKV3-15)
QQYHNWPLT

SEQ ID NO: 21240 - protein, 15 aa, Homo sapiens
  Heavy chain CDR3 for antibody 10620 (IGHV3-33)
TRDSRPEIIGPPFDY

SEQ ID NO: 21241 - protein, 10 aa, Homo sapiens
  Light chain CDR3 for antibody 10621 (IGKV3-11)
QQRSNWPIYT

SEQ ID NO: 21242 - protein, 14 aa, Homo sapiens
  Heavy chain CDR3 for antibody 10621 (IGHV3-23)
AKDDIVRATGAFDI

SEQ ID NO: 21243 - protein, 11 aa, Homo sapiens
  Light chain CDR3 for antibody 10622 (IGKV3-11)
QQRSNWPPMYT

SEQ ID NO: 21244 - protein, 11 aa, Homo sapiens
  Heavy chain CDR3 for antibody 10622 (IGHV4-59)
TRDRGLGSFDY

SEQ ID NO: 21245 - protein, 9 aa, Homo sapiens
  Light chain CDR3 for antibody 10623 (IGKV1-33)
QQYDNLPFT

SEQ ID NO: 21246 - protein, 13 aa, Homo sapiens
  Heavy chain CDR3 for antibody 10623 (IGHV3-33)
ASGYSGYDWYFDL

SEQ ID NO: 21247 - protein, 9 aa, Homo sapiens
  Light chain CDR3 for antibody 10624 (IGKV1D-16)
LQDFNYPRT

SEQ ID NO: 21248 - protein, 12 aa, Homo sapiens
  Heavy chain CDR3 for antibody 10624 (IGHV3-33)
ASRDILTGYLGY

SEQ ID NO: 21249 - protein, 7 aa, Homo sapiens
  Light chain CDR3 for antibody 10625 (IGKV3-20)
QQYGSYT

SEQ ID NO: 21250 - protein, 15 aa, Homo sapiens
  Heavy chain CDR3 for antibody 10625 (IGHV3-20)
ARDRGSSGWRDWFDP

SEQ ID NO: 21251 - protein, 9 aa, Homo sapiens
  Light chain CDR3 for antibody 10626 (IGKV3-15)
QQYNNWPRT

SEQ ID NO: 21252 - protein, 14 aa, Homo sapiens
  Heavy chain CDR3 for antibody 10626 (IGHV3-33)
ARDKTYPLSYGMDV

SEQ ID NO: 21253 - protein, 10 aa, Homo sapiens
  Light chain CDR3 for antibody 10627 (IGKV3-11)
QQRSNWPALT

SEQ ID NO: 21254 - protein, 12 aa, Homo sapiens
  Heavy chain CDR3 for antibody 10627 (IGHV3-33)
AKDPGWQQLAEY

SEQ ID NO: 21255 - protein, 10 aa, Homo sapiens
  Light chain CDR3 for antibody 10628 (IGKV1-17)
LQHNSYPMYT

SEQ ID NO: 21256 - protein, 12 aa, Homo sapiens
  Heavy chain CDR3 for antibody 10628 (IGHV4-59)
ARDRSGWAYFDY

SEQ ID NO: 21257 - protein, 9 aa, Homo sapiens
  Light chain CDR3 for antibody 10629 (IGKV2-30)
MQGTHWPLT

SEQ ID NO: 21258 - protein, 18 aa, Homo sapiens
  Heavy chain CDR3 for antibody 10629 (IGHV3-33)
AREGYDILTGYYNVKFDY

SEQ ID NO: 21259 - protein, 9 aa, Homo sapiens
  Light chain CDR3 for antibody 10630 (IGKV1-9)
QQLNTYPWT

SEQ ID NO: 21260 - protein, 13 aa, Homo sapiens
  Heavy chain CDR3 for antibody 10630 (IGHV3-33)
ARGVLWFGELFDY

SEQ ID NO: 21261 - protein, 10 aa, Homo sapiens
  Light chain CDR3 for antibody 10631 (IGKV3-20)
QQYGRSPPVT

SEQ ID NO: 21262 - protein, 9 aa, Homo sapiens
  Heavy chain CDR3 for antibody 10631 (IGHV3-30)
ARPKWGFDY

SEQ ID NO: 21263 - protein, 10 aa, Homo sapiens
  Light chain CDR3 for antibody 10632 (IGKV1-39)
QQSYSTPMYT

SEQ ID NO: 21264 - protein, 12 aa, Homo sapiens
  Heavy chain CDR3 for antibody 10632 (IGHV3-33)
AREDYYYYGMDV

SEQ ID NO: 21265 - protein, 10 aa, Homo sapiens
  Light chain CDR3 for antibody 10633 (IGKV3-11)
QQRSNWPMYT

SEQ ID NO: 21266 - protein, 18 aa, Homo sapiens
  Heavy chain CDR3 for antibody 10633 (IGHV3-33)
AGGGSGSYSSYYYYGMDV

SEQ ID NO: 21267 - protein, 8 aa, Homo sapiens
  Light chain CDR3 for antibody 10634 (IGKV3-20)
QQYGSSFT

SEQ ID NO: 21268 - protein, 13 aa, Homo sapiens
  Heavy chain CDR3 for antibody 10634 (IGHV3-33)
ARTDYYYYYGMDV

SEQ ID NO: 21269 - protein, 10 aa, Homo sapiens
  Light chain CDR3 for antibody 10635 (IGKV1-17)
LQHNSYPMYT

SEQ ID NO: 21270 - protein, 11 aa, Homo sapiens
  Heavy chain CDR3 for antibody 10635 (IGHV4-59)
ARSLRYSFFDY

SEQ ID NO: 21271 - protein, 9 aa, Homo sapiens
  Light chain CDR3 for antibody 10636 (IGKV3D-7)
QQDYNLPLT

SEQ ID NO: 21272 - protein, 9 aa, Homo sapiens
  Heavy chain CDR3 for antibody 10636 (IGHV3-23)
ARIWWLKDY

SEQ ID NO: 21273 - protein, 9 aa, Homo sapiens
  Light chain CDR3 for antibody 10637 (IGKV1-17)
QQLISYPPT

SEQ ID NO: 21274 - protein, 15 aa, Homo sapiens
  Heavy chain CDR3 for antibody 10637 (IGHV3-33)
ARERYSSAWSSGMDV

SEQ ID NO: 21275 - protein, 9 aa, Homo sapiens
  Light chain CDR3 for antibody 10638 (IGKV1-9)
QQLNTYPWT

SEQ ID NO: 21276 - protein, 17 aa, Homo sapiens
  Heavy chain CDR3 for antibody 10638 (IGHV3-33)
ARGGGYENDHYYYGMDV

SEQ ID NO: 21277 - protein, 9 aa, Homo sapiens
  Light chain CDR3 for antibody 10639 (IGKV6-21)
HQSSSLPYT

SEQ ID NO: 21278 - protein, 16 aa, Homo sapiens
  Heavy chain CDR3 for antibody 10639 (IGHV3-33)
ARAPGGDYYFYFGMDV

SEQ ID NO: 21279 - protein, 9 aa, Homo sapiens
  Light chain CDR3 for antibody 10640 (IGKV1-39)
QQSYSTPWT

SEQ ID NO: 21280 - protein, 17 aa, Homo sapiens
  Heavy chain CDR3 for antibody 10640 (IGHV4-59)
AREEDYYGSGSFGTFDI

SEQ ID NO: 21281 - protein, 9 aa, Homo sapiens
  Light chain CDR3 for antibody 10641 (IGKV1-6)
LQDYNYPPT

SEQ ID NO: 21282 - protein, 15 aa, Homo sapiens
  Heavy chain CDR3 for antibody 10641 (IGHV4-34)
ARVLRYFDWLGGMDV

SEQ ID NO: 21283 - protein, 9 aa, Homo sapiens
  Light chain CDR3 for antibody 10642 (IGKV3-20)
QQYGTSPFP

SEQ ID NO: 21284 - protein, 13 aa, Homo sapiens
  Heavy chain CDR3 for antibody 10642 (IGHV4-39)
ARRDVLAPAAFDY

SEQ ID NO: 21285 - protein, 9 aa, Homo sapiens
  Light chain CDR3 for antibody 10643 (IGKV6-21)
HQSTSLPFT

SEQ ID NO: 21286 - protein, 13 aa, Homo sapiens
  Heavy chain CDR3 for antibody 10643 (IGHV3-11)
ARDGGAAAGTWDS

SEQ ID NO: 21287 - protein, 9 aa, Homo sapiens
  Light chain CDR3 for antibody 10644 (IGKV1-17)
LQHNSYPYT

SEQ ID NO: 21288 - protein, 14 aa, Homo sapiens
  Heavy chain CDR3 for antibody 10644 (IGHV4-39)
ARQGDILTGYSFDN

SEQ ID NO: 21289 - protein, 9 aa, Homo sapiens
  Light chain CDR3 for antibody 10645 (IGKV1D-16)
QQYITYPYT

SEQ ID NO: 21290 - protein, 18 aa, Homo sapiens
  Heavy chain CDR3 for antibody 10645 (IGHV3-33)
AREGYDILTGDYRLGFDY

SEQ ID NO: 21291 - protein, 9 aa, Homo sapiens
  Light chain CDR3 for antibody 10646 (IGKV3D-7)
QQDYEFPLT

SEQ ID NO: 21292 - protein, 12 aa, Homo sapiens
  Heavy chain CDR3 for antibody 10646 (IGHV3-13)
AREAGIPDAFDI

SEQ ID NO: 21293 - protein, 10 aa, Homo sapiens
  Light chain CDR3 for antibody 10647 (IGKV3-11)
QQRSNWPMYT

SEQ ID NO: 21294 - protein, 17 aa, Homo sapiens
  Heavy chain CDR3 for antibody 10647 (IGHV3-23)
AKYGIGELSYYYYGMDV

SEQ ID NO: 21295 - protein, 9 aa, Homo sapiens
  Light chain CDR3 for antibody 10648 (IGKV6-21)
HQSSSLPYT

SEQ ID NO: 21296 - protein, 20 aa, Homo sapiens
  Heavy chain CDR3 for antibody 10648 (IGHV4-59)
ARDRGYDILTGYYGYYGMDV

SEQ ID NO: 21297 - protein, 9 aa, Homo sapiens
  Light chain CDR3 for antibody 10649 (IGKV2D-28)
MQATQFPHT

SEQ ID NO: 21298 - protein, 12 aa, Homo sapiens
  Heavy chain CDR3 for antibody 10649 (IGHV3-33)
ARDLVGATPFDY

SEQ ID NO: 21299 - protein, 9 aa, Homo sapiens
  Light chain CDR3 for antibody 10650 (IGKV1-9)
QQLYTYPYT

SEQ ID NO: 21300 - protein, 18 aa, Homo sapiens
  Heavy chain CDR3 for antibody 10650 (IGHV3-33)
ARDGYSGYDYYYYYGMDV

SEQ ID NO: 21301 - protein, 9 aa, Homo sapiens
  Light chain CDR3 for antibody 10651 (IGKV3D-7)
QQDYSFPLT

SEQ ID NO: 21302 - protein, 17 aa, Homo sapiens
  Heavy chain CDR3 for antibody 10651 (IGHV3-23)
AKDGIGELSYYYYGMDV

SEQ ID NO: 21303 - protein, 9 aa, Homo sapiens
  Light chain CDR3 for antibody 10652 (IGKV3-15)
QQYNNWPLT

SEQ ID NO: 21304 - protein, 16 aa, Homo sapiens
  Heavy chain CDR3 for antibody 10652 (IGHV4-59)
ARQLLWFGELKGVFDY

SEQ ID NO: 21305 - protein, 9 aa, Homo sapiens
  Light chain CDR3 for antibody 10653 (IGKV1-9)
QQGNTYSRT

SEQ ID NO: 21306 - protein, 23 aa, Homo sapiens
  Heavy chain CDR3 for antibody 10653 (IGHV4-59)
ARERTYSDILPGYYEDYYYGMDV

SEQ ID NO: 21307 - protein, 10 aa, Homo sapiens
  Light chain CDR3 for antibody 10654 (IGKV3-11)
QQRSNWPILT

SEQ ID NO: 21308 - protein, 13 aa, Homo sapiens
  Heavy chain CDR3 for antibody 10654 (IGHV4-39)
ARRDVLAPAAFDY

SEQ ID NO: 21309 - protein, 10 aa, Homo sapiens
  Light chain CDR3 for antibody 10655 (IGKV1-39)
QQSYSTPMYT

SEQ ID NO: 21310 - protein, 11 aa, Homo sapiens
  Heavy chain CDR3 for antibody 10655 (IGHV3-33)
ARDILTGFLDH

SEQ ID NO: 21311 - protein, 9 aa, Homo sapiens
  Light chain CDR3 for antibody 10656 (IGKV3-11)
QQRSSWPPT

SEQ ID NO: 21312 - protein, 18 aa, Homo sapiens
  Heavy chain CDR3 for antibody 10656 (IGHV3-53)
AREGHYYTSGSYYKAFDY

SEQ ID NO: 21313 - protein, 9 aa, Homo sapiens
  Light chain CDR3 for antibody 10657 (IGKV1-9)
QQLISYPLT

SEQ ID NO: 21314 - protein, 18 aa, Homo sapiens
  Heavy chain CDR3 for antibody 10657 (IGHV3-33)
ARREGITMIFYYYYGMDV

SEQ ID NO: 21315 - protein, 10 aa, Homo sapiens
  Light chain CDR3 for antibody 10658 (IGKV1-17)
LQHNSYPMYT

SEQ ID NO: 21316 - protein, 19 aa, Homo sapiens
  Heavy chain CDR3 for antibody 10658 (IGHV3-33)
ARDSGYSGYDYYYYYGMDV

SEQ ID NO: 21317 - protein, 10 aa, Homo sapiens
  Light chain CDR3 for antibody 10659 (IGKV3-11)
QQRSNWPMYT

SEQ ID NO: 21318 - protein, 14 aa, Homo sapiens
  Heavy chain CDR3 for antibody 10659 (IGHV1-46)
ARAYYAFLTGAFDI

SEQ ID NO: 21319 - protein, 10 aa, Homo sapiens
  Light chain CDR3 for antibody 10660 (IGKV1-17)
LQHNSYPMYT

SEQ ID NO: 21320 - protein, 15 aa, Homo sapiens
  Heavy chain CDR3 for antibody 10660 (IGHV3-33)
ARGGTGYYSYWYFDL

SEQ ID NO: 21321 - protein, 9 aa, Homo sapiens
  Light chain CDR3 for antibody 10661 (IGKV1-17)
LQHNSYPYT

SEQ ID NO: 21322 - protein, 14 aa, Homo sapiens
  Heavy chain CDR3 for antibody 10661 (IGHV3-64)
ARGGGAVTGANFDY

SEQ ID NO: 21323 - protein, 9 aa, Homo sapiens
  Light chain CDR3 for antibody 10662 (IGKV3-11)
QQRSSWPPT

SEQ ID NO: 21324 - protein, 11 aa, Homo sapiens
  Heavy chain CDR3 for antibody 10662 (IGHV3-74)
ARDRGNWGFDY

SEQ ID NO: 21325 - protein, 11 aa, Homo sapiens
  Light chain CDR3 for antibody 10663 (IGKV3-11)
QQRSNWPPTWT

SEQ ID NO: 21326 - protein, 13 aa, Homo sapiens
  Heavy chain CDR3 for antibody 10663 (IGHV3-33)
AREYCSGGSCYDY

SEQ ID NO: 21327 - protein, 10 aa, Homo sapiens
  Light chain CDR3 for antibody 10664 (IGKV3-11)
QQRSNWPTWT

SEQ ID NO: 21328 - protein, 14 aa, Homo sapiens
  Heavy chain CDR3 for antibody 10664 (IGHV3-23)
AKSRIVGALYYFDY

SEQ ID NO: 21329 - protein, 9 aa, Homo sapiens
  Light chain CDR3 for antibody 10665 (IGKV1-39)
QQSFSTPWT

SEQ ID NO: 21330 - protein, 11 aa, Homo sapiens
  Heavy chain CDR3 for antibody 10665 (IGHV4-59)
TRDRGLGSFDY

SEQ ID NO: 21331 - protein, 8 aa, Homo sapiens
  Light chain CDR3 for antibody 10666 (IGKV3-11)
QQRGNWPS

SEQ ID NO: 21332 - protein, 14 aa, Homo sapiens
  Heavy chain CDR3 for antibody 10666 (IGHV3-33)
ARDGAAAALDAFDI

SEQ ID NO: 21333 - protein, 9 aa, Homo sapiens
  Light chain CDR3 for antibody 10667 (IGKV1-6)
QQSYSTPFT

SEQ ID NO: 21334 - protein, 11 aa, Homo sapiens
  Heavy chain CDR3 for antibody 10667 (IGHV3-33)
ARDRVLAPFDY

SEQ ID NO: 21335 - protein, 10 aa, Homo sapiens
  Light chain CDR3 for antibody 10668 (IGKV3-11)
QQRSNWPPWT

SEQ ID NO: 21336 - protein, 18 aa, Homo sapiens
  Heavy chain CDR3 for antibody 10668 (IGHV4-39)
ARQYYFGSGNYYRGWFDP

SEQ ID NO: 21337 - protein, 11 aa, Homo sapiens
  Light chain CDR3 for antibody 10669 (IGKV3-11)
QQRSNWPPTWT

SEQ ID NO: 21338 - protein, 12 aa, Homo sapiens
  Heavy chain CDR3 for antibody 10669 (IGHV4-39)
ARHPRYLDAFDI

SEQ ID NO: 21339 - protein, 9 aa, Homo sapiens
  Light chain CDR3 for antibody 10670 (IGKV1-27)
QKYNSAPYT

SEQ ID NO: 21340 - protein, 14 aa, Homo sapiens
  Heavy chain CDR3 for antibody 10670 (IGHV4-59)
AKGGSGSYYNWFDP

SEQ ID NO: 21341 - protein, 9 aa, Homo sapiens
  Light chain CDR3 for antibody 10671 (IGKV4-1)
QQYYSTPYT

SEQ ID NO: 21342 - protein, 16 aa, Homo sapiens
  Heavy chain CDR3 for antibody 10671 (IGHV3-33)
ARAVYYGSGSSLIMDV

SEQ ID NO: 21343 - protein, 8 aa, Homo sapiens
  Light chain CDR3 for antibody 10672 (IGKV3D-7)
QQDYNLLT

SEQ ID NO: 21344 - protein, 13 aa, Homo sapiens
  Heavy chain CDR3 for antibody 10672 (IGHV3-23)
ARGELLWFGEFAC

SEQ ID NO: 21345 - protein, 9 aa, Homo sapiens
  Light chain CDR3 for antibody 10673 (IGKV1-6)
LQDYKSPFT

SEQ ID NO: 21346 - protein, 12 aa, Homo sapiens
  Heavy chain CDR3 for antibody 10673 (IGHV3-33)
ARAGMGAPYFDY

SEQ ID NO: 21347 - protein, 10 aa, Homo sapiens
  Light chain CDR3 for antibody 10674 (IGKV1-39)
QQSYSTPMYT

SEQ ID NO: 21348 - protein, 18 aa, Homo sapiens
  Heavy chain CDR3 for antibody 10674 (IGHV3-23)
ARYHLYFGSGFGSDGMDV

SEQ ID NO: 21349 - protein, 9 aa, Homo sapiens
  Light chain CDR3 for antibody 10675 (IGKV1-39)
QQSYSTPIT

SEQ ID NO: 21350 - protein, 13 aa, Homo sapiens
  Heavy chain CDR3 for antibody 10675 (IGHV1-46)
AKDGVRGSCGMDV

SEQ ID NO: 21351 - protein, 9 aa, Homo sapiens
  Light chain CDR3 for antibody 10676 (IGKV3D-20)
QQYGYSPRT

SEQ ID NO: 21352 - protein, 14 aa, Homo sapiens
  Heavy chain CDR3 for antibody 10676 (IGHV3-33)
ARDKTYPLSYGMDV

SEQ ID NO: 21353 - protein, 9 aa, Homo sapiens
  Light chain CDR3 for antibody 10677 (IGKV1D-13)
QQFNNYPYT

SEQ ID NO: 21354 - protein, 11 aa, Homo sapiens
  Heavy chain CDR3 for antibody 10677 (IGHV3-33)
ASWDILTGSGY

SEQ ID NO: 21355 - protein, 9 aa, Homo sapiens
  Light chain CDR3 for antibody 10678 (IGKV1-17)
LQHNSYPPT

SEQ ID NO: 21356 - protein, 10 aa, Homo sapiens
  Heavy chain CDR3 for antibody 10678 (IGHV3-33)
ARDHGWCFDY

SEQ ID NO: 21357 - protein, 9 aa, Homo sapiens
  Light chain CDR3 for antibody 10679 (IGKV1-17)
LQHNSYPIT

SEQ ID NO: 21358 - protein, 12 aa, Homo sapiens
  Heavy chain CDR3 for antibody 10679 (IGHV3-23)
AKEGLGSDYDPY

SEQ ID NO: 21359 - protein, 9 aa, Homo sapiens
  Light chain CDR3 for antibody 10680 (IGKV1-9)
QQLISYPLT

SEQ ID NO: 21360 - protein, 12 aa, Homo sapiens
  Heavy chain CDR3 for antibody 10680 (IGHV3-33)
ARDLVGATPFDY

SEQ ID NO: 21361 - protein, 10 aa, Homo sapiens
  Light chain CDR3 for antibody 10681 (IGKV3-11)
QQRSTWPTLI

SEQ ID NO: 21362 - protein, 17 aa, Homo sapiens
  Heavy chain CDR3 for antibody 10681 (IGHV3-33)
ARGYCSRTSCYLYYFDY

SEQ ID NO: 21363 - protein, 9 aa, Homo sapiens
  Light chain CDR3 for antibody 10682 (IGKV1-33)
QQYDNLPFT

SEQ ID NO: 21364 - protein, 18 aa, Homo sapiens
  Heavy chain CDR3 for antibody 10682 (IGHV3-33)
VRDRERYGSGSYPDAFDI

SEQ ID NO: 21365 - protein, 10 aa, Homo sapiens
  Light chain CDR3 for antibody 10683 (IGKV3-15)
QQYNNWPPYT

SEQ ID NO: 21366 - protein, 14 aa, Homo sapiens
  Heavy chain CDR3 for antibody 10683 (IGHV3-23)
AKDRYRGYEGLFDY

SEQ ID NO: 21367 - protein, 9 aa, Homo sapiens
  Light chain CDR3 for antibody 10684 (IGKV1-9)
QQLISYPYT

SEQ ID NO: 21368 - protein, 11 aa, Homo sapiens
  Heavy chain CDR3 for antibody 10684 (IGHV3-33)
ARGTTVAHFDY

SEQ ID NO: 21369 - protein, 11 aa, Homo sapiens
  Light chain CDR3 for antibody 10685 (IGKV3-11)
QQRSNWPPTWT

SEQ ID NO: 21370 - protein, 17 aa, Homo sapiens
  Heavy chain CDR3 for antibody 10685 (IGHV3-33)
ARGGAAAGPYLYYGLDV

SEQ ID NO: 21371 - protein, 9 aa, Homo sapiens
  Light chain CDR3 for antibody 10686 (IGKV1-9)
QQLISYPLT

SEQ ID NO: 21372 - protein, 12 aa, Homo sapiens
  Heavy chain CDR3 for antibody 10686 (IGHV3-33)
AREGIAVAGVDP

SEQ ID NO: 21373 - protein, 9 aa, Homo sapiens
  Light chain CDR3 for antibody 10687 (IGKV1-6)
LQDYKSPFT

SEQ ID NO: 21374 - protein, 10 aa, Homo sapiens
  Heavy chain CDR3 for antibody 10687 (IGHV3-33)
ARVVDTAMAY

SEQ ID NO: 21375 - protein, 9 aa, Homo sapiens
  Light chain CDR3 for antibody 10688 (IGKV1D-13)
QQFNNYPYT

SEQ ID NO: 21376 - protein, 20 aa, Homo sapiens
  Heavy chain CDR3 for antibody 10688 (IGHV3-33)
ARAGDIAVAGTHYYYYGMDV

SEQ ID NO: 21377 - protein, 9 aa, Homo sapiens
  Light chain CDR3 for antibody 10689 (IGKV1-6)
LQDYNYPRT

SEQ ID NO: 21378 - protein, 15 aa, Homo sapiens
  Heavy chain CDR3 for antibody 10689 (IGHV4-59)
ARDGHGNWGSGTFDY

SEQ ID NO: 21379 - protein, 8 aa, Homo sapiens
  Light chain CDR3 for antibody 10690 (IGKV1-5)
QQYNSYWT

SEQ ID NO: 21380 - protein, 12 aa, Homo sapiens
  Heavy chain CDR3 for antibody 10690 (IGHV3-33)
AKEGLGNDYEPY

SEQ ID NO: 21381 - protein, 9 aa, Homo sapiens
  Light chain CDR3 for antibody 10691 (IGKV1D-16)
QQYNSYPYT

SEQ ID NO: 21382 - protein, 15 aa, Homo sapiens
  Heavy chain CDR3 for antibody 10691 (IGHV3-20)
ARDRGSSGWYDAFDI

SEQ ID NO: 21383 - protein, 10 aa, Homo sapiens
  Light chain CDR3 for antibody 10692 (IGKV3-11)
QQRSNWPIFT

SEQ ID NO: 21384 - protein, 13 aa, Homo sapiens
  Heavy chain CDR3 for antibody 10692 (IGHV4-59)
ANRDYYGYYGMDV

SEQ ID NO: 21385 - protein, 9 aa, Homo sapiens
  Light chain CDR3 for antibody 10693 (IGKV1-6)
LQDYNYPYT

SEQ ID NO: 21386 - protein, 15 aa, Homo sapiens
  Heavy chain CDR3 for antibody 10693 (IGHV3-33)
ARDGGPDGDYKAFDI

SEQ ID NO: 21387 - protein, 9 aa, Homo sapiens
  Light chain CDR3 for antibody 10694 (IGKV1D-16)
QQYNSYPRT

SEQ ID NO: 21388 - protein, 11 aa, Homo sapiens
  Heavy chain CDR3 for antibody 10694 (IGHV3-33)
ATERDMVRGDY

SEQ ID NO: 21389 - protein, 9 aa, Homo sapiens
  Light chain CDR3 for antibody 10695 (IGKV1-6)
LQVYSYPWT

SEQ ID NO: 21390 - protein, 14 aa, Homo sapiens
  Heavy chain CDR3 for antibody 10695 (IGHV3-33)
ARQYSYGYPYYFDY

SEQ ID NO: 21391 - protein, 9 aa, Homo sapiens
  Light chain CDR3 for antibody 10696 (IGKV1-39)
QQSYRTPLT

SEQ ID NO: 21392 - protein, 16 aa, Homo sapiens
  Heavy chain CDR3 for antibody 10696 (IGHV3-11)
ARDGGAAAGNFYGLDV

SEQ ID NO: 21393 - protein, 9 aa, Homo sapiens
  Light chain CDR3 for antibody 10697 (IGKV2-30)
MQGTHWPLT

SEQ ID NO: 21394 - protein, 16 aa, Homo sapiens
  Heavy chain CDR3 for antibody 10697 (IGHV3-11)
ARGRYFDWLLGDWFDP

SEQ ID NO: 21395 - protein, 9 aa, Homo sapiens
  Light chain CDR3 for antibody 10698 (IGKV1-17)
LQHNSYPYT

SEQ ID NO: 21396 - protein, 15 aa, Homo sapiens
  Heavy chain CDR3 for antibody 10698 (IGHV3-30)
ARRGYGSGSPDACDL

SEQ ID NO: 21397 - protein, 9 aa, Homo sapiens
  Light chain CDR3 for antibody 10699 (IGKV2-30)
MQGTHWPLT

SEQ ID NO: 21398 - protein, 12 aa, Homo sapiens
  Heavy chain CDR3 for antibody 10699 (IGHV3-33)
ARGGIAVDVCDI

SEQ ID NO: 21399 - protein, 9 aa, Homo sapiens
  Light chain CDR3 for antibody 10700 (IGKV6-21)
HQSSSLPYT

SEQ ID NO: 21400 - protein, 13 aa, Homo sapiens
  Heavy chain CDR3 for antibody 10700 (IGHV4-61)
ASRYSSGRYPFDY

SEQ ID NO: 21401 - protein, 9 aa, Homo sapiens
  Light chain CDR3 for antibody 10701 (IGKV3-11)
QQRSNWMYT

SEQ ID NO: 21402 - protein, 16 aa, Homo sapiens
  Heavy chain CDR3 for antibody 10701 (IGHV3-64)
ARGRYFDWLLGDWFDP

SEQ ID NO: 21403 - protein, 10 aa, Homo sapiens
  Light chain CDR3 for antibody 10702 (IGKV3-11)
QQRSNWLMYT

SEQ ID NO: 21404 - protein, 14 aa, Homo sapiens
  Heavy chain CDR3 for antibody 10702 (IGHV3-33)
ARASSGSSYWYFDL

SEQ ID NO: 21405 - protein, 8 aa, Homo sapiens
  Light chain CDR3 for antibody 10703 (IGKV1-17)
QQYNSYYT

SEQ ID NO: 21406 - protein, 9 aa, Homo sapiens
  Heavy chain CDR3 for antibody 10703 (IGHV1-18)
ARGGWGFEY

SEQ ID NO: 21407 - protein, 9 aa, Homo sapiens
  Light chain CDR3 for antibody 10704 (IGKV3-20)
QQYGSSPYT

SEQ ID NO: 21408 - protein, 14 aa, Homo sapiens
  Heavy chain CDR3 for antibody 10704 (IGHV3-23)
AKDRNIPAAGPFDY

SEQ ID NO: 21409 - protein, 9 aa, Homo sapiens
  Light chain CDR3 for antibody 10705 (IGKV1-6)
LQDYNYPHT

SEQ ID NO: 21410 - protein, 14 aa, Homo sapiens
  Heavy chain CDR3 for antibody 10705 (IGHV3-23)
AKGDAAMASYYFDY

SEQ ID NO: 21411 - protein, 9 aa, Homo sapiens
  Light chain CDR3 for antibody 10706 (IGKV3-20)
QQFGRSPRT

SEQ ID NO: 21412 - protein, 13 aa, Homo sapiens
  Heavy chain CDR3 for antibody 10706 (IGHV1-24)
ARDAGYSSSWFDY

SEQ ID NO: 21413 - protein, 8 aa, Homo sapiens
  Light chain CDR3 for antibody 10707 (IGKV6-21)
HQSSSLPT

SEQ ID NO: 21414 - protein, 14 aa, Homo sapiens
  Heavy chain CDR3 for antibody 10707 (IGHV3-33)
ARDRRDFYYYGMDV

SEQ ID NO: 21415 - protein, 8 aa, Homo sapiens
  Light chain CDR3 for antibody 10708 (IGKV1-5)
QQYNSYYT

SEQ ID NO: 21416 - protein, 13 aa, Homo sapiens
  Heavy chain CDR3 for antibody 10708 (IGHV3-23)
AKDRGLRYYGMDV

SEQ ID NO: 21417 - protein, 10 aa, Homo sapiens
  Light chain CDR3 for antibody 10709 (IGKV1-17)
LQHNSYPMYT

SEQ ID NO: 21418 - protein, 13 aa, Homo sapiens
  Heavy chain CDR3 for antibody 10709 (IGHV4-39)
ARQWPSGYWYFDL

SEQ ID NO: 21419 - protein, 9 aa, Homo sapiens
  Light chain CDR3 for antibody 10710 (IGKV2-30)
MQGTHWPYT

SEQ ID NO: 21420 - protein, 11 aa, Homo sapiens
  Heavy chain CDR3 for antibody 10710 (IGHV4-59)
ARDRGHYGMDV

SEQ ID NO: 21421 - protein, 9 aa, Homo sapiens
  Light chain CDR3 for antibody 10711 (IGKV6-21)
HQSSSLPLT

SEQ ID NO: 21422 - protein, 17 aa, Homo sapiens
  Heavy chain CDR3 for antibody 10711 (IGHV3-23)
AREGYYDILTDYYGMDV

SEQ ID NO: 21423 - protein, 9 aa, Homo sapiens
  Light chain CDR3 for antibody 10712 (IGKV1-6)
LQDYSYPFT

SEQ ID NO: 21424 - protein, 15 aa, Homo sapiens
  Heavy chain CDR3 for antibody 10712 (IGHV3-33)
ARGAMVRGVDYGMDV

SEQ ID NO: 21425 - protein, 9 aa, Homo sapiens
  Light chain CDR3 for antibody 10713 (IGKV1-6)
LQDYKSQFT

SEQ ID NO: 21426 - protein, 14 aa, Homo sapiens
  Heavy chain CDR3 for antibody 10713 (IGHV3-33)
AKKGYSGRYYYFDY

SEQ ID NO: 21427 - protein, 10 aa, Homo sapiens
  Light chain CDR3 for antibody 10714 (IGKV3-20)
QQYGRSPPVT

SEQ ID NO: 21428 - protein, 10 aa, Homo sapiens
  Heavy chain CDR3 for antibody 10714 (IGHV3-23)
AKGDRWRFDP

SEQ ID NO: 21429 - protein, 9 aa, Homo sapiens
  Light chain CDR3 for antibody 10715 (IGKV1D-16)
QQFNNYMYT

SEQ ID NO: 21430 - protein, 12 aa, Homo sapiens
  Heavy chain CDR3 for antibody 10715 (IGHV3-33)
ASGYFGSGSAHY

SEQ ID NO: 21431 - protein, 9 aa, Homo sapiens
  Light chain CDR3 for antibody 10716 (IGKV1D-16)
QQYDSLPFT

SEQ ID NO: 21432 - protein, 12 aa, Homo sapiens
  Heavy chain CDR3 for antibody 10716 (IGHV3-33)
AKDPGWQQLAEY

SEQ ID NO: 21433 - protein, 9 aa, Homo sapiens
  Light chain CDR3 for antibody 10717 (IGKV1-9)
QQGNTYSRT

SEQ ID NO: 21434 - protein, 18 aa, Homo sapiens
  Heavy chain CDR3 for antibody 10717 (IGHV4-39)
ARQYYFGSGNYYRGWFDP

SEQ ID NO: 21435 - protein, 9 aa, Homo sapiens
  Light chain CDR3 for antibody 10718 (IGKV1-27)
QKYNSAPYT

SEQ ID NO: 21436 - protein, 15 aa, Homo sapiens
  Heavy chain CDR3 for antibody 10718 (IGHV3-23)
AKDGFYYGSGSSFDH

SEQ ID NO: 21437 - protein, 9 aa, Homo sapiens
  Light chain CDR3 for antibody 10719 (IGKV3D-7)
QQDYNLPWT

SEQ ID NO: 21438 - protein, 12 aa, Homo sapiens
  Heavy chain CDR3 for antibody 10719 (IGHV3-23)
AKEGLGNDYDPY

SEQ ID NO: 21439 - protein, 9 aa, Homo sapiens
  Light chain CDR3 for antibody 10720 (IGKV1-39)
QQSYSTPLT

SEQ ID NO: 21440 - protein, 16 aa, Homo sapiens
  Heavy chain CDR3 for antibody 10720 (IGHV4-59)
ARQLLWFGELKGVFDY

SEQ ID NO: 21441 - protein, 9 aa, Homo sapiens
  Light chain CDR3 for antibody 10721 (IGKV3-20)
QQYGSSIFT

SEQ ID NO: 21442 - protein, 14 aa, Homo sapiens
  Heavy chain CDR3 for antibody 10721 (IGHV3-33)
ARDKTYPLSYGMDV

SEQ ID NO: 21443 - protein, 10 aa, Homo sapiens
  Light chain CDR3 for antibody 10722 (IGKV1-9)
QQLDSYPMYT

SEQ ID NO: 21444 - protein, 14 aa, Homo sapiens
  Heavy chain CDR3 for antibody 10722 (IGHV3-33)
ARAGSGYDRDWFDP

SEQ ID NO: 21445 - protein, 9 aa, Homo sapiens
  Light chain CDR3 for antibody 10723 (IGKV3D-7)
QQYYNLPFT

SEQ ID NO: 21446 - protein, 14 aa, Homo sapiens
  Heavy chain CDR3 for antibody 10723 (IGHV3-15)
SIYFYGSGRDYFDY

SEQ ID NO: 21447 - protein, 9 aa, Homo sapiens
  Light chain CDR3 for antibody 10724 (IGKV1-9)
QQLISYPYT

SEQ ID NO: 21448 - protein, 18 aa, Homo sapiens
  Heavy chain CDR3 for antibody 10724 (IGHV3-33)
AREAIVVVPAAPYYGMDV

SEQ ID NO: 21449 - protein, 8 aa, Homo sapiens
  Light chain CDR3 for antibody 10725 (IGKV1-5)
QQYNSYYT

SEQ ID NO: 21450 - protein, 18 aa, Homo sapiens
  Heavy chain CDR3 for antibody 10725 (IGHV3-23)
AKVGDFFASGNYWDYFDY

SEQ ID NO: 21451 - protein, 9 aa, Homo sapiens
  Light chain CDR3 for antibody 10726 (IGKV1-17)
QQLKSYLYT

SEQ ID NO: 21452 - protein, 18 aa, Homo sapiens
  Heavy chain CDR3 for antibody 10726 (IGHV1-8)
AREGAAAGSYYYYNGMDV

SEQ ID NO: 21453 - protein, 9 aa, Homo sapiens
  Light chain CDR3 for antibody 10727 (IGKV1-39)
QQSYSTPYT

SEQ ID NO: 21454 - protein, 18 aa, Homo sapiens
  Heavy chain CDR3 for antibody 10727 (IGHV3-33)
AREGYDILTGYYNVKFDY

SEQ ID NO: 21455 - protein, 8 aa, Homo sapiens
  Light chain CDR3 for antibody 10728 (IGKV3D-7)
QQDYNLLT

SEQ ID NO: 21456 - protein, 14 aa, Homo sapiens
  Heavy chain CDR3 for antibody 10728 (IGHV3-15)
SIYYYGSGRDFFDY

SEQ ID NO: 21457 - protein, 9 aa, Homo sapiens
  Light chain CDR3 for antibody 10729 (IGKV1-17)
LQHTSYPFT

SEQ ID NO: 21458 - protein, 14 aa, Homo sapiens
  Heavy chain CDR3 for antibody 10729 (IGHV1-46)
ARKGIVGGFDAFDV

SEQ ID NO: 21459 - protein, 8 aa, Homo sapiens
  Light chain CDR3 for antibody 10730 (IGKV3-11)
LQRGNWPT

SEQ ID NO: 21460 - protein, 15 aa, Homo sapiens
  Heavy chain CDR3 for antibody 10730 (IGHV3-23)
AKEALRYFDWSGMDV

SEQ ID NO: 21461 - protein, 9 aa, Homo sapiens
  Light chain CDR3 for antibody 10731 (IGKV1-6)
LQDYNYPRT

SEQ ID NO: 21462 - protein, 11 aa, Homo sapiens
  Heavy chain CDR3 for antibody 10731 (IGHV3-33)
ARDSGYDPLYY

SEQ ID NO: 21463 - protein, 9 aa, Homo sapiens
  Light chain CDR3 for antibody 10732 (IGKV2-30)
MQGTHWPLT

SEQ ID NO: 21464 - protein, 19 aa, Homo sapiens
  Heavy chain CDR3 for antibody 10732 (IGHV3-33)
ARRRDDILTGWDYYFGMDV

SEQ ID NO: 21465 - protein, 9 aa, Homo sapiens
  Light chain CDR3 for antibody 10733 (IGKV6-21)
HQSSSLPYT

SEQ ID NO: 21466 - protein, 12 aa, Homo sapiens
  Heavy chain CDR3 for antibody 10733 (IGHV3-33)
VRKGYALYGLDV

SEQ ID NO: 21467 - protein, 9 aa, Homo sapiens
  Light chain CDR3 for antibody 10734 (IGKV1D-16)
QRYNSYPLT

SEQ ID NO: 21468 - protein, 18 aa, Homo sapiens
  Heavy chain CDR3 for antibody 10734 (IGHV3-33)
ARGYNQGSGSYYNVCFDY

SEQ ID NO: 21469 - protein, 9 aa, Homo sapiens
  Light chain CDR3 for antibody 10735 (IGKV1-17)
QQYNSYPYT

SEQ ID NO: 21470 - protein, 17 aa, Homo sapiens
  Heavy chain CDR3 for antibody 10735 (IGHV3-33)
ARDPARGIVRSFYGMDV

SEQ ID NO: 21471 - protein, 9 aa, Homo sapiens
  Light chain CDR3 for antibody 10736 (IGKV1-5)
QQYNTYSRT

SEQ ID NO: 21472 - protein, 14 aa, Homo sapiens
  Heavy chain CDR3 for antibody 10736 (IGHV3-74)
ARDGYDFLTGPFDY

SEQ ID NO: 21473 - protein, 10 aa, Homo sapiens
  Light chain CDR3 for antibody 10737 (IGKV1-9)
QQLDSYPMYT

SEQ ID NO: 21474 - protein, 18 aa, Homo sapiens
  Heavy chain CDR3 for antibody 10737 (IGHV3-33)
ARREGITTIFYYYYGMDV

SEQ ID NO: 21475 - protein, 9 aa, Homo sapiens
  Light chain CDR3 for antibody 10738 (IGKV1-16)
QQYNSYPIT

SEQ ID NO: 21476 - protein, 13 aa, Homo sapiens
  Heavy chain CDR3 for antibody 10738 (IGHV3-33)
ARRVAVAGAEGDY

SEQ ID NO: 21477 - protein, 8 aa, Homo sapiens
  Light chain CDR3 for antibody 10739 (IGKV1D-13)
QQFNNYPT

SEQ ID NO: 21478 - protein, 19 aa, Homo sapiens
  Heavy chain CDR3 for antibody 10739 (IGHV3-33)
TRDPHYDILTGYAYYGMDV

SEQ ID NO: 21479 - protein, 9 aa, Homo sapiens
  Light chain CDR3 for antibody 10740 (IGKV1-9)
QQLKSYLYT

SEQ ID NO: 21480 - protein, 18 aa, Homo sapiens
  Heavy chain CDR3 for antibody 10740 (IGHV1-18)
ARDPTFYYVSGSYYKFDY

SEQ ID NO: 21481 - protein, 10 aa, Homo sapiens
  Light chain CDR3 for antibody 10741 (IGKV3-11)
QQRSNWPTWT

SEQ ID NO: 21482 - protein, 20 aa, Homo sapiens
  Heavy chain CDR3 for antibody 10741 (IGHV1-f)
ATHYDILTGSPYYYYCALDV

SEQ ID NO: 21483 - protein, 9 aa, Homo sapiens
  Light chain CDR3 for antibody 10742 (IGKV1-6)
LQDYNYPRT

SEQ ID NO: 21484 - protein, 12 aa, Homo sapiens
  Heavy chain CDR3 for antibody 10742 (IGHV3-33)
ARDGRAAAYFDN

SEQ ID NO: 21485 - protein, 9 aa, Homo sapiens
  Light chain CDR3 for antibody 10743 (IGKV3D-7)
QQDYNLPLT

SEQ ID NO: 21486 - protein, 13 aa, Homo sapiens
  Heavy chain CDR3 for antibody 10743 (IGHV4-39)
AIRGVLAPAAFDH

SEQ ID NO: 21487 - protein, 9 aa, Homo sapiens
  Light chain CDR3 for antibody 10744 (IGKV3-20)
QQYGSSPWT

SEQ ID NO: 21488 - protein, 16 aa, Homo sapiens
  Heavy chain CDR3 for antibody 10744 (IGHV4-59)
ARGRYLDWLSGDVFDI

SEQ ID NO: 21489 - protein, 10 aa, Homo sapiens
  Light chain CDR3 for antibody 10745 (IGKV3-11)
QQRSNWPMYT

SEQ ID NO: 21490 - protein, 13 aa, Homo sapiens
  Heavy chain CDR3 for antibody 10745 (IGHV3-33)
ANTGDSYYYGFYV

SEQ ID NO: 21491 - protein, 9 aa, Homo sapiens
  Light chain CDR3 for antibody 10746 (IGKV3-20)
QQYGSSPYT

SEQ ID NO: 21492 - protein, 9 aa, Homo sapiens
  Heavy chain CDR3 for antibody 10746 (IGHV3-23)
ATIAAYFDY

SEQ ID NO: 21493 - protein, 9 aa, Homo sapiens
  Light chain CDR3 for antibody 10747 (IGKV1D-16)
QQYNSYPYT

SEQ ID NO: 21494 - protein, 16 aa, Homo sapiens
  Heavy chain CDR3 for antibody 10747 (IGHV4-39)
ARHPLIWTGYPNWFDP

SEQ ID NO: 21495 - protein, 9 aa, Homo sapiens
  Light chain CDR3 for antibody 10748 (IGKV3-15)
QQYNNWPLT

SEQ ID NO: 21496 - protein, 18 aa, Homo sapiens
  Heavy chain CDR3 for antibody 10748 (IGHV1-18)
ARDRGYYYGSGSYSPFDY

SEQ ID NO: 21497 - protein, 9 aa, Homo sapiens
  Light chain CDR3 for antibody 10749 (IGKV2D-28)
MQALQTPPT

SEQ ID NO: 21498 - protein, 18 aa, Homo sapiens
  Heavy chain CDR3 for antibody 10749 (IGHV3-33)
ARDRYYDILTGYYMGFDY

SEQ ID NO: 21499 - protein, 9 aa, Homo sapiens
  Light chain CDR3 for antibody 10750 (IGKV1-16)
QQYDSYPPT

SEQ ID NO: 21500 - protein, 13 aa, Homo sapiens
  Heavy chain CDR3 for antibody 10750 (IGHV3-23)
AKERGYSSTSTAY

SEQ ID NO: 21501 - protein, 8 aa, Homo sapiens
  Light chain CDR3 for antibody 10751 (IGKV3-11)
QQRSNWRT

SEQ ID NO: 21502 - protein, 12 aa, Homo sapiens
  Heavy chain CDR3 for antibody 10751 (IGHV3-33)
ARESGGSYSCDY

SEQ ID NO: 21503 - protein, 9 aa, Homo sapiens
  Light chain CDR3 for antibody 10752 (IGKV1-17)
LQHNGYPLT

SEQ ID NO: 21504 - protein, 18 aa, Homo sapiens
  Heavy chain CDR3 for antibody 10752 (IGHV3-23)
AKEGDYYGSGSYWGYFDP

SEQ ID NO: 21505 - protein, 9 aa, Homo sapiens
  Light chain CDR3 for antibody 10753 (IGKV1-17)
LHSNNYPWT

SEQ ID NO: 21506 - protein, 17 aa, Homo sapiens
  Heavy chain CDR3 for antibody 10753 (IGHV3-33)
ARDWFGELSDYYYGMDV

SEQ ID NO: 21507 - protein, 9 aa, Homo sapiens
  Light chain CDR3 for antibody 10754 (IGKV3-20)
QQYGRSPRT

SEQ ID NO: 21508 - protein, 13 aa, Homo sapiens
  Heavy chain CDR3 for antibody 10754 (IGHV3-11)
ARDGGAAAGTWDP

SEQ ID NO: 21509 - protein, 8 aa, Homo sapiens
  Light chain CDR3 for antibody 10755 (IGKV2D-28)
MQALQTPP

SEQ ID NO: 21510 - protein, 15 aa, Homo sapiens
  Heavy chain CDR3 for antibody 10755 (IGHV3-33)
ARRICSGGSCSLFDY

SEQ ID NO: 21511 - protein, 9 aa, Homo sapiens
  Light chain CDR3 for antibody 10756 (IGKV3D-7)
QQDYEFPIT

SEQ ID NO: 21512 - protein, 15 aa, Homo sapiens
  Heavy chain CDR3 for antibody 10756 (IGHV3-33)
ARDRGWKAPGYGMDV

SEQ ID NO: 21513 - protein, 9 aa, Homo sapiens
  Light chain CDR3 for antibody 10757 (IGKV1-39)
QQSYSTPLT

SEQ ID NO: 21514 - protein, 14 aa, Homo sapiens
  Heavy chain CDR3 for antibody 10757 (IGHV3-23)
AKEDTAMASYYFDY

SEQ ID NO: 21515 - protein, 11 aa, Homo sapiens
  Light chain CDR3 for antibody 10758 (IGKV3-11)
QQRSNWPPMYT

SEQ ID NO: 21516 - protein, 16 aa, Homo sapiens
  Heavy chain CDR3 for antibody 10758 (IGHV1-18)
ARYFDWLLRDYYGMDV

SEQ ID NO: 21517 - protein, 9 aa, Homo sapiens
  Light chain CDR3 for antibody 10759 (IGKV1-13)
LQDYNYPWT

SEQ ID NO: 21518 - protein, 15 aa, Homo sapiens
  Heavy chain CDR3 for antibody 10759 (IGHV3-23)
AKDLSSGWFAYFFDY

SEQ ID NO: 21519 - protein, 9 aa, Homo sapiens
  Light chain CDR3 for antibody 10760 (IGKV1-6)
LQDYNSPYT

SEQ ID NO: 21520 - protein, 15 aa, Homo sapiens
  Heavy chain CDR3 for antibody 10760 (IGHV3-21)
AKEALRYLDWSGMDF

SEQ ID NO: 21521 - protein, 9 aa, Homo sapiens
  Light chain CDR3 for antibody 10761 (IGKV1-33)
QQYDNLPFT

SEQ ID NO: 21522 - protein, 12 aa, Homo sapiens
  Heavy chain CDR3 for antibody 10761 (IGHV3-33)
ARKGYDMHAFDI

SEQ ID NO: 21523 - protein, 9 aa, Homo sapiens
  Light chain CDR3 for antibody 10762 (IGKV1-13)
QQVNSYPST

SEQ ID NO: 21524 - protein, 18 aa, Homo sapiens
  Heavy chain CDR3 for antibody 10762 (IGHV1-46)
ARDGDYVWGSYRSNWFDP

SEQ ID NO: 21525 - protein, 9 aa, Homo sapiens
  Light chain CDR3 for antibody 10763 (IGKV1-6)
QQYDNLPPT

SEQ ID NO: 21526 - protein, 12 aa, Homo sapiens
  Heavy chain CDR3 for antibody 10763 (IGHV1-46)
AREDYDIDGMDV

SEQ ID NO: 21527 - protein, 9 aa, Homo sapiens
  Light chain CDR3 for antibody 10764 (IGKV4-1)
QQYYSTPWT

SEQ ID NO: 21528 - protein, 13 aa, Homo sapiens
  Heavy chain CDR3 for antibody 10764 (IGHV3-11)
AREGIAVAGDFDH

SEQ ID NO: 21529 - protein, 9 aa, Homo sapiens
  Light chain CDR3 for antibody 10765 (IGKV1-9)
QQLNSYPLA

SEQ ID NO: 21530 - protein, 14 aa, Homo sapiens
  Heavy chain CDR3 for antibody 10765 (IGHV1-46)
ARKGIVGCFDAFDV

SEQ ID NO: 21531 - protein, 8 aa, Homo sapiens
  Light chain CDR3 for antibody 10766 (IGKV3D-7)
QQDYNLLT

SEQ ID NO: 21532 - protein, 17 aa, Homo sapiens
  Heavy chain CDR3 for antibody 10766 (IGHV3-15)
TTERYPRRYYYYFGMDV

SEQ ID NO: 21533 - protein, 9 aa, Homo sapiens
  Light chain CDR3 for antibody 10767 (IGKV1-9)
QQLNSYPWP

SEQ ID NO: 21534 - protein, 13 aa, Homo sapiens
  Heavy chain CDR3 for antibody 10767 (IGHV3-33)
ARDQRYSSGWYDY

SEQ ID NO: 21535 - protein, 9 aa, Homo sapiens
  Light chain CDR3 for antibody 10768 (IGKV2-30)
MQGTHWPLT

SEQ ID NO: 21536 - protein, 14 aa, Homo sapiens
  Heavy chain CDR3 for antibody 10768 (IGHV3-33)
ARWELPFYYSGMDV

SEQ ID NO: 21537 - protein, 9 aa, Homo sapiens
  Light chain CDR3 for antibody 10769 (IGKV1D-16)
QQYYSYPYT

SEQ ID NO: 21538 - protein, 21 aa, Homo sapiens
  Heavy chain CDR3 for antibody 10769 (IGHV3-33)
ARKRLYDILTGYYKAFYGMDV

SEQ ID NO: 21539 - protein, 10 aa, Homo sapiens
  Light chain CDR3 for antibody 10770 (IGKV1-39)
QQSYSTPMYT

SEQ ID NO: 21540 - protein, 14 aa, Homo sapiens
  Heavy chain CDR3 for antibody 10770 (IGHV1-2)
ARDYYGSGNYYMGY

SEQ ID NO: 21541 - protein, 10 aa, Homo sapiens
  Light chain CDR3 for antibody 10771 (IGKV3-15)
QQYNNWPPLT

SEQ ID NO: 21542 - protein, 15 aa, Homo sapiens
  Heavy chain CDR3 for antibody 10771 (IGHV3-23)
AKEFTMVRGVITPDY

SEQ ID NO: 21543 - protein, 9 aa, Homo sapiens
  Light chain CDR3 for antibody 10772 (IGKV1-39)
QQSYSTPLT

SEQ ID NO: 21544 - protein, 17 aa, Homo sapiens
  Heavy chain CDR3 for antibody 10772 (IGHV4-59)
ARDRELLWFGEFGGMDV

SEQ ID NO: 21545 - protein, 9 aa, Homo sapiens
  Light chain CDR3 for antibody 10773 (IGKV1-9)
QQLKSYLYT

SEQ ID NO: 21546 - protein, 13 aa, Homo sapiens
  Heavy chain CDR3 for antibody 10773 (IGHV3-33)
ARQSSGWFDAFDI

SEQ ID NO: 21547 - protein, 9 aa, Homo sapiens
  Light chain CDR3 for antibody 10774 (IGKV1-6)
LQDFHYPWT

SEQ ID NO: 21548 - protein, 15 aa, Homo sapiens
  Heavy chain CDR3 for antibody 10774 (IGHV3-23)
AKDLSSGWYAYFFDY

SEQ ID NO: 21549 - protein, 9 aa, Homo sapiens
  Light chain CDR3 for antibody 10775 (IGKV5-2)
LQHDNFPWR

SEQ ID NO: 21550 - protein, 17 aa, Homo sapiens
  Heavy chain CDR3 for antibody 10775 (IGHV4-34)
ARDLIGPLSSSWYPFDY

SEQ ID NO: 21551 - protein, 9 aa, Homo sapiens
  Light chain CDR3 for antibody 10776 (IGKV1-17)
LQHDSFPYT

SEQ ID NO: 21552 - protein, 12 aa, Homo sapiens
  Heavy chain CDR3 for antibody 10776 (IGHV4-39)
ARDSGSYYFFDY

SEQ ID NO: 21553 - protein, 10 aa, Homo sapiens
  Light chain CDR3 for antibody 10777 (IGKV3-11)
QQRSNWPALA

SEQ ID NO: 21554 - protein, 11 aa, Homo sapiens
  Heavy chain CDR3 for antibody 10777 (IGHV4-59)
TRDRGLGSFDY

SEQ ID NO: 21555 - protein, 9 aa, Homo sapiens
  Light chain CDR3 for antibody 10778 (IGKV1-39)
QQSYSSPFT

SEQ ID NO: 21556 - protein, 17 aa, Homo sapiens
  Heavy chain CDR3 for antibody 10778 (IGHV3-66)
ARVQYDILTGYYPYFDN

SEQ ID NO: 21557 - protein, 9 aa, Homo sapiens
  Light chain CDR3 for antibody 10779 (IGKV1-33)
QQSYSTPRT

SEQ ID NO: 21558 - protein, 14 aa, Homo sapiens
  Heavy chain CDR3 for antibody 10779 (IGHV2-70)
ARTAIAAAGSPFDP

SEQ ID NO: 21559 - protein, 10 aa, Homo sapiens
  Light chain CDR3 for antibody 10780 (IGKV3-11)
QQRSNWPALT

SEQ ID NO: 21560 - protein, 13 aa, Homo sapiens
  Heavy chain CDR3 for antibody 10780 (IGHV1-18)
ARGGGVRGAPLDY

SEQ ID NO: 21561 - protein, 9 aa, Homo sapiens
  Light chain CDR3 for antibody 10781 (IGKV5-2)
LQHDNFPWT

SEQ ID NO: 21562 - protein, 14 aa, Homo sapiens
  Heavy chain CDR3 for antibody 10781 (IGHV3-23)
AKDRNIPAAGPFDY

SEQ ID NO: 21563 - protein, 9 aa, Homo sapiens
  Light chain CDR3 for antibody 10782 (IGKV6-21)
HQSRSLPFT

SEQ ID NO: 21564 - protein, 23 aa, Homo sapiens
  Heavy chain CDR3 for antibody 10782 (IGHV4-59)
ARERTYSGILPGYYEDYYYGMDV

SEQ ID NO: 21565 - protein, 9 aa, Homo sapiens
  Light chain CDR3 for antibody 10783 (IGKV1D-13)
QRFNNYLYT

SEQ ID NO: 21566 - protein, 20 aa, Homo sapiens
  Heavy chain CDR3 for antibody 10783 (IGHV1-18)
AREVGIAVAGTLYYYYGMDV

SEQ ID NO: 21567 - protein, 8 aa, Homo sapiens
  Light chain CDR3 for antibody 10784 (IGKV3-20)
QQYGSSLT

SEQ ID NO: 21568 - protein, 13 aa, Homo sapiens
  Heavy chain CDR3 for antibody 10784 (IGHV3-33)
AKEDGDYHHYFDY

SEQ ID NO: 21569 - protein, 9 aa, Homo sapiens
  Light chain CDR3 for antibody 10785 (IGKV1-39)
QQSYSSPIT

SEQ ID NO: 21570 - protein, 17 aa, Homo sapiens
  Heavy chain CDR3 for antibody 10785 (IGHV3-33)
ARAYYDILTGYSYYFDY

SEQ ID NO: 21571 - protein, 10 aa, Homo sapiens
  Light chain CDR3 for antibody 10786 (IGKV1-17)
LQHNSYPMYT

SEQ ID NO: 21572 - protein, 15 aa, Homo sapiens
  Heavy chain CDR3 for antibody 10786 (IGHV3-30)
ARRGYGSGSPDAFDL

SEQ ID NO: 21573 - protein, 9 aa, Homo sapiens
  Light chain CDR3 for antibody 10787 (IGKV1-5)
QQYNTYSRT

SEQ ID NO: 21574 - protein, 15 aa, Homo sapiens
  Heavy chain CDR3 for antibody 10787 (IGHV3-20)
ARDRGSSGWRDWFDP

SEQ ID NO: 21575 - protein, 9 aa, Homo sapiens
  Light chain CDR3 for antibody 10788 (IGKV3D-20)
PQYGSSPWT

SEQ ID NO: 21576 - protein, 14 aa, Homo sapiens
  Heavy chain CDR3 for antibody 10788 (IGHV3-33)
AKSYDILTGEAFDI

SEQ ID NO: 21577 - protein, 9 aa, Homo sapiens
  Light chain CDR3 for antibody 10789 (IGKV3-11)
QQRSNWMYT

SEQ ID NO: 21578 - protein, 13 aa, Homo sapiens
  Heavy chain CDR3 for antibody 10789 (IGHV4-39)
ARRDVLAPAAFDY

SEQ ID NO: 21579 - protein, 9 aa, Homo sapiens
  Light chain CDR3 for antibody 10790 (IGKV5-2)
LQHDNFPYT

SEQ ID NO: 21580 - protein, 16 aa, Homo sapiens
  Heavy chain CDR3 for antibody 10790 (IGHV3-23)
ARDLGIAAAGTGWFDP

SEQ ID NO: 21581 - protein, 9 aa, Homo sapiens
  Light chain CDR3 for antibody 10791 (IGKV3D-7)
QQDYKLPLT

SEQ ID NO: 21582 - protein, 14 aa, Homo sapiens
  Heavy chain CDR3 for antibody 10791 (IGHV3-33)
ARDAMGTSTAWFDP

SEQ ID NO: 21583 - protein, 9 aa, Homo sapiens
  Light chain CDR3 for antibody 10792 (IGKV1-9)
QQLISYPLT

SEQ ID NO: 21584 - protein, 18 aa, Homo sapiens
  Heavy chain CDR3 for antibody 10792 (IGHV3-33)
ARRSAAGTGDYYYYGMDV

SEQ ID NO: 21585 - protein, 8 aa, Homo sapiens
  Light chain CDR3 for antibody 10793 (IGKV3D-7)
QQDYSLLT

SEQ ID NO: 21586 - protein, 13 aa, Homo sapiens
  Heavy chain CDR3 for antibody 10793 (IGHV3-33)
ARVHFDWLDAFDI

SEQ ID NO: 21587 - protein, 9 aa, Homo sapiens
  Light chain CDR3 for antibody 10794 (IGKV1-9)
QQLNGYPFT

SEQ ID NO: 21588 - protein, 17 aa, Homo sapiens
  Heavy chain CDR3 for antibody 10794 (IGHV3-23)
AKDGSFYSSGWYDAFDI

SEQ ID NO: 21589 - protein, 8 aa, Homo sapiens
  Light chain CDR3 for antibody 10795 (IGKV6-21)
HQSSSLYT

SEQ ID NO: 21590 - protein, 14 aa, Homo sapiens
  Heavy chain CDR3 for antibody 10795 (IGHV3-33)
ARDRGRHNYFGMDV

SEQ ID NO: 21591 - protein, 9 aa, Homo sapiens
  Light chain CDR3 for antibody 10796 (IGKV3D-7)
QQDYEFPIT

SEQ ID NO: 21592 - protein, 14 aa, Homo sapiens
  Heavy chain CDR3 for antibody 10796 (IGHV3-23)
AKDRYRGYEGLFDY

SEQ ID NO: 21593 - protein, 9 aa, Homo sapiens
  Light chain CDR3 for antibody 10797 (IGKV1-6)
LQVYSYPWT

SEQ ID NO: 21594 - protein, 17 aa, Homo sapiens
  Heavy chain CDR3 for antibody 10797 (IGHV3-33)
ARGLSGYDGYYYYGMDV

SEQ ID NO: 21595 - protein, 9 aa, Homo sapiens
  Light chain CDR3 for antibody 10798 (IGKV1-9)
QQLNTYPLT

SEQ ID NO: 21596 - protein, 16 aa, Homo sapiens
  Heavy chain CDR3 for antibody 10798 (IGHV3-33)
AREGITMVRGVIRFDY

SEQ ID NO: 21597 - protein, 8 aa, Homo sapiens
  Light chain CDR3 for antibody 10799 (IGKV3-20)
QQYGSSLT

SEQ ID NO: 21598 - protein, 12 aa, Homo sapiens
  Heavy chain CDR3 for antibody 10799 (IGHV3-h)
AREDYYYYGMDV

SEQ ID NO: 21599 - protein, 9 aa, Homo sapiens
  Light chain CDR3 for antibody 10800 (IGKV1-6)
LQDYKSPFT

SEQ ID NO: 21600 - protein, 15 aa, Homo sapiens
  Heavy chain CDR3 for antibody 10800 (IGHV3-30)
ARRGYGSGSPDAFDL

SEQ ID NO: 21601 - protein, 9 aa, Homo sapiens
  Light chain CDR3 for antibody 10801 (IGKV1-27)
QKYNSAPYT

SEQ ID NO: 21602 - protein, 11 aa, Homo sapiens
  Heavy chain CDR3 for antibody 10801 (IGHV3-23)
AKDRPYYGSEV

SEQ ID NO: 21603 - protein, 9 aa, Homo sapiens
  Light chain CDR3 for antibody 10802 (IGKV2-24)
MQATQFPHT

SEQ ID NO: 21604 - protein, 14 aa, Homo sapiens
  Heavy chain CDR3 for antibody 10802 (IGHV3-33)
ARDWNDVYYYGMDV

SEQ ID NO: 21605 - protein, 9 aa, Homo sapiens
  Light chain CDR3 for antibody 10803 (IGKV1-9)
QQYNSYPIT

SEQ ID NO: 21606 - protein, 12 aa, Homo sapiens
  Heavy chain CDR3 for antibody 10803 (IGHV3-33)
ARDIVGTSYFDY

SEQ ID NO: 21607 - protein, 8 aa, Homo sapiens
  Light chain CDR3 for antibody 10804 (IGKV3D-7)
QQDYHLLT

SEQ ID NO: 21608 - protein, 12 aa, Homo sapiens
  Heavy chain CDR3 for antibody 10804 (IGHV3-13)
ARDRGYSGYFEY

SEQ ID NO: 21609 - protein, 8 aa, Homo sapiens
  Light chain CDR3 for antibody 10805 (IGKV3D-7)
QQDYNLLT

SEQ ID NO: 21610 - protein, 16 aa, Homo sapiens
  Heavy chain CDR3 for antibody 10805 (IGHV3-33)
ARGANYYGSGIPNFEY

SEQ ID NO: 21611 - protein, 9 aa, Homo sapiens
  Light chain CDR3 for antibody 10806 (IGKV1-27)
QKYNSAPYT

SEQ ID NO: 21612 - protein, 15 aa, Homo sapiens
  Heavy chain CDR3 for antibody 10806 (IGHV3-23)
AKEALRYVDWSGMDV

SEQ ID NO: 21613 - protein, 8 aa, Homo sapiens
  Light chain CDR3 for antibody 10807 (IGKV3-15)
QQYNNWPT

SEQ ID NO: 21614 - protein, 18 aa, Homo sapiens
  Heavy chain CDR3 for antibody 10807 (IGHV3-23)
AKDGDYFGSGSYWGYFDL

SEQ ID NO: 21615 - protein, 8 aa, Homo sapiens
  Light chain CDR3 for antibody 10808 (IGKV3D-7)
QQDYNLLT

SEQ ID NO: 21616 - protein, 9 aa, Homo sapiens
  Heavy chain CDR3 for antibody 10808 (IGHV4-59)
ARGGASFDY

SEQ ID NO: 21617 - protein, 9 aa, Homo sapiens
  Light chain CDR3 for antibody 10809 (IGKV1D-16)
QQSYSTPLT

SEQ ID NO: 21618 - protein, 17 aa, Homo sapiens
  Heavy chain CDR3 for antibody 10809 (IGHV3-66)
AREDYDILTGYPCYFDY

SEQ ID NO: 21619 - protein, 9 aa, Homo sapiens
  Light chain CDR3 for antibody 10810 (IGKV3-15)
QQYHNWPLT

SEQ ID NO: 21620 - protein, 15 aa, Homo sapiens
  Heavy chain CDR3 for antibody 10810 (IGHV3-33)
ARRICSGGSCSLFDY

SEQ ID NO: 21621 - protein, 10 aa, Homo sapiens
  Light chain CDR3 for antibody 10811 (IGKV3-15)
QQYNNWPPIT

SEQ ID NO: 21622 - protein, 12 aa, Homo sapiens
  Heavy chain CDR3 for antibody 10811 (IGHV4-59)
ARDRSGWAYFDY

SEQ ID NO: 21623 - protein, 9 aa, Homo sapiens
  Light chain CDR3 for antibody 10812 (IGKV1-33)
QQYDNLPFT

SEQ ID NO: 21624 - protein, 15 aa, Homo sapiens
  Heavy chain CDR3 for antibody 10812 (IGHV3-23)
ARDSRPEITGPPFDY

SEQ ID NO: 21625 - protein, 9 aa, Homo sapiens
  Light chain CDR3 for antibody 10813 (IGKV6-21)
HQSSSLPYT

SEQ ID NO: 21626 - protein, 14 aa, Homo sapiens
  Heavy chain CDR3 for antibody 10813 (IGHV3-20)
ARDRGSSGHDGFDI

SEQ ID NO: 21627 - protein, 9 aa, Homo sapiens
  Light chain CDR3 for antibody 10814 (IGKV5-2)
LQHDKFPYT

SEQ ID NO: 21628 - protein, 17 aa, Homo sapiens
  Heavy chain CDR3 for antibody 10814 (IGHV3-33)
ARDCGSYYDYYFYGMDV

SEQ ID NO: 21629 - protein, 9 aa, Homo sapiens
  Light chain CDR3 for antibody 10815 (IGKV3-20)
QQYGSSPYT

SEQ ID NO: 21630 - protein, 15 aa, Homo sapiens
  Heavy chain CDR3 for antibody 10815 (IGHV3-23)
ARDRGSSGWRGRFDP

SEQ ID NO: 21631 - protein, 9 aa, Homo sapiens
  Light chain CDR3 for antibody 10816 (IGKV3D-7)
QQDYNLPLT

SEQ ID NO: 21632 - protein, 14 aa, Homo sapiens
  Heavy chain CDR3 for antibody 10816 (IGHV3-33)
ARDRDIMATSYFDY

SEQ ID NO: 21633 - protein, 9 aa, Homo sapiens
  Light chain CDR3 for antibody 10817 (IGKV1-9)
QQLISYPLT

SEQ ID NO: 21634 - protein, 17 aa, Homo sapiens
  Heavy chain CDR3 for antibody 10817 (IGHV3-33)
ARSGIVGATDYYYGLDV

SEQ ID NO: 21635 - protein, 9 aa, Homo sapiens
  Light chain CDR3 for antibody 10818 (IGKV1-33)
QQYDNLPFT

SEQ ID NO: 21636 - protein, 12 aa, Homo sapiens
  Heavy chain CDR3 for antibody 10818 (IGHV3-23)
AKEYDILTGYGH

SEQ ID NO: 21637 - protein, 9 aa, Homo sapiens
  Light chain CDR3 for antibody 10819 (IGKV1-9)
QQYNTYSRT

SEQ ID NO: 21638 - protein, 14 aa, Homo sapiens
  Heavy chain CDR3 for antibody 10819 (IGHV3-33)
ARGGYSGYRYYFDY

SEQ ID NO: 21639 - protein, 10 aa, Homo sapiens
  Light chain CDR3 for antibody 10820 (IGKV3-20)
QQYGRSPPVT

SEQ ID NO: 21640 - protein, 18 aa, Homo sapiens
  Heavy chain CDR3 for antibody 10820 (IGHV3-23)
AKEGNYYGSGSYWGYFDP

SEQ ID NO: 21641 - protein, 9 aa, Homo sapiens
  Light chain CDR3 for antibody 10821 (IGKV4-1)
QQYYSTPPT

SEQ ID NO: 21642 - protein, 15 aa, Homo sapiens
  Heavy chain CDR3 for antibody 10821 (IGHV3-23)
AKDGGWNYYYYGMDV

SEQ ID NO: 21643 - protein, 9 aa, Homo sapiens
  Light chain CDR3 for antibody 10822 (IGKV1D-13)
QQFNNYPHT

SEQ ID NO: 21644 - protein, 23 aa, Homo sapiens
  Heavy chain CDR3 for antibody 10822 (IGHV3-h)
ARDRGITMVRGVITYYYFYGMDV

SEQ ID NO: 21645 - protein, 9 aa, Homo sapiens
  Light chain CDR3 for antibody 10823 (IGKV1-39)
QQSYRTPLT

SEQ ID NO: 21646 - protein, 12 aa, Homo sapiens
  Heavy chain CDR3 for antibody 10823 (IGHV3-11)
ARHGSGSSYCDY

SEQ ID NO: 21647 - protein, 9 aa, Homo sapiens
  Light chain CDR3 for antibody 10824 (IGKV1-6)
LQDYKSPFT

SEQ ID NO: 21648 - protein, 17 aa, Homo sapiens
  Heavy chain CDR3 for antibody 10824 (IGHV4-34)
AGLRFFDWLFDYYGMDV

SEQ ID NO: 21649 - protein, 9 aa, Homo sapiens
  Light chain CDR3 for antibody 10825 (IGKV1-17)
LHSYNYPWT

SEQ ID NO: 21650 - protein, 16 aa, Homo sapiens
  Heavy chain CDR3 for antibody 10825 (IGHV3-33)
ARDKNTDYDILTGFDY

SEQ ID NO: 21651 - protein, 9 aa, Homo sapiens
  Light chain CDR3 for antibody 10826 (IGKV3D-7)
QQDYNLPYS

SEQ ID NO: 21652 - protein, 17 aa, Homo sapiens
  Heavy chain CDR3 for antibody 10826 (IGHV1-18)
ARDRACTMVRGVPPFDY

SEQ ID NO: 21653 - protein, 9 aa, Homo sapiens
  Light chain CDR3 for antibody 10827 (IGKV1-9)
QQYNTYSRT

SEQ ID NO: 21654 - protein, 11 aa, Homo sapiens
  Heavy chain CDR3 for antibody 10827 (IGHV3-33)
ARDRVLSPFDY

SEQ ID NO: 21655 - protein, 9 aa, Homo sapiens
  Light chain CDR3 for antibody 10828 (IGKV1-9)
QQLNTYPWT

SEQ ID NO: 21656 - protein, 12 aa, Homo sapiens
  Heavy chain CDR3 for antibody 10828 (IGHV3-33)
VRKWFGELYFDY

SEQ ID NO: 21657 - protein, 8 aa, Homo sapiens
  Light chain CDR3 for antibody 10829 (IGKV1-13)
QQFNTYPT

SEQ ID NO: 21658 - protein, 16 aa, Homo sapiens
  Heavy chain CDR3 for antibody 10829 (IGHV3-33)
ARGDDILTHQYYGVDV

SEQ ID NO: 21659 - protein, 8 aa, Homo sapiens
  Light chain CDR3 for antibody 10830 (IGKV3-20)
QQYGSSLT

SEQ ID NO: 21660 - protein, 18 aa, Homo sapiens
  Heavy chain CDR3 for antibody 10830 (IGHV3-33)
ARDRYYDILTGYYMGFDY

SEQ ID NO: 21661 - protein, 9 aa, Homo sapiens
  Light chain CDR3 for antibody 10831 (IGKV3-20)
QQYGSSPYT

SEQ ID NO: 21662 - protein, 12 aa, Homo sapiens
  Heavy chain CDR3 for antibody 10831 (IGHV1-46)
ARALTVGASFDY

SEQ ID NO: 21663 - protein, 9 aa, Homo sapiens
  Light chain CDR3 for antibody 10832 (IGKV3-11)
QQRINWPWT

SEQ ID NO: 21664 - protein, 11 aa, Homo sapiens
  Heavy chain CDR3 for antibody 10832 (IGHV3-33)
ARDRVLTPFDY

SEQ ID NO: 21665 - protein, 9 aa, Homo sapiens
  Light chain CDR3 for antibody 10833 (IGKV1-9)
QQLKSYLYT

SEQ ID NO: 21666 - protein, 12 aa, Homo sapiens
  Heavy chain CDR3 for antibody 10833 (IGHV1-18)
ARRDGSGTSFDY

SEQ ID NO: 21667 - protein, 9 aa, Homo sapiens
  Light chain CDR3 for antibody 10834 (IGKV1-6)
LQDYKSPFT

SEQ ID NO: 21668 - protein, 13 aa, Homo sapiens
  Heavy chain CDR3 for antibody 10834 (IGHV3-13)
ARAITMVRGVIDY

SEQ ID NO: 21669 - protein, 9 aa, Homo sapiens
  Light chain CDR3 for antibody 10835 (IGKV1-9)
QQLISYPLT

SEQ ID NO: 21670 - protein, 7 aa, Homo sapiens
  Heavy chain CDR3 for antibody 10835 (IGHV3-33)
ARELFNY

SEQ ID NO: 21671 - protein, 9 aa, Homo sapiens
  Light chain CDR3 for antibody 10836 (IGKV1-9)
QQLNGYPFT

SEQ ID NO: 21672 - protein, 15 aa, Homo sapiens
  Heavy chain CDR3 for antibody 10836 (IGHV3-33)
ARRVCSGGSCSLFDY

SEQ ID NO: 21673 - protein, 9 aa, Homo sapiens
  Light chain CDR3 for antibody 10837 (IGKV1D-16)
QQYNSYPYT

SEQ ID NO: 21674 - protein, 15 aa, Homo sapiens
  Heavy chain CDR3 for antibody 10837 (IGHV3-33)
ARGGTGYYAYWYFDL

SEQ ID NO: 21675 - protein, 9 aa, Homo sapiens
  Light chain CDR3 for antibody 10838 (IGKV3-15)
QQYNNWPLT

SEQ ID NO: 21676 - protein, 13 aa, Homo sapiens
  Heavy chain CDR3 for antibody 10838 (IGHV3-33)
ARAITMVRGVIDY

SEQ ID NO: 21677 - protein, 9 aa, Homo sapiens
  Light chain CDR3 for antibody 10839 (IGKV3D-7)
HQSSSLPYT

SEQ ID NO: 21678 - protein, 19 aa, Homo sapiens
  Heavy chain CDR3 for antibody 10839 (IGHV4-39)
ARQGDALRYFDWLLGAFDI

SEQ ID NO: 21679 - protein, 9 aa, Homo sapiens
  Light chain CDR3 for antibody 10840 (IGKV1D-16)
QQYDSYPWT

SEQ ID NO: 21680 - protein, 13 aa, Homo sapiens
  Heavy chain CDR3 for antibody 10840 (IGHV4-39)
ARHVLLWFGEFDP

SEQ ID NO: 21681 - protein, 9 aa, Homo sapiens
  Light chain CDR3 for antibody 10841 (IGKV1D-13)
QQFNNYPYT

SEQ ID NO: 21682 - protein, 16 aa, Homo sapiens
  Heavy chain CDR3 for antibody 10841 (IGHV3-11)
ARDSELRYFDWFGMDV

SEQ ID NO: 21683 - protein, 9 aa, Homo sapiens
  Light chain CDR3 for antibody 10842 (IGKV1-17)
QQDYTLPLT

SEQ ID NO: 21684 - protein, 15 aa, Homo sapiens
  Heavy chain CDR3 for antibody 10842 (IGHV3-30)
ARRGYGSGSPDAFDL

SEQ ID NO: 21685 - protein, 9 aa, Homo sapiens
  Light chain CDR3 for antibody 10843 (IGKV1-6)
LQDFNYPRT

SEQ ID NO: 21686 - protein, 9 aa, Homo sapiens
  Heavy chain CDR3 for antibody 10843 (IGHV4-39)
AGGIWDVDY

SEQ ID NO: 21687 - protein, 9 aa, Homo sapiens
  Light chain CDR3 for antibody 10844 (IGKV1-17)
LQHNSYPYT

SEQ ID NO: 21688 - protein, 20 aa, Homo sapiens
  Heavy chain CDR3 for antibody 10844 (IGHV3-33)
AIVGATMIRGLIDYYYGMDV

SEQ ID NO: 21689 - protein, 9 aa, Homo sapiens
  Light chain CDR3 for antibody 10845 (IGKV1-17)
LQHTSYPLT

SEQ ID NO: 21690 - protein, 17 aa, Homo sapiens
  Heavy chain CDR3 for antibody 10845 (IGHV4-39)
AGRLTYYYGSGSPSFDY

SEQ ID NO: 21691 - protein, 9 aa, Homo sapiens
  Light chain CDR3 for antibody 10846 (IGKV3-11)
QQRSNWMYT

SEQ ID NO: 21692 - protein, 16 aa, Homo sapiens
  Heavy chain CDR3 for antibody 10846 (IGHV3-23)
ARNWNDVGDYYYGMDV

SEQ ID NO: 21693 - protein, 9 aa, Homo sapiens
  Light chain CDR3 for antibody 10847 (IGKV1-27)
QKYNSAPYT

SEQ ID NO: 21694 - protein, 12 aa, Homo sapiens
  Heavy chain CDR3 for antibody 10847 (IGHV3-66)
VRDRAAAPYFDL

SEQ ID NO: 21695 - protein, 8 aa, Homo sapiens
  Light chain CDR3 for antibody 10848 (IGKV3-11)
QQRSNWLT

SEQ ID NO: 21696 - protein, 16 aa, Homo sapiens
  Heavy chain CDR3 for antibody 10848 (IGHV4-59)
ARDTPYYSGSGRPFDS

SEQ ID NO: 21697 - protein, 9 aa, Homo sapiens
  Light chain CDR3 for antibody 10849 (IGKV1-27)
QKYNSAPHT

SEQ ID NO: 21698 - protein, 11 aa, Homo sapiens
  Heavy chain CDR3 for antibody 10849 (IGHV3-33)
AREAIIGPFDY

SEQ ID NO: 21699 - protein, 9 aa, Homo sapiens
  Light chain CDR3 for antibody 10850 (IGKV2D-24)
TQATQFPHT

SEQ ID NO: 21700 - protein, 14 aa, Homo sapiens
  Heavy chain CDR3 for antibody 10850 (IGHV3-33)
ARGAAAGNFYGLDV

SEQ ID NO: 21701 - protein, 9 aa, Homo sapiens
  Light chain CDR3 for antibody 10851 (IGKV1-5)
QQYDSYPWT

SEQ ID NO: 21702 - protein, 17 aa, Homo sapiens
  Heavy chain CDR3 for antibody 10851 (IGHV3-23)
AKDGIGELSYYYYGMDV

SEQ ID NO: 21703 - protein, 8 aa, Homo sapiens
  Light chain CDR3 for antibody 10852 (IGKV1D-13)
QQFNNYYT

SEQ ID NO: 21704 - protein, 17 aa, Homo sapiens
  Heavy chain CDR3 for antibody 10852 (IGHV4-59)
ARDFLVRGEGSYYGMDV

SEQ ID NO: 21705 - protein, 10 aa, Homo sapiens
  Light chain CDR3 for antibody 10853 (IGKV1-6)
QQSYSTPMYT

SEQ ID NO: 21706 - protein, 14 aa, Homo sapiens
  Heavy chain CDR3 for antibody 10853 (IGHV3-15)
SIYFYGSGRDYFDY

SEQ ID NO: 21707 - protein, 9 aa, Homo sapiens
  Light chain CDR3 for antibody 10854 (IGKV3-20)
QQYGSSPYT

SEQ ID NO: 21708 - protein, 16 aa, Homo sapiens
  Heavy chain CDR3 for antibody 10854 (IGHV3-33)
ARPTYYDILTGYPFDY

SEQ ID NO: 21709 - protein, 9 aa, Homo sapiens
  Light chain CDR3 for antibody 10855 (IGKV3-15)
QQYNNWPRT

SEQ ID NO: 21710 - protein, 15 aa, Homo sapiens
  Heavy chain CDR3 for antibody 10855 (IGHV1-46)
ARGAVDDYYYYGMDV

SEQ ID NO: 21711 - protein, 9 aa, Homo sapiens
  Light chain CDR3 for antibody 10856 (IGKV1-6)
LQGYNHPFT

SEQ ID NO: 21712 - protein, 14 aa, Homo sapiens
  Heavy chain CDR3 for antibody 10856 (IGHV3-20)
ARDGGSTSYDWFDP

SEQ ID NO: 21713 - protein, 9 aa, Homo sapiens
  Light chain CDR3 for antibody 10857 (IGKV5-2)
QQYYSTPWT

SEQ ID NO: 21714 - protein, 18 aa, Homo sapiens
  Heavy chain CDR3 for antibody 10857 (IGHV3-33)
ARDRYYDILTGYYMGFDY

SEQ ID NO: 21715 - protein, 9 aa, Homo sapiens
  Light chain CDR3 for antibody 10858 (IGKV1-9)
QQLNSYPWT

SEQ ID NO: 21716 - protein, 15 aa, Homo sapiens
  Heavy chain CDR3 for antibody 10858 (IGHV3-23)
AKDGSYSYYYYGMDV

SEQ ID NO: 21717 - protein, 9 aa, Homo sapiens
  Light chain CDR3 for antibody 10859 (IGKV1-6)
LQVYSYPWT

SEQ ID NO: 21718 - protein, 17 aa, Homo sapiens
  Heavy chain CDR3 for antibody 10859 (IGHV1-18)
ARERYYGSGSYKYNMDV

SEQ ID NO: 21719 - protein, 10 aa, Homo sapiens
  Light chain CDR3 for antibody 10860 (IGKV1-9)
QQLNSFLMYT

SEQ ID NO: 21720 - protein, 17 aa, Homo sapiens
  Heavy chain CDR3 for antibody 10860 (IGHV1-18)
ARDEDYDILTGYPHFDY

SEQ ID NO: 21721 - protein, 9 aa, Homo sapiens
  Light chain CDR3 for antibody 10861 (IGKV1-9)
QQFNSYTRT

SEQ ID NO: 21722 - protein, 14 aa, Homo sapiens
  Heavy chain CDR3 for antibody 10861 (IGHV3-33)
ARRGSPLRPSHLDV

SEQ ID NO: 21723 - protein, 9 aa, Homo sapiens
  Light chain CDR3 for antibody 10862 (IGKV1-9)
QQLNSYPWT

SEQ ID NO: 21724 - protein, 21 aa, Homo sapiens
  Heavy chain CDR3 for antibody 10862 (IGHV3-23)
AKDIDYYGSGSYPLYYYGMDV

SEQ ID NO: 21725 - protein, 9 aa, Homo sapiens
  Light chain CDR3 for antibody 10863 (IGKV6-21)
HQSSSLPYT

SEQ ID NO: 21726 - protein, 12 aa, Homo sapiens
  Heavy chain CDR3 for antibody 10863 (IGHV3-21)
ARDGGRYGDFDY

SEQ ID NO: 21727 - protein, 8 aa, Homo sapiens
  Light chain CDR3 for antibody 10864 (IGKV3-20)
QQYGSSLT

SEQ ID NO: 21728 - protein, 17 aa, Homo sapiens
  Heavy chain CDR3 for antibody 10864 (IGHV3-33)
ARDPARGNVRSFYGLDV

(The sequence listing continues in the following parts.)

The invention claimed is:

1. A method of treating a subject in need thereof, the method comprising administering to the subject an effective amount of a pharmaceutical composition comprising:

a mixture of at least 100 unique recombinant antibodies wherein the mixture is capable of neutralizing Zika virus with an IC50 lower than 0.001 mg/ml using an in vitro neutralization assay, and a pharmaceutically acceptable excipient, wherein the mixture of at least 100 unique recombinant antibodies has been generated by the process of
  a. isolating single cells from a blood sample from a donor exposed to an antigen of Zika virus;
  b. amplifying polynucleotides, wherein each of the polynucleotides encodes a cognate pair of heavy chain and light chain variable regions from one of the single cells by overlap extension reverse transcriptase polymerase chain reaction (OE-RT-PCR);
  c. cloning the polynucleotides obtained from the amplification into an expression vector, thereby obtaining constructs encoding antibody fragments;
  d. expressing the antibody fragments from the constructs;
  e. generating antibody expression constructs using the subset of the constructs, wherein each of the antibody expression constructs encodes a light chain variable region, a kappa or lambda-type light chain constant region, a heavy chain variable region, and a heavy chain constant region,
  f. introducing the antibody expression constructs into a cell line, and
  g. expressing antibodies from the antibody expression constructs in the cell line, thereby obtaining the at least 100 unique recombinant antibodies;

wherein each of the at least 100 unique recombinant antibodies is an antibody comprising a cognate pair of heavy chain and light chain variable regions from a single cell out of a blood sample from a donor exposed to an antigen of Zika virus.

2. The method of claim 1, wherein the subject has a viral infection.

3. The method of claim 1, further comprising administration of one or more additional therapeutic agents.

4. The method of claim 1, wherein the subject has Zika viral infection.

5. The method of claim 1, wherein the effective amount is 0.01, 0.05, 0.15, 0.20, 0.25, or 0.30 g/kg body weight.

6. The method of claim 1, wherein the pharmaceutical composition is administered by intravenous infusion.

* * * * *